United States Patent 7,365,185 (GENOMIC PLANT SEQUENCES AND USES THEREOF) - sequence listing, part 13

SEQ ID NO: 28790 - DNA, 1501 bp, Oryza sativa
ccacgttgagccgtggctggccgtggctgcacgcgggctccaccttctgcttcgacacggagagcttggagtggaccgactacggctgctggatgctgccgttccagggtcagggacactacgacgccgagctggacgcctgggttggcatctgccgccacccggacaagcccggccgcctctgctcgtccgacgtcccggccccgcgcatcagaggccgggacagcaggtggcgggtcccgtcgtgcaagatcggcaaggacgtcctcttctgcaaggacaaggagcggcaccgaggggtcgctctccactacatgggcagcgacagcaacttctgtctgctcgagtgcgtggagcagccggcggcgacggcgagtcggctcatgtacgtgcggatgttccgcctcaagtacggcaaagacggagggcttcggacggccacgctcggccgctggggccgctgcttccttctgcctcccgaggcttccagcttcgacgtgatggatcaaaagatcacggcgttcttgatgtgtataacttaattaattgtactactccagttgctattttctactccctccgttctatcaagattcgttgtactaattatatcccatccataatttaatctaaattttaggttgaccttttttttagaattaagggagtatataagattttatttgcacgtaattcgtatgagtgatcgattgctaaagagaacacgagtcgatattagttaggaatgacaaattgacaagtgattagtgtgcggtaggggtagatcggctcttatgcaggtcagcacggaatctagcattatttttacaccgtccaaaaaataataatattaactacatatataaacatattaatatgattggatgcaagggttggcactcaatatcgtgcacaacagataaatatggtacataatatggtacatgtctactggtatgactaggctgattcgacgagagagacgaacacggatatatatatataattcttgacaatgagctacttcctccgtcctataatatagcaacttaataccagataggacatttcatattacaatgaatctagacactcttctgtctagattcgatatactataaaatatccaatccaaatactaggttgctatattatgggacagagggagtactcaataacaatcctccgtgatgtgcagttactgctatcagtcggtatacctaaaaaagtatactacatcggtcccaaaatgtagtgtaactaagcatacatgtgatacagaaccagaatggacagtggtagtagaaagtttgaataggaacgtcagtacagctaaaaaaatatagtatcaaccatttatacagagtgttttcagcctcgcatcacactcttaaacacatgaaatcaatttttctaccacaagttatgagctaaagattgcatgatcagttaacaaaaacatggatgcaataacagaagtcttatagttatactactatat

SEQ ID NO: 28791 - DNA, 1501 bp, Oryza sativa
tcaagcagcttggctgaaaaaaacattcaggttatcaaatcatcaaaagttgtttctgaaagcacataaggaatatttatactaggaacaaccctcctagataggtatgaaaagtcttgaaagaaggacatagactagcccaaaggcctcaacaagtgaatttccgagaagactcgcgcgtctgtttggcttatgagtagccttcagtaaaaaaaggtcgttactccttattggaaagtccaaatgacatggggtcagttgcgttggaaagctaacttaataagctttcacaccatgtgcataatgcactacgaaatattatagattgatacagttttgcatggaaagttaaatgtcatggcagactattggccttcggagcagtgtccactaatctggccataactctttagtgggaaatccaatggacgagcggtttgttgggtgtgaaactagactcaataagctttccaaaaaaaaatgctcattcaccttcatagcttttgagaatcaaaagttatgacgatttcttaaactggtctgttttgaagttgaactggtccgtttttcactgtagcggtttgatcttcatggtccgattcagcttcctcttgttgcataatcctaagcgcaaccaaagtagaacatttaggtagtataacattctcatctatagatgcatcaaatgtagcaaggagtgagttcacctgttgttgtagtttctgcgcacgactttgcgtaatcagtccttccattacttgatcatgtgtagcagtagttgaacttggtatagtcatgattgggatgtcctcatcagaaaactggcgactagcaagagacagcgacgcaggtgccgccggagtcagatgatgcacctagctagctagctgctgctggagaatggagatgatcgaaggaaatgaattgagaggatgaataaaagagaggatgagagatggaacagctcaccgctctagctagctgcgcctgcgaccgcctcgtggcttcttactcatgcctctttctcaatatcacgcctataaaataaaattatttatgaaagcacccctaggtaagtattcataatttttgttccaaaaaaccttgacattttgaaatttcaagacatcatattcatagctcaactgacagtatgcataacatgcggaaggacacacctcctctacagtacttccaatgtaatagcagtggctgatacgggagtctgattccatatattagtgtctgcggacaatctcattgatacagtaggagtatacagctatatacaggttttagttctattcatttcatataattatgagctaaatatacgtgctttactgaacatagaataaaatttactataatattacataaaattcaaattcatcttaatttaattttatatgtcactgttttatttggatttgattgaattttaatatttaaaatgggtaatttataaattttactatgagagtaagtggagtaagtggaa

SEQ ID NO: 28792 - DNA, 1501 bp, Oryza sativa
tcgcataccagtaactataatagtaatgacattatggtagacgatcctcacccggattttgtttgggcgagaaattggattaaaccagagattttgttatacatttgtcgataaattttcttctaaaattttgacagatgtaaatataatacaatcgtaatgtaattaattacattgtaactggtaagtaactataatataactcgtatgcaacttcgtaaagttttaaacattagatttgctttagaatttgtgcaagcgaggaagaaaagaatcacagttggcgcctatgtgagaagattaggtcccatgacctccgtttcacactaatagcatgttacctagagaattttgaaagttatatacaaattagattatagttacatgcaagttacaatgtaattacattatgattatactatatttacatatatcaaatttcttcgtttaaatttgacgacaaatagagtaaaatgtattcaaggtgagtcaacttggcaggtgagtgcaaattggtgcaacaacttgagaaataaacgtcatagtgcaacaacttggcagatgggtgcaatttagcgtaagaactttataattgaatgtataagtcataacaactttcaaggtgggtccagttttgatacaataagtagaagtgacgcgacaaataattattttgagatttttctatacaaattcaattttacgtacttatactaatgcaaatttgtgtaagcatatttaaatttttattctaataactgaaagtcaactaaattttactaagtataaaaatattatatttcggttgagatttgagaaggtgaagaaaacaaaatccaaaccgttggtgcaaattggttgtggaacttaattcttatggtcgagttcaagattataaggtaatatttgtaagattgctatatgagagcatattgattcagtgaaaaaaattatctaacactcatttaccagaacaacatatactttgctaagttgttgtaccaaaaaattaataaattgtatttgtattagaatacacccacttaccaagtaattacacttggacgttcaattatcaattttttatactatatcgtatctatctaccaagttgctagatcatgtgtaataatttactacgatgaaccttgttggcttgtactccctctgtcttaaaaaaatgaatctagtactggatatgacatattctagtacaacgaatttaagattataggtatgtctagatttgtagtgttaggatgcaggttagttttttatgggacggaggaagtatggtttaatatatttgggccgatttcaacccatcagatttgggctaatctttcaaaagagaacttatgggctctctcccttcagtttatgggccttccacagtaaaaagccttgtgctcttttccacttcgtcttcctcctgcgaacagtccaacccctccgcctccgcctctgcagtccgccgccggcggccggcggatggccgcct

SEQ ID NO: 28793 - DNA, 1501 bp, Oryza sativa
tcggcgacttggccggcgtccgcgccggtgcctccgacgatggcgatggcgatgcgtacgacccaggctcattgtgcggccgccatggtgacggagagctgcggcccggcagcgccggtgtccccggcgacgtgcgcggatgtcgcgccgccgttgcgaacccaggctcatcttgtggtggccgggcggccgggaaggtgcggcccggcggcgccggttcggccgggtaggtgacgccgtcgtcctcgtctctgatcgtgctggtgcgctcgatactcttatgggtgtctaagatcttcgccggctttaatcctggtggtcctaaccgcggctcctgcggttcttccggcacggcggcgggcggtgctgggtggccagcaggcgccgaccatggcgtccggccatggctaccctcctccgcccttctcagccgcgcaggcaggtaggacggcttcttccctggcctcctcgccagggcggcttcctccccggcgacggcgtcgccgtgaaccggcgattgcggcacttccgttacttgggtcacgaaacgagtgcgtcggtccggacgggcgctggtaccggcgccaccgtcgcccggcgccacggcgtgccgtacgccatggacgatctcttcttggcgacgctcctgcggcggcgcgtgcgtctgcggcgccggcccccgcgtcgtcggcgccgcagtgccggacgcacgggcacggctcctcggctcgctgccgcccgccggctgtttgcccatgtctcagcaagtcacacagctacacaagtgagagagagagagaggagaggatggagatggatcggaagtgtgagaggttcttggctttcttcttctagtgagcaattcagcgtccatgcacttgaaggagaagaggaagaagaagaagaagcaagaaatgggaattttggagggaaagggaggcaaggaaggtatcatttgatttgtgactgaggcaagcaacttagcagccatcatgtctggctgtctgaacatgcaatttcatagtattacactggagtacttaccactactagtagtagccaaggaatttttcatggcttggcaagagggcttcctttcttcgctgccacccagctccagctgagaccaaaacttgtactatgcatccagcagaaatggctgccatgatctgcacaaaagtggtttttgtcgagaggatatatagatgtttaatgattttatctcccattggttcattattactgggcaatctcgctgacgaattaagggtgcgtgttagtgacccatgttataagcagaggttaaaaatgaccttatcagccacactcaaaatgagaaatataattaacatataattaattgagtattaattattaaaaaaaatatattttatttttaaaatcattttttatgtaagaaaactttcatacaaaacatatcgtagcgatatgtaaaacgtgttaacaaaatttgagaaagtagccaagccaatcccgattt

SEQ ID NO: 28794 - DNA, 307 bp, Oryza sativa
gacgagattgatgatatggtatgacactgaccaacttaatcttgcattagtaggaacattttatttcatacattttgtagtcctattgtcaaaaaaatgtatattgattgctcataattacagaaaagcaacagagtagtgattgtcggtgatataggcctgggggtattgtgtctagagggaggaggccgcccccaaactcatgtggcactcccctgagggtggtcgggcccggggttgagcagcggctgccccctcccagttaggggtcaggccatcccgaccccctccacgcacccccccagca

SEQ ID NO: 28795 - DNA, 168 bp, Oryza sativa
tcctgcagcccgacaaatgattttttactggtagatgtctatctaccatatatgaatgcatgcaaacaaacagagatgtatggcatatcctctgctccaccagcaaaattccatgtcaaaattaaagatatgtgaggaagacaaaaaaaaatctggaggagcgaagaa

SEQ ID NO: 28796 - DNA, 1501 bp, Oryza sativa
atgcttacgtgttttgggtatgctgatgttgcccatgtgaaacaaaaatgttgagcagtcaggtttcataatgtcacatatattactccttgaactttttgagagttggcacagtcagactttaaaagtgttgccactgtttgtcctgaatgtagctgaagttgcagtgtttgcagaaagcgtgcatattgctggaagtgaatagttttagatgttgcatatgcatactactactcaaaatgttttatctgtatgtcaccatgtggttgccgctaggtttttctcaattttcacaaatgtttcagtgggtgaaatttttgcttcatgcctttaagacagaaattaacagtttaatgtctgatggcaactcatgtccaaaaaaatagtctgtgaacaatcatttccctacctaattgccatgctaaaaaaccacaatgtaaactcgactttttgaaacatacaactaacagtacaaacttgatacaacattcatcatatatattgttactaatttctcatcatgcaaatttgatgcaacagccatgttttggttattatcagttcgatcactaagatgtataggcccactattgtaattagtctaatctgcttcagttcaaggggagtttctcaaatatagttggagaagaagagcatataccttcccacgacggcggcgagggtcttaacatatgcggcgaccatatcttcctcggagggcttgggatcggtcgggaactccatgacgatgagccagtgctcgtagtcgcagccgtccaacaggatagtctccttgggcggccgattgctccagtttggggacgggtcgttcagcggcgagtacccagacccacccgacgacgcggtcttcgctccgcgtgacggcggcgcccacggggcgaggtaggctgaggaggcggcggcggcgagcggggcgaagcggcgttgcagagcgcgggaggagagaaggagcgcggagagactgcggcgggtggctgctgctgctccggccgccatggctggggattcgggatgtttcggggggcgctgcaggaatccgctgctacggacttgcgtggaagcggcgacggcgatggcgacgggcttcaccaatggcggcggcggcggcggcggcggtctgggtatggaactcgtagaagcagtggggtggccgaggccggatgggatggattagcgatgatgtggcgggagcaggagaacgccggcgccacctctgctagcaggatggagatcggcgccggcggcaggcgaggagacgggagtcgagggcggcgggcgaggaggagccggaggtctgccgcctcctatgggtcatatgcacaggcccatgaggctggaaatttttcatctcggaaaaagttcacctaacctcccttatcttgttgtcgagttttaactgttccgaacttgaagatataatgtatccctaatcttgcaaaaccgggtcacatttgatcccaaggtatgctctttggttttg

SEQ ID NO: 28797 - DNA, 1501 bp, Oryza sativa
aaaatcgccacaagcctaagttcaaacagtcttcttcaagcttaccccctccgtccaaaaaaaaacccaatcctagctacgaacctggacacgcaacacaatcctccaaggcatccagcaacaggtggatagaagagtggtggctaacggccgtgtcatggaccccccgcgcgaagagcagctgagcatggcaagagcatggaaaagcgaagtaggaagggctcccgacatgtcatcccctcaaggcataccatcatgtcgttgcacggcagctcgcgcgtatccgtatcgtggtcacatgtcagccacaccatcgggattggcgagagaatctccaagagacaggagatggagtacattgtgatgcctgagcacgatcgcaagcaccaccagctccatgagtgtccatgcgtgcacacaaagagtcgctaaatcatgggagaggtgtgcggtggccggcgaccgacagggagaagggtggcggtggtaggtagaatcccgacggcgatgactggcgatgggtgggagaaggcttgcagctgtcgagaagcttcatagtgataggatgtggggagaagggcgtaggtgtcgaagacgatgcgaccacagtgtggagtagatggagttgacctcgaagacgatgtggcgaagccacgcgtgctcctcagtggaggagaggcagagctcagggacacttgaacacatcagcttttgagcagctcggcgggggtggctctgagcttgggggataggagcttggccagcgtgacaagacggaagccctagccctcacgcgcgtaggtaaagatgatattgtcgttgcagttgggacctgggcgcaccacgtgcgcgctcccggtcgttgggagccgcatcagccggtggcctccgctatcgagcttttccctatcggcccacaccattctccccatccattggcggctgccttggaggtttgggttgagatgggaagagaggtaagtgaggtggaagaagattgctggctgacatgtgtggtccacgtgggccccacactgactcggccgccacgtcaacaaaaccaaagagcataccttgggatcaaatgtgacccggttttgcaagattagggatacattatatcttcaagttcggaacagttaaaactcgacaacaagataagggaggttaggtgaactttttccgagatgaaaaatttccagcctcatgggcctgtgcatatgacccataggaggcggcagacctccggctcctcctcgcccgccgccctcgactcccgtctcctcgcctgccgccggcgccgatctccatcctgctagcagaggtggcgccggcgttctcctgctcccgccacatcatcgctaatccatcccatccggcctcggccaccccactgcttctacgagttccatacccagaccgccgccgccgccgccgccgccattggtgaagcccgtcgccatcgccgtcgccgcttccacgcaagtccgtagcagcggat

SEQ ID NO: 28798 - DNA, 762 bp, Oryza sativa
ctgttccacgtgcacgtttttcaaacagctaaacggtgtgttttttgcaaaaaaaaaagttttatacaaaagttgcttaaaaaaatcatattgaccccttttgaaaaaaaaaagctaatacttcctctgtttcatattataagaatttctagcattgtccaaatttatatagatattaatgaatctatacacatataacatctatataaatgtaggcaatgctagaaagtcttataatatgaaacggagggaatacttaattaattacatgctaatggaccgctccattttctatgcgtggaagatcggttcccatcaagcccaagcgaactcagctttagagcagatacaatagcaggctattagccagctataaacatattataataagataaaacgatgagagaaaagagcagcgggctatagatctgtagccagctacagcacggactccaagacgcaatgtgtgtatgacaggtggaaccatatattaatagtatagtaagcaactattgtataaattgattattagattgactatcttattaaacttgctctagggcaaatactataatgtttgtttgatgtgttgcccctaaaaatacgtgctcccctggacagcccctgccctccccgcatgagtttgaaggatgtaaaaaaaggacacaggggtatttttgtcatttcggatgtcaagacatcggtggaatattgttaaatttctccaaattttcttccggtcggtctcgaaccttcgtctcc

SEQ ID NO: 28799 - DNA, 163 bp, Oryza sativa
tgttgccaatgcttccaggactgattgctgctagcaacaggggccaaattaattgacaaaaatgatgggaagcaaacctggataatatcagggagcatattgcggtcattgccagcaaaaattcatggttgaagccactgaatcggccctcttgctttgcagt

SEQ ID NO: 28800 - DNA, 1501 bp, Oryza sativa
ctgcatggattaatcctttgttaagcaaaccatgcaagcatatgcagattgtatatattatcagttcatcacaccgccgtatcatcatctatcacacctcagaaaagcttgcttgagttgtttcagagataaaaatctagttaaactatggtttccgcgagatacggtctttgcatgcatgcatgcatattggccgtccctctgcttaagatcgtgtcatttcgtgtgaaatttgtgatcatccacatgatcggattaggtagagacgactctgattacgtgcctgatatgagcaatggaccacggcccgatttggtctttggcgcccgatcgcccggcatgatcagaatggatcggctagagaaaatgcagcgtatcttaatccctctgaatcctgattcgtcttctcttcagtagttcagtactactgctgcatcctccattgcaagggaacttttcgccattattgctccggaattcgtcaaaaaaagctcaggactactgcaagtctgcaactgggatagctagctgttcatcagtagaaattgcaaatggaaatatattattagcactgtatttgtatttttcagttcagattttcttttcataagataaggcaagagcaatgcttttttgtatgttatactccttccattccaaaatataagacacaaccacccttaacacaaataccaagaaataattatcatcacctcatagtttggattaacctaataaatagaatgcatgcacctaataaaattagagattttgatgatggaggattcaaataataatattttagtgtaaaagatgtgctagttaatgacatgcatgcatgcataccttatattatgaaacaactttaaaaattagtcgtgccttataattatggaattaagggagtattatgttcagttcagttaagatttaaggctaagaagaggccaagactactactacatgcaacttttcgccattattactcgcgaagtcgtcaaaagcttagtactggaacaggggtagctagctgttcatccgtagaagttagatgcaaatggagataatatattattagtgtactgcattttcagttccgatagattttcttctgaaagaaaggcaggagctttaatttgcattttatatattatattcagttcagttcagatttaaggctaagaattggccaagagtacagtgaattggtaagagagaagctgcaattagcagtaggtgaagtggagctctcactggggatcattggatggtgtatgtcccaaccgcctcggcctaatcaccagcacaatataaaaaccatcatcaccataataatcatacttgtatactactgtagaataattctccatcgcaagaattaaacaattgcaacgagaagattcccatagagctagcattagtttttccaatgctggcctgcctcagtctctgacagacagttcattctcttgtgtatcatatccattctctgcattcttgc

SEQ ID NO: 28801 - DNA, 1501 bp, Oryza sativa; identical to SEQ ID NO: 28281

SEQ ID NO: 28802 - DNA, 1501 bp, Oryza sativa
agattttgaaacaaggttggcacccggccaaaagctttttaaacggccacccgggccaacacctttcaaacggccacccgggccaacaacttttaaacggccacccgggcctagctgatcccatcagctgcaggttttccaaacatagaacccagtttctcaacagcaatttcacaagcagtagtcaaacaaaactacgctaggaatcacctcacatccgcccatgaccgtgggcacggctgttcgaacagtttgttaacctctgcagagggggtacactttacccacatgacattactaacccggatcatccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgacttatgtttggatgaaattccaaggaatcggtccttaagtgcgagagcgggaaaccgtacacccggtacgttccccggtccgcggttttggaaattcatttagttcacaagcaccgacccaagtgtcgggttttccaagtcttttgtaaaactccagttttacccaagttgttactcaaattttaagtttgaaggcgaccgtcgatattcgcacagagtgcacgattatcgaggcgcatctgggtggttacaaggggacatggtgtagcaattttcaacggaaggatcaattgcaacaagttaggtaggtccgccaatctgccttgcagacgggacaacagattaagtgtgatcctatcaatgcataatattttgcaagcaatataattaaatttcaaatataggctcaagatgttcaaaggtggcttgccttgctcgagatctggagcttgatcctcgaaatcctcgcactgcgggtcttcgggctccgaaactacacgcgaaacggaacaactcaacaaacggcgaaaataaagccctattaatgacctctaagcgtgccattggatagatctcgagatttgggaaattttggaagttgaacggagtcaagcggagttatggttggaaagatattgaatttctaagattattggatttttggtctaaaggaaaaaggatttaattaaatccttttttggaaaaaggaaaaagaaatgatgaagggagggaatctagactttcctcggacggctagggcgcggcccaagggaaatggagcggaccggccaagctaaatgggccggccggcccaaggcggcccaagcgcgcgcgcgcgcgcgggagggaggagagagagggccggtggaccgggctcaccacgcgcggtcccgggtgggacccgcttgtcggcggctcggctca

SEQ ID NO: 28803 - DNA, 1501 bp, Oryza sativa
tggttaacacatctttgtcagggatgaaaaagccttcgaaacttctgcatattgcttgcctttgcttgtaagatttcttttttgtgttcttattgtttctgaagagcgtgtttgtaaggaacatcccaatggcgtacaagatgaaagggatcttcaagggactcaaggtcatctctcagatctttggtcagtacaatagtacaatgttttgggcttttcatgctcctctgcatctaatctcctttcttgcttgctgacatctctcattttctactgacggtcttctttcttgcattctctgaatggtttttgcagtagtgaaggagcatgagatgcagattggtagtccgacagacgtgaagcatgtcgcgcacatcggttgggatggcctgacagggaatgcttctccaagctgggtaaatgtacctgaatttcagtgaaatgatacaatcatcttcttgtttcaaattgtctgatttctctcatctgttctttagatgaatgacatcagggcatcgtctgaacttctgtctttgggcaactttgcaccatctgcagggacctcttgggcttctcaaggtatggcaagaattacttgttcttcagagtggaagattttctgtgttggtgcgattgcttcatatgattgtggcttctttgggaaaggctttggtctgtcttatgagtggcatgtatggataagcatgcaaacttggcaagttactctagtttaatcctagaatcatgggcacgtctgcatgttcttgatctgggatccggagttgcagggaacactccgataaaacaaatccacacttctgatttcctaactaccagcagcatcttttgccaggcaatggattgtgtgtacacatgattactgaaccttttgaaagaaaacttgatgaatgataaaaacatgtaagcctctggtaatcctcttcaatcattatgtgattgatggttagaatcacgagaatcgaaatttattacgagttaagtaagtgtgaggaagttcagagaaaacaatgtttaaccaagaacaatacactgtatcatgcatagtttaatactgcaatacggagtgagctcgagacgtggtctagctaataaactagcagaaattttcttgttgaactcatatggcaggacaggattcggatttgataagaacatgatgtccattgtccactcatgcataaatagatccttcccaaggcacaaacaccgtagattagattcccattgtcacaaactgctgtctgacagacaacaaacaagcatgctaatggccacggaacgactgaaattttgcatgatcactcaacatattcagttaaacactgctgcaacaatgcagttcttggacagcatcagcaatcggccatgtcgatcctaatgtcttcttggcactcacatgctgatctgcttccactgttgggacagatttcgaccagcctcgagactcgtcgtccttcgccacgccgtcagagaacaccag

SEQ ID NO: 28804 - DNA, 357 bp, Oryza sativa
atcccggggtttgtttacatcctgttaacaaatatgggatccacatttgcatccaaccacgactcatctttaatactacctctgtttcaaaacaagttcatttttcaccatctcacacatatatcaataaaaataccaaaagatagaattccctactttatctaatctcaatgtaactattcatcactttatctgctcgtaatacgactattctctacttctacaaactccgatacaatggttactctaaaaatgtgcttattatgggacgaagctagaaatgaacttaaatatgggacaaaggaagtattcacttaatcttacccccaaccaccctcattatgtgtgttactaaga

SEQ ID NO: 28805 - DNA, 619 bp, Oryza sativa
ttgattaagaaacccaaaaataagattcccacttgaattggtttttcaagagctgatacctaaaaaacttaaaacttgagcttcaattttttttatgcaaacctaacgtaatgatcaatgaacccaaaaacctatgtacatcaactaaaagttgttgaacatgaatgagaaaaacctgcccacgaacttggattttactgcctccgacctggccgccactggcccactgccattttggaatgctctgcagcatgatcgggtcaccattgaccattagtcctactcctcaggaagtccttgcttaagtgaggctttggctctagcagcggcaggcatgctgtatttctttgattggatgcattcaattgtgtacaatctcacgagcagtgctggaggttccaaatagcacacgaacctatatatgcgagcaccaaaagcttgttcgatgcttatatctaatttattgtcctaacaagaacagaaacttcttggtgaaatgaaataaaagtgccatggagttgaatagcttaaggacatgttttctctgcattatgatttattttatgaagcttatattcagttttgactttttgtaaacctagactgattttattttatt

SEQ ID NO: 28806 - DNA, 612 bp, Oryza sativa
tcatggatcggaggtcacctgaaaaatggatatgtaccacatgttcatatttgctgatgtccaatttgatatcccaataactcatgagaaaattaaatgctcatgagtcattaagaaaaaaaagagatatcaaaatttgtagagtaattagtttggtaattatcaaagatctcagctatagttttattgctgaaagtttatatgtgcaaaggcgtgaaattctttaccgtaagtttgaatgaccaagaactacattatgtgtgactgctatgtatgtgtaaacatctatgaaaactttatatatggataaaaaatagacatcataaaagattttaacagttataaaaaaaacagaagcccacgcaatcagcctcggtgctccccaccgcctcctccatgttcccatgacaacaacaagccgacggcctcctaaacagatcatcgatccggcattggcgcatcgcctccaacagcaataggtgatacttgttgacggtcgctatcgaccagtttcgaccgtcattattacccaatatatgaagactagctatgtttgcaatgcataattcccaaataaaatatctacttccactatgtgctatgctactaaca

SEQ ID NO: 28807 - DNA, 154 bp, Oryza sativa
ctagaaaaaaatatttacgagtgcaagtgaaataaaactaacataatcaacatatgatttccatggtgtcaaagagttaagtccgattaagttcacacgatcaatcgagaagcaacgttacgagatgcactattgggtttatgtgaatatagga

SEQ ID NO: 28808 - DNA, 162 bp, Oryza sativa
caggaaatcgtgcctagggtggaaaatggcatctccctcaccacatacacagaccacatatatggacgagggtgaacagatatataccttcatgaaaaaaaattgacatctgaacattcagggaacttaattctgaagaaactcaacatgaatatattgtta

SEQ ID NO: 28809 - DNA, 1501 bp, Oryza sativa
tcattcgtatccaaaaaccccttccgatatccggtcaaacgtccgatgtgacaaaaaaaggccctaagtaaaattgtttttgttagaaatgaaagaggtaggaagagagagattttatttatacccaacttagcgattttatatatatggtgatgggatggacaatagctagcttggtcgtccagtagttgagtcagcccaagacgaagtgtcgcatcatcgccaaccaaaactcatcagtcatcacggtaatgaatgtcaacttgccaagaaaagaaactcataaggaattaaaaaaatctacagttaagctaccagtgtgaattctcatttctcaaccccctgtgctcaacctatgcaagtggaactgtggaaggccttgtttagttgctattttttttttcaaaaacatcacatctaatctttggataccgtagaacattaaatatagataaaataaaaaactaattgtacagtttgcatgaaaaatcgcgagacgaatcttttaagcctaattagtccatgattagtcataagtactacagtaacccacatatgctaatggtggattaattaggcttaataaattcgtctcgcggtttctaggcgagttatgaaatttgttttctcattcgtgtcaaaaactccttccgatattcggtcaaatgtccgatgtgacgcttaaaaattacttttttcgcgaactaaacaaggccgaaatatggatcctccgtcttgacgatcactataagaatactttctggggttcgcatcaaatgctacagatacaaacgccaccaatgcagtttcagtccacagttaaatttccctggtaaaaaaaagggttgggaaaaaaaatcaaggattcaaaaaagaagaaaaaaagtatatatatcacgttttgacaatcttttattatcgatgtttcactttgaaccaccttttaattaactattatttttattttggacatgataattttacctttgtgatatttagacaatctacatcaattttgtcatacataaaaaaacggtctacatacatccgagggagtttattgacgagtaagagatggcgtacacaaggttgttcatatgcttgagaagagagtcaggtgatccaaagtaaaacatagataatattatctggcctaaaataaaaatattggttaaatgacagctcaaaacattaagaaaaacatcggtaacacaagatagctcaaagtaaaatatacattaagaaaaaagaatgggaacgcgggccaggtcacggcctcaaaccggcgagcccattcggatccccacggcccatgattggctaaagcccattaaatcctcgtagaaaaaaaggcccagtaaaccactcaccacgacactcccccccacttcgtcgtctccgcgcgccgccgccgccgccgccgtcgcgcggcgcaccaagccaccaatcctcccgccccccaccaccgcggcgccgagcccgcgcgcgcgcggggctgaaa

SEQ ID NO: 28810 - DNA, 1501 bp, Oryza sativa
atgcaggcttcaaggagaggctgttgtttttgcaattgattttatttgaactcccttttttttttctaaaaacgactaaatgagtgcttctcaaacgacacggatgagacagtgcgtctcgtccggtcggagtatgtgcaatgtatcagtctttagatttgaaacaagattggcacccggccaacagcttttcaagggccaacaacttttcaaacggccacccgggccaacaacttttcaaacggccacccaggcctagctgatcccgtcagctgctgatttttcaaacatcgaacccattttctcaacagcaatttcacaagcggtagtcaaacaaaactacgctaggaatcacctcacatccgcccatgaccgtgggcacggctgttcgaacagtttattaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagtgggaaaccgtacacccggtacgttccccggtacgcggttttggaaattcatttagttcgcaagcaccgacccaggtgtcgggttttccaagtcttttgtaaaactccagttttacccaaattgttactcagattttaagtttgaaggcgaccgtcgatactcgcactgagtgcacgaatatcgaggcgcaactgggtggttacaaggggacatggtatggcaattaacaatggaaggatcaaatgcaacaagtcaggtaggtccaccaatctgccttgcagatggggcaaaagattaagtgcggtcctatcaatgcataatatttttcaagcaatataattaaatttcaattataggctcaagatgttcaaaggtggcttgccttgctcgagatctggagcttgatcctcgaaatcctcgcactgcgggtcttcgggctctgaaactacacgcgaaacggaacaactcaacaaacagcgaaaataaagccctattaatgacctctaagcgtgccattagatagatctcgagatttgatgaattttggaagttgaacggagtcaaacggagttacggttgggaagatattgaatttctaagattattggatttttggtctaaaggaaaaaggatttaattaaatcctttttggaaaagaaaaagaaaaagaaaagaagggagggagggaatatagacttttctcgggcggctagggtgcggcccaagagatt

SEQ ID NO: 28811 - DNA, 1501 bp, Oryza sativa
tagggcaagggtgagtacgggagtactcagcaagccaggggaaataagtgtttaatgcaggcttcaaggagagactggtgtttttgcaattgattttatttgaactcttttctgaaacaactaagtgagtgcttctcaaacgacacggatgagacagtgcgtctcgtccggtcggagtatgtgccatgtatcagtctttagaaatgaaaacaaggttggcacccggccaacagcttttcaacggtcacccgggccaacaacttttcaaacggccacccgggcctagctgatcccatcagctacagattttcaaacgtcgaaccccttttcacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaagatatttccaaagccgacacaggtttaccatatgccgacgagaggggtcccagaccaacaacaggttaggtcccagaccatactgtgccaggaagcccaggggtcctcccagacaccaccccggtgaatccacatgtctcccattccacccatgtggtcgtacttgtcttatgtttggatgaaattccaaggaaacagtccttaagtgcaagagcgggaaaccgtacacccggtacgttccccggtccgcggttttggaaattcatttagttcgcaagcaccgacccaggtgtcgggttttccaagtcttttgcaaaacccaagttttacccaagttgttactcagattttaagtttgaaggcatccgttgatactcgcgcagggtgcacgaatatcgagacgcaactagatggttacaaggggacatggtatcgcaattaacaaagggaggatcaaatgcaacaaaattaggtaggtctgccaatctgccttgcagacgggacaagcagatcaagtgcgatcctatcaatgcataatattttgcaagcaatataattaaatttcaaatataggctcaagatgttcaaaggtggcttgccttgctcgagagctgaagcttgatcctcgaaatcctcgcactgcgggtcttagggctccgaaactacacgcgaaacgggacaactcaacaaacggcgaaaataaagccctattaatgacctctaagcgtgctattagatagatctcgagatttgaggaattttggaagttgaacggagtcaaacggatctacggttgggaggatattgaatttctaagattcttggatttttcgtctaaaggaaaaggatttaattaaatccttattggaaaagaaaagaaaagaaaagaaaagagggatggaaattagacttccctcgggcggctagggcgcggcccgagagaaaaggggcggctcggccgagcttaa

SEQ ID NO: 28812 - DNA, 1501 bp, Oryza sativa; identical to SEQ ID NO: 28747

SEQ ID NO: 28813 - DNA, 1501 bp, Oryza sativa
tctctgctcgcgtacacggttttcttctcgcgcacacggaattcttctcgaggtgtaaaccccgtttggtaactttggggtatcaatcaaagcggcgaaaccgtgcaccgctatgtgccacatgggcgcagcattcttcccgagctccgaattgataagttggatctggtacggcgtagcgtacgcattgcatgttgcgatcgatcgatcgatcgaagtcccggcctgggcaataattcgctgctgcacatccacacacaccgcaagctgacagcggctggctgacgtggtggaaccaccaatcggcattacgaacagctcggcaacgcccaggatgactcgtcactgacacgtggatcccatagggcacatcacgatcttttcttagagaagggtattttttatcggcctctacatccgaccggatatatgcaatatttttaaattataaatttagcctaacccaatctaaaatttgctatcatgaatatgctacttaagtcaatgcaaccgctaaactacatgtggcacgtcacaatcctgcctgcgttgcatagtgttctttgtgacaccaatgccacagttggtaacgaacgaactagtcgggggcaaggggcaagacagcatgtttcgcatagcgcttgggagtgaactggtgaagttacacaggaacagcgagcgacagagagggggagaggatcaggcgagcgattgcgtattttgcattacgggagagggagaaatgggtggattggaggagcagcggcatgtgctatgggggaaagctaatgatgggaaagagacaagcgtatcaactgcagcgccttcctgcagctgccgggttggtggagtaggtgacgaccacccgcgcctgggtgggagtgggatgccggcgcggggcaagtgatcgatcgattgaccatggtaggagccacacaggccacagccacctgggtaactagtgtcatcagctgcattttgctcagttgctgcttgccatcgtcgtcgacttgttgccctcctcttttttcactgtccgttgctgcttcttgggttcacttttggtgcgtttggaactttggatagagtattaggtgatctggataggcacgaggaggaagccatgcgatgcaatgggataatatgcaatgggtgatgaggtgtttgggtgtccacctgttgaaactgtgtcattgttggacgggtgacatgtcacatgctgatggggtggcgtcagtcaatcatgtttttgtagattaaccggagtgaagaatggggtctgatgttctatctgatctgatctgatcatctcttgtggatcatcatggttaggcttggcatgatatatgaatcttggtccagtcagcaagtgggggtttttattggtaaattgctttggtaagttaagaggtcacatcactaaacatttgctatgcaaatgtgaatgcgtatgatccctacttggcaaaaacttggaacgtgctgtttgcgtgtcttcgca

SEQ ID NO: 28814 - DNA, 1501 bp, Oryza sativa; identical to SEQ ID NO: 28741

SEQ ID NO: 28815 - DNA, 392 bp, Oryza sativa
attttacttctttctcaatttgatgctgagttcctagttagtatcacatattcttctttctaagaaaaaagaaacaagtaattccttagtttcgcctatgattaaatgccgggcaaaaatattttgattatctcttaatttcatactaagttcctagttattatcccacattcttcttctttcgaacaaaaaagaaacaagtgattcctctgatttgtcaagctggccaatgcataagaaacatgctagagtgtgtgcagcattcgctattagcctgccaattacacaaaacgctatcattcaccatgaatgaaatcaacatgatatattaccacccacatcacaaaatttatctggttgtggtggaaaaaatggaacccatggtagagtca

SEQ ID NO: 28816 - DNA, 563 bp, Oryza sativa
acggggcgaggcgtgtgacaggccgcctgctgccacctaacccgcaatctgaccggtctgtgaccggtcacacactgcgaccggtcacggaccggataaacgagcgcgctgcgttgcattaaatgcggcgtggcgcgctcgtccaacccgcaataaatgcggttaggtgagccccgccgtgctcacctaacccatacacgtggcgccaaaaccacagggggtcggggcgccccagccctcggggccgaaacgggagcggcccgacccctcggggagacagaggaaggggtggccatgtcaccctcgggcccgacccccccgagggggtcaggccacgtgggtgaccgcggctgcccaagcctctagtcatgatactcccggtcccatgtcaccgacagtagcccccggcgttatgccagggcgatcgcccccctcgagggaaacgctcgggcgtgacgccactccttaggcctggtgacaggtggggccggtctctacaggcgggcaggaacccagcagtcgcaaatcgcgcacatcggcaacggaaaaccgactgtctataa

SEQ ID NO: 28817 - DNA, 197 bp, Oryza sativa
ttggtcaagatagggtgggtccccacccaaaaaaaggggtaggtagaagtgttgcatgtggtatccccttgagatataaaaggaggaccttgcccactgaaaaggggggatcaaaaaaaaaagatcgtagcttggagggggtagagagaagatggtagctgggatcggagagaaagaagatcgtagcttgtagagga

SEQ ID NO: 28818 - DNA, 398 bp, Oryza sativa
cccaacgggataccggtatatagcagctcccttttcaaatataggaaaaacagcaattcattaacacaaagtcaaagctcagaaactctctgaactgtgagtgcctaggttcctgcaaattcaaagtaagatttggcaaaatgcagtctggtctatgcgtttttattaccattactcatcaatggtaaatggaaaatcaaaggccagggggaatattacatgaactgtgaaggcaaaatgactgtattgaaaaatattaccccttgatgttctcctatttttcttcctggttactactacttgtatgtaaggttgtataaaatcttataaatcattttcttttgattttatagtaataagtttatatattcatactttgccattcccaagcaaaccgc

SEQ ID NO: 28819 - DNA, 268 bp, Oryza sativa
agggcaatcgacgtgcatgaccaaaaaaatattgttcttgtgaacgaaatccttatatttgtggatggagggagtactatgctttggctgtttgactagcttggccatatcaggtctccctgaagattgggctagctctgaatccgatctgatcatctgatgtgatgatgatcatggggagtgagaggggatgcatgtccatctgacaacaggagtaaatctaacaatgatgcaggatgtgcaagcacttgcctttgcccaccgacca

SEQ ID NO: 28820 - DNA, 528 bp, Oryza sativa
cttctcagtctggcaccccataatgaatcatgctatacaaaaggtaaagccgttgcccacgctggcttgtggttggcacggtaaaagtttcacaacagtagctcgcgaaccggtccttaattgtcatgagcacaaccatcaataccatatgctcacaacccaccttaaccaggttttaattatcaattaattaacctcacacgatcaaccatcgtgagctaccattaatgtaaccataattaaaataataatgtaacatagtttataattaatccctttagttagctattgtttctaagcacggctaagcaaacttacatatagcatttagctgaaccaatccaacatataaggttcatgctaatcaaattataacccataggaaaataagatcatcttcggccgttaattaattgggaaggttcaccacccgatgacattcgaaaacaatgcatagttgaaataaaataatagctttaaacgggttcaacatgctcaaagagttgtttgggatctgtgtgacttgcc

SEQ ID NO: 28821 - DNA, 218 bp, Oryza sativa
agatctcagcggtttcttccggttcttgatccatttgtaccggtcgatttcatcctcgcttaccctttttttcctccttttataaattcgattcctgcagatcacggcaaggagattagagagggagcgaaagatctttccttatttttttttgtatcaaaaatctcagaagagcaggaggaaagaggaataaatcgggagcgagggagaaggcatga

SEQ ID NO: 28822 - DNA, 660 bp, Oryza sativa
cttgcttgtcaaaaaaactcattaacatttatttcttttcaaaaacacataacaatcactgaagcatggtaatggcgcactcaaattagaacacgaatgcacttcaagagagctgatttgaaactgaagaacaacagtggtggttcagacgatcagacagggattgagatccatctaacgtgaaatcagactaacggggatcttaggatctacatatcaataatcacgtcaggagtaatttcacgttagaggatctttttttatcagacagagcctgcagaacggaagagaacagcatgcccaagcaaacaaaacaactgtagaaagcgaagtgagcgtatctcaattattcagattttctgtggtgaaactaattcatccgggttcaagtcttaaacttaacacgagtgctcgcatttattgctaattatttcaactgtagaaaaaaacaattaaaaaaagaaacacaaggatgggttttgtggcaagtgaagcatgcactcatgaagttgcagtaaccgcacgacagaactccgatactcatcaggctagtacaacagcgactgcactcaaattattgcgatcctgttccaaacgcaacgcacactcccgtcccgtggaaaaaaaagaagagacgctgtaagcagcccacagagccaa

SEQ ID NO: 28823 - DNA, 1501 bp, Oryza sativa
  unsure (1)..(1501): unsure at all n locations
ccagttcccacattcatatttctacattccacgttaacaacaaagatggtggtatgacagcaatcaaattaaccaaatccccagtttaaaagagcaaaccatgtatacggttttgcacagaatatgccaagtaaaatgatcgcagttgttcatgtaaatgacagaattgaagcatgccaatgttaacataacaggggaaagatgttatttgaatagaggcctgagtctaatacacatgagcggtaacttgagacaagtttgtcccttcttgttccataaatatttatgtttcataaattccatgttcatgggcatccctgatgattgctcacaagcagcaaaaaaagaatggttttttacttccaaacagcacgaaaacagaaatattttaatatcaagtgactaggatgttttccagtgaactactccagttcaattcatgcgatatttgacagttcttcaatcaacactgctattactcctaatgcgaagatcaccacatgcaccagcacatatatgcaagtcacttgacaagtaacggaagaagcttttattaaaaaaaaagttttaccaattagttaattatcacagaatttagaattactgagagttacccatccaaaataagtttgcatgcagtcacgcaaaaaagaccccaagcctttcaaaagattatgatataaaaagggcagtggtacaccactatgttttttcactatagggcatttctaataaaagcttagtaataacncaggatagagaatgatattccattagtggtttactaaaaaggaatcaatgaaatgaatccgtcagagtttctgcggatcatcagtgatacgacaaacttatgagaaacaactaaactaaaacaataccaagcaaggtcagctctcagcccagacatgtttatacaaacaaaagtcacaactaggatgaaacatatcgttgttgctagtaaaaaacttcatgaaagacaagcacatcatgaagcaagtaaagttgataaaagaaaattataccagcaaacataaggcatggtgttcataattgatgaatatctttgttgcagccacatatgaatcgagtattgcttaacaggttgttcatcaatagtgaaaagccttctgaaagctgttcctagattattaatataacactgttttgcatagtctcgtatctttcaaatcacgagcagttgatccaaatgcaaatgttgaaatggattagcgaggaaaacagaagtattagaagaactcagggggttacatgactgctgccactcagcagatgcccagttgaatctgaaactggacagaaggcagaaatcgctacggagcatcaggactgaagcaattgaacaggctgcctttgtgcataccatccttcataaataatccaccatattgaatctttattcagtggattcaacagcccatcacagcacaattatacacgaagttcccagatggccgcctggcaatcaaattccacacaggcg

SEQ ID NO: 28824 - DNA, 872 bp, Oryza sativa
acaaattaagaaaaatctatagaaaatgtgctcctctttagtcttttccatggaatttccatccggcggttatcttaagatttcttaaaagaacatcaatttcctagcttttgattgatatagaaatgtatactctttcacatacgtacgggtgataacacgtaactaaatcatgctgcaccatacacgtgtgtgtgcatctattctacatccaatactaggagttagatttaggtgtggtccgaacaaacacactcgctccagccattgatattttggcttgttatctacaaattcgtatcaatgcatattgttacattgttgttttctcatttgatcggcaacgatgacaccatactctctgcacggagcaatagcacgatggattgattattggtaagtaaaaatacatgagggtacgacaaaaacaactagaggcttagacaagatgaagaaggcacattctgctgacacatgctaccggatataggtgcaatgtaaaatagcgtatagacaaaaaaagaaagggtaaactaggttgagtcatgagaattaagggacagataggttcacaggatctatacacctttaaaactactataagccattaaaaagcgactaactttatagaaaaaaaaaccatgcaacccataattgacgactatcttttccaaaccattttttcacacaaacactacatttatttggtcaaacttacacaccggtataagtacactttccataaattttgtgtaaatgaacttatacacagacaagaaaagaaaaaaggaaacatttttcataatacaagaaattggggctgccatgccaatcagcaaggcaggcagatgaaaagaaaggaggggaggcga

SEQ ID NO: 28825 - DNA, 1501 bp, Oryza sativa
cccccgctcttccactggatcaaaagagccatcgatatttagcttcatctcgatctcctttttggtttctcccagtgtggtgcaggggccttcggagcttggtgacaaaccgaattactctctccgtcccaaaatatatatagcaaactttgtagtggatgggacacatcctagtacaacgaatctgaacaggggtacgtaatctctatgtaatccatccttagcttgatcgtcaagttctccattaattaacatctaagatgtccactttaaatgtgaacacaaatacgatcaaattcccagatttaagtaattatatatatatatatatataattctcaccgatatcaaaatatgttttagataagagggagttcagtttttgttgtagcttgcttacttgcggtgtgtgtaaattgtaatcggtcagctcttggctctgcgtaattggttgttgagtatgcgtgacctctccatttgatggttttgggcagcgacgatgcttcttaatttacacggcaatatatgatcaatgattacttcgtaaaggcagaggtgttggcggagtaatctgtgtcaacagctctaaatataagatagaaaaatacaatttattgcccctttttatctagtcggtataaaaatgagtaaacctcgctgaaaactattaaaaaaatatctttcacctatttaatagcgatattgacccgtatagatgataattctactttttctagagagttgttaacagtgaaatttggtaagcccctaagagagttatcacgtcgccaatagtcggattactgttatattcggttaaggaaattaatctgttaaagaaagcttatctaggagtcaccgagttcaagtaagatgcgacatgacagtttatctattaattaggcacaatttgttagtttcttttatctttagaaacgtgtgtttagtgtcctataaggactttatgctttccttttatcttttaggaaagtttctttcttgtcctacaaggactagtatgtccccatgggtataaatatgtacatccgggatcattgtaaactatctcttgatcaatactactctcggcgcatcgccaccctctattctgagggtttttacttatcaaccagtggaattaggcacctgacgcggggctgcatcggttcaaatcgatctccggcgaaggggtaagttctacgttccgccggcccaggcaattgtctcgtctatgtcggtgtcgttcaatgctgcatcagtgcattcaacctcttggatgctcctgtttggatgatatatttgtctgcctatttatcatatgtcttcgttaatctagtcttagtatctcaatttagctttattggttgtctctcgctttagggtttctgctggtatcggctaaattgttttactatattagattacttaaggcatctaccaccctgaaaaatcagtcaacggcttgattgtctagatattatgtttcttttcatacttagtg

SEQ ID NO: 28826 - DNA, 221 bp, Oryza sativa
gggcgaattcgagctcggtacccccaaaatctattcatgttataacccgagctaacaaaggagcaaggtaccaaaatagtatggctgtaacaataggtaaacatcccatagtgttattgcaaaacaaatgcagtatttgaaggaaaacaatagaacatttgcaatgtaggatcaacatgatcaagtgacaagtatgacttgccttgctctgctgctgaagg

SEQ ID NO: 28827 - DNA, 1501 bp, Oryza sativa
cgacctcattccgagttcgtatgaattaaatatgaattttacaaaatttaatttcaattaaacctattaaagaaaagactattccaaattgattaaacaatttacaaatgacttatagctgtgacaaaagattaaaacatcctccggaaatagattaggtcatatttggtagatgacatatattaaaaaggaataatatgccattgaaaagaaagaacagatttatatcgattttggacggctgagattaatctcgaccgagtcgaccaagatcggatggcttggattgacacacggcagcggcacaacagcggttgcggtggcacacatacagcagcagcacgacggcgacgtacaacgtctaaacagcgacgcggcggcaacaaggcagctagcgcagcggcgacgctagggcagcagctagcgacacagcaacggctgcgctagggttagagcaacagcggcggtgacacgaccaagggattgaaacctaacccgaggggacacggatagaagtctcaccgaaccaaagcgaccggagagggggggtcgacgatgacgatccggcgacacacacggaaacgatgacgacgctagggccaaacaacagattggattagattagattaaatccctagggataaactacaccggtaaacgacatgggagagaggagagctcaccggagaagacgacgacgacgaccaagacgacgacggcaaggggtgacggctagcggcagtggcgactagggcagcggcggctagggtgttggaggaggcggctaaacaggaggaggaggaggctaggggtggctgcaacacaaaaaaaaaggaaacaggaggggagaggacggcttatataggggaagattgaataggattaggtgggccaagggaggcccggcagagggggagagggagggactcggaggggagagggcagaggaggagcatggctgggagaggggggaggcgcacggctgggaggaggccgagagggggaggggaaaaagatacgggaggaggggttgcctagaaaggaaaggtgcgggaaacagatgtggtgccgttttgggaaaggaagaggaaacggaaccagaaagagaataggactcggctcgtcatacaaaacgaaatcgtggcggcaaagaggtcggcggatacaatgaaccgcagacagggagagtgaactgggaatgattcacaaccaaaggaggaaaaagaaagaattattaattacttttccaattaaattaatcactgaatgatctttcatttattaaaaatgcttccaatgctcaaataattctgggaaaaatctagaaaatacttggacattaaaaatatttaatacaattttatctatatcaacttaatgttcaaaattttcatagattttattcacacacttgctttaatcattaaataatttctaaaaattcctttttcacaacgatttataatttagcgatttttatggtgtgacaatctcacataga

SEQ ID NO: 28828 - DNA, 503 bp, Oryza sativa
tgcgtatgcccaagcacgcaagtggttaatgtcatgtggtatagtgcatctctttagtaaagtatcaggcgttgacatgaacacctgacggagcaagtagctagtctccttattctgtaaaaacgactcgactgacgagccgtggacttcatcttcatgtgcaagctgtgcattttatgtaatttgtggccgggcacgttttgtcaagtgcatgcctagttagatcaacgctagtcaactggcactgggtatctaaaaaaatacacaactggatgatcataaattacacctgaagttcaaatggggtcgcagagaaaggccaaacttcattgtctcgcaaaacatctcttctatgttatgttcagttctaagcaattctcttttgaaggaaagttccaagttccaagtaggctcactacttaaaaaaaaacatttttagaattaggtgggcaggccgccctaacaaaacggccgcaaaaaatgtagccatttccacatgcagg

SEQ ID NO: 28829 - DNA, 1501 bp, Oryza sativa
gattcagatttgaaaatactttttcgaatggtctattaataaaattaaaaaaaataaataagtctaaaaaaaattgtacagtccgagggggcatcaacgaaagtttgattttttttttcttatataatgcttataaatgattgggccaattcaattttaacttaaagtgatttgaagaagtttggggacacgatcttaccgcggtgtcaataactagagtaatgaacacaacccaaattaaaagaaaaaaaaactcccggaccagtaggctgagtttaaggagaaggggataaagaagattgggaagatacataaaacgaggtgagctactagtgcatgattaattgagtattaattattttaaatttcaaagatatattaatacgattttttaaagcaactttcctataatttttttttttgcaaaaaacacaccatttaggagtttgggaagcgtgcgcgtggaaatcgaaacaaacaaactcactttcacctctcctagaatgcagcaaaagcacaacttcaaaacatcatgtagcagtagagtatatgttcaatttaatttggaattacaatgcaagttttccggtaaaccattttaagcactcgagtggacgcccacctattttttgcatatcaattcaatggttatgaaaaaattttcaaattttttttgataagatagattaaatatgaaatatatcacttcacaaacatacaagtttaaatttaaattctacaagttttttagaaaataacaaatttaattatgagtatatacgtatactagttagagtttagtttgtcatttttattacaacttgtagaaattaaacttgcatatttgttgagtggtatatcacatatgaaactatgttgtaaattattttaaaaaactttttaataactatttagtcaatatgtaagaaacaggtagacataaacaacaagaagattaaattaggccctgtttagattccaacttttctcttcgaacttttagcgttttttagatcaaaggcttcacacctggctttactgagataaagcgtaacaaggtaacttctaacttttccgtcacatcgaactttaatacacacaaacttacagcctttttatcacatcgtttcaatttcaaactttcaattttaacgtggaactaaacacaaccttaatctccaagttttccaaccatcaggaggctctggctacatcatcatagtcatagatggaaaccagaaacaagctggaaacttcttcggtcaaacaggcgctaagctatacagtatattgcttatatgcaattgacgtgacgctcctactgtttggtcaaacaattaaatagatacatagttgcatgatgcatacttctttgcttggcaaaccgtaacaagtgtgaccacgtaaaatacgtacacggtcattgctagctgttctcgtgtgctgatttttttttccctttagaaacgaagcctgtgttaatctcatcacttgaagcatt

SEQ ID NO: 28830 - DNA, 318 bp, Oryza sativa
ctattcatgttttatcatctaatagcaataaaaatactaatcataaaaaaatttcaaataagacgaacggtcaaacgttgaatgtgactagtgcaaaactacatttattttgggacggagggagtacaatttagtgaatcaatagcatgcacacaaagctgcagatttgttagattttcattgttttgcatcactacaaataattaattaagagctcgagcatggatgaaatggcataagaattaaaagaaataaaaaaaaggatgagatggaaaaaagcgtgcatatttgttttgtacaaatttcatgtgcgctgca

SEQ ID NO: 28831 - DNA, 170 bp, Oryza sativa
gtctccttctcatccaatctcaatctcaccaacccgacctacagtagcagaatccattataattccgcagtaatccgcacggctccaactctcgatcgcgagctgttgttgttttggtggaagaatcggtccgtgcgtgatttgatccatggcggtgtcgtcgtcgtcgc

SEQ ID NO: 28832 - DNA, 167 bp, Oryza sativa
  unsure (1)..(167): unsure at all n locations
aggatatatatgtacatatagtcaaaatctcaggggctgtactgtacagatacatccaaaatcctccatccagcatggcgattatcntaatggatcatcaggattaactctcgcatttatcaagaccttggcagatactaaaataaaagttaaaccgcacacttagg

SEQ ID NO: 28833 - DNA, 156 bp, Oryza sativa
ttgccccttcctaatgggaattactctgctaatatcacttttaattccccccattgatgtgctttaattttggtgtagatttttatttggcgagcataccaatttaaaaccatggacttattgttttatgtaattccagctacgagtctacggaga

SEQ ID NO: 28834 - DNA, 377 bp, Oryza sativa
atatagtttcataatttaatttatatgagttaaaccactgtaaataatattagttttgtaaatgatcaatccatgtcgtcaacaaactattggatagaatcgatattgatatcatcatcaaggacttcgtatctaaaaatatccgaaaaattttaagctaacaggttacaatgtttttatatattataatttatagacgcaatttcaatgttatcggcaatagcttgttgctgtgaaaactctggatcgaccctgtttagagctatggataaagattactccgccaacacctctgcctttacgaaagtaatcaattttttcccaaattttccaaaaatttttttggggggcccccccccccggggtgtaaattaaga

SEQ ID NO: 28835 - DNA, 199 bp, Oryza sativa
  unsure (1)..(199): unsure at all n locations
caacctacactgcttatgccatgatattgctttaacattttggattaaaatatgccgattcttgaccatatttccaacaatccaaaaacctgataggtcattttcggtagttggctttgctgctgcactgaaaccacatgcttttgatggttctaactataagagatgnaaagcccgtgcactatgtggttgacagcga

SEQ ID NO: 28836 - DNA, 458 bp, Oryza sativa
gtcacatgagcaaatcaagcgattagatcacgagatatcagagacaagagagtgacactgttcatgtagtggcatatcagtttgctgaatattctctcctgtcatgaaattaataaaaaaacaacatgagctaggagctatagtgccattgatttggcaccatcagacgcctctaatcaagcctagcacaatccatatgtactgaaattttgtcagcttaaatatactaatgaactgaccagatgtctgctagtctagtactccattttgcattttcaacagcttggagatcttgtagcaattgacactttgcagggccccatgtctgtgactttccatggtctaatttaatttgtgaagccccagggccgagccaaaaactttgaccctctaggtattagggcctagtacatttgatcccaataacctgcttaatcaatcaacctctcttttataga

SEQ ID NO: 28837 - DNA, 291 bp, Oryza sativa
cctgcagcccctactacagtagtactgctagtcaaaggtgacaagatcactgctcatttagatctcatctacactgcagagttgggacttgggaggaaaggaggaatgcttggacgatgcatggcaattgtcagctgcctcctctgtgggggctggctatggttggcctgcaaatcgaccaatctttgatgtagcgtgatcttgcggggatcaaacgaaacgaccaatttgatggcggtgtgcagcgtggtggtccttggtttccccggtgctggatctttcgtttctagc

SEQ ID NO: 28838 - DNA, 151 bp, Oryza sativa
aaaatctgcacagaaaatgaaattgttggtctctttcgaaattcacaaataacaaaactcaaatatgcattgacaatacatgctcaagcacaaaagagatgtcaatgagatatattgtcgtggtgttaggctgttcacaccccaatgaaga

SEQ ID NO: 28839 - DNA, 499 bp, Oryza sativa
caagtactactcggattgtatccatattggtttccctagttctacttggacaaggggacacctatgggtataaatacaagacccctaggaggagaggggacacatccaccatagaagacacgaaacaatagatcaagacacaagatcaacatacaagccaacatatgccaagacaagacgctggatatcgacttcagggataagtaaggctagtcccctacggtgtctccggatactgtcaggagagacgaaagcgctatctctgatctcgccgggcacgaactcgaggaggaagactaccttgttgtcgactacgagtcagaccttcagaccgccatgtcaacaacagttagataggctaccccaaatattgtactggtgtgattatggtgaataagagcaataccggcttcagccaacaggatgtagggttattacctgacaattcaggggcccgaacctgtataaaaatctctgtctccatctcttttacctcagt

SEQ ID NO: 28840 - DNA, 1243 bp, Oryza sativa
ctctcaatgtcgaatgacagctagctagcttcgtgatcatataagttgatgcatttattctctctgtaatattgtaattcaggtcaaattaataactaatcaaaattcaaacaggtttttgaaggaaacgatgccagcacacgtagcacgtttcatgcaggaaaacattttcttctagagactgcaagaaaacagtttcttagaccgtgtgcatgcagaaaaatttcgggacttcggtacatgccaaaaaaattcatgcattattcgatttctggtcgttgatgaaccgggatcgatattggcatgtgtatattcagctatgctacatatagccgcttaatttcgtcaaaactcagtaaatttgtagaaaacataacaatattttcagaactaaacaaacgtattatttaaatatatttaatgctagatttaatcaaactaagttagatttttggatttttagatttgctaaattttttctaaatttgattaaacttaataatgtttgactagagaaaaagtgacagcgacttgcgatatgaaacgcatggagtagtattgttgtgttaatagttgaccgatactcaaattaattaagcagttaaatattaattatagttatgaacagagtgagtatatgtatattagtacgagcttccatgttgaagttctttctgtaaaagtgatgatcacgattttcttgtcgttctaagtcaaatagtgtcctaaatctgtcctaatcaaatatttttagatttgaccatcatttttttagaaatttgtgtagtttaaaatatgaattataaattataaaaatatttggtgaatctaaaaatataaatcttattatgttaaacagttgatatactatactacaactagggtacgatatagctaaaatacatctaacgtagttaactttttactgcgagagaaatcatcgtactatagcactaaaacttttactatgactactaggtaatgaaaaggtgcaggaatgaatgttcgggggtgatttttctggcattaaagattttactatgctacctcataataaaaaggtatgggaagagatatttcagcatgatatagggcttgttcggctggccgatacagccgctgcacgtagccgtagctgctgcagctgtagacacaacacattgtttgtgttggctgcacaacagtgaagttgagtaaagccgaatagagccataactcgtggtaacaattttactgtgtgagg

SEQ ID NO: 28841 - DNA, 1501 bp, Oryza sativa
agcacgcggccgccggcgccggcgcatcggcggcggcgtacgtgcgaggaagaaggccggccaccataccgatcaccattgtagcgccgcaggaggtgataatctgggtcgtcgtcgtcgtcactgccgacgtacggcgcctagcaccggctgctgggcgagcgagctcgaccgcgttcgcgtgaattaatggcggggtgcctgtggccgtgcgtgaccggcggcggcgcggcggcggacggggcggggagcctgttccggtcgaaggcgaggggccccgtggaggtggtgcggcacgcgcgggagctcctcgccttcctcgccgagaaccacgacgcgtgcggtgacaagcgcgacgtcaaacgcgaacacaaggtgggtgatacacatttttcatgtatcgttcgctcgttccgttccgtttcaaccgagagatgacgagatatgtcctaaattaaagcctgatctgaaaacgcaaaagtttaaaggttgcatatatccagttggatgtagaggccaggtaaaaaaatacacttctaaaaaaatagaaaacacaaacgtgaaaacgttttccaattttaacgatatggaagttttttatatgacaatttaccaatgtcgctttcacacgatacatcgatgtttttcaacttttttttcgcgaacgtataaaaaaaattacacgtcaatatattagaaggtagaagagtttttgttacacagcacaatcaaccagataggcctatgccaggggaaggagaaaaaaaaactgcaggtaggaaaaaagagaaactactttaacatattattttgaaccccctttttaacatattattgattaaagtgtttaattttgtctgcgcatattcgaaagccacattaatttcaaaccagagattgtattagacctatttagatgggactaaaactttttagtccctatcacataggatgtttggacactaattataaatattaaacgtagactattaataaaacatatccataatcttactaattcgcgagacgaatctattgagcctaattaatccatgattagcctatgtgatgctacagtaaatattctctaattatagattaattaggcttaaaaatcttgtctcgtgaattagctttcatttatgtaattagttttataagtaatctatatttaatactctaaattagtgtctaaatatagggactaaagttaagtccttggattaaaacaccaccttattattgtagaatcaattaacagctgagcctgttgccaattaaacagaagatttgactagaataactaggcatgattatattagtcgctctgctttcatcaaaatgagcaggaacttagtataacaacaaaacaataaacatatgtagggggaagttgtgtttgtccaaaattgtgttaaggttagacactacaatttatacgtttaatcattcatatcatcatatatagggggatcttatgcatttgtgactaaatacgcac

SEQ ID NO: 28842 - DNA, 201 bp, Oryza sativa
  unsure (1)..(201): unsure at all n locations
ggtacgtcaacactagggttccattgctccaatgtcggcctancggtgtcgtccaaaacctttaacggccgtggtcgggtggctntactttgtggcctgcgtcgaagactaagctgttccggaagtcagcgtcacaggcgccacaacccttcgcggtggctcggactctctagccgccgacgcttctcctgctggtggcta

SEQ ID NO: 28843 - DNA, 1501 bp, Oryza sativa
tgtctgcctcaccgaggcctgcaccactcaaacgcgcacgggaagcacaagcaggagcagagcacgatgtggtgtgtactggtgtgtgcctccatcaacggctcaacgctgggcaaagagagagaaaggaaagatatactactgctgccacgacatgtaacatgtgactgttcacggtcattttcatcccaaagactatgcgattgtgcgatggtaacgtgcgattgtgcgaacgattaaaaaaaaaaacttatctcaaccccatgaggccatggccctgtgttagcttttaattcagttggttattttttttcaaggggttaggggcttctcctaccactcgatatcaaaaactataaaaaaatattagtgtgtgtttatcggtagatgctggatatgtataatgtataccattttcattattaaaaaaaactctcttacaacttcgtgtccaatcacccaacaactcataactccgtagtgatcattgtgacaattttgaaagaaagaaaagaaaaaaaataaataggttattgaccaaattattatagtgaattatctacattatatatatatattaaatgtatcgataaatgtattaacttatgattgattaagttttaattattataaacttgaaaaatagattaatatgatattttagaataactttcgtataaaaagttttcgcacgaaacacaccatttagtagtttgaaaagtgtgccacgaaaatcttaatctccatctaactcttgttggagaaaagaacataacctacagcagcagtagtatttcactcgtcctaaaataaaataaatcttatgtctagtactacctccgttccatcccaatataagtacagtgtaggttccgtgtttagatagtccgtcttatttaaaaaaaaatattatttttttcttattacatgataaaacataaatgatactttatgtgagactattctttttaaatttttcataaattatttaaataagacgaatgatgaaacgttgagtgcggaaaaccacgacggcgcgtatattgggacaggatgtagtactactcaggcaccaacaggaggggaaaaaaaaaagaatccatttgctacagaacgtttcgcacgcaggaatgaaccatgaccgtggtgtcggtccaggaggccactgacccacccgccaacggaattgaaaagcgctagaacaaccaacgtgaacgtacggccgcacccagagccgcgtccgcaaaaacaggcaaagcgcacccagtaaacaaggaaaacccaacagcgacccatccactgatccattccaaagccacgagcccatcgacttatccgcacccatcacccagcctcctctccacgcaaacgcaacccaacccaaacccccctataaaatcccttctcccacacacagaatttcacaagccacccacagacacgtactacgacaccgagtttgagctttgagctttgaggagtgtgtctgagagtttggtca

SEQ ID NO: 28844 - DNA, 929 bp, Oryza sativa
ctcgatcatctgaattttgtagtttttaaggagttgagttttttgctactgtgccacaattttatcctagagtctcgatcatccaaattttgtagtttttagggcgttgtgttttttgctactgtggcacaatattttgctaggtgttgtttgtcagaaaaattggtatgatgataaaactgtaacggcatgtacaaataacaataaattgcagactgcacacagtagtcatatggatatatatatatacacacacacacacaaaaaaaagacatagggaaaattaattattactatcggtcacaaaatataataaattttagggtatgacacaaatatgaaggaagtaggtagaattaaattggggaaaggttataattgattgagaaaaaaattagtagagaagttgtcatatttttttaaaagtaaagttgttatttatttttggttgaatttttaaatgctagaagttgtattttgggatggagagggtagttttcaactgtgtatacagaaaatataccaatatatatctttgtttcaaaactaagattaaatacctttttttatagttgtgtctgggatttttctaatttattgacatgattaccttaaccatgcacttatgataaaagatataattcaacaccaaaaaaatcagcaacatattcattatttcaatcaaactaaaaaagaaattgtaataccccgtattaaaatatatttagtttttttagtttgggttgacttgttaaaataaagaagttaacagaaataaataaaagaaaaatatctttagaagtgtgccaacatgagaaggcccataaacccaacccattagtttttccctaaaacttagagagaggggaaccgactcccacctcctatgttcgcatctctcccctctacaacaaattgctctccctaga

SEQ ID NO: 28845 - DNA, 501 bp, Oryza sativa
  unsure (1)..(501): unsure at all n locations
gggcgaattcgagctcggtacccatctaatcttcgtaattaccaataatactcaatcatattaatcactaatggtttgtgtaagcagaataatcacgcgtacacgtatggcagagcctctacagacgtcaaaagagctagctttctttgggatcaaactagcttgctacacacataggctgttgatatcgcttccattgcactaaagatgattagagcaagttcaatagtaatctatagccaatgtaatagccaatttatacaatagttgtttactatactattaatacctgtttctacttatcatacatacattacatcttaaagtccgtgctacaagncctttgggggggtttttttaaaccccccaaaaggggggaaaattttttccctgtagcccgctgctattctctctctttttttatctttttaaaatatgtttatagctggcttatagcctgctattttacatgctcttacacaggttgataggctgctgata

SEQ ID NO: 28846 - DNA, 170 bp, Oryza sativa
accgtctgggtttcccataagttgctgctgccgaagttgtattccttgcttcttggcacacgactccgcatggcgcttgaggtgacctgtaccaccagaagaacgagcagataaaatttgcctacatattctacaacgggctttcgatacctcccttccgtcggggcagg

SEQ ID NO: 28847 - DNA, 481 bp, Oryza sativa
atgctctattgccaattatgtgtatatgtactttctagttccatattgtacttgctgagtattttgatacttttatgttttatttggttttaggtgcgcattgagaccgacatgcttgggctggaagtagcacccatatatacacctttatctgcacactatcaatctatattgcctaggtccataatgacacttaaactatatcatggttcggtcttgtaataatcttttagatgtattttagtttcttttcatggattataaggatggatcgcactgtgggaatgatattattattagtttaacccataattgcctgttgtggaagtccgtatttacaagggaaactatcgaaattcttaatgaatttaggacttagtggtttctataccatagtgtgtagcattctaggtatgagaatacctggcatgttacagagaccgacaacaatagcctgtgttctgcggtgccctgctcgaaa

SEQ ID NO: 28848 - DNA, 1084 bp, Oryza sativa
ttttcaatattctcaggccaggatagtatgtcaacttatgaacgcgttagccgatttttatcatggatctttgagggttaggttgttccggttgtcattgtctggatcggctttcacttggctttcttctttgccatgtggatcaatcaacagttgggccgatttggagaagcattttcatagctatttctacagtgagattcatgagttgaaattgtccgatttaacagcgatcaagcagagatatgatgagcctgtgcatgagtatattcagagatttagagagatgaggagcaagtgctacagcttgagtttaattgatgcccagttagccgatttggcttttcagggtatgattgctccgatcaaggagaaattctcgtctcaagactttgatagcctgtcacatcttggacagaaggtaaccttgcatgaacagaggtttgcagaagtcaggaagaactttaaaaaggttaatcatgtctgtccttacatatatggatcggatgatgatgatgatgatgactctgagatagaatgggtgagaagcaaaaaggttataccatgccaatgggtaaagaattctggaaaagtggagaggtatgactttgatattaccaaggctgataagatttttgatttgttactccgagagaaacagattcaacttcctgctggtcatacaatcccatcggctgaagaattgggcaagaggctgccatctatcgaggactgtcctgggtgcggtaatgttgtagaaagttcaagccgatcgtgtaatagaagcaatcggctaaagcaaacaagagttcctgttcatcaaaggttgggcccggtgaaccaagattataaccaagaggacaatgaagacatgcagaatcaatggtgtccttctggtatctttacaaagaatcaaaagagaagtgttcagaggttgaggaacagagaatgattttaggaggttgagcaagaaatcaatcatcgactgaaaaaacaaagccgaagcaggagtggcgcgttaagaatcaagctcctgtagccgatgaagcaaagagattggctaaagggaaaagttttgtaacta

SEQ ID NO: 28849 - DNA, 296 bp, Oryza sativa
ctgggtactgatggtgcagctgcagacggaagtggtacagacattcatgaagaaggagatgaagaagagcatgacatgtttgtcccatctccattgggcggtgaaatggttgatgtggaccctgatatgctgcaagatatgttacgtgacgttgatgacccagctatgaacgagagagattccatgaagttcagcaggttggttagtgactcggagactcctcctatacgtaggatgcaagccaaaacacaccaaattatcagcaacattagacctaatgaagttgaaggctagta

SEQ ID NO: 28850 - DNA, 269 bp, Oryza sativa
tgtgttgattttacaaacctcattatgtatttttttaaataatagtactgattattgtaaataaatgctgattacgggggtgggatttgcgcagcgcgagttgagcagctggcgcttgcgcgcccactagaagccccaaggtgaagagtgatcgctgcggcggcttttggcatagctttggcttatgcaggccatggacaccatagtcaagcccaaacttttgtccacatgtccgaccgaagcttagatggaaaagcatttcagggaga

SEQ ID NO: 28851 - DNA, 1501 bp, Oryza sativa
cgacaagcggagcctcgacatggtcgagcacatgcccagctaggggtgaaaacggtacgaaaacagacggaaacaacctttatcgttttcgttttcatatttttttcggaatcggaatcgaaatcggaaaccccggaaacgaaaacggaaacgaatattatcgaaaacgaaaacggagcgaaaacgaatcggcgcggatacggtaacgaaaatttatcggaatacagaaacccctcaaactgagcttcacagcaaaatatattcttctataacttcatataatttgcataacaaatattctaaaaaaattacagcaaaacactatggtacaaggtataaactattagtgctttcactccatcatcagtacatactacatagtcatcaatcatcacataacagcaacacatatcagtccatcaatattcagtacttagagcgtacacagtaacaaagagtgatagaggtggagccgtggaggttgaggaacacctgctgctgctgggctaatggctgctgaaaggcgaggcatcgtgcatcggtggtggtgaggctgtcggcggtgtggccagtggccggcgtcatcggtgtcgtccgcgtcggcggcgtcggcatcgtcgcctcgtcggtggtggtggtggctgcgaaaatggtgggggcgaggacggagcgagagagaggaagggcggcgagacggcgggggcgaggtcgcgaggagcccactagccgaggacggcagccaggcggccggcggtggcgtgctcgaccccctggaggctggatgcgccgcctctctcgatctgtctctctcctctctagcctctgtagggttagccagttagggacctagggacttgggttgggcgggaacttgaggaggaattatggactatttggatgggcttttttttacttcggaaattccgacaaactttccggaatttttccgaccgattccgagttccgacggaaactgctattatcatattcgattccgtttccgagaaatttcgaccggctgattccgttttcgaaaacaggtccggaatccggaaaaaatctgaaccgttttcacccctacgcccagcccacctaccacagctgagtcacccaagaaagtgagaaagacaaacaagacgccgaaactggactccgcaatcaagatcgttccactctctagtgccaaccccgacaagaccgtcaagatcggggcatcactaggcgagaaataggaactcgtgctcatcaccttcctccgtgacaatgttgacgtgttcgcttggcagccgtctgacatgccaggggtactcagggaggtgattgagcacaaactcatggtgcgacccgacgccaagccagtaaagcaaaaactgtggagatttgcaccaacaagccatacgagaagagctcgacaagcttctcaaagctggtttcatcagagaggtactccatccaaagtggctagccaacccagtcatggtgcggaaggccaacgggaaat

SEQ ID NO: 28852 - DNA, 1501 bp, Oryza sativa
tatttccgatatcgttttcgtttccgactttaccttttccgagaaaaatatggttacggaaatggttgaggctgttttccgatcgtttccgaccgttttcatccctaatcaagacgtctagtccaagaacaaatgctggaatatctctgctgtaaaacaatattgatggagggagactcacaagtggctagctgaacagtaccataaccattttcagtcagatgactgatgacatcaccgaccgtgctttcacaagacactttcttcaggttaataagtggcaatccattcgtctagctcctcccttttgacacggtcacacttaatggtgctacgtacctatgtgatgtacttataacatgtccactggagtccagggtcctacaaatttggtctacaaccgacatggccagacatgattggacccaatccagacattgatgttgcatcattaggactactttgataggcaattaggcatgttggtacatgttcagacgcctccaaaatcctcagtttgatggtacaactcgacgcctgaagttatccgagactatcaattgattaagacattgtttgtggagctcgagattataatatgcagctagtgattactaagtcatctacttcttctatcctaaaatataataatatagtgctgaatatgttcagattcatagtacagaatgcatctcaaccgatatgactaggttcttatattttgacatgaagggagtaatgaaaatctaaaaaggttgggtttcatagtttctaactgttaatttattttctagattttataaatatagagtctaacaaattagatgagaatttaaattgcatagcggagatgtaaattttagaagaagttgtagccactaaaaaaactcttttaaacagatgctaagacatggttagaggatccaactccccatgggccacagggtatcaaaatcatgctaagacatggttagaagtcctccatgctctaaaaaaaaaagaaaagattggattaatccttctgagaggtttttttaaagatacttcattagaccttttacaatatagcaatataatattttctgtgtggcggtagaatcatgaatgtataactccatgcatctaccagggtgctgtacatcaatggctgatactaaaaaagtagcctcttgtaggctgtagcttgcaacaccctacttggatgctgcagtgtgaagtgttctatagatagagcaattacgcttttgaccctactttaaaacttaacagagtttgcttgtttgatcttttttttcgaaacgaagaagaggcctgaccctattccatgaagacaacgtgacggtgttaactcaagacaaaaatttcatttatacccttgtgaatttaacccaattagtgaatattaaattgcaaaaaatatacatggtacaaatttgtgtccaccaaaaacaaaaaacaaaaaaaaaacatgtcaaacaatagcactttcaacacaagcaga

SEQ ID NO: 28853 - DNA, 1501 bp, Oryza sativa
agggcatggagaaatacttttggcttagcgttcctctgagttggaaaccagcgcccccaacaacgcatggtttgctcttgttcggctggggcttgagaaagaaaatgcggcggaacaaagcaaaatgaggcctaatgccctgaaaagctttgcatacatgaataaagttggcgatgtgaactatgtagtctgggttcagatgatgcaggctgattccatagaaattcagaattccccgaaaaaatcttgaggttggaagggagaaaccgccatagaagaagtgagcaaataccacgatttcatgcgtatcgggagtcgggaatgcttcgccgaataccggtcgccacccaatgatctccttcgctggaagaacgccgtgcgccaccatctccttcagattatcttccgtcacatcggagggcgcccactgactctcgaagctttctctttcttccgccatgaatgtgaactgatggtttgatttggttcgagataaggctggaaagagatgggggaatcggtgcggtggacgcgcggagaagtttcgtgggatttttgagaatggattggggcggattggtgaaccctagctccgtcggcgcagtcttgtactgtagcgaggaatggggaaatggcgagagtctcggcggggaagacgaagcgtcgcttagacttcggtgttttgttagagtatcgggagtgctaatgggcctgggcctgtacagtacttcagcccaattttatttccagcgtggcccgttgtgatccttagggacttaggcactttttgctttggcaatttgtgctcacaatgttgtggcccaatgctgattaaatcatttttaatgcggcttgctaattctttagaattaacacgatgcaaacaaaaggtgtctgacagaaaggtgttataccgtttttgtaagctttattaggctgcaaaagctgtttgggttgatttgagatgactggtttattcatagtcattcttttagcatgttatatgcttattttagttatggtaagggtcacagcctaggctattagactcattaattaccatgattttttatcatgtttggtgaatcattttaagagtttcttactcggattcctatcaaatatgtctatttttggaccttttgagtgttcatcactcagcccttcttgtattttctgtccttgatatgttcaagttgagaagtagtcggctgggtatcttactaagtaccatgcgtgcttcgctgtaaaaccactcggttcttgactatatgtttagtttttcaactaatcacatagtcgggggctacacttaattaggtgcatctactcgatacaccatgttttattttcgcccttcacagtcttttagcactcggcaagccggagcaagttgaattgaagcactcggattattattttttgtttcgagaagactgttttggtcgactgcgaaggtctcgggggctactgtggagattatggttaccccatatctaca

SEQ ID NO: 28854 - DNA, 187 bp, Oryza sativa
tttccagattgtggggttgttcttcctgttttttttgtgcaccctaaaagaaaatagggaagggaagtgatactatgcttctcaaataaaaacctgcacggaaattaaagcacatcaatgggtggatattaaaagtggattaacagagtaatccccccattagcaagggggcagttttgtacttaga

SEQ ID NO: 28855 - DNA, 1501 bp, Oryza sativa
tttgactaattttttttagaaacacagtacaaacgcaggcgctcacaacatgcgcacactgtcgaaacaagatttcggcaataataaaaggggtggctatcgagctaggaaagtggatgggtttggagacaaggaattttatacacgttcaggccttcttattcaagaagtaataccctactcctgtccggggatgattccgccgagtgtgttattgattgtatgattgggaaaaaaaagaatcgtgccccaagaggcacacggaccctccttatataggggaaggaatccgtaatatccatatcctaacggaatatgggattacagataaaatacaatcgtaaccgactaggatcccaggtactttcttgatatacaagtttagaatctaacccgagtcctcataaagatattctatctatatttggtactgtatatccagctggaatataactgccatgtagatatggggtaaccataatctccacagtagcccccgagaccttcgcagtcgaccaaaacagtcttctcgaaacaaaaaataataatccgagtgcttcaattcaacttgctccggcttgccgagtgctaaaagactgtgaagggcgaaaataaaacatggtgtatcgagtagatgcacctaattaagtgtagcccccgactatgtgattagttgaaaaactaaacatatagtcaagaaccgagtggttttacagcgaagcacgcatggtacttagtaagatacccagccgactacttctcaacttgaacatatcaaggacagaaaatacaagaagggctgagtgatgaacactcaaaaggtccaaaaatagacatatttgataggaatccgagtaagaaactcttaaaatgattcaccaaacatgataaaaaatcatggtaattaatgagtctaatagcctaggctgtgacccttaccataactaaaataagcatataacatgctaaaagaatgactatgaataaaccagtcatctcaaatcaacccaaacagcttttgcagcctaataaagcttacaaaaacggtataacacctttctgtcagacaccttttgtttgcatcgtgttaattctaaagaattagcaagccgcattaaaaatgatttaatcagcattgggccacaacattgtgagcacaaattgccaaagcaaaaagtgcctaagtccctaaggatcacaacgggccacgctggaaataaaattgggctgaagtactgtacaggcccaggcccattagcactcccgatactctaacaaaacaccgaagtctaagcgacgcttcgtcttccccgccgagactctcgccatttccccattcctcgctacagtacaagactgcgccgacggagctagggttcaccaatccgccccaatccattctcaaaaatcccacgaaacttctccgcgcgtccaccgcaccgattcccccatctctttccagccttatctcgaaccaaatcaaaccatcagttcacattca

SEQ ID NO: 28856 - DNA, 223 bp, Oryza sativa
gctagagaagttcctcttctgtgatccagtttttttcctacaaccaattggtaatttgtagccgaagccctagaatcgaaaaagcaatttcctctaggcaaaatccttctcggctatctataccaaatgttgaataatgcatcagctaagatagctatcagatcagtagttggagcaggtggaccatggtggctattgcagacttcgttaaatctgatggtca

SEQ ID NO: 28857 - DNA, 1501 bp, Oryza sativa
  unsure (1)..(1501): unsure at all n locations
tttataagtcaaaagtttacatacgcgtttcaaatttgaatttgaattcaaatattagtttatagacccaaagtttataagtcaaaagtttacatacccgtttaaaatttgaatttgaattcaaatattagtttatagacccaaagtttataagtcaaaagtttacatacccgttcaaatttgaatttgaattcaaatattagtttatagatccaaaatttataagtcaaaagtttatatacccgttttaaatttgaatttgaattaaatattttttatatatagtatttctatatatatttttttctaactttgttcttttattttttaaaattttatagtatactgtagtagaaagagaataaggggaggaggaaggggggagaggagggagcttatatggggaggggcgcaatagccttacccgaataaatccctccaagtaaaaatgctcgcgcgctcagccgtaacggcataatgtgccttactcgatgctgacttatacttcccacatcccacaatgttcctatctagtatgcgataaaacatttccttgtgcaatgaatctggacaggctaatcagattcatttagaaaatatcctctatccagatttattgtactaaaaaatatcctatcgcatactagatagtactctatccgtcttaaattataaggtttacatttttatacggttttcaataatatattttgaccattaatttattgtatgttatgtttccaatgaatatatgaaattagcatcaaatgaaagtaattcaaaatatgaatttagttatatagcatgcataacacttagcatagatattgttaatataatcattagtcaaaagttacctggtttgattattcttttagtggtaggcgacatacccgtcgacagcgaggcgcctgtggtgacttcgttaatatcaagatatgccggtccagtcttccggaggtgctcataggggtagggtatgcgtgtatgcgttcataggggtgagtgtgtgtggagattatggttaccccatatctacatggcagttatattctagctggatatacagtaccaaatatagatagaatatctttatgaggactcgggttagattctaaacttgtatatcaagaaagtacctaggatcctagtcggttacgattgtattttatctgtaatcccatattccgttaggatatggactgtactttgtattacggattccttcccctatataaggagggtccgtgtgcctcttggggcacgattcttttttctcccaatcatacaatcaataaaacactcggcggnnnnatcnccggacaggagtagggtattacttcttgaataagaaggcctgaacctgtattaaattccttgtctccaaacccatccactttcctagcttgatagccacccacttttattattgccgaaatcttgtttcgacagttggcgcgccaggtaggggaagcgtcaagtttttgccgactaagtgcga

SEQ ID NO: 28858 - DNA, 192 bp, Oryza sativa
gaagggacggccatcgaggccgacggggagagggaggaggaggaggaggagggacgactatcaccgtcgtctcctccgcaccccgccatcgtcgcgccgtgcaggcgagatgggagggaaagggggagagggagcggcgcgccagtggggagaggggagaagaagggaagctgcgccactagaggggagaga

SEQ ID NO: 28859 - DNA, 655 bp, Oryza sativa
ctgttctcgcttcctcgcttctgatctcttgcgagcacgagagattggaaggagcagtgcctccgaaaccacaccttcacctgagatctgcaccgggtaggcggatgatcaggttttttgggagtgcctcccgcacgactgctcgccatgtctggagttgccgccgccgctgctggaggaaatggcggaggtggtgcgccgccgccaggagctggagccggtggcgcgaacaacaacatcaacggaggcaattctgcctcataatccagcggagggccattctcggggtatatcattctcctgttcctgttcccactgttagcgctttactgctatgtgcgctatgttcctgttcctgatattcatgatgcctctagcatgttattgcgttgctgtaatgttcctgttcttcacattcatgatgcgcatagtatgctactggttatgttaagatcaacctacactgcttatgccatgattattgctttaacattttggattaaaatatgccgattcttgaccatatttccaacaatccaaaaacctgataggtcattttcggtagttggctttgctgctgcactgaaaccacatgcttttgatggttctaactataagagatggaaagcccgtgcactattgtggttgacagcga

SEQ ID NO: 28860 - DNA, 217 bp, Oryza sativa
tgtctataaacttagtcaaacttgaaacagtttgactttgcccaaagtcaaaacgtcttataacctgaaacgaagggagtacattctatgcttccacgtggcatcttcaatttcatccttttttgctggtggggcaacagccacaacaacatcgagggcctcgttgatggagacgagaagaaacttgctgcaacttcagttgccttaataaatgagg

SEQ ID NO: 28861 - DNA, 1445 bp, Oryza sativa
tatattttatctttctttcaaaaaaaatatctatagttttatgaaatttactcatttattatgtgtatatgtgtagaccatttttttttaagatcatgccttgtaaaattagatagtaagagttttgcagtgaaagggacaacagaacagaaaaatcaaggtgacctgtgtctggctgtccgctcgaaccgctgcttctaacacgactacagccactactacacagacgatttttctatacaagaccctataatttttacaaacggaacataacttgccgcgtctgaaaaaaatcgagcggcattttcgcatacggctacttaacacgcccgtatgaaaaaataaatttttccatacgggccacttaagagcctgcatataaaatttaaaaaattgaaaccagtttatctcactcatgaactccaaattggatgatcattttttctaaatgtttccaaaatcatgctctatcatgtcattgtgttctttctgctattattttggccattttttcttgtaactttgttttgtcaattaaaaatttgaatttcaaaattttaaataatattttgaagtagtaaataacttcagctgaaaaggtcatcaacagcaaagttgtataactcatcatgatctataacttttgttttggtcatttcttcatccaacaaagtgatagtaatattttcccaaaaattacatatctttcttttattttataaaactatataagagatgtgtaaattttatgaataatgttactatcactttgtcagatgaagaaatgaccaaaataaaagttatatatctcgatgagttatatacaactttgttcttcacgacttttttagttgaaatcgtttagtacttcaaaatgttgtctgaggttatcataatttaaaattttttcccccgggggaaaaaaaaatttttttccccaaaaacaaattatatttgaaacaaagtcaaatagcaaaatgatcaaaacaaaagttgtagatcttgataagttatacaactttgttgttaacaatttgttcatttaaaatcatttactacccgaaaaattatttgaatatcttatattttaatatttaaattttatatagttcaatcaaacttggatggagagatgaccagaagaaaaaggtagatctcaatgagttctacaactttgtttttgataactttttcacataagttgatttagtaccataaaattcgattcaaatttctcatatttttacatgcagccccttaagaggtccgcatacaaaaatacaaccctaatttttttcatctccctacaccctcttttcgctcccaatacatcaaattttttccaacccatctccactctcaccccttctattatatcactctcccccctctctctcacctctcctctccctctctttttattttgtcctctccctctccctcta

SEQ ID NO: 28862 - DNA, 1212 bp, Oryza sativa
taaagtattaaatatatgctaaaaaataattaattacacaaattgcgactaaatttgtgagacgaatcttttaagcttaattgctccatgatttgacgatgtggtgctacagtaaacatttgctaatgacggaattaggcttaataaatttgtctcactgtttactgatggattttataattagtttttttattagtgcccgaatactcccatgcaacaccctatataatatctgatatgacacgctaaaactttacacccttaaatctaaacacctcctgtatcctgcataggtagcctaggcgttgtttggtcttagagcaactatgaccgaccctcatcgagacaatgacggtgcaccacatcaaagagatgcctctggtcaagagggttgagctttggaattcatattagtccaagagaagtaactaaacctgggtacacgttttttagataatagattaaataaaatccggccactacatccttaaggatgtatacagccacaacctgggtacatgtgaaagttttttatagttctcatacaactgagttttttttttctgggagtaaattacatcaatgatatacgaacttaacatggtgcaatttaatacacaaatttgcaaaacgctcgtttcagtacatgaacttgtttaatacgtgaaacaagatcacagcgacagacaataactaataattataagttagagtctacttagaatggtatgagcacacataaggggtcatgatacacgctacatgtgcgaatagcctctatttgatatttaattttgttctaccaatgttttcaattcattgcatccttcatctatattttatattactcaggtcccttattatacatttggctgagtacatacatatctagatagtctaatcatatcttgtgcctatatgatatcctgatgaacattcaactaagtactaataatcatagcatgctcatttggcttaggttcacacaatcacacgtaccagataagtttgtgcaccaaaacaagtgtttttgcaagtttatgtatcagattatacctatatcgtaaatttgtgtaccgtcagtgtaatttacgctttttttttggtttgctaggtgaaagcatcatgcaactaattgtgaaaaatatggagtatttcctctgtttgtccatttgggatcgtaatcgttgttcgaatgccttcttgtcaaca

SEQ ID NO: 28863 - DNA, 1501 bp, Oryza sativa
gcttttcatttgagggcagcgttgagatggttgtgttctggtctccatatcaaatactacaaaacaactaaagaaactacacacaaaagacatgcatgataggtcgcatggcaaatcacaacttattttgacacaaccaaaggttacagaaacattattcagatagcgttctcttgttgatttataaccttattttttcttgaacgaaagatttgtaaccttatatttgtggaactacctcttttttcatagatttggttgtaaaaaaaagttctcttaccttctcaccaattaataaaaatccaactgtgcctcaaaacgacacagttgcagtcgtacatggcctaatccccttgaatgttgaatccctgtcaatgcgtgtggtccaaacagagaatgagctacacagcgttggaccagtggagtcaccagatgaatcgaggcaatttaatctattctcctcagggtaaactgaaatatgctaaataaactctacaacaataattttctggaagcatgatgaattaattacaggtcaaaccaccctattgaaccaaacaagatgccaaagctagcgcaaattcaggggagccgaccaagatctgaactaaagaacggtgtctcatgtccctagcagtagcatgtccctactagcaggcatctacttatctgaacctatcattgtgttgagagtattctcttctgtatccatctctgaacttatctgcaaattaggacaccaatgattgattgcccacatcgatctcggatcaggatcataaattttgcacacgaatggccaaatgatttcctttaatctctcggtggatggaccatttcaagccgcatatgcatatacctcgggaagggatgagattgtctgctcgtaccgcatttttcgtactggccggcatgcagccgtaccattcattcccaacaaagctgcttactgtacctgcgtactctcattagtagtttaattggtttccaaacaatcaaaacactgtgattcactgttaacacgttattgtgctcccttattttcccttttaaaaaataagttgcatacatctcttgattgttttcttacaaaactcgtatacacatattggttacagattgagagagttgcaaaatttcggttgttatgattgtttattgattagatagtctaatgcttatttctagtattttgattgcaactaacccagtaacgctcaaaatggcatgacgtatctcgccactagagccacatagctgccctaattgaggttttgttggtgttcattaccttttttaaaaaaaaatgattattgaaacccaacctactcttttaactgtcggtggctttgcagatttggaaaataaacaagaggaaaaaacaaattctaaggttgcagtgcccacagctcagtgagaaaccaaaagtgatgaaccctagctcacatcctcaaagataattggctgatctcaagcccccacttcacttatttcccacagt

SEQ ID NO: 28864 - DNA, 715 bp, Oryza sativa
tctaagccgaaagggcaaaatatcagtaaattttcttttaagacagaaacatttagagctagccgaccaaatggtacaacactgcagctttccccccaaacacttgctgtgaactgtgaagaagtgcaagttgcaaaaatgcagaggatatgatcactgaatccacctgaactacctgcgtacacagtatctgatctcgcgccattaactgcacccccgccgcttttatgctgcaacgggcggtacgcatgggatcatgtgatgctattcttcacctaaaatctgatttgtatctttggggcatgcaaactgatgattccaaagggtctcctcaatcttgccatcctattgtctgagccaattaatctcagctgcagatggaaatttcacatgtatggcattagaattacattgtttctagagaagcaccggcaatgtgatgatagagttgtgggtgcataactctatctgctagagttcaaatcctagtgtccataaatactacgtacatataggtgtgttttcaatagaattttagtgagataagggatatgttagttttcatctctttgagtgtgggttaggaaacatgtatgtgggtgtgtgagtgtagtgttgcacgtgtagcagtgtgtgtgcgtataatcaaaaaaaggaattacattgtttcttgcatgtgtttatacaaaattcctctctttggagccatattagg

SEQ ID NO: 28865 - DNA, 427 bp, Oryza sativa
gaaaacgaatcaataaattgctttttgtgcagctgaagaaccaggaaggtgaaaaagagagaaccttacaccaaaaaaaaaaaaagttactgctttgcagcaaaagagacacctaacaacaaaaacgagggcaacacaaacaggaggaatactaacacagaaaaagaaaaagaaaaggtctaacttttgtgcaacaagaataagctcaagaacactgagctcttcaacatcactgaagaaacttaggctcagggacagtaaacaaatagatatgatagaaacccacaagggtgccagaatctgtaaatgaatccctactgtaatatttcaccagtaaacgcggtgaattctgaataaactcagataagaaacacgcataaaagaacaatttaaccaaagggaacctggaaccgtcactccaaacagg

SEQ ID NO: 28866 - DNA, 1501 bp, Oryza sativa
tcgatcagcgagagagggaaggagcggagcgggcgcggaggaggaagaggaggtgagacacagcattgcggcggatgtcggtggccgtggaggcgactcccatttccacagcttcgaaatcggcggcgatttatagcgccggagcggaggccggaggcggcgaggaagcacggaaaagcttgtgcagcagtggagtgaaaattgggagaaaaaaaaaggagaaaacaaagccaaagtgctgacgtggacacctgccacgtggacggccaggaggtgcccaggagcctttgggccaattggccatgggccttcacgtgtctctccttccttttctttttccagacgcaaataaatacaaaccgaattcctgtaaatcataatacaagacaaaagcgaaaggtaatgagatttctatgctgacactgttgcttgtttcatccaaatgaggttgcttgctgctgttagctgtcagtaaagcaaatgcatacaaggtaaaagcagctttgatttctgtcaaaatgtgtaattatgtggcctttttgatagctaaagcagtgggggaataaaacgtatttgttgctcgatcagcttggtggtgtttagatccagggacttaactttagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggcctactctcacgtcttgttatcagttgcttttggtgactcatagcatcctaggaggataatcactttgtatgcgtgttatgtagcacaacgtgattgtgccaaatctgtcgcgtgatcagcttaactaaggttctttttccattaattcccggcacaaaggcatatgttttcttgtcaaaaagaaaaaaaaaaaggattcaaggacatctggatgaaaccttgaagaaaagataagaaaagaactgcatatttattttcctcttcaactttaatctgcttgaaatttattgtcttcttgataaaaagtagccacttgaaatgtatttgcgttaactgggatgttacagaaattgcaagctcagagcagttatcattctgtcatgatctgacgcaactcaactcaaatgcggtatatcccaatgattggatttacctacggtgcaaatcattcatctaatgccagggaggtaaaaggacgccctcctttataatttatttgaatgaaagaatgaacaatatactgtaagtacatataacaaaaacttgacaacaccaaaaacaaagcttgcaagacatt

SEQ ID NO: 28867 - DNA, 1501 bp, Oryza sativa
acattgtagttcaaggcacaagtagaggacctttcacaggctggaggatcccagtgtacaccatcatatggagctccaaatttagaggcatcaaaagttgcataacgaatccatgcgggaatacgatcaacccatgctccacccccatgcctaaagcgaaatttaaccttggaattgtgagggatggcaggcttcccattgacatgtgaaatcttgattgaccaaatgccaaatttatccttctccatcttgtgttttgcaccattccagttattgaactcaccaatgagctgtgcttctctatatgcatgaagaaaaacctccaagttaaatgcattgaatatttccccgcaaaaaaatgcattaaatattgcaaatactggtaaggtcttaacaaaaacgacaattaagaaatcacagcctcacaagttcagaaccaactacaatcggacacagataacataattttctctcttcatggcattatgttctacccccgatacttaccttaaacagccaagacgtgctatgagtgaaaactcaaaacatctctattaccggcggtgaggagctatcttatgttgtaaaattaactttctgctagctgctaccagacaaagcatagtattgaaaataaaatgaagaagtggtacttaaacaacttgatcagtgatccatatttcctacaacacataaacattagcgaatagctggatgactacattagaacttactgtgcagcaggcgcccattcacgatatattgtggcaccatcaactgtattaatcccaaacttcaaatagcctacaaaagatggaatgagagaaccataaagagttaaaagatgcaaagaaaatagcatatgccgactcttgtatgaaggagtatttgtgcattaaattgaagtagtgaacttaacctttagaaaattcttcaaggcccccctcatgtttttcaatcaggcatttctggtcgaggtatctttttatcctatagttgaagtgatccttgaattcctccaacttagggtccagatcatatataggaaggtggtcgacctcctccacaacagtcaccatggttttgttttttcgcgcagtcgcaggaactgagaaattggtcttgacctttgaattatgaacaatagttagatttacttgaggtggcttctatcacttcgatttatatattgcaatgtaacaatcagttgctaaactgtaccatcttgtataagactggtaggaaaaaagatgaaccgcaaacaaaaacgtagataaatttaaccaaaatcctatccggtcaataagggcaaagattgctactccaccaaagtacagctttggtgtcaccgagatgacccaatacagtattccaatcaataaaaatccaacatttccccacctgaatatattacagagaagagatacatgagagtttccaagcataggagcccttgacagaagaaaaggggaggaggaggggatggaataggggagaagga

SEQ ID NO: 28868 - DNA, 1501 bp, Oryza sativa
tgcattatcagttgtaaaggacagttttttccacaaaagtatataagattctgatttgaggaagaaatgtcttgcaagctttgtttttggtgttgtcaagtttttgttatatgtacttacagtatattgttcattctttcattcaaataaattataaaggagggcgtccttttacctccctggcattagatgaatgatttgcaccgtaggtaaatccaatcattgggatataccgcatttgagttgagttgcgtcagatcatgacagaatgataactgctctgagcttgcaatttctgtaacatcccagttaacgcaaatacatttcaagtggctactttttatcaagaagacaataaatttcaagcagattaaagttgaagaggaaaataaatatgcagttcttttcttatcttttcttcaaggtttcatccagatgtccttgaatcctttttttttttctttttgacaagaaaacatatgcctttgtgccgggaattaatggaaaaagaaccttagttaagctgatcacgcgacagatttggcacaatcacgttgtgctacataacacgcatacaaagtgattatcctcctaggatgctatgagtcaccaaaagcaactgataacaagacgtgagagtaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccaccaagctgatcgagcaacaaatacgttttattcccccactgctttagctatcaaaaaggccacataattacacattttgacagaaatcaaagctgcttttaccttgtatgcatttgctttactgacagctaacagcagcaagcaacctcatttggatgaaacaagcaacagtgtcagcatagaaatctcattacctttcgcttttgtcttgtattatgatttacaggaattcggtttgtatttatttgcgtctggaaaaagaaaaggaaggagagacacgtgaaggcccatggccaattggcccaaaggctcctgggcacctcctggccgtccacgtggcaggtgtccacgtcagcactttggctttgttttctcctttttttttctcccaattttcactccactgctgcacaagcttttccgtgcttcctcgccgcctccggcctccgctccggcgctataaatcgccgccgatttcgaagctgtggaaatgggagtcgcctccacggccaccgacatccgccgcaa

SEQ ID NO: 28869 - DNA, 626 bp, Oryza sativa
tggtgaataccggcggtggtacaccattcgtgtcaacggtgaagctaagcccgtttaaagcttggcctacccgaccgacaatcagtcactctccctctatgaacggaagagcatgagatcaggtgctgacgtcgatataataaggttggagcactactactgtatttcctaatttccggccgtcgtagtaattaaggagcagctcatttaatttgcaccttaatataatgtacaaatggattggagaagaacctgtatattctctgattttactaactcctaattttctatatcaacctgtccttttgttccttgtggtgaaaaatatttacattaaggataaagtttgatcagactttaatttttataccctaactattaattttacagtaattaatggaagtgctcttggattcgtacgtacactattttttggaaagcatagaacccttcttatataagtattatttttcaacataactcatttcctttttgatggttgatggtcaaagttttatattgtcacaaacatcaaattttaggactagtcaaatatttacgaccagaggaagtaagtattcatcgtcaatttgtttttcaattgcatgtttcctttcatattcagg

SEQ ID NO: 28870 - DNA, 234 bp, Oryza sativa
tagctcatcacatgggatcacaacctgataaccgcaagttcgcaacaagtacttttcagttttacaaacagtttctctgtttctgttcccgcgccggctataaaagcgccaagctttttgggacgctgcagctggagaagacgagaacgcaaaaccaatcagtcgcggcgaacgcggcgggcggaagaggcgaatcgcgtaacgatttttgttaaatttgtaaccggccatgga

SEQ ID NO: 28871 - DNA, 1237 bp, Oryza sativa
caccccccccccccctccttcctctcctctaagtggtttcttttttttggtaccgcattactttccatttagtaaatttatgcacataaagtttatacacctcaagtttacacatataaagtttagagacccaaagtttataaatcataagtttatatatccgattctaatttgaatttgaattcaaatattttttatataaagtatttctatacatctaaagtttatacacctaaagtttatagacccaaagtttataagtcaaaagtttatatacccgattcaaatttgaatttgaattatatctgattcaaatttgaatttgaattcaaatattagtttatagacccaaagtttataagtcaaaattttacatacccgtttcaattttaaatttgaattcaaattttttatatatagtatttctatccataattttttctaacttttttttatttttttaaattttatggtgtgttgtagtaggaagagaagaagggagaggaagggggagaagaagagtgtatagggggggagggacgggtgttcgctagaagtagggggaagtgatcacccgcccactagcagtaccttgatgctcgttgccttggtaggtgatcgctaggagtagggggaagcgatcacccgcctactagcagtaccctgatgttcgttgccttggtggatgaactgccgcccgcgctgtgaatccatcgctcgatcgataggatcaacaagaatacgggctcagatttttctaaggacaaaattgcccctttctaatgggaattactctgctaatatcacttttaattcccaccattgatgtgctttaattttggtgtagatttttatttggcgagcataccaatttaaaaccatggacttattgttttatgtaatttcagctacgagtctgacggagatatgtgcaaaaaaccaataacttcgtcctcaagaaacagagcagctaccttagctgtttatgtagcggctccagtgcttgtagtcgccatgcttgttgtagcatatttgatctggagagccaaaagaaagccccattgtgtgtaatactataatctgcattgaaaaacacattgtttaatatctgcatttaatactgctaaacatgttctttctccaccagtttctacagatgattctcccacggtaccagaacagataagtcctccaggacattggacaaatcattgggaccatctacaaaaacctgaga

SEQ ID NO: 28872 - DNA, 1501 bp, Oryza sativa
ggacagtcaaacgttggacacggaaactagggtttgtctttttttgggacggagggagtatgttattgacaacaacaaacaatataatattatattatgaaccgaccaatattgtgtagatactatatattactacaccagaagttcaactgatttattacagaaattaaacgagacctagcttaatcaacataaagtcaacacgtacgcaatgagtcaaattaaaagaggagaaaaagagaaggtagctagaggaagaattgaatcaacacaaatttcttttgaggcaatcaatgcaaatcaattgaagtcgtttttagtactatttggcttgagatgtatatttggtactgtagggtgcagttttaaccccatgatcccatattcgatttctcaattaaagtgctcacattatctctttggctgtcaaatgtttttttaactttcaaattaaccatgccatgtatactaaactagttcatatgtgctctcgtgagcctagttaattttgccccccaaagaacctgcctctttgtaactaaatctggttaatttgatcatccgagacgatatatatgatgtagaggtctaggctgacgttaattgttaattaataactcagcgatgatgatctgctgcagctgccgtggcgtcggcttgagccttttcggcgtcggcgattctgcggtagaaggtgcgcatctcgtcaaactgccgggatctcacctacgtatttacacaccagatatgtattaattaacatctacaggaatatatatattacgtcaagtttttttatacattaatatatttaataactagtacacaaattactttttaataactagtcaaaagccaaattcctagcttatcaaaacaattgaacacatatttaatccaactatagtaaattttatataattttccttattgtaaatacattgaattgattggttacataaccctcaatttttttttaatttacctgggccctcttgtaaaagatggcatatctaatgagcccttaagaaaaaaaaaacaaaccgaatataatattgcttaggacctcgagtgattcgattttgtaagtttagggacccattatatctggtatttggttcagggatgaattgcaaactcggcgatagattgagggacctatagtgaacttattcctagccaaagagaccaaatttgcctcatagacccaataagctcagtaggtggcacctaaacccaactttttttttggatttttttcttgcatatctgaaatactccctccatctcaaaataacccatcttaggataacgaagctgaataaaggcttatctagattcgttgtcgtagaaagggtcacatcccatcctaggttgaattgttttgggacggagggagtaggtgcacgggttgaggaagggggctagagagagtaggctacgtgagaagtatatgaaggcttggtagcggtagccagtagcggaggaagcgcgcgcggag

SEQ ID NO: 28873 - DNA, 1501 bp, Oryza sativa
tgaagaatccaaataccgccgcagataatgcggtcacaatggggtttgctctcattctcactgtttactaacaagatcatctcaaatgttagttagtacacctagttagtccttaggaaaagatgaaaacatcaagaaaagagagtggtaagagctcacattatttctcttgagaactgcaagtaaattaaacagcgcagtttgcgttcgctgtctgctaacaaggtcttttactcttcagtgacccaactgaactgtaaaaaacccatgtttcagaggagcaaccaaacaacattcaggcaatggcagcagtacacacaagaaggaaaacaagaaggagctgcagacttacaggcacaaacagaattgacgtcctgtacacgggtgcaggtatgcaaagaggatgaaaattaagcaccgactgacctatatatgacttgttatgctggctggctaagctactctgcttggactgctgtttagccttgatttggttgtgaaataaagggataactaaaataacatgattgatagagtagaatccggctaacttatgcaggggaagtatggagttgagttccttacacttgcactcaaagcagctgactcccgatcctacaatctagctactctgcaacttgtttcataaggtatgctagctagcaagtttgcacacaaagtaaggccagcattgctctcaaggtctgcacgtattatattattatacttctctagattaacttttgacaatggttacagcggtccctaccagtaacagaaacaatggtgtttggatcagggactaaaattttattccctgtcatatcggatgtttggacactaattagaagtattaaacgtagactaatgacaaaactcattccacaaccctgaactaattcgcgagacgaatctattgagcctaattaatacatgattagcctatgtgatgctacagtaaacatgtgctaattatggattaattaggcttaaaaaatttgtctcgcgaattagctcacatttatgcaattagttttattattagtctacgtttaatacttctaattagtgttcaaacatccgacgtttaatacttctaattagtctctggatccaaacaccacctagttttatctaccttgtatctattatcatacttatgttatgggtaatttttatcatccttgagaatgtatgacatttgtagtgtaaaagttgatacctccagttactttcttaagtactgtaaaatttctcttatattatactgtattactaagatagctaaaaaaagaagccgccatctctgttttggaggtgtagaaattaccaggttaatcatatcagagaataaaaaagatatacaccatttggtcattgtgagtttagattataaccgtacaaattgattgataaagttgtatataaaatacagttgcacactacatatgaggaaaaaaaaagtattgtacacccaatacatgtatatctttaaaatcct

SEQ ID NO: 28874 - DNA, 1501 bp, Oryza sativa
cctctcttcatcggaacacgcacacttggaccagtctagtataatcgggctctacatatggaccttttcacttttcagttgcctttttgcacttatatggccctttttgagtttacagatctaagggcttgttcagattaatgtcattttaaactatattattttttgagtaaagttaccaaatatgtccatctatttattttcttaccaaattctgataaataaataagaaatcttggcaatattgccaaatcggaaaaattttggtatccaaaattcggtaaggtttattttggctacaatctgaacaggccataaacgtgcaatatttttaaggacctagtaattcatatcacccctacaggttttattttacttttaaatttacttggcactgtagaaaatctcgtggcaaataaggtgtagcaatattttttcaaatcaaacataaaagttgtattgtggagtaatacatagtcacctctaaaattgctttagaatgtagaaatcatacattttgattaaaaaggttgaatgcaagtatattggaacagagggagcaggagagatagaaacatattcacatgtaagagatttttaatgtgattacagtataactacaccacaacacaaaaattcccaaattatttgctgccaaattagtacaactcatcctaaaccaaagcacgaggtacaagcgcgcgcgcgcgcgcgcgcgcgcacacacacacacacacacacatatatatatatatatatatatatatataggtaaattaactggtgctacatggagtatgggctccaagattcaaattgagtatatacccaatttgaatgagcatgaattttttaaaaaatatttagatatgaacattaacttctttactaacaagttcaaacaagtttgaactgagtttgaactttttttggttagattttggttctaggtatataacattcaaacatataattcgttaggtatgtaataatgaattgtgaaataaagttgagtttgagttgttttgttgttaggtatatgtatgaatcaaattcatatacctaggtatatactcacaatttgaaaatttttaaaaatttgagagaatttgtgtgttttataccttggagcctgggcaccatggagtcccatatgggtatcatatatatatatatatatacatacatacatatatacatatatatatatacatatatatatatatatacatatatatatatatatacatatatatatatacacacacacatatacatatatatatatatatatacacatacacatatacatatatatatatacatacacatacacatatacatacacacacacacatatatatatataactatacttcagacaatatacaatatttcaagaacactatttattcggctgattactattcagtttactgttcaaattactgttcaatactgttcacttcgagagatattttaactttaggatctttgcagg

SEQ ID NO: 28875 - DNA, 385 bp, Oryza sativa
gcgaattcgagctcggtacccttctctttctggttccgtttcctcttcctttcccaaaacggcaccacatctgtttcccgcacctttcctttctaggcaacccctcctcccgtatctttttcccctccccctctcggacttctcccagccgtgcgcctcccccctctcccagccatgctcctactttgccctctcccctacgagtccctccctctccccctctgccgggcctcccttggcccacctaatcctattcaatcttcccctatataagccgacctctcccctcctgtttcctttttttttgtgttgcagccacccctagcctaccttccccttttcccccttttccccccttcgggggttttttttttttttaaaaagc

SEQ ID NO: 28876 - DNA, 340 bp, Oryza sativa
gtacagatctatctccgaaccaggaatgtaccattccaaaccaggagcaaatcaaattattaccagttatcgcatcatttattatggtgaaaagtgtgagactaatcacgaaagacattgttatacccgctcataaccgcaggcacggctattcgaatagttttactctggctagaagtgtaccactatacccacaagacatgattccacacatgttaccatgccttgaagtaccaccacggcactacaaagggggaaatcgtgacagtacccttcgcacaacacaactcaaagcagtgcaccgtacctggatcataatcacctccttatagacaaggca

SEQ ID NO: 28877 - DNA, 1501 bp, Oryza sativa
ttcttttttttcatttgctgctgcagcatagccacagcgctgtcaaagattgggctcccaacaaacgcataaatacccacactgccacacagacgcaaaaacaaatatactacatttgtcctaagttcaacatttcaatatttataaattcatatagtttaacatcataagttttatattctcaaaacttgtcgtgagaaatgctttcttaatattcagttcatatgttgttaaactatacaagtttctaagaattaatggtttggtatagaaatatttgatttgggataaacctaaaatgatgtactaccataataaaaatgtccagtaccattaggttggaaagaaagtgagcttagagcacaaccaaattaatctaactagtgttgatttttttttaaaaaaaattgctagtgttactaaatttctagtgtgtactatagtagtatatactaacagttagcagaagcaatagttaaactgctcacagttgtgtacatcaaatttgtattagtgtacattaaatctcacgctagtacttgatggactctcattctgtcgtgcttaatacagcaacaaataaagtcaataagcgtaagcgatgaagaaaatggatggtgtggcagagatattaagcaggaagaacacacaacggctcttcttcaattcggagatgagaatcagacagacaccaccgagatcgacgcgatgaagacgatcgatcgccgacggcagccgtagccgccgccgccccctaagccggccgccggagcagccgcctccatcccctcgcgaaccgccggccgtacgtgcaaccttcggtatccaaatttacagttttaaaaaacctacgcacttttttattcaacagttatatactctcaattttaattagcacaccactgcttaagtcgttggtaggactaggagatccttttcattaaactagtggatttcccgcgtaaatttcttggagccttgattttcaaagcagaataggattcgatatacaacttttagtttatgtttttcgtttgtacagttgtagccttttatatacagtaggattttaaagatatacatgtattgggtgtacaatactttttttttcctcatatgtagtgtgcaactgtattttatatacaactttatcaatcaatttgtacggttataatctaaactcacaatgaccaaatggtgtatatcttttttattctctgatatgattaacctggtaatttctacacctccaaaacagagatggcggcttctttttttagctatcttagtaatacagtataatataagagaaattttacagtacttaagaaagtaactggaggtatcaacttttacactacaaatgtcatacattctcaaggatgataaaaattacccataacataagtatgataatagatacaaggtagataaaactaggtggtgtttggatccagagactaattagaagtattaaacgtcggatgtttgaacactaatt

SEQ ID NO: 28878 - DNA, 1501 bp, Oryza sativa
agaccacgcgggatggacccggcccaccggctctctctctctctctcctccccgcccgcgcgcgcgctttgggccgccttcttgggccggccggcccattaagctcggccgggccgcccctttctctcgggccgcgccctagccgcccgaggaaagtctaatttccctccctccttcttttcttttcttttctttttcaaaaaggatttaaataaatccttttcctttagaccaaaaatccaataatcttagaaattcaatatcttcccaaccgtaagtccgtttgactccgttcaacttccaaaattcctcaaatctcgagatctatttaatggcacacttagaggtcaataatagggctttattttcgccgttggcttagttgtcccgtttcgcgtgtagtttcggagcccgaagacccgcagtgcgaggatttcgaggatcaagctcaagatctcgagcgaggcaagccacctttgaacatcttgagcctatatttgaacttaattatgttgcttgaaaaatattatgcattgataggattgcacttaatctgcttgtcccgtctgcaaggcagattggcggacctacctaacttgttgcatttgacccttccattgtaattgttataccatgttcccttgtaaccgcctagttgcgcctcagtaatcgtgcactctgcacgagtatcgacggtcgccttcaaacttaaaatctgagaaacatcttgggtaaaacttgggttttacaaaagatttggaaaacccgacacctgggtcggtgcttgcgaacctaaatgaatttccaaaatcgcggaccggggaacgtaccgggtgtatggtttcccgctcttgcacttaaggaccgtttccttggaatttcatccgaacataagacaagtacgaccacatgggtggaatgggacacccctggctgagtaactagctaatcgggggagccatgatgccaagagacatgtggattcaacgggatggtgtcggggaggacccccgggtttcctggcacagtatggtctgggacctaatctggtgttggtctgggacccctctcattggcatatggtgaacctgtgtcggcttttgaaatgccttgtcataaaagccttaaggtctctagtcgtggctgttctgcacgggctggatgatccgggttagtaatgtcgtgtgggtaaagtgtaccctctctgcagaggttattaaactgttcgaacagccgtgcccacggtcatgggcggatgtgaggtgattcctagcgtagttttgtttgactactgcttgtgaaatttgctgatgtggtttgggttcgatgtttggaaaacctgcggctgatgggatcagccaggcccgggtggccgtttaaaagccgttggccgggtgccaaccttgatcaattcaaaagactgataccttgcacatactccgaccggacaagacgcactgtctcatccgtgtcgtttgagaagcactcacttagttgtttc

SEQ ID NO: 28879 - DNA, 1501 bp, Oryza sativa
ggagcttcatgtattctaggaagtgaaagaagtttaaaatcagataaaatggtttatgacttgttctatggtttggttctttgtagagatttttttctggagctaaatattcttaaccattaagctcaacattttttagcacgcggtgtttattctgctctctttctttttgtttccactcattttccaaatatttatgtgcaaaaaatatatgttgtggaatgttttacatttagatgtgtgcaccttgttgcaatttttacttctttgttcagccactagctcacaatgtgttgcataattagagttgtgcagcgcacttgatatatagaaatttatattgcattatattgtgagaaagaaagcttctgtactcggttgtttcacttttaattatcaccgtagcgttagcacgggcttgtaactagtaagataaggggaaaaagttagttagagacctagattagcaagaaaaaaaaaggggggggggacaagaaaggaaagatgggcccagatcagcatagactccaaaatgttggaaccaagtgctctcttctctcatgacgagatttctcacttctgaacttcaatttctcgtcacaaatcgcctgctaactacgattccgccccaccacctacccttctagtctcatcaacaatgatctaattatgcaacacattgtgtgttgcataattagatcataaagctcctctccaaatatattcttctcctaactcctgctcctctccaaattctaattagatcataattagaatgcaacacattcttctcctaactcctgctcctctccaaatcccaaatcccatattccaaatccagacgcaactttgatcgttggattcttcggcttcttccttcttttattcccttcacttcataaattggctctcctctcttgcggcacaaatctgatcctccaggtttgtgttgtttcagaccgtaatatctgttcttcgattcattgcccctccttgggcggattctccttttgctcctcagtggggcactctatagggctattagcagtaaaatagattggtttcgatggaaattcggcagaaatttgcgttttttttttgtttctgattcacggcggcatcaaagttaggagtttgattggaaagatgcgatttttgttttgcttaatttatgagcctcgttttctccagatttaaattcggctggtactcctttctatggagggcatgtccttgctgctggtccttctgatctgggatttgcccataaaaatttcagtcttttttgtgcttgcagttgaatactaccgtgcatttggtggaagaacataatcctacctcttggtgtctgcctcctaataaaggactccagtatcagttggggcttgtgaattatgatactttatgaaccatattgtgaaacaggaggaggctgtcaatatattggtagctctaatagtggcgtactttgagtagaattgagggagacaagagagaacaa

SEQ ID NO: 28880 - DNA, 470 bp, Oryza sativa
aattgagaatttttcttcggatcccccattacatgaccctatgggaacatttatagccctcattactggttcttactactagggttgtggttatacatgggaaattacatggttgcccttatgaaagggacatttatatgggtacatagtgtaattgaggttcacgggcccctgatgggcagtcgggcgatcatcggcccaatagcccctaggcttgatgggctggaaagacttcttcggtccttgcgggggcgaacttgctatggcgccttcggcatatactcttcgccctgcatccttcgcccaagaggccttatggcttggcaaggtacccatgtgattccccgcctctcgccgtcgttattccatagtcttcgccatggggggacttcgccctgactaatcttgacgtctcgggcttcaatccccactgttcgcatggcttcgacaaaaaaaaaaaaagggcctca

SEQ ID NO: 28881 - DNA, 177 bp, Oryza sativa
tgaatgcgcagctataggctatagctagtcgatccaggagcaaagcacagcgacaatcaagctagctaagcatgctaatgatcgatcgagcttctgctagcagctagctgggcgatcgatcgaacagcttaattgttggttgataagtttattagcttagcaaaagcaggtcgaaga

SEQ ID NO: 28882 - DNA, 394 bp, Oryza sativa
atgaatgtaagcatttttccctcatgttaccttctctcgattttttcctaacatgtttgtctagattaaatttttaagagagaatctattgaatttgttgttctataatatgctactgagccatacttaacttctataatatatcattgttgtgcagtaagattcattagtattgtatactcactccgtcccaaaaaaaattgaatataggactagatgtgatatattctagtacaataaatctggatgtatgttcaaattcgtgtgtcacattcaatactagattagttttttatgagacagagagagtaatttttttaatgaccgaagtacccttgagatgaaaacttttaaaatctgctgaaaatttcgaaatatcatattgtaaactagc

SEQ ID NO: 28883 - DNA, 201 bp, Oryza sativa
agtaatccacacgccagaaggtacgtgaggcttcccgaatgataataacacactgagcaccgggacccacctgcctcttgagttcactggtttctcgtgttgcgttgcgtaggtgagccagccatcttttaccggccgctttccttcccttcccttcccaaaccctaacccccccaaattttccaaaccggttccccggcg

SEQ ID NO: 28884 - DNA, 1501 bp, Oryza sativa
gtggatcgctctgcgcctgtgattcctgtatatgcgcaagaaaaagtggtccaattattgtaactgctcggtgaaaggtatactaggtcatttctcctacaagaaccatcaataccagaacaaattggagcctaacaagtgtaggaagaatccactgtccatatatgttttttcaaataagtgagtgaaaaaaaattgaaatctctacatagaaaagtttgttcgttaagaaaaactccaaagctacacactttctttcgtgccgtgtaactgtcaaagctgttgtggactaccactcggcctatctgacaacaacctttttgttttcagactcctcgtacgtacattaagctttcacatctctcgggggtaaaaattctcctaattgttcagaagaaatgtacggaggatactaaacatgacgttgaacttatcaaaagctaccgcagtaccgctcgtggcacttcagatatctggtcggtgctgctttaggcccatcaatccatttttcgtggaaaaaagaattaacaggagttttagctgcaatttacatgcttctttctaaaataaattcattttctaggggccttttgatttggaggaaaaatataagaattttagaagattcaattctataggaaaattttctataaagatttttgaaacaaatgattgaatcctatcctacattgaaattcctatggaatgattgataaatcctataaagattttggagaaaatttagcaagagctcgaacctcttgaaaattttcttttgagtctatctctctcatattttttttcctactatccaatcaaacagtcatttccgtgttttgtaattctatgttttgcacttatattcctaacataatactgtgtttttctattcctatttttccattccgacgatttaaggagagcccttagcctctataatttatcccaaaataagttccattttacttccttacataatcctagcacgaggagttgtatttttttaataccctttatatctacccttccagtaatactattttcttatgaataagaagtattatgatcttttacccttctattctaatctcaactccgctggttagaaatgaagttatttagagaagggaatatatatattatctatcataagaaagagggttaaaaggagctatatatgatgttcgctatgaagattattgtgtacggtgttaattcagaatgagaaaattaaacaagcaccatttcatcgtggcgagtaatccatattatcagtatagattgcacggtatatttgtatattaaattgattttatttatgaagcataagtgttgttatcaaatttaagagtaaattttactttgggtcaccttttactactggtgttttgctttggaccaccctttaactaatattttcactttgaaccgaaaaatcttacttttgtgtcactttggagcacactcaaatcttttatctatctacgtcaaacttgtcatc

SEQ ID NO: 28885 - DNA, 1501 bp, Oryza sativa
attgaaccacttgaccaacagactaatgggccgctgaattaagaacgttagcgcaagaacccacatcaccaattggttaaatgcatcattacgggagcatgcatggtttaattgtgttgtttttattttacaactcattgtagcatatgtatttcttacattattttttttaaaaagaaaacatatacattattttttaaaaaaagaaaacatatatatgttttcttttttaaaaaaataatgtaagaaatacatatgctacaatgtgagctatgataccaaaactattgctattagagcaagttcaatagtatagcccactactagctccaattcatgtatagccaatctaatagccaattcatataatactacctccatattttaatgtatgacgctgttgactttttgtttaacgtttgaccattcgccttattcaaaaaatttatgtaattatcatttcttttattatggcttgattcatcgtcaaatgttctttaagcataacataaatattttcatatttgcacaaaaattttgaataaaacgaatggtcaaacgttggttaaaaaatcaacggtgtcatatattaaaatacggagggagtaattgcttattatactattaatatatggtcacacctgtaatacacacattgtgtcttgaagtccatgctacagctgactataaatctgtagctcactgcttttctctctcatcgtttatctcattaaaatatgtttatagctagctaatagcctgctattgtacctgctcttagctgaagaaaaagaagaggattaatactattgggctgctcgcacgttaatgctagaaacaagaccggctgcaaaaccccccatatacttcgttaggtcctcttggtcaacccgatattgacagtggtcaagtacttgtgcgaaggttggttagaattagaattccaaacaatgcgtgctcacatatgtaattattgggctgcgtgtgtttagatataaaaaaaatcggtattatatcgaacaaagataaaaactacattgtgatttcgttaccttattgatcgttgcctccacgcatgatgtcataattgttgtcaaacatgatattagtataagcaaaattacttttcttggattttgtcgaacgataatagtgggtgatataatattgtcttggccaaaaaaaaaactatgtagttctacatcttgggccgcgcaacatggcccagcccattccgtggggcagactgcgaaggacgccgcctcccattccgtggtgctctggaaagtcgaggcgcgacgccggcgacgtgagcgccattggaggtcggcggcgagttcttcaccggcagattctgctcgcgactccttccttgcactgcgatctcaattcttgcttacttgcgctgttgattcatatggcttcttttggtcttctgctcttgtgcagtttccacgcgcaccacctgttcgacgaaacgccactgcgtgatcggccgcca

SEQ ID NO: 28886 - DNA, 351 bp, Oryza sativa
tacagtagctcatcaatgcaaaacaaacagatatagtttgattagccttaaaatattacacgcttaattgtgtaatgcgtatatcaagctagggtttgatattaacccgtgcatatcagttgatcaacacatgcacgtgaagcactcagtcgctgttgatcccatggactgaattgccccgtgtcgtatgaaggttacgccggcacctgtacagatcgtaccaggcgacgagcagacacaccgggacttcgtctcgatctcagccggtgcgtgaaaacaagaaaaagaaaagtaatagaagattagtctgcagttagagaatgatctaactagtgaaaacgacaaagccaa

SEQ ID NO: 28887 - DNA, 1501 bp, Oryza sativa
ccgtctggctcaagagacagccctgcatctcctcgtgggttgcggatatacaagaagaatctggagggaattggctgtttgaatgtcatataacatgttgagccctacctaatgggaactggccacgatagtacatgaatggtgagaggcaaccggaaacataagaggagtgccaaagcaagcaattcacaccttaatgctactggtctcctgggagaattggaaagaatggaatcaaaggaccttccaacacagagagctctcgacgcctagcctactatccaagatcacagagaaagcaaaaaacttgggcccttgccggcacaagaaaactcgtggattggctaccttaggaatccctacggcatataactactttatctatatacttcgttcaatttatattataagttttttttttctaagttaaactttttcaagtttgactaaccttaaataaaacatagcaatattttcaacgtaaaacaaacataacatcaaaatatattgaacgaaaataattgtgttataaatgttgctatatattttatataaatttgattaaatttaaagaagtttaatgggaaaaaagtcaaaatgatttataatatgaacttatatactccctctttccacgtaagttacatttattacttttgtcaccaagaataaagagaaattaactcatcttacatgtaacaaaaatgaagtgtatgcacatatacaaccgataagtattaagttggctcgtcgggttctgatcaaacattcaagttacctctctatttaagttttagatgtatataaactacgaataggaacaattcatttgaaaaaactaaaatatgaaaaagttctagctcttaaggatggtgggagtaatatgaaacttagttactttcggacgaagtggatcaagctgcgttctactccctccgttccacaatataaggaattttaggtttttgcttgtaacgtttgaccactcgtcttattcaatttttttttgcaaatgtaaaaaacaaaaagttgtgcttaaagtacagtagataataaagtaagtgcaaaaaaaatctaaataagatgagtggttaaacgttgtaagaaaaactcaaaatcctttatattatgtattatgggacggagggagtatgtctattgtgctctgatgggaaataattagttggggggggggggggtgggaaacgaggaggcatccccgctttttatttcagcgccgcaaatacacagagattgttcgtcttcttcctcttcacagcccaaaccaatcgaggtttgcttcttcctttcttccaatcatcgtttcttgcatctgatctctattctctcctcgatcgccagagctgcggcgttgtcgaatcttgctgacggttgatctgctgcttgcttggtttcttggttttcccctctttgcagcttccacgcgcgccacctgttcgacgaaaggcgtctgagcgggtgctcagcgcgtcggtggcca

SEQ ID NO: 28888 - DNA, 202 bp, Oryza sativa
atcaatgaagaaactcggggatatgaaaaggatcagataaattctacaacatagaaagggttagtaatatatttaggaggtatacaaagaatttctccatatgtgtaccttgccagttacttgaggtttaatttgaacccgcaactagcttggttgattaaacgctagttcatcaataattgtctttctcttgacaaatagg

SEQ ID NO: 28889 - DNA, 1501 bp, Oryza sativa
aatgccctactcctgtgttttggtggatctgtgtatgaaggagctacaaagtgtgagccaacctcccccttgttctaggttccgactctggaaaaaaccaaaaatcccccccttctcaatgggcaaggtcctccttttatatctcaaggggataccacatgcacccctctctttccaaactggacttttcttctcttcataaatggacggagatttgcacggttgccctccgaacatccttctgacgggacggcacatacctacctccacttctgccgggggcaggcgcgtcgtgggaacgtggctgtctgccgatgacatgatcagtgtcagaccggtcacaaatcggtcattcttgtccaccacgcgtcagcttagcaacgtgcatgtttgcccttcttcacacaacatcttgcttgtaatggttaggatgaagcctggcatatatccgaccggggctaacgtgccatctctgggaggtaacacgctagctccagctggggacgagtgcctagaagctctcgtcttgacgggatggggcgaagcgtgcgtcagaccgactgtcgcctcctaacctgcgatctgaccggtctgtgactggccacagaccggacaaacgagtgcactgcactgtatttcgtgcggcgtgacacatttagccgagccgcaataaatgcggttaggtgagccccgctgtgctcacctaacccatacacgcggagtagaacccgcgaggggtcggggcgccttggccctcgggggcgaggcaggagtggtccgaccccccccttcggggagaccaagaggtgggcgcacacatcaccctcgggcccgacgtcccccgagggtgccaggccacgtgggcgattgtgtctgcctcaagcctctagtcgtgatactcccggtcccatgtcaccgacagtagcccccggcgttatgccagggcgatctcccttttcaagggaagcggtcgggcgtgacgccacccctaaagcctggtgacaagtaggaccggcttctacaaacaggcagaaacccaacggtcacaaactacgcacatcggcaatggtaactcggctgtcagtaatgagcggtctcttccagactgtcacattactcgagtagtacacgaatctggacgagccgattcgctttgccaggagataggtgatggcgcttcggtcggcgagcgtaatcaacgcgcacacgatatgatctacctcgaccgccacaaccgcatatccacctcatgcgccgcaagcgggcgaatgggattagtggaagcgtgggcgcgagaaacgagggggcgaaataatgggcgcgagaaacgaggagccgggcacagcattggcaagggtataaaggcactggggaagggatttgtttccttcctttcgccatcattccccttgtcttcgccgcttgcgccctaactccttcttccctgcgcccttctttcgccacacgcgctcgctctccatcttctcttcgtccggcgcca

SEQ ID NO: 28890 - DNA, 1501 bp, Oryza sativa
ggtgaataagagcaataccagcttcggccaataggatgtagggttattaaatgttgtagtaatgtaagtgaattattttttattttgctactaagatagattggttaacattgtggtttcgtgaaatcttaggactaaaatactcatggttatgtgacatatgctaaaactcgtgtgattttgtgcgatttgaactacaatacccaaggttttatgaaatttactctattatttttatttcaaaacacacacctccaaatatagacaaaattaccatatttttctcgctgtcaatgggtatgtcatctaccattgaaaaatatcaatgtgtacaacgcttatcattgaaagaaaaaaaattaacagtaaatgtgagcacacgcgtgaagtttataatttgaacccgagtgtgcatattccaccacaaagggacagctgagctacacacacatcgtagataaacattaatttgtttctaaatggggaagctaatattttcagtagtttttattaatgtgatctcccttcgagtaagtaagtatatactccgtactttacatccgttacataaatccatatcaaatgtattatactctcaaataagtctcccatatattcccaccgttccatattataagccgcttcgactttttcaagtcaaacttctattaagaatagtatcaaattaattttattaaatctagcattaaacatattttgatagtttgtttgttttgtgttgaaaatattattatattttttttagaaaacttggtcagatataaagaagtttgatttttaaaaaatatcaaaacgacttatagattataatatgaaacctcgttagtagataaaagtgcagccatttcactgattttttttttcctacagcataactaaactcattttgtagcagcacacatactgtacaaaatcaatctgaaccgtccgatcgtgcatcgacggcctaaaaccaccttgaagccatttatatccttaacccatcaacttctcttcttttgccttgaagttgaagcagagcagacatcctcctcccattcattcttcccgtgggtgcgtttccggttccgaggcgaccaccaaaccaatcgaggttttgcttctccctttcttccaatccattcttggttctcctcccccttgatcgctggagctttcacccatcgatttctgctcgaatcttgcgctacgttgcccaatcttttttttgctcatagttgagctgctgcggattcatggcttgttcgtttcttgcatcctttcttgttcgatcgctggattttactttgaaataaacattttttgatccaatcttgcactaggacatcaaatcttgcttacggttgagctctggatccacggcttgttgattcttggtgtccctcatttctgcagtttcgacgcacgccacctgttcgacgaaaggcctctgcgtgctcggccgccatggaaggatcgcctggcaagcgcgtgcagccca

SEQ ID NO: 28891 - DNA, 395 bp, Oryza sativa
cccttgcgacggtacaaacacgaactccagctccagcagtgacagcaacaacaacatgctcaacttctgggcaccatccgtcagaaacagcactagtgccccgtcgaatgccactatttcaggggtacactactactactactactactactactactactactactactactttgtgttcgatcgtgatatatacactagctagctacctcatatcatacggatttttacctgcagctggatcgtacctagcggttcttctttctcggacagtacactagtaaaggcagtagtttgtctgaatttacatatatatgaacgatcgatctgtctcgtaaccaatttacatatcgatcgatcgggctgtgcttgcagaacggtacaacgacagcagc

SEQ ID NO: 28892 - DNA, 338 bp, Oryza sativa
ttgccatatatataagacttcttattttgtatttttaacacaggacctcaaagtcttagggacggtcccaaacattagggtggcacgcattcaccatgtgttgtcactcatcaaccgtggccctagcaataaacaaccgacgtgttagatctgggtgtgctccgccattgctagtgatgctctagtgttttgtactagtagtattatactaccggtagaaatgatttgatccgttcattattaagggtaaattagtaatttactaatatatcgattaggggtaattggcatttatatatatatatatatatatatatatatatttgactagatcgata

SEQ ID NO: 28893 - DNA, 283 bp, Oryza sativa
tcctgcagcccgaatacatggaaacagtgcgtatttagatagcaatcctatggattatctgcagacctctgaatggttaatggagactctactagttgttgttgtaggccctgaagctccccggaatagccttgactctccactgtacgaccataccaccatcaccatgactagtactgtatgttgtacttaattgctcctatgcttaatgctcaagtttcttgttaatgcaatcaattagtaccatcgtatttactgtttttctttaataaaaatatttaga

SEQ ID NO: 28894 - DNA, 168 bp, Oryza sativa
atttttggtgtggtcaagattgctaactgctcaaaatcattagacagaaagtgatggtggatttttgccttccgctgttgcagattgacagcggaagctaactatactaacctagagggctccaaaataatgtgcatgcgcactctctttttcatttttgcttctagt

SEQ ID NO: 28895 - DNA, 1501 bp, Oryza sativa
gaagtagcacccaccgaccaccgacggtggcgataccgactgcacggtgaagaaccaccggaacagccgaagagatgggcgcaccccaatgaacatctcacacaggtgcgcgaagatggctaatgtcatcactgcgttgggggtgaggtgcgccatctggagatcgtagaactccaggacatccatgaagaaagaagaaaatggcggaaccagccctgccattgcaaaggggagaaagaagacggaccgccccgggtagtctggcgccgggcgtccctcgcccagcatgactatctcacggccggtggcagattccggcatgaagcggcgcggcaacccagcctgcttctcgctcacgatgcgggaaggcggtagcacgctaccatcaagcagtgcggagccccgtgccatggcgccggacgaagagaagatggagagcgagcgcgtgtggcgaaagaagggcgcagggaagaaggagttagggcgcaagcggcgaagacaaggggaatgatggcgaaaggaaggaaacaaatcccttccccagtgcctttatacccttgccaatgctgtgcccggctcctcgtttctcgcgcccattatttcgccccctcgtttctcgcgcccacgcttccactaatcccattcgcccgcttgcggcgcatgaggtggatatgcggttgtggcggtcgaggtagatcatatcgtgtgcgcgttgattacgctcgccgaccgaagcgccatcacctatctcctggcaaagcgaatcggctcgtccagattcgtgtactactcgagtaatgtgacagtctggaagagaccgctcattactgacagccgagttaccattgccgatgtgcgtagtttgtgaccgttgggtttctgcctgtttgtagaagccggtcctacttgtcaccaggctttaggggtggcgtcacgcccgaccgcttcccttgaaaagggagatcgccctggcataacgccgggggctactgtcggtgacatgggaccgggagtatcacgactagaggcttgaggcagacacaatcgcccacgtggcctggcaccctcgggggacgtcgggcccgagggtgatgtgtgcgcccacctcttggtctccccgaaggggggggtcggaccactcctgcctcgcccccgagggccaaggcgccccgacccctcgcgggttctactccgcgtgtatgggttaggtgagcacagcggggctcacctaaccgcatttattgcggctcggctaaatgtgtcacgccgcacgaaatacagtgcagtgcactcgtttgtccggtctgtggccagtcacagaccggtcagatcgcaggttaggaggcgacagtcggtctgacgcacgcttcgccccatcccgtcaagacgagagcttctaggcactcgtccccagctggagctagcgtgttacctcccagagatggcacgttagccccggtcggatatatgccaggcttcatcctaaccattacaagcaaga

SEQ ID NO: 28896 - DNA, 354 bp, Oryza sativa
aacgaacatgtgcaagagagtttgttgcatctttcgacttcatatatatccacatgatacattgcatttgaataaattggatgtatctatattttatttaatagaaatgacaaacaaccaacctaatggacattatgattttggatctttttgggcaaggcaatgcttttaaatatacaatccaagaaaagaataacttgtcttgttttgcagtgagcggtcaccatagctataatatgagacatgagccaaacataatgctgctcttgcaaaatgtataagaaaattccttgtgtgcctaagtcttcactccatccttctatacatgctcctgattctttctttattcctaga

SEQ ID NO: 28897 - DNA, 359 bp, Oryza sativa
ttgaaagagtttttacgttgatgaataatactgataagtgcaccattcagccctatcttgtaaaatatatcgagggttcagtgacacaaagacttaactccatattttgccaaaatgagtacttgatattaaaatgttcagagaaatgtgggctttccaggaaacacacagacttaattccacccaatacccccaatgaagtcattggctagtgaagcatagacttaactccttaaggcccaagtgctcagggacacataaaccactttttctcaaaacggccaaaatagaattacgtctttgtgtcactgacccctcgatatatacttttttaattatataaatgtactgtttcccat

SEQ ID NO: 28898 - DNA, 453 bp, Oryza sativa
tgattcatctctctctctctctccaaccgggaaaagtacttcttgtctggaatttgctttgcgttaaccctagcttctcttctagatctggaagaagctcttctcttaatttcagagccttaaccttaatacaagtaacagtttgcttgttccccacaaaagtttagggtttcaactgaatccgcatttccccccttggttgctactcatctgggaagttctggtggggcggtttgagcactgagaaagtatcaccattggaaatgagtgcaggtgtgctgatcctgaatttgtcctctattaatattttttttctacattgatttgctctggatgtatgtcacaaccgtgaagaacttatgggttccattaatccattcgtgtactgactgtttcctgcttaatctcccaagttaagtgatgctaatgtgaagttcggaataactttgtggg

SEQ ID NO: 28899 - DNA, 258 bp, Oryza sativa
cgttggaactggtcatcttgtaaaaaagtcctcgattaacttgataattactcttacgtccctcaccctatgttcctgtgttttgtactctttcgtaacagccctcaatgtcttggtatatactatgtgaaggagacaaaattctagatataggaccgcgctctgaaaaaagggaaataagtgtgttttctgcaaaagagaacatccctatcctatcctctccattcccctgaaaccctacacatcactgttctcccg

SEQ ID NO: 28900 - DNA, 1501 bp, Oryza sativa
tttttatattcatgcttgtaaataaaattaattggatgatatattactattatagttttgggctaaaaagttgatcaatgaaggctggagaggtgagccttaattagttattgggctaacttactcccaccgtccaaaaaagacaaaccctgggtttccatgtctaactttgactgtccgtcttatatgaattttttttataattcgtatttttattattgttagatgataaaacatgattaatactttgtgtgtgacttttcttttttatttttttcataattttttcaaataagatggtcggtcaaacgttaggcacggaaaccagggtttgtcttttttttggatggagggagtatgttgttggtaaatttgcaatggttgaatagtactccctccagtttcattttaattaacgttttggacaatgacacggtctacaagatacatctttgatcttatttttccattataatatatataataaataaatatatgtttacttttattatagtactttaaaagataaatctatatatgttgttctagttcctttaaactaaatattattaaagttattaatggttaaagttataaaagtttgatatcaaactcgtccaaaatgtcgattaatatcgaaccggagcgagtacagtattagtagcaagtcagccacatgggacatggcccacatgcatgcacgtcgtatgaacacaccgtgattctttgccacttgcataatattctagcactgctatactacacgacgactgacggcgacgtcagttcagtttagtttgccgcatccatcgcgaaggctactctacccatcccatttttttttaaaaaaaaatactataaatctaaatatcttacattagatttgtatattttaaagcaaagagaataatatgtagatataagtatgtacctactcgctcgagcacaagatcactgcaacaagcattgaagatcgctcctagcaatggtctcaacttaccatgtaaactaagagcaactataatgtttttcttttattaggaatggttgcatcttatattttgagattgagaaaacacatatagaaattatacaggatttagcatttgggatgccggccggattcctgatttcccagtctctggctttctttttaaacaaaaacgaaaaaagcagtgatccgatcgatcacgatgagcgagctagtaagctccaaaacaaaatagagtacgtacgtataatcctagagtccggataataataatccgtttggttcgcgttaaaaaagtcttatctcctcgtgatccctttttttggatcgatccatgttcgtagtacgtgacaagcacgcgcaccaaccgaagcaggtacctgtgtcgctgcctgtgggccccacacaccccaagacggccattaataaacaaacacgacgtggacgaagagaagggaggccggcaagaagcatactagcacgctacgaaaccccccttctcttcgtccc

SEQ ID NO: 28901 - DNA, 407 bp, Oryza sativa
ccaacgccggggtgccgtgctcgccaccacagagagagagagagagaggggggaagaggagagagaggtgggggaagacctctgccgttggccgccggcgccacagagagacagagagagagggggggagaccgctcgccgtagtcgccgtcgtgggccgcgccgcgcgccatcaccgcccccgcaacgcccgtcaccggcctggcgtcctgccgcagttgccgccgctcgccatagccgcagcagatggacagacaacggcggcgccaccctgcttagctcgcgggatggaggatcagcgtagcctactcaggccgccgccggcctcggtgtggaaaaatctaatatgttgtattattgtgttttcttatattttctgatatattacatcgaccctctcatgaggt

SEQ ID NO: 28902 - DNA, 270 bp, Oryza sativa
ttcccaatcttcttaatcccctatccctcaaactcacccttagggctcctttggcagcccaggatcccactgggatcccagcccattccctgggagaaaggcccacgggggaaattgtcacgggttttattccatgtccatttggaagcccacgaggcagggatttcccggcccaatccgcggggaaaccctagggaaaggaccccgaccttcggaggtcgggaatttttcctctctcaatccgccgctgcttctcgctcgcgcaacagg

SEQ ID NO: 28903 - DNA, 1501 bp, Oryza sativa
gtaacagaagtaaaagagtgcaccatatcttcttcttatcttccacgaagggaacagtttctatttagaattattttaattttcacaagatccttattcaaataaattatcctatttaaaagtctgtactgaaagtaccgaaccgttgtatgcattgtacagcgaaacatcaccctgaaataatattgcatatatttattatcaaataatataccatctgcatgccatctattacataatatattcaaattatcgtccctttcttttaacaggatttggtatacagtgcgtccaagaaaaaacgtaaccaagaattatcgatgttttatcatagcttaatcacaattataattaataaatgacacatatatgttaagcttagatcctcctctttcatttgatgcaactcatacgatgcatattgcacgcctgagtgattaaaatcaatttaaagagagggaactaaaaagtcatttggcggaatgtatctgaatttcaaagacaaaaatcacatttctagaaagttcagtttctgcccttccataagacacctcaatcagaaaaagatctctttgtttaaagttatgcttgcatttccaaagatagtagagttataattttcaaattttgaaaatgtgaacattttccacaaacatatgctgcgttcaaactcttcattaaatatatgatatcaataggaaccttgtcagaattacgaagagatatagaaattaataaccgaaaagagctcgttgcccaagctcgtgaccacttgatggttctgtggtggaacgcagggttagtaactatcacatacatgcatttctgagtttcattggttgttctcatgtatctctgcagcttgctcggctagaatcacttcagtttgtctgagaaggcgatccacgaagtgttgaaatgaagttttcggcgatcatcgttgccgccattataggattcatctgttcctgtgcaggtaacaaaaagtacaatttatttgtagttatcgtccggattaaacaaaaattataacgaagaggggattttcttctcttttttttttaaatatgataattccaattatgcaaaactctttctaaggatactagttgttttcgaccatggtgtttacggaaatggcatatcagaacaaaacagactatggattgacgcagttttgcgtcaggcaaatgactcctcgtgttcaatacgcatttgagaatactgtttttcactatttttccatgggcctcggtcccctggacccacctaacgtaaaatatgtgttttcaagcatgtttcttttccaattatttcacatttttcagagggtactagctgtcgtcgaccaaggagtttgcggaaaggacgttacgaatatcagaacagtgcagactatggattgacgcatctccctgtgaattacatcgtgcgcgcagtgtgtgagcctgacgcaacgcttgtaggagatgaattcattatctgccaggacaatggacaa

SEQ ID NO: 28904 - DNA, 178 bp, Oryza sativa
acatttagatttgtgcaatttacattcgtagatacatatttgagcccatatcaccctaggattgcaaaatataacttagttgcttagttagacttgtccctcgccgagcctagcaacttaggttagttttgattaggtgttatttagttttaaatcgcctattcaccctccctctagt

SEQ ID NO: 28905 - DNA, 1501 bp, Oryza sativa
cgctcttcagcctgtccatggtggacgagaacaaggtcgccattgggaccctgggaggcatacctccgctggtggacctcctgcagaacggcaccgtcagaggcaagaaggacgcctccacggccatcttcaacctcatgctcaacaatggcaacaagctgagagccatcgaggccggcatcctgcccacgctgctcaagctgctcgacgacaagaaggccgccatggtcgacgaggcgctctccatcttcctcctgctggcctccaaccctacgtgccggggcgaggttgggacggagcatttcgtggagaagctggtgcagatcatcaaggaagggactcccaagaacaaggagtgcgcggtctcggttcttctcgagctgggctccagcaacaacgccctcatggcgcacgccctcggcttcgatctccatgaccatctggccgacattgccaagaacggcaccagcagagcgcagaggaaggccaattctctcatccagctagctcgcaagtgttcatgagaagaagaagatcgagttaatacgaaccaactgtcagaaaccgcaacagtaattattcttttatatactccactagttttggatcaatagtagatagctaatctgtcatgttcacacacacacgtacaacaactaacatgtaagtgagaaattacaaagattaattgtttgttggcattactgcaatttttgttgtaattaagtctctatactatgctatggtaaatgtataagagaagtcgttgttggtgttttaataggaaaccaagcaaaattaatttactagtatcttattcaggttaaattattagtactagtttcgcagtacattgacagtgactttggccctatttgggggagcttgtcccagctgcagctttttccaaaagctgcttctgttagaagctgccccaaacagtccacagcttctgagaatctgtagttacagattctaaaaaatgaactaagaagccagaagctgggtttcagagattttccagattatcagaagctggctaccaaacagctgcttctcagaatctaaagctctcccaaacagaccctttgtgaggttactgaaaaaaagaagcccaactaacaacacatcagcccaactacaagtagaaaacctccttactcgcacaggccggcccagctctatctcaccgtcgttgccatcctctcctctgatgtccgaccaccgggagggacttcccttccgtctcctctcccggccggatcggaatcgccgcgacgcgcgcaccgacggtggagagggagacatacgcttctccacctcggctccagcctcctctctcgcaagatcctcgcgcccttccctctcgatgtttttctagctagggtactttgtttaatttcgtcgcgtgccgtttgctctactcgatcaaaattttgatgctcttgcaatagctctctggagctgtactttctagatgaaatctatgaattgttagcct

SEQ ID NO: 28906 - DNA, 255 bp, Oryza sativa
cccttgcttttttctgaaaacaatgtagtctattcatctttgtcttgggaagtattaaaaagttaataacaatatattttttttgtctatcacttcttcttttgcaaagagaagtacaactgattggttttttataagctattctagttaacatcacgtagtgtttggaatgttttaagaccttaccaaccaaaagtatccacaaataaaaataacatgtactccctccgtcccataatataagggatttcggga

SEQ ID NO: 28907 - DNA, 529 bp, Oryza sativa
tcgatgtaatatatcagaaaatataagaaaacacaataatacaacatattagatttttccacatggtatcagagccttagagaccaacgtcgttcgatccccgcgtcgccctggggagatgagatcaatcttataatctccctggggcgccgcatctattagctccacaaattatccatagattagattttaccaatattagaattagatcaatttatttttttgccacatcgaaccctacgatctccaggagccaacacaacgatgatttcgtcgcaagccgtcgctcaatagcatcatcaagcagaaggcgaggccgtggcgtacagcaccaccgtccaagtcgccgtgaagcccgagcgacgggaacaccagacgtcatcaagccatctactgttgcatccatctactcaattgagagaagcacatggtgcacaggtgacaggagaatcaagcgtcaagacaccaagcaatccgcatcgatcatcttcgccaagctcctatgaacggccgcgacgcaagccacaac

SEQ ID NO: 28908 - DNA, 1501 bp, Oryza sativa
attgaatagagaaggagaactttagaaagcgaaaggaaaaaaagaaagaagctaagacctttggtccgagctaacttaaaaaaaaaccagctattaaaacttctcgctcctgctaaagcctaagttttggcctcttccttgatcttggctaaaagagaggtagctgaaagctccttctgttgccatcacatcaacctgttatacacacacaacttttcagtcacatcatctccaatttcaaccaaaatctaaactttacgctgaactaaacacaacctatattcccacacgtgtatcagattatagtcaacagcacaagaacatataatcactctaacatgagtgtactaatacatatatagtactagtttaactctagctggtagatagagatcgaacgaaacatgagatgggatttacacgaaactgtgagttgggtcgaagcatctccggtctccacctgaactatgctcgtaaacttgctttcaactagtattgatattgggtggctgggtgaaacgttccattcgttctagaggagcctgtactctaggcccaaacaatttgaaatgtgcagcggttgggtgggctctgcggttaccgggtcatttcttcagagagacgcccaaacagccacagtttgataccgcttcttgtagcatttaagtaaccaaggctggtgcaggctgggctttccatatggatgtggtcaaacactgaaatatgtctcatttttctatatgttgtttggtgtgccttgagaagttgagatggcaaaaaggatagagatcctgaactctgatcatattaacatttgcatgccaaatagacgtataggtcagaagttacaaaagaactgcagccacttgtctggtgttctcctgtgacgggctgacggcaactcttgaactgcatttgcaagtaatggcattgtcatatgccttcaataataatattggctcagtgagattggagtgtacctatcactgcaaccaactttgctatcctagtattttagtgtactaatcaggattagtctcatttaattgggatattacacggttacatttttttaagaaaaaacaagcgtttgcccctgcagtgttcacttttcatttgtagaaatgatactgctccttttgctttaagatactagtatcaagtgcaactacgatcagccaaccaccacaacgaagggataggaaacggctcggtgatctgatcagggtgttgttgtcttcatatcttggtaggacaggcacatccgaagcttcttcacctcaagttcgcagctctcaccaacacaaatactataatatctcttcagaaaatttatgtacttttcatcactcatcgcagctgctagtataaataatcagctcagctggtgcctgttccggaagcagatcatcacctctccacccgtttctttctcggcccatccaacacgcgctcttgcttgaacgcgcaaagagaaacacgacgggcgaggcgagcgaga

SEQ ID NO: 28909 - DNA, 772 bp, Oryza sativa
caataattaataaatagaagagaagagaagatttggcttcaatcggcctgcgaccgagacccccccctaatcctcaacaaatattcgttagcctataatattacattcaagatattgctcttgaaatacatcatctaaattggacgagagatagttaaaaactttgaactaaatttcggcgccccatgactgctgtacgtgtgtagtcccgtgtacccgaatatgtgtgcattatgtattcactgttttgactctcagcaagataagttgaattacattcattttaattctaaagttacaatgcacatctttttaaccattccttatccttccctatcatcttgttattaatatcgccattgtcatttgccctccatttaatctagaacttttccgaaggttaggtgtttaaggaatacaattaagttcgtaattataaaagccgaaaatgaaataggttcaacatagtatttttcagtacagaaaaattgtaatttgaaaataatgtagtttctatttccttttcgctatcatgaatcttctgaaaaaatgggagggggcaagaatttcttgtaataatgttattatgtattgtaatgtttatacttatcaagataacaaatgaatatgtacatacattttgttatactacctgtaataatatatataaaacattgtttatcttacttttggaaatgaaataaatacgaattgaatcggattgaataattattaattctaattcaccaaattcacggctgttgttatcttt

SEQ ID NO: 28910 - DNA, 1501 bp, Oryza sativa
gtggtgttgggtgttagaccgttggttccgctgctgttgttgctgctgttggtgttaaggtaaataagtcctctatttattttaaggattgctatgattcatatttgttaccgtgggtaccagcactatgtcctgggactggtaccgagatcgcggtttcgtaggaagcggttcgcgccgttttccctacgacacgctcctgtcaggtgccgttgtacggcggtatcagattggggtgtgacaatatagaaataaaatttagaaataatagaaattaggaattaaaaaaaataaatattgaagaagagcctagtgtccataaaggaatttacaattaaattaaattcggaatgaaaaataataagattaaaattagaatttagagtcaatatagaaatataatttacaaataactaaattttgaaaaaaaaatattggaagaagagtccagagagcatataggaatacagtgtaaaaataactgaaattaatttttttttaaaagtattgataggtaagtttagagtccatatagaagtacaatttacaaataacagaatttagaattaaaaaaataaggaatgatgaaaggtgagtttagagtccatatcgaaatataattataaataataaaaatttagaattaaaaataagaaatattagaagaagaatattctagagtcgaaatactattacaaataacggaaatttggaattaaaaaaataataaatattggaagaaaagtctatggtccatatagaagtatattttttaaaaaagtgaaattcagaatttaaaaataaaaaatattgaaagaaagtttagaatccatataggcataaattttgtaaatactggaaattcaaaattaaaaataaagaatactggtagagaaatctagagtccttagaggaatacaatttagaaataactaaaattcggtattaaaaaataattaatactatcacgtacatacaatttgcagtacaatatgaatattacccattggttagtttgataaagttcatataaaatttaaaattatattgtcattttaatatattttaataataaattatatatatatataggtaaattaactggtgctacatggagtatgggctccaagattcaaattgagtatatacttaatttgaatgagtatgaatttttttaaatgtttagatatgaactttaacttctttactacgttagttcaaacaagtttgaaccgagtttgaacttttttttttgttagattttggttctaggtatataacatccaaacatataattcgttaggtatttaataatgaattgtgaaataaagtttagtttgagttgttttgttgttaggtttttgtatgaatcaaattcatatagctaggtatatactcacaatttgaaaatttttaaaaatttgagagaatttgtgtgttttataccttgaagcccgggcaccatggagtcccatataggtatcctatataggtaaattaa

SEQ ID NO: 28911 - DNA, 309 bp, Oryza sativa
gatcgatctagaagataagaaaatcaggaaaagaaggcaccttgtagggacccatggcgtgatttgttgtgggagagatgagaatcgaactggatgtggggaagaagagaagagaagagaagaggatcggattggtggtgataaggacgaggagagaagaaaggggcggccttttttgtagtgcaatttggggacgaagagaaggggggtttcgtagcgtgctagtatgcttcttgccggcctcccttctcttcgtccacgtcgtgtttgtttattaatggccgtcttggggtgtgtggggcccacagg

SEQ ID NO: 28912 - DNA, 1501 bp, Oryza sativa
cgcaccccgccatcggcaccgccgcgtccgccatcccgaggtccacctcgtccgctgttctcccgtccaattccatcgccggagctcgcatctcctcgcactccggtgagcttccaccattgccgccgccttcgatcggttatgtcgtgcgccatggaccgcctccctctctctaacccctcccaaccttctctctaggtcctcccggagcccgtcgccgtcgtcctcccgtctctcatcgttgccgttcgccgtcgctcctccctcgcgccggccgagcccctcggtgaggatcggtctccctctcttcctctctctccctttgccgcgccgcccgccgcgtagcgccgccgctagggtcgctcgcgccgccgcttcggccgccgccgccgtctttgcgccgtccgccgccgcctcccgtcgccggttgccgtcgctggcaaccgtgcgcgcgcgccgccgccctcgccataaccggccggccggcttgaagccgagccgagccaggccgcctttttccccccccccttgtgacactgcccagtgggcccgcttgccagccgcccctctctctccttgagtcactgacccgcgggtcccgcgtgtcggcgccacccctccttgtgctgacgtcagccctggggcaatattgcgcaataaattgattaagagtttttcttttatagtaaaaacacagagaatcttctaaaaatcataactaattcatccgagctccgattaaatccattcaagtctcagtaaattcataaaaatgtatagaatccattaaaaatggttttgcttcatgtttcagtagtcttatagcatgttttgcttgtgtgctttgtttgtcgcgtagagttcggccgtttcgtcgattcgcggattctcgaagacgttgctgtggtctcatcagtgcgagagcaaggcaagtcatgcaatacaattgatcatattgtacccaatttacaaatatcccgcatttctattaaatactgcattgttttacaatatcatgtgggatgggtcctattactcagctatatgttgtttcccttacgccattgataacttgggtattaaaatgactagatgttggtttaggagatgcttagccatgcttagttcaactagtgcacaaaaggggatcacattaaagcatagacttgattattggcatagctttgatttagtgccaccgtaatggtgttggttaattaaaatacacgtcatggtgggctgtgggtgcatggtcttgctagtcgcacccatggcatttaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaac

SEQ ID NO: 28913 - DNA, 154 bp, Oryza sativa
tatatatatatatatatatatatatatatatatatatatatatatatatatatatatatatatatatatatatatatatatatatatatatatatatatatatatatatatatatatatatatatatatatatatatattctattaatcctagt

SEQ ID NO: 28914 - DNA, 1501 bp, Oryza sativa
cggccggggtgtccggttgatcggcttccggattcaccgcacgggaacgtgtcgtggggctgtgtcttgtgggtacagttgtacacctctgatcagagtaaaactattcgaatagccgtgcccgcggttatgggcggtcaaccagattcaccgtgattagtttcaccctagttagcttttggaactggttagttcaggtggtggtttgggcctgttgcaacgtggtgtaacgttggacagtgattggttaatatggattaaatactacaactgttttactgctttcaactactgctttgaaatgccggctttatgcaaaagaacctttagcctcccttggatatatcttgcatcatacctcctcttccggtatgacttgctgagtaccgtgggtagtactcagtcttgctcttttccccctcaccagaattgaagtccttctcagttgaagatgtctcgaagaggttggtttcgtcgctgccgtcaaggatgcctgtggaatggagtcgcccgctgcagaagtcaagccttcaggcttagctcgcttttatctttttccgctgcatttgtaatcttttctatttttgtaagacgtggatctgtatgtcaacaattgtcgtttgtgtaccctggctggtcctggacaggggtttaatgcacattcagcttagaaattctggttcgtgaatttctgggcgtgacaagttggtatcagagccgaccttgaccgtaggacaagccaactggaaaacctaagagccctctgaaccccttttcatatgcacatgcctttttcacttggatttgtttcgggaaactttggggtttgatcttttgattttgggagaaaatcttggtcgcctatttaatcggatctcttggctagggacagtccagggttttagcaaaactttatttggaatttatttggcagtcagtcgagaattgttaggtggtatgcattaagttgtgtctagattcgatgggatgcagtttttatgcgcatcatgattatcatgcatttatttcatacattaagtcattgtttagtcagttgcattagtgtcttttgtctgggttcatgaaaaatgttccatgcgtaaaaatcatcatgcttggctagttgtttgggccatttgttgctttgtttaaatttggatttgagcatgcattgattcctatcccttgtctaccttagaagtcagacctgttcttcgatcgcaagcgccgctccgagcttcagagtcgccgcccttagctttatcgtcttcttagttttgtttgcttgctagtttccatgtttaggtttgttgcttgtgggttagtcggcggtcgatatcatgtgtgagtggtatgacagccttaattaggagttgcgtgcctctttttcagtgttttaatcaagattaagataattgcacttaagtttataagaaagattagtttctgagccatctgttttcttcctttctcttatttctacctatcctcgtccagatgg

SEQ ID NO: 28915 - DNA, 765 bp, Oryza sativa
tagggtttgtctttttttgaaacagagggagtacatgactagggtactaggcatgttatatttgaaaacaaactatgtacttggtttctattttttttcttcttttacctctctctatccctgcacctggccttcatctgagcatatgtataacttatggttaagtgaacatgtatatgcttatgtggcattctaattacgtagaggagtagaattacgtagaggagtagacgttagtaagatcagccatgcatggtttgttgttttagccttcgtttacacaaactacgaatgttcctacatggaaattggcatcttataagtttaggttataaaaaaaatactctttttttaaaattgacaatattgcacccacttcacaggttcgtataccactaatataatatattctttttttaaaaaaaacctgtatcaaagtttgcacaaatcttaaagtaccatctgggcaaacttgtactcctgcttcatatcataagttgtttagttttttcctagtcaaatttctttaggttttcccaagtttctagaataatatagtagtatttttaatataaaacaaacatattatcgaaaatatttaatttcaattttaatgaaactaacttagtgttgtgcattttgctaatttttttttgtcaaacctaaataattttaaataggaaaaaaaatcaaacgacttataatatgaaacggagggagcaccttgtatagcagtctataggccatccagactatcttgacata

SEQ ID NO: 28916 - DNA, 170 bp, Oryza sativa
ttattagggtgtccaaactaggagatgataataattgttttttggttaaaggtggttgtgccttatattttggaatggagggagtactgagttattattatattttaaaaccgacggacgctgtaaaggcatgcacgcagcagctcttccagactcctgaccctccgcta

SEQ ID NO: 28917 - DNA, 265 bp, Oryza sativa
tcctgcacccccggccagcaacatcaacatactcaacaagtacatgtcgttgtgggcggcaccattttccgtccgtagcagcgccactgccaacttttcgtcaaacgccactatttcagggccggtataatatatatctcgtctagctactatatatatatagtgatatatatacaacgtaactgtgtcgaactaattaatactaataaccaatttaagtaatacaaaaacgtgcgcaattatatatattgatgatgcttgcaga

SEQ ID NO: 28918 - DNA, 1501 bp, Oryza sativa
caagagagggcgacgtggaatttatcaaatttcaagaaatcataactcttgaatggatcatctaattttgctcaaactttcactaatctgcttaaaagttaaatatttattttaatgatgtatgggtataattgtccttaaagtgacagctggaatattaaaatacttacatgacctttgattttggctaaatatgggggtccccatgcatgaacaatatacacaccaaatttttttttattttttaaattattcacatttttgtaagcactatggacagatgacattttgatctcttagttttactccacctgggtggctctacaaagatggctagccatagggaacataatagtatacctattatgtaatgggagcttgctcatctgtcgggaccaattaaaaaaaagtcttcattgaataattgattgaatttatttaaccacggtaaaaaacttaaacataaatcatacagaaattacattgaatagaactacacagagaaacaacctagtaataataagcataattaattaagcatgataatgaaatgaatacgataacaatgagagaaacataataaaaacaagaaaacctaacaatacatgtaagatgtctgtgtcatttgtatagtaactgaagggaaaaggagaacaaagatgagggaagaagaggacgcgagagcatatagggggaagtctgaggagaaagaggaagagaaggggagaacataagacagagagagagaggaagagaaagagggaggtggaggttggggggagactgacactttaatggtacaatgcatctacctctgcttcaaagagcttacgatttgagaaaagatactctttcaggcaacacgttgtataattggacacccgtatagataaatcccattgtttgttttgagttttcctaaagatagtttatggccggaatttctgagcccgtaagaacatccttttaaagaaatgtgttcgcataatgacgtaggaagcaatttgtaaacaagtttgaagatctatcctagggctttccttttccaacgtatttggacacggtcaattttactaagagaatagagcagatactatctcattaaaacgagataactatctcattaaaacgagataactatctcgttttaacgagatactatgtcgttttaacgagatactatctcattaaaacgagataactatctcgttttaacgagataaaaatatttttaccatgtcccttcccgggctccgtagttatgactctagtaataaggagctaggcctacttaagttgggtacaattttttgtgacaagcaccgtaaaaaggactgatttgaatgaaatcagacgttgtaaaatgttggaggttgtaatgctgtgccacagaggtcagtggctgcatgccccgtttggtgtgtgtctctgtaggtctgtgtcagagccatgagtcggaaagggaaacaattttgataacgggatttcaaagacatgtagg

SEQ ID NO: 28919 - DNA, 1501 bp, Oryza sativa
  unsure (1)..(1501): unsure at all n locations
tatcagctgcaaagtaaaacagtgggtctattgtcgaaagagcacacatatttcccccggtattctgcgtgttggtaaacagaaaattataagaatatattgaaaacctaagattcaagggctaaccaaattgtacaagttactaccatgatttgtattgtgcgatatattgagtggggccatgatatataattatctttgtaacagggaagatagtttttgcaaaatctgttgcattcgaatcaagcaatatttgttaataaaacctgacatgacagtagggggggtgcatttaaaggagaattgtgaagcaagtgactaaaaatagacccctaaaaggtgttggctggcgatgagatgaggaggggagaaggaaacaagtgagaccagcttctaatttgaaagcacatgtgggaatcgggccttgtggggtgcgggtagccgttaaggccgcggggtgactcctccgccgcaggatgcagatccgacggcccagatcccacgaccgttgcgtttaaacaggagaggccgggtgagcccttgccttttcggccaaattacgccttcctacctcccctattttatctctcctttgtctcccctctcctccgctcctccaaccaccgcagctcgcactcgcagctaggcctctcccctctgctgcttcttcttcttctggagcatcgagagagagagagagagagagggggagagaggtggcagggcancaatcttcttcctcctctctcgtcttctagatcgtgtaaggctccttcttgcggtagattgatgcgttcttggtcggaaatttgggctagaggaggagattttcattttgaggggttttttttgatgtggttttgcgttcgatttggttccctgagctcgttttcccttggatctccgcttggatggagacgtggacgagtaattcagggaaaaagattagcagctagctgaaatcgaatcgtcggtactctagcctgtaggattggttcaagattagatctttgatgtttttgatgggttcttcctcctggttttttctaccaagaacggaggaaactcgacagggagatgattccgcttcttggaaggcatgttcagcaacttcttggacagccttcctttttttgtgggtgttttttcttttcttttattttctgctgtggaatttcttcgatctctccaccctgacgagagagttcaagcacagcaagtctctcgagttggaattacgagggttctaatctgtttcttctcttggtttctgccatatttgacttcttgggggtcgtttcgtggtcaaaactggaatttttaagacatctagcgaaatatcaggagcgaattcaaataataatgtcttgccttttgtagatccgcgtggctcgtaatgctacatgttcatatcgctgcctgtttttcgatttctgacaaaaaaagcgttcgtgttctgacaaaatttcggtttggtttttctacagtagaacgtcagcaa

SEQ ID NO: 28920 - DNA, 1501 bp, Oryza sativa
ttatatgcggacgcgaaactcgctcccaatctcgcactcccgcctctcccttcccgtttccacgcgtggagaaagcgatctttctgcgcgtgaaagaaaaaaaaaggaatttcctatatatgtagtttaacagaagggtccactttcaagttttggggattgaatttaggctatctgttggagggaggagttttttttacttcctattttcaatttaggaaacccacaaacaattttttggggaaagattatacgtaagttgttggtgatgctcttagggcactcacaatgcaagccatggggctcgtacccctaacccaaaaagttggctcaaagacacccatcccacagtgcaagcaccccaagttgtgtagcttaattggatgaaatcgctgtgcaaagcaactactctcacaacgcgcgtgacctgggtgcggttagcacgaccgagcgcaagaaatcatttccttcacctacccttcatctcgctcccgtgctcgagttcgcctcctccacctcacccgccgctcctccctcgtagggacgccgctgccatgcgcctcgtctcgccgtcgactgcgccgctcgcttctcctcctgcacggactcgggagcggtggtggcggcgggagtggacaacgcgatgccaaatggtggattcctcctctctgctactccggtgacgcgacgctcgagcgggggacgcctccaccgtggcgacctcgccgagggagacctcgagcggcggacttgatgaggaggccgtcgttgttgtctgcactcaagggcccggatccgagttgcagcgccggatttgggggcaatgcctcctctctactgctccagcggatttggggggcaacgccgatttggccctatgaattgtgatgattttgcttcctttttctttttttcatcttgttgaacccgatatgttcttcaatttcttatctttcaatccccaaaattttcttgccttttcttgactcggtggtgggaggggaattttcgtgagcaaaccggggatttcttcgcacgagggtaagacgcctcgaagccacgccgtccttggtgcgggtgctagccgttttctccgccgcgcatgaactcgcaacagggagctttcttgtcgccctccgtgggggcgagcggctctgttggggcatgcttcctcgctccacgcaagcccacatccgagctggcgaggtggagcaccggtccacgttcccgcactgtgatcggccttattaagtagtctactcgcatcttttgcacagaaaaaaggacaacgtcagtgtatctggcgctgaaatctgcacactgtataaacatattttaaagagattaaaggaagagagagaagagcagcatatgctataaatctgtagtcagctgcagcatggactttaagacttaatgtgtgtatgacatataggaccaggtattaatagtatagcaagcaactattgtatgaattgactattacattggctatacttgg

SEQ ID NO: 28921 - DNA, 1031 bp, Oryza sativa
catacattgcgagacaaacaaatatcactagcgatattattttggataggtttaccttgctgcaatttttttgcattgacttccagcacggtatccttgatcatctgagtgagggcgtcccggagctgacggaacatctccacctcaaagtaacccgtcttcatgttgggcctcttcttgtgccagagagggttggtgacgatggcctggagctctgggtcctccagatcacacagctggtagaacatctggtggtatgccggtaggatccctcgtctcatgatgtagtacgaatcctacaggtgtaacagatattaattaatctattttattcaattttattcatttcatgttgaattgccggcagaaaggcgtatcataaatctctgtgtataagatgcaccttttttcggaagtgcgtcttataaacaggtacaagattttttatatatttttttagtgtcgatttatgcctggcaatgtctcccagctcagtcatacatggtgtgttgactcaccactcagaaactagaacaacactacctgtatgtctggatttctgtttggactttgaggacaaattttctgtcctctttagttttaaaaacaacattgttactattatttgtgacaagttctcaagcacaaattcggcgacttcaactgcacctcgcagtaaaataaaggtttgtttgttaattctcggcccccaaaataggggtgcgtcttatacaaagagattacgggtaggcatgttgcacagttctgctaaatgcaggtatgaacttgcgttaagcagaaagtccttcgcataaaaatgcctgtaatttcataggtatctgcttatttgataccaataatcaaattaagttactacaatggatctttctctttaaaaattcatttgacgaagagaaaatctctgttctgtttaaatggttagagcagtcaaaacctcggaagcaagataccaacaatttgctttgtggcatgcacacatgctaatgtccttcagccagcggctaaatgtt

SEQ ID NO: 28922 - DNA, 1501 bp, Oryza sativa
atgaggcagataaatgtgtgtactattgtcatggtgggggtaaggaagttattctgtgtttgtatgttgatgacatactgatatttgggacaaaccttgaggtgataaatgaggttaaatcattcttgtctcaaaattttgatacgaaggatttgggagtagctgatgttatcttaaacattgagctaattagaggtgagaatgggattacactcttgcagtcccattatgtggagaagatcttgaatcactttggttacattgatagtaagccttctccaacaccttatgatcctagcttgttgcttcgcaagaacaagagaattgctaggaatcaactggaatactcccaaatcattggctcgctgatgtacctggctagtgcaactaggcctgatatctcctttgctgtgagcaagttgagccggtttacctctaatccgggagatgatcactggcgtgcgcttgagcgagtaatgcgctatctgaaagttactatggaattggggcttcactatactgggtatcatgcggtactggagggttatagtgattctaactggatctctgatgtggatgagatcaaagccactagtggatatgtcttcacactaggtggtggtgctgtttcgtggaggtcttccaaacagaccattttgacgaggtcaaccatggaagcagagctgacggcattggatactgctactgttgaggcagaatggatgcgtgatctattaatggatctgcctattgttgaaaaaccagtgccggctatccttatgaactgtgataatcaaacggtaattgtcaaagtgaatagttataaggataatatgaaatcgtctagacatgtgaaaagacgattgaagtctgtcaggaaattgagaaacttcggagttataacgttggattacatccaaacagctaaaaacctggcagatcccttcacgaagggactatcacgaaatgtgatagacaatgcatcgaaggagatgggtttgagacccatgtgaattatactatggttgtaacccaatctatgtgatcgaagatctcgtgaattagaatatgggaagaacaaaccattagtaaactagaggagagtactaatctatactctctctaagtgaagatgcatgtactctcatgagctgcaaggcagcttggctatgacttaatgagttctattggctttaattagcgaagatgatgtcttgcagagcattcttgaaagaactcacctttgtgagcttgactgttggtcgcagtctatggagattttgggtgaatcttctaggaagcttactaaagacctaggagtatgacttatacgctacacccgaggggtagtttatagacggtctagtaccagataagactctgagtgaaacttgcttgcacaagacttgcaattcaaggtgtagtccattgttcaagtgttgagtaagtgtagcttggagttctagatggatgttcaaccttaatcggtctccatcgaacc

SEQ ID NO: 28923 - DNA, 154 bp, Oryza sativa
catattttgtcagttgcaggttcaaactgactggcatgctcgcacctcccaagatttggacctgcattctaagcagatcttctagggtagtgtgtgtttttcgcgtcaacacatttttggcacgtccagtgggacacaagttttgcacccaaca

SEQ ID NO: 28924 - DNA, 342 bp, Oryza sativa
aatttagcagtcagaaaaaaacatggcatgtggaacatggacccatagtcacaagcaaacttgaataccgttcacagcactgatagtatattgaatcacaaattgcttttattcaatgatgattgtatgatactaacaaattcattatccaaatatgtcagatagctggtttagtgttgatgagaagccacctattgcacatgccaaggtagagatcttggaaggtgctgatatgaaaccctctgatccaaatggtatgttctcaactaccaagcccgtccatatatagtatatttgactaggaaaattccacaagagattctctgttgaattactgtactg

SEQ ID NO: 28925 - DNA, 1501 bp, Oryza sativa
caaatattagtgatgtgaaaatggagagtgtaagcgtcttcagaattctatttatttatttatttatcatggatgaggatgagttaataccgaaatcacaccaagtgagtgtggattccaatattcattttgtgcaacaaatttactttggtttgattgaacaagtgaacaatagaatatcagaaagaaggaaaggtcactgtagggtggtaagagatccactcctttgtgttgtatactgaactaagagcccagactagcatgattgaaacaggaaaagtacgtagatcaatttgtgaaagaaagaaagaaagagagagagagagagagagagagagagagagagagaaggctgaaattacttggttccagcccaatggagtaaggtgggcgtcaaagagttggggcgacatgtaggcgctgtgatccttctcgccttccacattgtgaacaccctgggcatgcctgacctgcagggacaggaaaggattactgatggctaaggaaatacagtacattgtgatcgatgagcagtagtaggagtatttggaaaagcataggaggaagtagtaaccaggtagatggttttgcagcggtggagaggatacatggcggtggtaggaggattggcgtccattggagctcctaaaagacaaagaaaatagaatctgcgtccattagaataacaacagtgggggttaactcactcaaaaaaataaaagagcagtgaaaaggaaaggaagaaagaaatcctttaaatttgcaggaaggaagaaattggaatcggggagggatcgttgggtttggggcccggccggcagtgatggggatttttgtgtggatccaatccgatccgatgggatgggatattgcgaatgtacagatagaggaagaagctaggagaggagaggggatccggagaaagaagtggtcgtatgaatgaatcaggcggggcaaggataagtaggtggaagctatatatgaggtacctgaggaggaggaggaggaggaggaggtgcagcgaggaagaagaacaagggaggtggggaatttggcacggcggcggggaaactgtccgactccgatggtggtggtcgcggcggcgaatacagtgtgcagatgcgagtgctggagcagctggaccattactactttgaggctttcagctcgtgccaaaaaaactgtgagtcgtgtcagagttgggcacaaagaaagaaagaaagaaagaaagaaagacggggatgcgttcggattggctacttggcttgccacttttgtttgtttatttgcccactcacccaaagacacccacagatctggagctgctgcttcgctcctctcctactagcagtagtagtaatactctatgaaaaatctatttactattagccctctgacatcagtttttctgtattgctggaagaaagatggtgcgagagcaagtttaatagtatagccaagtatagccaatgtaatagtcaattcatacaatagttgcttg

SEQ ID NO: 28926 - DNA, 827 bp, Oryza sativa
cccccccctcaccagtacgccagtgtgtattagtcaaaacatattctttcacataattggtaattaagtgcttccatttcattttttgaaattggggcgtttccaaacactggtctttacctttaaagaatgttgtactgtaaaacgtcatcagaagagaaagaggtggagaggaggagggagagacagaaagtgagagagagaaacggagagggggaaggagagacgaagggagaaggaggaagaggcagaaagagacatattctgagagagagaggggagggagtgaaatagaaatagagaggaaagactgaagaagagaaaaggaaatttgaaaagtagccagttcaaatagagaaaagggatgagagagtgagaggaaggataaaagtacatgcaatataaaaatacgaatgaatggcagaacctgctgtgccaatcatcatgacagttaatataggttttcccgcccaacttcgtcaacttagcatccgaattaacgttacgttcattcaacttcgtgcgaaattgaatgataatgtagatcaacattcaaaaagctaattgcgtcattcaatttgatttagtaccatgggattgcatactcttgtcacggagacgtgcaaaacgagcatttaatttagaaaagcgtgcaaagagcattcaaattcgcgccggacagacagtggtatgtcttcgtgcattcaattccgtgattaggcatacatatgtgacatttgtgcattgcttttcatttgatgttaatttgtcacttaatatacttctgtttgaataattttattcaaaatttacttggaggaatggca

SEQ ID NO: 28927 - DNA, 1501 bp, Oryza sativa
tatgccaatttgctaaattctgaccaaccaaagctctcctaaaaaaaacattcagcggaacagatctcataacattagcaattgaagaattcttccttcgaacaatggcatatagagacggatacttatctttaaaagccacgttacatatccatttatcttcccaaaatctagtttgttccccattattcacaatccaggaacccatattcaagaaagtatttttaactttcatgagacctgaccagaaatgagaatcccctggtttcctatcaacttgagttatagaatggttagagagatacttccttttcaataagtcctgccaaaccccttgctcatttattaacttgaacaaccatttactcaaaagatatttattttggatctccaaattatgaacacctaaacccccttggtctttgggttgacaaattatatcccatcttgttagtctatattttttcttatgatcatcaccttgccaaaagaaacgtgatctataataatcaattttttgaagaactccctttggaatctcaaaaaaaagatatcattattttccgttggaataaatacattatttttcctccctcatctctagcccttgatcgaatcgcattccttaaccgcaaatccggtgaaaattaactccttcgatggttttagagaagtggttttgctgacgtgctatgttaacttggtccaagtatgctgacatagcaactcaatcgtcaaatgaattaaaaatagaaatggattccacatataattaagtgacaaggataaaaacataaaaacaatggagcctacttgtcagccccacttctccttctcttcttcttcttcctctcgcagtcaaagcttgcacgcgcggcgatggcggctacggaggcaagcggtgtggctagggtgggagggagttgggataaggagtgtggatgggcgttagtgaacggtggcggtggtgacaatttctcctcccctccctctccctactctctctctctctatctctctctcccagcggacagaaagacatcgatggtgatgggggacggtgggttggcgagggccgcgttgtgcccacgacagagccccgccacatcgcccataaatctcagttgcgttgcccggatctaaggagcagtggagttgcaacagtcgattcctcctaacgacgcaacgacaaacacaatgactgcaacggagacatcgtaatccccgaagataggccaatgggaggggatccggtgacgaggagcgcacgaagtgggtgttgttgcctagtaggaggggatccggtggttgccactctattagtttcacaccctatggaggctggctcaataagaactagttgtggtaggaggtgcgcatccaagcattgaaaccgccacatcagcgtgcggcagcctggtagagctcattatcgctgggatgggagggggaacaagaggttggggatgggagtggagggggaggggaggagaggaccgcg

SEQ ID NO: 28928 - DNA, 403 bp, Oryza sativa
gaaaatataggtatgatcaggcaaatttctccaacagaaatacttcagcaaaaatattacattggaataaggatctcagtgaagtctaaaaacaacatatggtgaatggtcacaaacaaagaattgctgattaatttctatttccatgaatatatatacttcaacaaaaattactttttatttttgtgatgcacaagctctaaataggttagttttgttctgaataatttaacagatcaaaatggtgctgaaatcaatttggataaaccacaatttattctgattaattaggccccgttcacatatcaggaagcctgctcacgaaaaatgagggagtagctaaacccaaacattgaattgaacagatccttaacagttgaaaaggctaattctgttgtgagta

SEQ ID NO: 28929 - DNA, 1501 bp, Oryza sativa
aaacaagatttcagcaatactaaaagggggtggctatcaagctggaaaagtggatgggtttagagacaagaaattttatacaggttcaggccttcttaatcaagaagtaataccctactcctgtccggagattgatccgccgagtatattattgatcgtatgatttgggaaaaaatcgtgcccctagaggcacccggacccctccttatataggggaaggggtccgtattacaaagtacagcccatatccttaacggaataggtagctacagataagatacaatcgtaaccgactaggatccgggtatttccttgacgtacaagtttggaatttaacccgagtctccttaaagatattctatctatacatggcaccccatacccagtcggattatacatgccgcggaggtatggggtatccataatctccacagtagcccctgagacctttatagtcgacgaaatagtcttgtctcgtaatccaaaatgataatccgagtacttcgacttcttctgccttgatctcccgagtaccaaaatcaaagactatgaagggctgaaaataaaaaatcaggtgcattgactagatgcacctaattaggtgtagcccccgactatgtgattatctaaagactaaacatatagtcaaggcgcaaataacatccatccgagtggttttacaaccaaattgtccaaaagtatcatacagctaagcatatgcggcgtttaataaaacatccagccgactgctttagctttaatataccaaaaatggaaatataaaaaggcctgagtaaaaaatactctaaaggtccataaatcaacacatatgacaagaatccaagtaaaaactcttaaaggatccatcaaatgtggtataaatgtgatttcatgacaattgatgagtctaaatagcctaggctatgactcacgccataatctagataagcatataacatgccgagagaatgactgctcaaaaaccagtcatctcaacaaaacccaatcagcttttgctgcctaaaaaagctagcaaaaattagtataacacttttccattgggcacctttttatttgcatcgtagtaattccaaataattatctaactgcgtcaaaaaggattttagcagcattgggctacactgttgcgagcaagtattgccgaagcaaaatgcctaagtccctaaggatcacaacttagccacgctgatagaaaaaaaaagtgggctgaagtactgttttgggcctaggcccattagtactcccgataccctaataataccaaaagccaaacgtcgcttcgtcttccccgccgaaactatcgccactttccccattccctgctacagtgcgaaaccgcaccggcgaagctagggttcaccgattcgctccaatccgtcctccaaaattccacaaaaatcttccacgcaaccaccgcatcaatctcccattcattcccagccacattccgaaccaaatcataccatccagttcgcatcca

SEQ ID NO: 28930 - DNA, 1501 bp, Oryza sativa
gacaaattatatcccatcttgttagtctatattttttcttatgatcatcaccttgccaaaagaaacgtgatctataataatcaattttttgaagaactccctttggaatctcaaaaaaaagatatcattattttccgttggaataaatacattatttttcctccctcatctctagcccttgatcgaatcgcattccttaaccgcaaatccggtgaaaattaactccttcgatggttttagagaagtggttttgctgacgtgctatgttaacttggtccaagtatgctgacatagcaactcaatcgtcaaatgaattaaaaatagaaatggattccacatataattaagtgacaaggataaaaacataaaaacaatggagcctacttgtcagccccacttctccttctcttcttcttcttcctctcgcagtcaaagcttgcacgcgcggcgatggcggctacggaggcaagcggtgtggctagggtgggagggagttgggataaggagtgtggatgggcgttagtgaacggtggcggtggtgacaatttctcctcccctccctctccctactctctctctctctatctctctctcccagcggacagaaagacatcgatggtgatgggggacggtgggttggcgagggccgcgttgtgcccacgacagagccccgccacatcgcccataaatctcagttgcgttgcccggatctaaggagcagtggagttgcaacagtcgattcctcctaacgacgcaacgacaaacacaatgactgcaacggagacatcgtaatccccgaagataggccaatgggaggggatccggtgacgaggagcgcacgaagtgggtgttgttgcctagtaggaggggatccggtggttgccactctattagtttcacaccctatggaggctggctcaataagaactagttgtggtaggaggtgcgcatccaagcattgaaaccgccacatcagcgtgcggcagcctggtagagctcattatcgctgggatgggagggggaacaagaggttggggatgggagtggagggggaggggaggagaggaccgcggatgaccatgtcatcgtcaaccgttgtcgcactcaccgatagtcgctcgagttcatccttcggccgtctctgccattgttgcccccttctcgtcgaccgctgccttcccatggatgagctggcgagcttgtcaaccgccactgtcggagagaaggaggaaaagagactgacatatgggtccattattttctaattttttttcactaacatgtgggtcccattaaatttttttatttttattttcgtggcacaggttccatttagttttttatttttattttagcgccacatcattgtcacataagacgaagaccaagtcagcatgccatatggatgccacgtaggacaaaaacactagccgaaccgccgagggactcgatttgcaccggttttcaaagatggaggatgcgttatatccagtattgcgat

SEQ ID NO: 28931 - DNA, 1501 bp, Oryza sativa
aaaacatccctccaccaaaaagatcctttaggagtaacagcatgaggaggttttgcagtgtagtaagtattccaaatcaaactaacccagggaacaggatatctattatagaacttatgcaaattcttcaagagaagggcattattttgcaatctaaggtctattacacccaaaccacctctatctttcagctgacaaactctttcccggagaaccaaagacttcctactagaattaatatcagatcccctccacaggcaatgtctcctagctctatcaatactttctataactgtctttgaaagtgaaagagagcacatgtagtaagtgggaagggaggaaagaactgcattcacaatggtcaatctgtccccataagataccaaagcagtggttgctgagagtcttctctctactctatcaactagaggagcaaaatctataactcttggtcttgtggttccaagaggaagacccagataagtaaaaggtaactaccaatagagcaaccaaacaattttgagagatgatcaaccttttccaaatctacattcagaggaatcatgcatgacttactatagttaatcttaaggctagttgaagagacaaaagtgttcaaaattgccttgagatagaaaagctctttttgggaagcagtcaaaaaaagtagagtatcatctgcatactggacaatccgaaattcattaccaggtgttgggattggctttgtaagaacttcctgagaacaagttttattgactatagattgtaacaagtatcttgaggcttggtcgatctcgagagatcgaattgttgaggatgatggttccgaccttgttggggcacatactctggctaggttagacttcccagatccaaagtagttgaagtatctctcgtcaaagaatccatagtgccgatgacttggcaagcttgacgaagatcccgatccgtcgaagaacgtacttcgttcgggtcataccacccaacatacgaagccgttgagtagtttgttgttgaagaatccatcttctcgaacccatctcgtcgaaatcctaaagcaccaatatccccctacggccctacctggcgcgccactgtcgacgtatgatgtcgcgattccggtatttgcataatatgaggatcgttggcactaggatgtacgcgagacttaggtaaaagatacggagatgaggatttttatacaggttcgggcccctgaattgtcaggtaataacccaacatccgaagccggtactactcttattcatcataatcacaccagtacaatatttggggtagcctatctaactgttgtcgacttggcggtctgtagtactgactcatagtcgacaacagggtagccttcttcctcgaatccgcatccggcgagatcagagacaatgctatatctctcctgacggtagccataggcaccgtaggtgactagccatgccaatctctgaagtcgatatctggcgtcttctcttggcgtatgttg

SEQ ID NO: 28932 - DNA, 562 bp, Oryza sativa
ctccgggcatcgtcggccggcgagatgaactggccgtacaggcgatccagggatcgggtcgccgcgcaccatccaatcgaggtgcgggctgcgtcttgacctatttttcacgcgggcccctccggagtacttcacgattgtttatgggctgaaagttagatcgggctgaatgagaactggtcctgccaaagtgagcctttcagtaatgggccaatccacgggccggtagtagagtagcccaatcggtgtctaaaaagcagcccacctttctccaggagaacaagacaaagctcgaaaagcgaaaagacgcgctcgtcggctcgtgtactgaactttcgcttcaccgcggccgccgctccgattcccggcgcgcgcaaacccccctcgtcttccgagaagggattccagtgcgcggcgctccacctcccgggcaatcattctcccacccatccccgccattaaaaccctcctcaccggcgtggcacaactcacaaccacagcgatctccttcccctgcttcttccaatcgccctgacgccacccacactagctgctgcaccca

SEQ ID NO: 28933 - DNA, 1501 bp, Oryza sativa
ttttttgtaagcacgatggcttgaaaatggctcaatcaaatgccttcaaattctgcacacatatgtataggcatatgtacaaagcacaataacgttttcaacattgaccttgactaatgacgtcatctaggcgccattttgtaatttttttggaaaatcaactcatgatcatatcttcataaccaaaagttttttctcattcatatttatcatgattaaaggtattacaaagttttggtatgggatcatgaatttggttcaaattaacatattggaagcatatgcgttcctacaatattcattgatcgttgtcgcgattgaaatcgagtcttaagttatgaaattataaataataaactctttatgttgtatagctccctctcaaggtcaagattttaatttagctatgaaacaatgtttcttgactaaaatcgaccgattagctaatcccatttggaaattatatatcacaattacatattctgatattttcatggtcgcagctcccattgcacggccataggcgctattttaactttgtcaaaatttaccgggagcaccggtaaacttttatattcaatttttctcgaaaacagaagtgttttaggggctaatttttttagtgcttataatacatccacaggggcatccaaatatatcaaaattgtaaagattcactatcgacccaattttcaaaatttcccaaaactttgtattacctttaaggtcaatatccgtccggtcaatttaaggtaaaaaaatgcgcgcgtacgcgtacgtccgcgcgtcagcgcgcgcgcaaaatttaaaaaatgctcaaaaaaactcaaaatcatttagcatacgttttaggccatttacagcattttataaaaaatctcgcaaacgcgcatgcgcgcgcgttttcgcgcgtcctgacattttgcaaaacagaatcgccaaattttcttcgtcatcatatttagcacatttttttcaagcattttgataccttgttcaccttttcctgaccattaataacggagtgagggtccgtttaagatacatgtcagtgcgtgcgagctcttgtaatacatagcatataagggaaaaaatcatgcccatacaaaatccatgatatgttctagctgggacaatcttctacgaatgcagcgttcacaatttttcattttgacaaaagcatcatggcgtatttttttcgattaaaggaggaatatcaatttttcactttttgcgtgtattctctatgggacatgactttttttcaaaactggactctacattcccgtcttttgcgagcaatatctccgtcgttttagcttcgtttacgctgaacttcgagtatgttgtagctgagacaataagctatcttaaatttgccctttattttgtctcaaattttagttagaccagcccacctattcttgttcaaaacaagtattacaaatctagttattattattatcatcaacaatgtcaccggagcaagtgtcgcttcagg

SEQ ID NO: 28934 - DNA, 1501 bp, Oryza sativa
ggaggggtagcgcggctggtgcggcgcattcaaaactgtacactctactactgcggctctgctaggtgaatcatcggcgacgtacggcagcctgctaccctatctctttaaccatatcgatatggctgtgtttagttcgtgtgccaaattttttttaagtatatgaatacatatttaaaatattaaacatagactaataataaaacaataaattccgtctctaaactgcgagacgaatttattaagcctaattaatccgtcatcagcaaatgtttactgtagcatcacattatcaaatcatggcgtaattaggctaaaatgatttgtctcgtaatttatatgcaaaccgtgcaattggttttttcgtccacatttaattttccatacatgtgaccaaacatttaatagaagagatttatattgtattttaaaaacatgtttggttaaaatatcatcggaggtttacgttcaaacttccaacttttccatcacatcaaatgtttggacatatacatgaagcattaaatatgaaaaaaaactaattgcatagtttacatgtaaattgcgagacgaatcttttgagcctaattacgccatgatttgacaatgtggtgctacagtaaatatttgttaataacagattaattaggcttattagattcgtctcgcagtttacaggcggaatctgtaatttgttttgttattagtctacattgtccgtgtacgttaaattttttttttgccaaaacaactaaacacagcccaaaccaacatggccagtagtttatcagcatttttttttgtgatgtccggttcacgtggctgaagaactagcaacataagttgtgtgttcacacaactatgacctctccatctattaaatatatttatatattatttatgttaatagatataaatgttaataacaattaataataaatatgttttaacctattttttttaagaagtgtagctataacagtaatggatttatatatcttgatttgttattaagaatatcattgtaacaacaaataatttatcatatattaccgcgatcattatctcctacaatatctaaataaatgtgtcaattgtagtaataatgtaaatagctacatttcttacgcgttacaattctgtcatcaccacttgagaagtatatatacgctttttaatagtaaatcttataatcatatgattgaaatcagctttgcaaaatttattatgtcatccatgtcacatttttttttaatttcaagctgtagtgaagtaatcgatagtattaggttatgtagctattcatattttcacggatacctactattgttgatacagtagaattactattgaatgagttaattactattgaatactcattgatgattattttataaggataattttgaagatattttttcattcgcatatctttgtttccacacattttatgggatatgtttgaagggtctagaacatcctatgacattatttgcttttt

SEQ ID NO: 28935 - DNA, 1501 bp, Oryza sativa
ttcttgctctatctagctcgtgtactatatcaatttcgaagtttgaagtcggtgagaatggacgaaaatggccgcgtttcgcatgtggacgtgatttgcgtcgagagcagttttgagcagaattttatcaccggtgacgaatatgtgtgacttataaacggtaaattctatcaatttcaactcttctgtgatactgtgttaaacttatagtcaatattacgagcagatttatgcgtaatcatggagaataactcgccactcagtaagaaactaaagttgaacaatgagcacgcggactcagcagttcctcaccaggcttccccggcaaccgccgggaacgttacagtgtgcgaccccccagcgaaacggaacattctctcatcagtttcccactctaccccagcggcagtagccgacctatcaatgaacaagccaccacaatggttcgtacaattctttgctgattttgagaatagacaagaggctcgtattgagtcacttctcgacaaaaaactgggtgaccttacttttaaagtcgcagatcatgaagagaagatcaaatgtctgtcttttgaagttgataatatgaaagatgctgtacaggccttgcaaatagagaatggaaagctggaaagcaagttagacgatcttgaaaatcgttctagaagaaataatctcgtagtctttgggatccaggaatcagataacaaggaagactgcaggaaggtgattcaagatttcatgcgttttgcagaggtgcctgaggatgttatcaaggatattcaacgatgtcaccgtacaccatcatttcggccccaggtaaaggagaattctcaacaatatcccaggaggatccacttaggttttggcgcctacactgcgaaagagagggcccgaaaagcctgcattaagaagcttaaggctactacatcattataccaagaccacaaggttttcgttgcggaggatctctcgcaacgtgttctccaactcagaaaagctaaggctggttcattcaagcgtctcaaggaagagggcaaaaggccttttttcgtttttccggacaagttatgtcataggaatccagatggaaagatgatcatcgcttaactttctgctgtcctccttttatgggataatatcattcatgtgacattccagtttcatccctgattattatgtttgttttatgacgttctgctgaagaattcctatataggtctatggagatacacgtaggtgtgaattaattgcttctggctatttcaccgtggagtctacagcactcaacattttttattcatcacattatttgaaagtttcttactttgtttggagaatatacatccgtacgttcatgtcatctgtacaaaagaacttgcattaacaagctagttgacagtaacttggatgttattgacagatgtctaactctcctttatttggtgagggtgaacttttaaacatataagagtgtaatttaagtttattttacaagatg

SEQ ID NO: 28936 - DNA, 534 bp, Oryza sativa
gaaaagaaagaaggagaaaaaaaagaggaaggagaggaaagaaaggaaaagaaagaaaaggagaaagaaaaaaaaggagaaaaaggaaacataagaaaacaaacaaaacaaaagaaaaacaaacgaaagagaggagagagagagagagaggatggtattaagagcctaagagaagagaggtgggagtaagagagcaaagggaatgttaggtggagtcgccacgtcgaaggagcaagaaagatacgcatagataaattatgttgctgtactgtgtcgggtccgctgtgtcggtattcttgctctatctagctcgtgtactatatcaatttcgaagtttgaagtcggtgagaatggacgaaaatggccgcgtttcgcatgtggacgtgatttgcgtcgagagcagttttgagcagaattttatcaccggtgacgaatatgtgtgacttataaacggtaaattctatcaatttcaactcttctgtgatactgtgttaaacttatagtcaatattacgagcagatttatgcgtaatca

SEQ ID NO: 28937 - DNA, 1501 bp, Oryza sativa
tgtggcggagtgatttacaacgagggcaacatagctctaggtggtggcaaagagaaggctaggagtgtggagattatggataccccatacctccacggcatgtataatccgactgggtatggggtgctgtgacatcctggcccagggcttaataggattaatagaatactcatataaacaagttgcaacttctttttcggaagccaatctcccaagaactccagggttaagcgtgcttggcctggagcaatttgggatgggtggcttggcctggagcaatttgggatgggggaccgaccgggaaattcttcccgggtgtgcacgagtgaggacaaattgtgcagaaaagactattgttggtctgtgagggtagtctatatcctaggatatctgccagatgtagagagggcccggccttggagagtagtgttggtctgtgagggtagtctatatcctaggatagctgccagatgtagagagggcccggcctcggagagtgtgttggtctgtgagggaatcctaggatagctgccagatgtagagggtagtctatatcctaggatagctgccagatgtagagagggcccggccttggagagtgtggggcgtcacagatggtatcagagccaacccttgcagctatacgtatatatgaatatgtacgcgggcatacggtgtatacaggatgatccacgatgtggtcgtatggcatgacgtatgtgcgccgaaaattgtgtgtatatacgtggtgctaataggggacgttcctggcctgggttgaccgacgaggacgtcggtatcttaagggggtgagaatgtgacatcccggcccagggcttaataggattaatagaatactcatataaacaagttgcaacttcttttccggaaaccaatctccaaagaactccagggttaagcgtccttggcctagagcaatttggaatgggtgaccaaccgggaaattcttcccgggtgtgcacgagtgaggacaaagtgtgcagaaaaggtgccatgtatcgggaaattcttcccgggtgtgcacgagtgaggacaaagtgtgcagaaaaggtgccatgtatagatagaatatctttaaagggactcggattaaattccaaacttgtacgtcaaggaaatacccggatcctagtcggttacgattgtatcttatctgtagctacctattccgttaaggatatgggctgtactttgtaatacggaccccttcccctatataaggaggggttcgggtgcctctcggggcacgattttttcccagatcatacgatcaataatacactcggtggatcaatccccggacaggagtagggtattacttcttgattaagaaggcctgaacctgtataaaattccttgtctctaaacccatccacttttccagcttgatagccacccccttttagtattgccgaaatcttgtttcgatagttggcgcgccaggtaggggtagcgtcaagttcttcgccgactagtgcga

SEQ ID NO: 28938 - DNA, 1501 bp, Oryza sativa
taagcttagagctgtttttaagcatttaatgccttatgtccatgtccacaatgtatatggctgaaaaaaagtcttaaggctcactcttatggttacattgtggatgcccttagagcaagtttaatagtatagccaactactagctccaattcatctataactaacctaatagctcatttacacaatagttacatactacactattaatatctggtctcacttatcatacacacagtgtgccttagagttcgtgctacagctggctacaaatctgtagcccgctgctcttctctctccctatttatcttcttaaaatatatttgtagcgggcttatagcatgctattgtacatgctcttagcctaacgtcgatgcaactaaccaagatcagtacgaatagtccagcacgagcgagccggccattgaaagcctgaaactaacagaggctgcggatcccctggtgttcacggctatgcctgtcatgaagaaggcattcatggaacctagctggtttcttgaaggggccagccttccatgattatttgagagatatttagactatcattacaacaacagatgcaacgaatctgcgaatgcatttttttcccagtaaggcagcgctgtaggttcatgagataaactaaaccctctgcagcagcgttttattaacaaacatgaaaatctccagcgacaaaccgatactcttatatatacctacggcaaacaaactacaaaccacgtcgatggcaatacaagaccggtgttcctgccagtgtacatgtacgattaagagcatgcatgcatcggattctattgctggtgccgagatgtatgattaaggccagttcttcctttcattccgtaccattttttccaaccgatgacaaattaaaagatgtgtctacctgttgacagggacactgaatcgccataaaaaaagagaatccaatggttactggagacaatcaccccagattttgcacggccatccttgcccaagtcgtgctcaccaccacgcaatttgccaattcatgcccgtctcgtcgactcgtcgtcatggccggtgcagcatttccattttaccaggctccaaggttcgtacgtacccattggccggcggccgcatcaaacgggacgaattcctaaccctcgtcatccgtcccttccctccattcaaacgcgaaaaaaaaatggagaaaaatgagagcgagctagctctctcatggggtccaatggcccgaactttctccctcaaaaggtgaaagctagaagcttcaaaacaactcatccagccaagcctccacccctcccaaatcattccatctgctgcctttgcaagtttcaacccgcaagaattcattcggtctcgctcggcttggcgtggcggcagctagattccaagcagtcgtcaaggccgaggcgaagatcggaattttttttctcatgctgtggctgtactaacttgtaaggatcggagggcgcgatggcggcggcggcggcgg

SEQ ID NO: 28939 - DNA, 1501 bp, Oryza sativa
cggacgattaaagttggaacggaaagtcatagctgcacttaaaatgggacggaggaagtagtctacttggttcgatcgttgacgagagaaaaacaaagagaagaggagaatgagatgagccatgcatacggttgcgcagaataagaccaagaccgaaaaattcgttagtagtcggtttcaaccagtgaaataccaaaatatattctgtcaattcaattagtgatatcggttaaccgaattgacccatgtggcctaacctagtgggcctaataagcccactaattcggcatactaaaccttagaggcagggtagagagctgctcctccgcctccatcgttcctcggttcacaccacctccgtctccatcgcgctcacgcatccatcctctgcttgactacatccatcgcaccgcctcattagcgtgcaccacctcgcgcctccacctccaaccagcctccgccttcatctcttcagtccccaccctcacgatcgagtttcaggaataaaagagagagatagagagttcggagctcctaaacgtgcggcgctgccatcggcgacttgcactgcactgagatgaatgggatttggaacttctcgtggagtgatgaagatcgatgggatacaagtcatggcaagattaatttgcttctttttttcccctatgagtcgtgctcttttgctactagcatcgtatgatagttattcatttgagttgctttgattcatcaatgttgtatcgtcgacttatttatttttgtgattaattcttttgttgtttaaatcactgttatgggttagttcggtccttaatcgaaaccaaaacaaaataactgaagactaaagtgctcggttttgaatttttttaagatcgacaagtcttgtgattttgaagattgaattttccaaaaaaaaacagagaaaccgagctgaatttgtcggttaaatcgaatagccacccctagccgtgctgccggccgcagcacaagtgcactgaggcaaaggcgagaacacacgtgtcctgtactccagtgatccagtctagtcctagccggtcggtccaggccggtccagaccattctttgctggaatggagaccttgagattaacaaaggagttgacccttcagcccttcactctagaatagtatataactaggcaatgcttcatcaacttgtactctatttatttttaaaaaaaggaaagaaaacttgtactctattcatccaggcctttccttttctaaggaacggaagaacggagtaatgtgacattttccaagctacgaaaactatttcgtacagtttctttaaaaataatatatcaacttttaaaaacccgatttttttatttgtaataattaataactctaaaattaaataagtagtaaacatagtttcaaaattatagaaataggaaggacgctcttccgtatagcgtccagatatggacgttgttgaggactgcgtccatgtgcggacgccttggcgatagcgtcca

SEQ ID NO: 28940 - DNA, 1501 bp, Oryza sativa
gttataaagtgatttagtaatagcctacagggtgcacagtgaagcacattgttgaatgttgctcggcatggttttttttcgttgtttatttagtggatggtgactagtctaggtgtcagaccttacttggtcagaaccagttcatgagtatacatcaaattatatggttttgatatttacaactatgtaatacaataatatcatcaatagagatatgttttgggttgggttatatagtagaggatgcattagtgcaggtagcattggccaaatgaccatactaaatgattgatatgtatgtcttaaatctctagggggtctgcagtattagagacctgtgttcactagcagttagcagcaccttaattattgagtagttgagctggatcacagccgaggatactccaggtatgagttagtcttttatgtgaatatgttgttaaaagacaaaggttatattggtagttttgttttatgtaaacaaaagcttaagtagctaattatcattatgtatatgaatgtcaatagacccatgtagtctttaattattttgtatggttactcacgatactaggagtatgagtcatcgctagtagtcacattattattctttccattgttgattcattatttacccttgttgaagatgcaaattgtcgttctgtgattaaattataggggaagatgtattctatagtagtcgtagttataagagaagtatatccggaatatcgattatgtcacttactaactatacactgtatgatggttcttcataataatcacattatcagttattcaagttcaggatacattgtaataattgagtattttatctgaaacgactttaaagacttgtgtttctgtggaaacacacaatacattttagttgttgttcattgtagttacagttatattgccgaaattagtacctgcaaacaataaggataattgtattttgtttcaaagagttcacatagttccagaagagtgactgtatagaatggcaaggggtgagactgtgtctaacagtggttgttgttcagtttaaaccttagttgggtgagtcagtcagaatggccaagttatgttgattgtttgttttaaggaataaacagttggattcatttaattggattgatgttaacgaatagtgataaaagagtcatatgttcatatggatagatagatgatagataaatggtttattcaaatcaaatcaaacatgtaaacaataaatgttcattaattccatgcttcgtagctaaaaactaaattgcgcaatggattacagaattaattattacaaggtaaaattgcacttactaataataaactactatagataataatgcaactcttggcaccggcgtcgaaccgctgccatgtgtttctataataagataacagatgatgatgtacatgtatattataatcagtgatctaatattgatgcatcatcttgaagtgcttgaagatgaccgtggcctctgccgagttt

SEQ ID NO: 28941 - DNA, 238 bp, Oryza sativa
agtttgctttttttaaaaaaaaatatatgatgcacaatataaaacggagggagcaagtagtagcccccttgtcatagtgccaggttcaaagtaagcatcgcctggctgcctgaggattaattcgtgaggcaattcgaagggcgctgaacgaaaaccataaggaaacagatcaaatcaaaacagagtttgagagtaggcgatgcatgcatgtcaacactgtcttgctccctcctaacca

SEQ ID NO: 28942 - DNA, 1501 bp, Oryza sativa
ccccgtgctgtgccgtcgccctccccggtaccgcagccgtcgtccgtggctcggcaatccctccgtgttcgccagtcgtcgccggactcatcttcccgtgcctcccggtgagctccgtcgtcattttgtccggcgtttcccgcgcaccgcaacttcctaccctctattaacctctccatttccttccctcggtccctccgaccatcggccgccgtttcccgctcgcggaacgtcgccggaccatcgctgtcgtcgtcgccttcctccgctccggccgccacccgggtgagaagccctcattcctccccctcctcttcgccggccgtgcgcgccgccgccgcccgcgtgcgccgccgctcccctgccgcgtcgcgccgcgcctccgctctctttgcatgtgctgccatcgcccgcgtgcgccatcgccgattgtcgccgccggtgaccgcgccgccgcgcgccgtcgctcggccgggccggcctgagccgtgcccgtgcccagccgcgccatcccgtggccgcccgatcagctcgggctgatctgggccgtcggtccgtgtggaccggcggtggaccgcccttgtggtcccggtccacggtggaccgacctccttgtctcgctgacgtgtggggcccgcctgtcggcgccggcctcacttgatgacgtcagcggctgtgccttttcctttggaaagtaattatcaattgcgtaataaatcattaataattatagaagttcatttaatggctcaaaactttctaaaattcataactaattcatttgaactccaaattgggccgttcaacttgcaaaattcatctaaaattaagatctacatgtttgtttactttttatgtactgtttgcttggtgtttattagagtttttcctcgttttgtgtgccagcgtgtagaatccgtcgtttcggaagtccgctgtcgcgaagaaaagagttcagaagatcaaagtgaagaagcaaggcaagtcacacattccccttgagcatgttgagcctactttacaaatgttttactgtttgcaaataaatatgcatgttttgccaattacatgggaatcgggtttacctagctgctcgcttgtgccatgtttacttgatatctgtcctttgtcaaccttgggtaataaatcgactagctcatgttacttatgtgacctagctagaactatatgcttagccatgcttaattaccactagctcagttgatgggataattgcagtattagacctcttagtgacatgacaagctgcgtgctcgagacatcttgccatgcttcatggtcgtaattatccaactaaaatgcgactgaatggtgagctgtgggtgcatggttttgctagtcgcacccatgacaattaaggaccggttcgcgggaaaccctggaagaattccttgtacttatcacaagccagcgtgggcaacggctgggtttgtagtgtagcttttctctagccgacgctcccaagcaagggtgggcgtga

SEQ ID NO: 28943 - DNA, 593 bp, Oryza sativa
agcttgacattgtaggactatattgctctaataaatttgcggccgctaatacgactcactatagggagaggatccgcggaattcgttcataaaatggattgctcaccggctcggtcaactctgcacagagcttcgcaccaagtcccgcagtgtgcactggcgcgtaacacagatcactgggtgcgtccattatgacaaaatagggagaatgggtcttgttcataacatgaacataaaacaaggacgatttcatttgcatgtttatgtcttttaatgaaactctaagacgacacaaaaacaataacaagactttaaaactgttgaagattgaattcatatcgataattcaatatcaaggagttcactaattatatatctaaccccaaaatcaaatggaacattcctctctcagggtctgaggtttacgacgaacaattttacaaaatcctttgtgtttcttcatggtcactggcaaattacacaacaaatccataatgtatcaccatttaattatcattactacagtctacatgtcttcttctttctatatttaaggttaaaactcacatattgaaagaaataactacacaaaa

SEQ ID NO: 28944 - DNA, 1501 bp, Oryza sativa
gctggtagcgcgcgcgcgcgcgcacacacatatatatatatatatatatttgatgctctatggtgtccgggctccaatactatccaccgttcactggctttaggattcgtgctgcactcaaatgggtatttggtgaaaattacgggtcaaactcgttaagatattcgtgtagattggtttccatttaatacccaagaaattgaacgtaagttatgctactgattttctttccatgtgatagcttgcttacaaaatcagttactttacttgatattttgccaggtgtttccatgtattagcactttttccatgcggaagagaatatatctgatggtagtagtagctccttctagatcagcgagatcaaatcccatcatatatatctcttattttcagggggtgttagattcagggtgtaaagttttgacgtgtcacatcaagtattatatagagtgtcgtagggggtgttcaggcactaataaaaaacctaattacagtatctgtcagtaaaccgtgagatgaatttattaagtctaattaatccgtcattagcacatttactgtagcaccacattgtcaaaccatggagcaaggcttaaaagattcttctcgcaaagtggtcgtaatctgtgcaattagttattttttagcctatatttaataattaatgcaggtgttcaaacgttcgatgtgataggatgtaaaattttaaggtggaatccaaacagacccttaatcccttctaaatttgtcctatagtgtaagagatttggtactgctggtcacattaaatcaacttcaaatcaaaattatttcactctaaccacgcccacccatactagtggtcaacatttttgctgtgctcatctacgtctacgtttgtgttgaccaactccgatacacttaaaaatggtgcaccatttttattcaactgatgaccccctatatatatatatatatataaaatattgatatttccgtgtgcgcgcgggcacggaaaaatgacgcgtgggtgacaccacgtacgacgtttggtgcgcgagccaaggcaacaccaacaaattccagccttctagggttagaaccaagcgagtacatgcaagcgaataagaaactttttgggaagaaaacttaacaagttagtgcttgtttagttggtgaaatgaaaatttttaaatgttacatcgagcatttgattaaatgttggaaggggttttcagagacgaataaaaaaaataatttcataactcgcctggaaaccgcgagatgaatcttccgagcctaattaagccatcattagcacatgcgggttactgtagcacttttagccaatcatggactaattagactcaaaacactcgtctcgcgatttacatgctagtttgcaattagttttttctttttatttatatttaatgctccatatatatgtccaaagattcgatataatgtttttaggaaaagtttttaggaagtaaacaaggccttactaccttgattt

SEQ ID NO: 28945 - DNA, 194 bp, Oryza sativa
tgttgggggttgtaggccttttatagaagaagatatacagtgcaaatgcattgcaggtttagctagctagcttagctatagggttcataacttgatatgcagtcaaactgtcaaagcaaggcctaaagacatctcttctaacccgtacatctgtcatggttttgtttaccaagccctaggaatagtttaaccca

SEQ ID NO: 28946 - DNA, 479 bp, Oryza sativa
aagtaattattaattcttttcctatcatttgattcattgttaaatatactttcatatatacatatggttttacatgtttcataaattttattataataagatgagcggttaaatatatgctaaaaagttaacgatgtcaaatatttagtatttagaaacggatggagtatatagtacgagtgctttctcgttgttgattgattggctgtacttgcggggcgctcggaggcgtgattcatgcaccggagtagttgggttttggacgccgtaatcatttatactccaaaaacgtggtggtttaggtgattaaggccctgtttctttcagcttggaattattataatctagattattgaatcaggttactataagctagattgttataatatgtagtagaataagtggttagttgtttctttcctagattattatagcctagattattgggtttgcaaatctaaagaggaagtggggtggca

SEQ ID NO: 28947 - DNA, 245 bp, Oryza sativa
tatagggaggttgtcactcttcccctcctatctctataagcagcttcaaagttctcttcacatccaaatggtgtcatctgcttattctttttatctaaacacagcagactgagatcttagctggaaaagcagattaaccattgaattattttctctttggccaatccacataacattcagaatttatgcttcccatatactccatgaagctaatggatcaagctcctccttttctttctcaattt

SEQ ID NO: 28948 - DNA, 446 bp, Oryza sativa
cggcaccgatctaccctcggccggcgcgcgcaggcggctcaagccgacccggggctatggcacggcggcggcgcggcaccggcggcgaccggcggacagcggcggcgattcggcagacggcggcggcgcgacgacgtctaagcggcggtgctaccagggaaaagagaggaggaagaaggaaggggaaggaggggcgtcctcaccgaaggggtccgaccggcgtggagggaaacgacggcgaccggcgacgaggaacaacggagggaggtcgacaagcggcggacggggtccgggacgacctaaggaacgaaatggagaggattagagagggagagagagaccatagagggcggaaacgccggccgaaggcggcggccatggcgtttcttaccggcacacgacagggatggggctccggcggcgaacctcgacggaggaggggtgga

SEQ ID NO: 28949 - DNA, 1501 bp, Oryza sativa
aaaagtccattttatacttttaagttttataaaattctgaaaattcaaataggacaatatttgcctcttaacttttcaaaccgtacgttcacctccaaaactttacaggcaaagcttttggctcacctccaaaacacaagcactgtattgaactgtcaaaattttctatgttaatcttgacacgttccctagacagaaagcgatgcacgcagtgacctgctcacacacgtaaaaaagcaactagtctccaaccttgattgcagctttgaagattagaaaacactaaaaacttggaaggggacgcccttacccttgttccaagagacacttgggccaagatcctgcaacaatattccagcaggtatacatgattaaatttaagtaaaggaagaaacgcacgcttatttatgtgagtagctagcctagccatcgtctccgtgatcagggagaaagtggagaagatgacaacgtttggagttggttggatcttttgtctagatcgaccaccacacatcatgcctgcatgttaatttcttcagtttttccatgatgctagctgtgcattgacctcttcttctgcatgcttgctgcatgcagacgtcggtggtaacttttcgttttcaccactttccacttcgctgattaatttatggataatatacagcatggatctttgatgctatgatcaaagttctgaaaatttacttgttgtagagctccgaagaaaaatagggatgaaaacagtttcgaaaaattccagaccggccgatcgagtatcgcttccataatagttacagtttgaccgttttccgattcaagctatatataagattcgtttttttctaacttatgtcagtatcatgttgatgccattactaaatatatagctaaattagtagatttagatttttcacattttcaccacttcacttatggatatagtagcatggatcttcgatgctacgatcaacttctcaaaaaaattacttgttatagcaccgatgaaaacggtggtggaaattccatacagaccgaatcactaatttctatccgcgtctgttggtttatatatagtcgctaaatagttaaactggtaaatacgaaaaaaatccttctttgatcaacccagaaccgtttatttgtgcagacatgattgacatcgattccaacccaaccgtgttttcgtcctcggatgataaaatcactccacaagttgaagcttgaaacgggatcagttgggatcgattcggtcccatcgtaggtactccctccgttcaaaaaatcccacttctaaatttgaatctagacaagtaggttaaaattcgatcgggttaagcacttatgttggaccggttaatttcccaaccgaaagctggtgtgtgtgcagctgcagctttatctggtggtcgttggcttatcctttcttggatcagccagcgagctagcgctagtgcgccgcacgcgccgcctgcggctgcccatgcatgtctcggtccctagc

SEQ ID NO: 28950 - DNA, 495 bp, Oryza sativa
aataggttattgtcacggattatttcctcaacatctttagaaatgtggttttgtgttaaacaaatgtcttctacaattctactactacattgcttaagcacttgttttaagctattcatttttatatttctaaaaattatataatttatttctataattaaatacttccttcgtctgtccagatcgatccgttgtcctagtaaaggtcaaaatcccattgtaggtgacaatattttgagacgaagaaaatagataaaccataccaataacctaaagaaaaatttgttctgtacagcgtggagtcgctgagagaggaatggactgagcgtactgtggaggcacatgagagatgatgagatgctgtgtggttaaagttgcgtgaagcaacaacccccccgtgttgtgtgcgtgcttgcagttgcaggtgaggtcggtacggtgctagcttggcctctccgtgtttttctttcttttttcttttttttttctggcagc

SEQ ID NO: 28951 - DNA, 1501 bp, Oryza sativa
ctctctccagctgctgctttgttgcttccagcacgtcctggaatttgccattttgattaatttgatcatcagttaactaattagattttcactactccaaatccaaatctacggttagttactccctccgtttcgaaatattcgacaccgttgactttttagcacatgtttgaccgtttgtcttattgaaaaacttttgtgagatatgtaaaattatatgtctatataaaaatatatttaacaatgaatcaaatgataggaaaagaattaataattacttaaattttttgaataagacgaacggtcaaacatgtaataaaaagttaacggcgtcaaacattttgaaactgagggagtactttctaggatgaagaaaagaaggaaacgtactttgaactgcatgtaggatgctcgcattgccagccactgggcatccatcatctcgaaagctatacagtacaggacgtcaaatgcctcttcgtgttctaccattaccatgcagtgaattagtagtatttcattgtaaattatacttcagaaaggcactgcccatgcatgcatgattcatgggagaagatgacaagatactaataataagcgatcatttgctcacctgacagcactttgataaagttaatccctggcaaagacttgggccgttctgagcagagcagcaaccaaattaattagctactaaaatcaatgaagaagtaaaagggcaaacagaaaacaaaacaaaacaaaaataaagggcacatcaatcatacctcgtggcattatatacactacatgccatctgaagaaagaaaagaaaacagttgaactagctactagtcctagcaagcaattatagaagcagcccggccagcagcgacaattcagtaactgcatctctaaccagttgcactcaaggagcacatgagcaataagagcctttcttgtgtcaaagcatatataataatttttcttcctgataattgttagtagttcgttcttggagttggctcaatgattaattctggctagatgattgtgtgtacaatatttatacaggtaatgataaatcaaatagcaggggcagagagggaacacacaatgagacgtactgttgggcatctgaatcagttagcagttagccatatatatatatactatcttcttttcgaataaatttttgcataacgtttgaccattcatcttattcaaaatttagtataaatgtataaaactatatgttaagattatattttatttaatgataaaacaagctagtcacaacaaaacaaatgatattataaattttaaataagacgaatgataaaattttatataaaaagttaacggtctcatcttttttttaaaaaggggtatatagtactactcattatgcaccatctgtctgtctatatgcatatgatatggtcattatcaaaccaaaccgcaagattcctctaattgtgcagactgcatgcacaagagaataaataaacacagaagatgc

SEQ ID NO: 28952 - DNA, 491 bp, Oryza sativa
ttacagcctgattggtaacgattgatcaatttatctcctgtcatacaacagaagggtagaaatgtcatggtgactgtccttttatttactttaagggattggaatcgatcatttcaaactttacacacacatattagctgtgcgctcgctgaaatgttgcagaatagtcattgtctttatgttgaataacatatatttataatggtcatagctctatggcattccccctgataccgacttatctcaatcttcaagcaacaaatttttactatgttacatagaatttcatgatgccttccttttatcttttagttgtgtacttatggcactaccactttaattgcgtaactaccagttagtgatatcttcatttgttgacattctgaataaagattcatgcttttgtcttaaagaaacaacttggttacttttcatgtgtaagaagaaaatgcacctaaatagctaactgatgtttgtgggggacaaacagg

SEQ ID NO: 28953 - DNA, 1501 bp, Oryza sativa
caaatcaagtcagtctggggttttagtaaaattatttgagatttattcgacagtcagtcgggatttgatgggaagaatgcattaggtcctaactcaggaatatgggttgcaaggtatttatgctcttattattagtagtgtgtatctaatttctcattattttatcgctatgtaagttcgtcttatttattcgccctcatgcaaaaatggtctatacacaaaattatgctctctttagttcactttcattgagtcttttactgctttatttaaattggatttgagcatgcattgatcctacccctttgtcttctctagatggccgatcacccacccaaccaccgcggagaaggcatggatgattttgtggcagagttggctcgcatgaccctagtggtgggctaccccaacgcgccggagtactcgaccgttccaccgctcaatggcgagcttccccaccgtgttcgtctggaggttcatggctatgtgggcacctgcctcgctaatatggtggttgaggcatctgggggcactgcagatcatgcctgctaggaggcagcatatctgatgatggccagacttcgtgagcgccacaactacatcttctgcaacacggcataccatttccaccctcgtcgagcaagtggtgacgatgtcaacaccttccgcccgacagccggcgagaacgacaccaccttcggccacatgtgcgccgtgatgaggggaatggacaggatgcactcggatctgcacaaggcatccaaggccttgaatgacaggaagctcgtgaggatcatagctttaaaggatgagatagcgcgcctgaagaaggagaacgcttagttgaagggtctctctgcgctaggaggagttcggatccgcaccacgccccgcaagtctacgactgctcccgtgcgcattcagcttgcgcccaggaacccacctcctcctgcagctcctcccgcagctcctcctgcagttcctgtagcgcccgcagctccaactccagccccagctcctgttctagtgtcagctcccgcgtctgctctctccttcgctccagcgtcagccgccaggggtctagccagtggcagccacgaccgcagcagtagcagttccagtggctcagagccgggcagcggtgagacgtatctgccagactccaggagccgctcagaggaacctggcgacgagcaggaggacgcattcgactccaccgaccgcaggagccgttccgagcattaggctcgttttcccttagtttatcgactgcttagtaattgcctgttagtttgtgtgtctaggtttgttcgcttgtgggtcagtcgacggtcgatatcatgtgcctatgatacgactgtcttaataaggatttgcttgccgttttaagtgttttaattcagatcagaacaattgcagtttaaattcctatataataaagcttagttcctgagcatctgtttttcttgttttctccccctccgtctgctctcccttcaga

SEQ ID NO: 28954 - DNA, 1501 bp, Oryza sativa
cgccccaccgtgccgccattagcacgcctctttacccaccgccggccgccgtccactgtccgctgccgccagctacaagaaagaagattgggtgatttggcatatggggagctccaacaccaacgccaacaacagcagcggcggtggcaaggacaaggacgatgagacatcgccgtccttcaaggagggcgagagagtgctcgcctaccacggccccctcctctacgaggccaaggtccacccctatctcccattccactccaatccaactagggttctagtcccctcccctcccctccggattgatttcaatccaacctagccgatacatatatttatatagggtgatctgtctatataagtggcaaataattttaatttggatcacataccggattcatggagcattaagccaccgatgtgagccgtcggggtgcatccagcccttagccgggaagcggcatcactgttgtcatcgcctatggccgctgtaccctcccccttggcgtcgaggcctacgggaagagggagaggaggtgggacgaccgtcgctgtcgtcttcgccgtctccgtgccgtacccaccattgctgcatcgcgtcgtactctcaccgtcgccgtgccgtgcctgcgacacgggaggagagggggagaaggagcggcgctgccggtgggggaggggaagcgatggagagagagcgacagagggggagaggcggccgacggtaggaaagggagggaaaaaatgaaatagggtcagggttttttttggcacatgtggttttgattgatttggaaccgatctgagctgagccatccatcaaaacgaacgacgactcagatgctcacatcgatcccatatcgagctggtctccatcgtcgggtcgtatcattgctgggccacgtgctgtctgtcgggtccaacactacgcttaggttatactttcagttagggcccacatgatagtgagagtagtacttggagaggctgattagactttagtttgcttgctgggctggacgcttgcttgcgggctgaggcgaaggggaggagaagagaggaaagtaggccgactcggttgcgggctaaggaagaatgggctgaaaatggcccaaagaggaatgatgatttttatttaaataaatactgaaatgaatgatgtttatataatcaaaattgacaattaaactctagaaattccaacaaattttgaaaaagtgttattaatgatgactaatttactaaagattaaatccaaccatagccaaatatttcgatgtaaatatcttttcttcccgttgcgactttctttttagtaaagcagaaatcggcagttccgatccacaaagagcccctactgcttggcttccaacgttcaaaaccgccccggcatagtctctctctccgccccgccgcgccgccattagcacgcctctttgcccaccgccgtccgccgtccgccgtccgccgccgccggctacaagaaagaagattgggtgat

SEQ ID NO: 28955 - DNA, 289 bp, Oryza sativa
acccttagtattgtaaaaccttaacctatgcaatgaagaaccagtgatattgaatgtatcaatatctactgatccagggattgatacatcaattccagtcggatccaagttgttagtttttgggacccgacattatatctcagaaaaataataaaaagcgttgccccgcatgcaaaaaaaaataaatttaaaatggtggggcccctatcccacatgtcagtctcactcctctcttcttccctctcccttctctcccttcttccctttcccctctctccccttccccagc

SEQ ID NO: 28956 - DNA, 1501 bp, Oryza sativa
taaatgaatttccaaaaccgcggaccggggaacgtaccaggtgtacggtttcccgctcttgcacttaaggaccgtttccttggaatttcatccgaacataagacaagtacgaccacatgggtggaatgggacacccctggctgagtaactagcttatcaggggagccttgatgccgagagacatgtggattcaccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgccttgtgaaattgctgttgtggaaaggggattgatgtttggaaaatctgcagctgatgggatcagctaggcccgggtggccgtttgaaagttgttggccgggtgccaaccttgatttcaattcgaaaaactgatacattgcacatactccgaccggacgagacgcactgtctcatccgtgtcgtttgagaagcactcacttagttgatttcagaaaagagttcaaataaaatcaattgcaaaaacaacagcctttccttgaagcctgcattaaacacttatttcccatggcttgctgagtactcccgtactcacccttgctctatataaataatcccccccagttgctgaagaagatgaagcggatcccgctgacgaggagttcttccaggagcaagccggctacgatgagttttagggtttcagcctagttcccaagtcgcgcctgtgatgtttggtccaagtcttggcttccgcttcccttttgtaatgcagttgtaagctcgggatctgtccgcagcccaacatgactgtactcctactctataataaagagacctctgttgctgtgatattctgtcttcctgtgataccagcactgtttcctgggactgttatcgattaacaggttaatttggagcgtcacgggctagttccggtcgggactagttcggggcgtgacaagagatggtatcagagcacaggcttggccctagggcgaaacccgacatttaggacgaccctaaggatactaagttcaaaactacttgcgaaaagctaaggcttcttttggtttctttattttcaatagtttgtttctaaaatggttactgatcttttctccctccttcaaaattgtagatggcagtgaacgccagcttcagttcccacggttttggtgagggtcaccacgtcgctcagcttcgtgacctcgcccgcttccttggcttttcgtgtcccgagtacacggggtactccgtggaccgtgttccccctcgctg

SEQ ID NO: 28957 - DNA, 1501 bp, Oryza sativa
catccttggctcctcttccccttcccatacgcgcacaagggagggagtgaggcccggcgacagcgaccggccgggagaggtcacggcggaggttggagagggtggagcaagaggggtccgctgtcggcgttggcttctcaagttgggcatgcatgtttgcaagcacagattggcttggtaaaggaaaaaggtccattggatgttcctcgactataagttgagtttaatttcctcaactgtaaaactaggtatgaagggtaacaacttctaatacgggtgtaaatcaagtccctcaattgaattaccaacggtttcgactaacatggcgcttattgacttgtattcgtccgatgtggcggcttaagtggcactataccaacaaaatttaaaaacaaaacccctaataggatgcacatgtcagtgggaatctggtaaggtaaaaaataaaaacaaatatattgggcccacacatgtcagtgagtggtgggacccaaatgtcattaccccctctccccttcttctctcatggccgtggccatggtgatggtggcgaggggcgatgttttactgcctagtgcctactacagagcttgaggttaaggctattctgagtttctatggactatggttggtattttctgatatttggaacaacgccggtaatcttaagacatcaggtggcagtaaatcatctagaatcaaaatctggttgtttagtttgatcagaatcggttgtttgatttggtcagtatctgattaatttgaaatggctttttgaatcagattttaagataacgcattgatatatctacaagctggataaagagaattcgtcagcataccattgtatacccgtaagacataaatggcatttctgacatgcatactagtagaatgaagctgctgaggacaataaaagaaaataaatggagattacttattaatagcatgactactggaggcatctcattaatttgcaaacaaccaaaccattgcgattgggatgaatgtggaatgaagctacttctacttcctttaacagaataatgtttaagactccatgattgcataggtagccaaaccagactagtcatgtcagaataacaattaacagaagggagtaataataaagggttgcactgcattataaaaagaagaacagaaatgcaccacaagcatcatcatacagcaaaagaacacctttcctgagccaacatcttcagttcaatggtacaaactgaactttttaactgcaaacttgaacatatgatgctagctagccaccataaaataattactaaacaactaggacatacacacatctggaaatcttaatcgtgaacgatcaaatcttgtagatgctagcggaagaaggcccccactcaagtgcctataaatatgcagactttctgtatgtagagtacattatattaaatccaaaacaaagcctgataaatcattagcactgcatatttttgaaccatcaggtgtaagaaagata

SEQ ID NO: 28958 - DNA, 194 bp, Oryza sativa
atccgcctctaccgccggccaccatctcctccttctctagccatagacgcaaagcaagagagagagggtgagagaagggaagcagggggaatgggattagggagggattggtgtgaggaaagagatgacatgtgggcctagatatttttttatgttttattttgctgactagatgccatgttggtggccaagta

SEQ ID NO: 28959 - DNA, 1501 bp, Oryza sativa
tcgccgtgtgctcgccgccgtcgccgcccgagctcggaagcgcctctcgtcgctggcctccctcgatgcgtttccacccaatccaacgctagcatcggattcccgtagccgcgtagatgctctcgccgccgggaatcggcccctcgtgacctcgtcgctgtttcccccttcttccgccgccggttgccgccgccgcaatccgccgccgtcgagcatcccccggcaaatccgagtagttggctcgactcccctcgtcccgcgcaacttcccggtgtgctcgctttcgcctagatcgccgtgtttcgcttcgccgcttgccaccgccgtccgccgtccgttccggccggcgtcttcttcaacctcccgccggcccgcgtggctgccacgtaggcgccacgtcggcgccacctcgaccgtgaccggatcagctgacccggccagccgctccctccgtttcccctccctcgcgcgcgcggtccaccgcgagctgtgaggctgcgcgtgggcccgccgcatccgcgtcctccgcgaaccgcgcgcgtgcaccgcgtccctcccccaaaccctggcgcgcgccgcgtgcgcgttccgcacggtgaaccgtgtcaccgacaagcgggtcccactcgggaccacgcgaggtgagcccagtccaccggctccctctctcctcccctcccgcgcgcgcgctctgggccgccttcttgggccgaccggcccatttagctcggccgagccgccccttttctctcgggccgcgccctagccgcccgagggaagtctacttcccctccctcttccttttctttttccaaaagggtttaaataaatcctttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgttttgcgtgtagtttcggagcccgaagacccgcagtgcgaggatttcgaggatcaagctcaagatctcgagcaaggcaagccacctttgaacatcttgagcctatatttgaacttaattatgttgcttgaaaaatattatgcattgataggatcacacttaatctgcttgtcccgtctgcaaggcagattggcggacctacctatttgttgcatttgatccttcctctgttaattgttataccatgtttccttgtaaccacctagtcgcgcctcggaaatcgtgcactctgcactagtatcaacggtcgccttcaaacttaaaatctgagtaacttcttgggtaaaacttgggttttacaaaagacttggaaaacccgacacctgggttggtgcttgtgaactaaatgaatttccaaaaccgcggaccggggaacgtaccaggtgtacggtttcccgctcttgcacttaaggaccgtttccttggaatttcatccg

SEQ ID NO: 28960 - DNA, 388 bp, Oryza sativa
aaattttgcgcaagtttttgcatattatgggtataacatgaagatatgaatcaacaatacatgtcattcccatgtccgatacatacaggatacagccatatgcagcattccagtgtatctggacatgtcattcaagtttagcatttaaaattaacaaaatgagatacagcagacccaccatctgcatcttatataaaaatccacgattagcccaatatcatattaaacccaaatccctctgtggagtatactagaaaacttgagaaaactaatgagcattctggaggaaatgcataatcagaaattcagaaaaccattttaaggtatcctagggtgaaacatattagttgaaaattgaagggaaatgcagcagatgtcacatggaaca

SEQ ID NO: 28961 - DNA, 1501 bp, Oryza sativa
cggtccaccggctctctctctcctcccttcccgcgcgcgcgtgcttgggccgccttgggccggccggcccatttagctcggccgagccgccccttttctctcgggccgcgccctagccgccgaggaaaagtctatattccctccctcttttcttttcttttcttttccaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagagctttattttcgccgtttgttgagttgtcccgtttcgcgtgtagtttcggagaccgaagacccgcagtgcgaggatttcgagggtcaagctccagatctcgagcaaggcaagccacctttgaacatcttgagcctatatttgaaatttaattatgttgcttgaaaaatattatgcattgataggatcgcacttaatctgttgtcccgtctgcaaggcagattggcggacctacctaatttattgcatttgatccttcctttgttaattgttatatcatgtccccttgtaaccatctagttgcgtctcgatattcgtgcaccctgtgcgaatatcgacggacgccttcaaacttaaaatctgaataacaacttgggtaaaacttgggttttacaaaagacttggaaaacccgacacctgggtcggtgcttgcgaactaaataaatttcgaaaaccgcggaccggggaacttaccgggtgtacggtttcccgctctcgcacttaaggaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgattcccacgggctgggtgatccgggttagtaatgtcgtgtgggtaaagtgtaccccctctgcagaggttaacaaactgtttgaacagccgtgcccacggtcatgggcggatgtgaggtgattcctagcgtagttttgtttgactactgcttgtgaaattgctgttgtagaaaggggttcgatgattgaaaaatctgcagctgatgggatcagctaggcccgggtggccgtttgaaagttgttggcccgggtggccgtttgaaaagctgttggccgggtgccaaccttgaatcaattctaaagactgatacattacacatactccgaccagacgagacacactgtctcatccgtgtcgtttgagaagcactcacttagttgttttt

SEQ ID NO: 28962 - DNA, 1432 bp, Oryza sativa
ccccctaaagctgtaatgttttccttcgtggacaatttctgtacctgcgtcttactctcgagctgtgtgtaaaatctcggaatttctggctgtcaacgtggtgcgtactgtgatatataatcacatgtttggaatttacaaatcagctgctgccttttttttgtttgatccggtgttcttagatagcaagagaagcacatgatgattggtatgcattatatatattgttgggttgccatgttaattaagtgatgggctcttgattaatcatgtgacaaaggatggtgcgcacttggtatattaaggcccaaatcgaattcttgttggaccttaatttagctggtgaaaggattaaaatgtagtaaaatcgagtccaattcatcccaatccattcagatacattctctcaccaacaatttgcctcatttaaatctctcctttccccaacttgaagagtcactggtatgtgggttcatagcaaagagaaccgatatgacagtgaaagtaagtcggcttaagtcaaagtatctgaatcgcatcttgagagcttggtgcctagggtggtagctagcgagctacaatgagtagggtagggcaactaaaaggttcaaaatgattttgtaaagtattgcaatcacttattagattttgagtaaaatgcaccggtggtattacaacttgcaaggtgagggtagtttagtcactcattttgcaaattgcttaaataagtcacttatcttccttagatggtgcaaatcctaccaaatacattgtcatatggattgtttgtttttaaattgaaagttgtattgacccaatcatgcatttttttagccatgtgggcagggcaagcattaaaattataaattaacactcgtattttttatgtatatgctattacttctactttcaataaacaagatcatatttttagtcgcattgcacattggcttatttatggatcgtgtgatcatgtttgtaaacaaattgacatagcatataacttcattgcagacaccccacatgacacatgttctatgtgatttgcacccctaaaacaagataagtgacttgtttgagcattttacaagatgggtgactaaattacacctatctcacaagttgtggtactaatggtgcattttactcagcatgtaggaactttaacaaaaggtctaccgtgcatatataaatggatgactttttaactgtgacgatatgcatccatcagaatatcagattgacagcaccactgcatgcaccaagtggagagcataaatcctcaaatatatgtcacaaataccagaaatcatgacctttaatttgattccatcggtatcattcccctattataattagatcccagcatacaatcaaacacagacaacagtttattccattggatgctcctctacttcgttttctcaatagg

SEQ ID NO: 28963 - DNA, 257 bp, Oryza sativa
tggagaagaagtcttaggtggagtcctggcttataccccagttgagcgcctgtgaagatggagccgtaggcccgctttttcgctgctgtttatttttgattgtcaggccttaagtgcctttgtaataatgtaaatattatcgatataataaagatgtgtcttttatatcatgtttgtgtagtgtaccccggcttttcctgggacggggattaatacactagctttcgggaaaatgtatttttctcggtcgcgacagg

SEQ ID NO: 28964 - DNA, 1501 bp, Oryza sativa
gtgagtacgggagtactcagcaagccatgggaaataagtgtttaatgcaggcttcaaggaaaggctgttgtttttgcaattgattttatttgaactcttttctgaaatcaactaagtgagtgcttctcaaacgacacggatgagacagtgcgtctcgtccggtcggagtatgtgcaatgtatcagtttttcgaattgaaatcaaggttggcacccggccaacaactttcaaacggccacccgggcctagctgatcccatcagctgcagattttccaaacatcaatcccctttccacaacagcaatttcacaaggcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggtgaatccacatgtctctcggcatcaaggctcccctgataagctagttactcagccaggggtgtcccattccacccatgtggtcgtacttgtcttatgttcggatgaaattccaaggaaacggtccttaagtgcaagagcgggaaaccgtacacctggtacgttccccggtccgcggttttggaaattcatttagttcacaagcaccaacccaggtgtcgggttttccaagtcttttgtaaaacccaagttttacccaagaagttactcagattttaagtttgaaggcgaccgttgatactagtgcagagtgcacgatttccgaggcgcgactaggtggttacaaggaaacatggtataacaattaacagaggaaggatcaaatgcaacaaataggtaggtccgccaatctgccttgcagacgggacaagcagattaagtgtgatcctatcaatgcataatatttttcaagcaacataattaagttcaaatataggctcaagatgttcaaaggtggcttgccttgctcgagatcttgagcttgatcctcgaaatcctcgcactgcgggtcttcgggctccgaaactacacgcaaaacgggacaactcaacaaacggcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaaggatttatttaaacccttttggaaaaagaaaaggaagagggaggggaagtagacttccctcgggcggctagggcgcggcccgagagaaaaggggcggctcggccgagctaaa

SEQ ID NO: 28965 - DNA, 384 bp, Oryza sativa
ttagtaaaacttaaaatagtttggttttgaccaaagttaaaacgtgttatgaactgagacataggagtcccaattaagggcccatgctgccacgtgtcaaggacgaccagtagtcaacgtcgactccaatatctttcttgctcgctttctatccgtcgtgaaagtcacgaaacatacttttttgccatgcgtatatgcatgcacgactgcatggattaataatacggcaccttaatttccttccattatctcatgtacgaactaaaccgcttaattagttaattaatttgtttggcaaagtggctgattggcatgcatatatatatttttggcctttggagatatgggacaggtagtactagttctaatctcagtaagacaaaa

SEQ ID NO: 28966 - DNA, 228 bp, Oryza sativa
taatattagagcctagaggtcaaaaactattttgtatagagaaaattatcccacatagccatctgttgtttattcaagaaatattatatgtatcttcaggggaaccatatgtgatacacaaattcaattttatgtccattgttagagaatccatttgcttgaatcaaaattagagaatcatatatctgatggaaaattgtctttttaccaatatgtttgccttgcaga

SEQ ID NO: 28967 - DNA, 1501 bp, Oryza sativa
ataagtgtttaatgcaggcttcaaagaaaggctgttgtttttgcaattgattttatttgaactcttttctaaaaacaactaagtgagtgcttctcaaacaacacggttgagacagtgcgtctcgtccggtcggagtttgtgcaatgtatcagtctttagaattgaatcaaggttggcacccggccaacagcttttcaaacggccacccgggccaacaactttcaaacggccacccgggcctagctgatcccatcagctgcagatttttcaaacatcgaacccctttccacaacagcaatttcacaagcagtagtcaaacaaaactgtgctaggaatcacctcacatccgcccatgaccgtgggcacggctgttcgaacagtttgttaacctctgaagaggaggtacactttacccacacgacattactaacccggatcacccagcccgtggggatcagccacgtcgggagacctccaagctttcatgacaaggcatttctaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtctcattccacccatgtggtcgtacttgtcttacgtttggatgaaattccaaggaatcggtccttaagtgcgagagcgggaaaccgtacacctggtacgttccccggtccgcggttttggaaaatccatttagttcgcaagcaccgacccaggtgtcgagttttccaagtcttttgtaaacccaagttttacccaagttgtttttcagattttaagtttgaaggcgtccgtcgatgctcgcacagggtgcgcgaatgtcgagacgcaactagatggttacagggggacatgatataacaattaacaagggaggatcaatgcaacaaattaggtgggtccgccaatctgccttgcagacgggacgacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaaacggacttacggttggggagatattgaatttctaagattattggatttttggtctaaaggaaaaggatttatttaaatcctttttgaaaaagaaaagaaaagaaaagaaggagggagggaaattagacttccctcgggcggctagggcacggcccgagagaatggggcggctcggccgaccttaa

SEQ ID NO: 28968 - DNA, 153 bp, Oryza sativa
agacacagacgaactacggtgtgaaaaaaagaggaaacaaaacaaccaaacaccgtatgaaatatctgaatgtatgaactctctacatcatccataaattttaacttatattctatgtttctgtgttactgatttgacttacccttttctagt

SEQ ID NO: 28969 - DNA, 484 bp, Oryza sativa
tctttgaagatattttgttcattattctgcttgatgaggttctcagtgtaccagtgtatgataaacactaatcctactatattattgtggaggaggtctatgcaatgtactcagtttttacaccttactagaagcattataaaccaatttgtctgcttacactgttgaagctcttaatttgttaaatcatgtctcaagattaccaagatttgatatggagaaatctgtttttcaatatttttcatgtttcatctgcacgttaattagtaaaactctagtcctttattcttttttgtgcactcttgatttgctattgtttgttgacaaagaggaacttagctgtgtagttgctctagagaaatgaacacaagaaggtctttctgtaaataattttaactttaatgcaaactcttcttgctatagttgtcttgtttggggagaacttctgttatcttggttgaaatgattggtttgttctgcttaa

SEQ ID NO: 28970 - DNA, 1032 bp, Oryza sativa
attcctgcagcccagtcaactgggccgataaattctgcttagacataattgtgtatctgtgctcaaagtctaaaatagaaagtactcctataatgttttcaagggaagatgcatgcccaaatgaccaaaatgggctgatgaaattcaatgaactagcagtattttaaattcagttttcaagttgtggtgtggcacatccattttaaatcctttttttttacctacctcaccactcaacctttttgccctcaggcctgcaccaggtgtggctgctggcctgctaccccaaatcatgtcttcctttgcttccattgcaatgcaagtcacacacacacacacacacatggcacattgctcattgatcttagctatctccttagccatggcatcattgtatttgcagactcttgcagggtataaaaacccttgtttactctctgcgactgcaccatctccatgacagcttagttagtttctctggtttgctatatagatttagacacagatggcgtgcttatccttgctctccggcgttcatcccctaccactactcctgctcattactctcttaggtactccttcgttctagaataagtttacttttcaaccctccgatttatcataaataaatttatttttagtcattattatattggagtttgtaaaattaggagatggatacattaagagtagataaagcaaaaaataattgtatcaggattgataaagtgaagatattttagtcttttaggttttaattgatatgtggagaataggaaaattgaacttattgtaaaacggaggaagtagatcacatccatggcttttgtatattaaattagttccattaaaatctacaataaaatatgtctgatttatttgaaactgaaattgctagctatttttataaactctgttaaagagagagaataaaacctacgttcttttaatatgaaatggataccgtaaatcacacccacctacgttctttttcttttggcaaaatttacttttcagcattggtaatttcca

SEQ ID NO: 28971 - DNA, 497 bp, Oryza sativa
accttcttcctacttcctccgtcccatattaagtactcccatatttttaaatctcttcatttgtcccaaataagttcgtttatagagtaatcattacattggagtttgtaaaagtatgtaataattatattagaagtagataaagtgataaatagttgcattgagatttgctaaagtagagatactctaatctttttacttttgtattggcatgtgttccatggataaaaaaataaatttattttgggatggctattgtcatgaaccccaatgcaatgattgttagaaataaaattattttaggaaaaataaaatagtgtaaaaataatcttattttagctattgaaaaggtttttcttaatttgtagtatctttttttaaagaaaaaaaagggggttttccaaaagctttaggcctgggactgagccaggaggtatggtgcacacgaggcactgcagcttgccatcacgaccactgatgaccacttgactcagtca

SEQ ID NO: 28972 - DNA, 1501 bp, Oryza sativa
gcatgatatcattgtataagaataaattgatgatttataactgatcatattcaaatatgttatattagttattcaaaattgttcatttaaacttccaaaatatacaaaaccatcatcaaaaactaccttagggggtaatatggatggtatggcaaagttcaggcgggttggatgtcgattttaaagttcaggttgctagacggatttccataaattttaggagggtatttggactttttcccttacttattaattgtttctcagctactatgccacttaattggaatatttagcatatgcacacgtaggttatctatttatcgatatcaggtagcacatactttctttattttgtttagcacacatattcttcgacttcagcaactataagaaattataagcagcttattatatacggtcttaaacgaggctatcttaaggtggacttgcaaaaggagaagaggctggtgctacaacatagtattgcttcctactcgcagagtctctctgctctctctctatctcttcatttgtctagcgaatgcttatttatttgcagaaactactcaagaacaaccatttttgtcggctctctctttgttttgtttgttttatttgtatgaaatttaacgcatgaatcatagcatatggtagtattgcctattattttacttgctagaaagaatatcacatctggtgttttgttcaccctacctaaattatggttgccatccatattttgcactgtcagaacatgttttacatttatgtgcgcaaatagtcgatagagatatcacaatcttatacgtaccgggaaaaaaatgcttcgacaatggtgtatttgaaaaaaaaaagaatagaatcataatagaatataattagtgttattcctggcaactgaaatcctgatttagagaacaatactactatgtacataaatactgttatcgtcttttggttgaggataaattaccaaatattaccgtagcgttagcacgggcatactactagtgaaaaaaaaaacctttatacacttgcttaggtacgcatgcgtacggacaccattacgcccatacggatacgtacacgtacggcctcgactcatcgagctcgagccgccggcctggccacccttcgtcgcccgcgaacccccctttctccgtcgttccctccctttcaacctcctttcaaaccctagaaactcgattccccacctccaaaaccctaaccctagctcgccgcggagagcctcctctctcctcccccttcacgccgcccccccgcggctcctgcggccgccggaacccaagcccccgcctgacggggccctcgcggacctagggtttgcccgcgcgcgctcccccctccttgggccccgaccctgcggggcggtagcggtcggcgcgtgtgggggtggagagagagggagaggaggtgggggaggtggagatgagatgaggcggcggggtggcggtggtggtggtggtggtggtgatggcca

SEQ ID NO: 28973 - DNA, 341 bp, Oryza sativa
aactgaaagtgctgcaagagccttagacaatcgtgattgcgatcctcttctccatacacatagaaatatgcgatgaacagccctttgagatacgacatcttgccaaaattgacagagctctgatctaaattagtagtactccacccgagaatctccagcttaggtgctgagatgttggcgacgggttgactctgagctgaaccatcagaaaagtggtaattaacatctaataattcaagtgctggtgccaccacattgaactgttgcaatcctatcccctggagcacaatctccacgagagaattggagtggatgttgaaattgttcatcctgtgagcaga

SEQ ID NO: 28974 - DNA, 396 bp, Oryza sativa
caagccgatgcatatcaaagaaatgaatacaatgagttccacttaccatcttgggaccaacaaatatcttttaatctctctgaaccagagaccaccattaaattagacgagcttcagaatcttctagttctttcggcgaggggaatggattgaccttaaaggaagtggattgactttgattctctcaacaatctcaaattccagaaacatgattacaatgttcgtaacacacgagagaatcgattcgtccagccgaacgacttccatcttcaccagctataaaaaagccgagaaatccaggtgctcagcacagtggtccagatcacttgcgccatcacaagtcgcaagccaaaaccatctcgctcgagctcaccatggaattctcctcgagttcaa

SEQ ID NO: 28975 - DNA, 390 bp, Oryza sativa
gggatgggagcagcaaatggaggaggcggagggggaggaggagagggagatcgatctgatagggaggagagggagatcgatctgagaggataagtgcgaggtggttgtagaggagaggatagggaagaaggattatatattaagcgttgaatttgatctttagtcccgattgataacaccaactgggagtaaagttaggatctttagtttcggttggtgttaccaaccgggagtaaagatcccagggggcctgacaaggcctgacaggtttagaactgggactacagatcatctttagtccctggtgttaccaaccgggactaaagatcaaatatgcccactgtagccaccaaccgggactaaaaatcatctttagtcttggtttttaga

SEQ ID NO: 28976 - DNA, 1501 bp, Oryza sativa
tagtggttagatttgtttatatatgggtgagccaacatgatgttaataatgcagaaactcttgttgtgttcgtcttgcagtagtgtaacacaaaatataattttgttccattagtgataatgccttcaccaccataaaaatgcaaaacaaagtactcctttcggcatttcatcaaacatatgtcatgcatgaccaaaattgcaaaattgcccgtatatggtagtaatgatcttgacgttacccatcttgtacagagaagacctgcacaatcaaagtagtaaaccaggagccaaaccgccaaacccatcattaacacccaagaggtcaatatatataatcagatagatctgcctccttttgcaaagaatgattttcacccgttgttgaggaagctgacgaaggcggcgacgggaagaggcaggaaagaagtagcagctgaggcggtggtcgtcaccgaactgtctatcgagttcttagcctctcgccgttttctggtgctctgtagcactgttcggggtggacgcggcggacgtcggcagagggtgtagagtcttgactgagaggcgtggtcacggcctcacgggtggagaggatcccgacaacggcaacggggccgtggaggacgggcttgggcgccggtggagacatttccgatgaccgcacaagggcgcggagcattggaggatgatggcggcttcgggctagggctaggcggtgcggcaggaagggggcaacggtgaatcggcaacggcgctagggcgagcaggcgcggagggcagaggcggcgatgagaaggatgggatcatgggattgatgagggaggggtgccggaggagatcagcgcgatgggcggaggcacgcgagcagtgggggtggcggcgaagaaagcgggaagcggggtaggaagggggtcgcgatggagggcggcgaaagggaagggagcgcgcgtgcgaggtgtgacggagcacggagagagagaggatggatgcgcgatgtgagcgtggatggggcgtcctgtgcgttgatttggtgggaggatcctccgaaacatctcagccattaaattgttcaggactcaccgccaccactacataatttttaattagtagagattttgttcgagtataagtattacaccctccatcctaatatataaagctctgtttggttaatgggatagaaaaatgttacacacccaccaaaagacgtctctaaatcctaaccgttcattcttcctcttccatttaatcttaacccttcatttatttctcaatctcaattccacccctcatttcacattatccaaacacaccctaaaggttcctttgaattgcaggaataaaaaaaacgaagaaataggaaaatcacaagaatttgggaaggtggttaaaaacaggagggatttaccaaaacacaaaggaatgtaccggttttgattgggaccgttagaaaaaacacagggaatcggtatgtagaaagatagactcgaaggaaattttcc

SEQ ID NO: 28977 - DNA, 475 bp, Oryza sativa
ataccctccgagtaaactttcagaatttactgctcccatcagctgaaggacagaacaactaaggttaaatgaaccttcagaattttgacgcaaggaaaatatgagcgaggaatcatgaagtttttctagtttcttaccgctgtaccataaacttctgctgtatcaaataaggtcatcccattatctatgcttgtgtcaaatgctgctttagcctcctgcagtctcctgtctgatgaaatcaaaggaagcacgttttcttatcatttctttgttctgtttttggaagacttttcttcccaaaacagcagcaacgattgtatcacaaatacaaagaccataacatacacctgaagtggaaaccttacaaaagaaaaactctcccagaaagagggggaagaggggcaggaaaaggacagagttgataattaactaaccaatgatagggacatgttaagttgctaattaactaatcagg

SEQ ID NO: 28978 - DNA, 1501 bp, Oryza sativa
agcttccgaatatgatctgtagctctatcctactcctctataaaaaaaaattcaaactggtccagattcatccctacagtttgattttttttacggagagacactactacaggaatgattttccttgacgggggtcattttagattgcaaacggcgtgtaagtagttgcgtctgcgaaaatcgtgctccattttcacgtgcgactctttaagatgactgcacaaaaaaaatcaattatcgcaggcgggccacttaataggtccgcatgcaaaaataggcttgttttcgcgtacggacctgttaagtcaccgcacacgaaaatagcctctcaacttttaatccgccgtcgctgccccacatgcacccactctcatcgctatctccttagatcccatctcacacctgctcctcccatctccctctccgcctcctcctcccatctccctatccgcctcctcctcccactcctccctctccctatccgccccctcctcccactcctcccatctcccagcgacggcggcagcatcggagcggattcgttgccggccgccgcagtgaggatggatccatcgcctgtgaccgcgaggggatccgtcgccggcgacagcggggacgacggcggcgggccttaggcaaggcggcgatgacgacggtggtgacggcgacgatggcggtgacggttttttttgtttcgattttttattttcccgtgcacacgtgaaaatcgcgattttcacagacacttcgttccagacgggtggaagattcgcatgctcgaccgcacagaaaaatcattattgcactagtgggagtatatgttagcagatttgtttcgagcctaatcaacttttattatagttcgtgtgtgcgcctggatcaattatttgtgaactagagagagctgtaccaaagctgaacctaagaacctgattatttgagcgggcgtccactgtctagctttactagtactactattgatcgagtcaatgatcgctctactagtactactattgatcgagtcaatgatcgctctactagtactactattgatcgagtcaatgtaacgatctgtttggtggcatatgatgtattcttgatcagcaaaacgtatgcttgagctgcaagccgatgtataatcaaggaaatgaaaaacaatgagttccacttgccatcttgggaccaacaatatcttttgatctctccgaaccagagactaccattaaattagacgagcttcagaatcttctagttcttccggcgaggtgaatggattaactcttttttttaaaaaaaatccagaaacatgaataccaagttcgtaaaacacgagagaatcgatccaccagccgaacgactgccatcttcatcagctataaaagagccgacaaatctaggtgctccgcacagtgatacagatcacttgcgccatcacaagtcgcaagccaaaaccatctcactgactagctcgagctcaccatggaattctcctcgagttcaa

SEQ ID NO: 28979 - DNA, 426 bp, Oryza sativa
tgcgcatacaaatgcttatttgcatatatatgatacgttttcttatcctacaatactagtagatctcttaatttatactccctccatttcaaaatgtttgacaccattgactttttagcatatgtttgaccgttcgtcttattaaaaaaaattgtgaaatatgtaaaactatatgtgtacatgaaagcatatttaacaatgaatcaaatgatatgaaaagaataaataattacttaaattttttgaataaaacgaatggtcaaacacgtactaaaaagtcaacggtgtcaaacattttgaaacagagggagtaattaagagtttcgtattacttatgcagatgcttgagatatcataatttatgtactactgtataaacggagtcgtcctctagagtaaatttgaaaatatactgttttttttagt

SEQ ID NO: 28980 - DNA, 602 bp, Oryza sativa
ttcttttggcttatgaaccgtagacaaaatttaaaattttaaaagtgattttagagttaatttagagatttattttttcgtagtttttttcgtgtgcttttaaattaaaggaaaaaatatgaatggcctcctgaactatagtggtcgattgaattacacccctaaaccacaaaccagacattcttcacctcccaactatataaatcggacaaataacccccggttcaattcgcggtggttttgatcctctcgcacgccacgtaggatcaaaactaccgcgcacgtaggattaaaaccaccatggattgagccgggggggttatttgtccagtttgcatagttatagatgaagaatgtctagttttgtgatttaagggtataattcgatcgaccgtgatagtttagggatagtaaggatataaatataaaagctcactcattaatctttttcctaattagctgtagtccaatggattaaagtgaatttgaaacataggaattttcgctagaaccggttcggctgttggaggagccgtgagcgatttcctcgttattatgctcctaggttttgacgactttgttgttgttgtcgccacgccaca

SEQ ID NO: 28981 - DNA, 1501 bp, Oryza sativa
agctaaattgattcactaaaatactaaattattaagttttttactagaacgcacccacttgtcaagttgttgcactcggacgttcaattataaagttcttgcactatattgcacccacctatcaagttgttatatcgtaggtgtaatttactctaaaataaaagaggaaacacgaacttgtgtgtggtgtcagtgtgtactgtctacctttaatattgaagttgcggcacaacaaagtcattgtaacgatctgcttgcgctgaatcacttctcaccttgataggatgatccactcctgaatcttgagctgcaagccgattcatcttaagtaaattagaaacatttagttccacttgccctcttggaaccaataatgtcaccaatttaaactctaccattaaaattagacaagcctaagaaacttccagttcttctgatcaagggaatgtttgacttttgttctctgacctatgtgaagtcgtaagcacatttatctatctataataactctattaattgagcaccacgagggaactaaccgaaaatatgtaggagtagttgatgactaaccctgctgcaactaagcttagggtgtgtttagatcccaaaaatttttggtctaaaatgtgacatcaaatgtttggacacatgcatggagtattaaatatggacgaaaaaaaccaattgcacagtttacatgtaaattgctagaaaaatcttttgagtataattgcgccatgatttaacgatgtgatgctacagtaaacatttgctaataacggattaattaggcttaataaattcatctcgtaatttacagacggaatctgtaaattgttttgttattagtatacgtttaatacttcaaatgtgtctccgtatatttaaaaaagtttagccaaagaactaaacacggccttaagcaagttgtgccatgcaataaaaatatgattagaaatagtttatcataaagtatagcatggctaagttttttttagcaacagaggttatcgcagaaacaaatttacagattagcccgagatattacacaaccaaggagactcttagtgtcaaataattaagaaattataaaagaagtctgggcatgctagaactcaccccttccactatgctagcaagcactttcctagcattgttagttataaatttggaagtatacatgacatgtgataagtgcagtgcgatacaatggcggcaacaaaataaacatatatctaaccatgacataactaaagtgtgacttagcaaaataagacaaccaaacaaaagccgtaaaataccaaaatacccaagaacccaacacaattgatatgttgctgagccggacgactacaatctccagctataaagcagccaagcaatccatgtcttcttatcccagaaacattgatactgatacagatcacttgtctgccagtcacaagcctcatgccaaaagctcctctcacacactcactctctcgcgccatgaaattctcct

SEQ ID NO: 28982 - DNA, 218 bp, Oryza sativa
tatacatcctggagacaaatggcaaaactgtccagacatatcttttgatatttgcgattttcttttgagatgtttgtggtccacaatcatcatcttctgaaacattacaaaggaccactaaaataaatctttctaaatttccaccaaaattatctgagaatttagtttgagttctattgccatgagctacctaactatgatgtagtttgtgttgcagt

SEQ ID NO: 28983 - DNA, 1501 bp, Oryza sativa
aaaggaaaaacaatcgaggaagagaggcgattgatctgaaattgtggagattttgaaatattctacccaagttaatttaaaatttagataaaatttgtataaaatttactaaattcataaaattaaaattttcggatgaaataatttcatacccgggaccgaagtttctaaaaccaaaatatcgaaccctgcttaattaacgtggtgttcatgttctgtggtcagtatgggcactaaagtacttcaaatctgtactgtcactaatataagtcggaggaattttataaaaaataaaatcaattcacatgtaattatgtaaacacttcaaagaatataattatatgagattattattacgagatttcatttgaatatagaaatgtaagattttgttgtgagatcttaataaaaggaatataacattataaccatatcgtatatttgataaaaaaaaacagttgaaaagataagaaaatctttatttgaagattttccttgttattaaataccgataagaagcattacttgtcattgatcaaatcatttgacggagagaccgaggaatgggcgcatgatcgtgggaagcgtttccccaagatctaatcgtggtaagcttcctaaagactactacttgcattaatttaaatataattgtgcgtgcaactcgtgtgattttgaaaattcacaagttcatattaggatttgttgagaaggagaaattagtggaattaaatggtgaaatattatgttcgttgagaagagaaagttggtatagaaataaaatgatggacaattctgatttgttaaaaaagagatatagatagagaaatagctacattttactttctccattgcaaaatatagctatactttctagtttgaactaaaaagtagatgcattttgggatggaggaagtaaaaaaaattgaaagctagaaataactatatttgtgatagagtgataccatagtagttgtccgcattacatagtactattttattttttttatatatgactccgttgatttttacatgtcatttgttcatctttcttatttaaaatttatataaatattatttttatatgatttatctttaaaaaatctctaggtttgatttagggggctgcaatataacggaatcctattttcgaacgggatgatcctgtcgacgtttgatgtcgtcattctggtatttgcatagtatggggatcgtcggtgctaggatatacgcgagactgaggtaaaagagacgaagacggggatttttatacaggttcaggctcctgagtggtcaggtaatggccctacatcctgttggccggagccggagttgcttttattcaccataatcacaccagtacaatatgtggggtagcctatctaaccgttgtcgacatggcggtctgaaggtctgactcgtagtcgacaacagggtagccttcctcctcgagctcgcgcccgacgaaatcagagacagtgctagatccctacggccggcc

SEQ ID NO: 28984 - DNA, 1501 bp, Oryza sativa
gttttttaatctcattcaattcatttatgttttaattttatgtctttcagttagctctattcttaatactagttagctctattcttgatactttatgcttttacaagaggagcataataccatacgcagtggagctgcattcttggagtcggtagccaggggtctattttttcactttggctaacatagttcctataaaatattgttatagattctacgcgttttctttttacttcatccgtttcataatgtaagactttctagtagtgaacgtattcatataggtgttaagtatatatgactagatttattaacactcatatgaatatgggcactgctagaaagtcttataatatgaaacggagggagttgtatttttgctgcatatgatcaataaaaaaataggggtttttccatatccttgagtttttttatttataatgagatataaatcatttccattatatataaaaaatacacccacgatctaaggctgccgcttaaatatcttaaaaaaacgtggttttatttgtagagtgcaggaaatgcaatttgacaactataagccggcaagaaaatattaacattggatcggcagtttgggagtagcaaacaacgcttaattatataagtactgtactactactaatcatcaacgccttcttcgtcctaaaaaagtattaggacataaacgcggggtgttctccgcaaaatgtgattattttaatcggtgttgcgccagaggccgcgtcttgagcttgctctctctctctatcactctgctcagctcaagtagccagctcgaacaagaagaagaggagaaaaaaatcgcgcagcttctctccctctctcttacttatagcagcagcagatccgcctcccgaaacccagctctttgtgatcctcaagagccgcctccaacccccaatccacgcgcgacccaagaatccgagaaatttttctgtccagaataagagggtttggtttgattttgggagctccagttgttttcttctcctccttcttcttcttcttctttcttgcaatttgaggaggtttgctctggtttggtttggttctttgttgttgctgccgctgccgcggcgaatggtggcgacgcgaggaagggaatgggttcgttctcctgcgccgcgggcgatctgtcgtgtcgagatagtggcgcgccctgacctgagagatgtttgttcttgttgatttttgtgtgtttgtttgactgaaaggtgctcgtccttttcggaaagtgagggggtttgttcttatttctggttcttgattattattaggattagtttgttcctttgtgtgattcgattccttgccgcgccaaatcttggtttgagatttttctcttttccttttctctctcttggattggatcctttgcctccctcgccgcccattcctccgtgcgatttgagtacttcttggagtgagttcttggtgagtgagatcgagtactttgaggaggatctagaggaga

SEQ ID NO: 28985 - DNA, 174 bp, Oryza sativa
aggttagcactttggaagcagtaagatttttcctgtagacaatgtcgggggtgaagttaacaagagagcgaacaataggttcgaaagatccggattaactatttccaaatatttcagccgagtgcttcacgcgatagtctgtatggcatgtgatgtagttcggccaatggaccc

SEQ ID NO: 28986 - DNA, 635 bp, Oryza sativa
agccccgcctggcctcctccccctccccgccgcgcgccgccggcgagctgcccctgaggcacacggcgtgtgcggcctcctcctcctccccttctcccccacccctgcgcggcctcctcgcgcgcacggccggcgcagcaaggtccggagacgcgacgcggccggcctcattccactcgcctccatccccggctcgaatcgaacccccaaggtactcgttcttctcccgtagcactctctcccttcctccctccccgccgcttcatgagccgtcgtggcgtggatttggaaatccatcccgacctggattgactactttgcctccaattaacccattcagtttcttccgtatttcttagtataatagtagttttttttttgaaaaaatgctgaacccccacgccccacgttaggtcggtttattttaacaaatttggtggtttacacttcaacgcttgtgctaatttcttggcttgctaattaattttcactaattattactgcgttcttcatatgctaatcatttgtagcactctaaatttagggggtacccgatttcttaaggtggacgcatgtcttactgtgtgcagcatgccatttttttttttgtgtgtgtgtgttttgcagttgaacaa

SEQ ID NO: 28987 - DNA, 1282 bp, Oryza sativa
aaatacaaatgcatgcataataagttaataatctatattatataccataatttatgtaacatagtcacctacattactatcaccagtctaagtctattttgtaaagggatttttaaaaagaagaagatttgcaaaagctaaaatacactcgtaacattgaatagagtttgtagcaactccccgtagcctccaatccaggagacagacgtgaatcatgatttaatttagcactgtgcaggcttgtatcactgtacccatagctactcttaacatgtttgactgtcgcacttcgctagatgcggcaccatactaagaacacagaactattctcctacttcaggttactacactccacgtttgtgttgagcctatcagctctccacaccaccgcgctactatatgcgcctggaatgcacttcatcggcattcatggggtttatatcatctcccattctactactatttacccatgtggagtataataaacttgataaggtactagcccatcttaagacggatctatggtcgacacggtatatacgattctctgatacgagtgatggggtgattagtccttatatttatacaccgtatgtagggagagccctgacctgccatcatcatcaatcatctcatccgtgagctccccctacccaccatactagtatcccgatgatctccatcatcatcggcttgtcaatcatatcatcatcgtccatatcattattctagaaaatatattttgatgcaatactaggagaaatatttgtatgaaataggtttttacgttgaaatagaattatgtctatcaacatgatcaaatgagagacttgcctgagttttctgtgatcgaaaccgaaataatatactgctgccaattgacacgttccaactctagcttctttcctgaaatttgttatatacgctgaggtttcaataaaatttcagcacaagaaatgcaaatgctctctaattaaaatgtgctctgcagagtttattttattgtgccagctttcttatgtttaatagctaatttatctaactctaagcttgaacttcacaatactattccggtagtaggttcaatttaatgacttgtgtagtctagtagtgtacatccagcaatttaatccccttccattctctccttctctctcgaacagataaggcagcagcactagttattcccctcctattctcctcccttgctgctgttgctaaggcttttgttcctcccctaactcaccatccactccatggctaccgatctgctgcttctagg

SEQ ID NO: 28988 - DNA, 1501 bp, Oryza sativa
acaaaggtgtgaggatgatggggagttcctaaaggttgcatgctgcaagttggagtcgatggttatgcaattatttgccaattatggatggaggttcacaaatagacttcaataaatgtgttctccttattttggcttggtttcctctgtttttgtttggtgtgtcctatttagctgaactacgctcttttctggattgctacaatgtaataattggctgtagctctttttaagcaaaggctgggatgttaaattccattatctaaaaaaatataactacaaacatatcattatctggaatgagctttttatgattgttcccataatttcatttttttataaaatttttagttaaatattaggaattatgtaatcgaaagtaaccaacccacaaatattttgtttagctagcctgcattgggcatgaattagttacaattagattttataatcgtttatctgaagcctataatgtctatccacttgtcataattatcacatattctatgaagttctaaaagaccctagaaaatatgtgtttcaaatatcagataaattatttgaaagctttttgcatttgtagcatggaatttgtttggtcactatacaatccacttgcaccttctactcaatatatgccctatggtgacaaaaagtaaggactagctggagtcaataggactcctcttatcctctattgatgcactatttttatctcattaaaactggtctactcagtgtctccctgctttgctttctctctcattctagttcgcgcaagaaaatttttgggttccaaagtctaaacaatacattgtaaattttttctgtctagtagatgacaattgtttggtgataatggttttcttgcacctccaagtcatcatgttgcatggttgtaaaacttgtatatatgctgagacacggagattaccatatgattcattgtagtagtgtttacagtttcgatcgtgtttagttaatctttcttttcatgtctcggtgtatcgtaacacataaatggattccaaacttaattcttcaagtgaatatgtgcatggtgacatgtttatagaaagttaatgtccatatatatggatgataagatctttttaaaggtttgtgcacagagaaaacatacttttttttcatacccgtaaggtatggaatataagcacatagccaccggcaagtatatatatatatatatatgtaccatatactaaaatgctattaaataccgtctaataaagtaatttaaatgttacatagaatatattctagagcacttatgtagaagatcgtttggcactcttcgattatttgagcacattttagaaaactcatgaattcgattgtttcctctaactggcaaaactgcatttttcgatcaatcacaaataaagatataaaattataattgttatggtagctagagtcaaaagccgaccttaaccaaatatgtcattctggatatgtattggcagtgaaaacataaagt

SEQ ID NO: 28989 - DNA, 271 bp, Oryza sativa
agataaaaataacaacgattttgctatatctcactcgaaagattttttcttatctctcactcgattttctcactcaaatttacagtgtattttcttgtaagttacagtgtaatttatgaaacttacactgtaacttttgtaagttacactgtaatttttgaatcttcacatgtaaattttaaattttgtatttgatttggtctttttcttgaggatatggtaatttaatgttcattatggtatttcttaattgcttttttctttttattat

SEQ ID NO: 28990 - DNA, 1211 bp, Oryza sativa
agatgggcttaaaactcttagggacgaattaaaggtagttctaactatttctctgttgcgatctctaatggtgggttattatttggcaaaataatagtttgttaaataataatctacagtctggcacttttatcttcaatgttaaaagtgcggggcgtcacagctgcggcaaccacactgtggtgcagcggctgcaccttacagccgaacaggcctagtatgttttttattctctgaacttaaatttggactttgtgagctagggccattctagtcttgcatttgcaatccataccacctcaaatttgtctcgctaatttagtttgaaatgtgtctcatttgtaaacggtactacgtaaatatggtattgcttagatgttttttttctcaataaacaaaatataaagatcgacgaatatgggtggtttctaaacttatccggttgtgtcacccaagtgaaaaaaaaaactacttgatatagcacattttgggtggtatggaagttaacaataataattgaatggaactaaactagcatataaaaaacccaagaatctcctatataaaatcctaaaaacaaaaatgtcaagatattataatacaagtgttacacgttgttgaatacaccaaggtctccttttgaacccctgaaatttacaaggttttcacattgactaatttaatcggtaaaattatgtcaacttggggctgaatctggaccgaattagcatgggccgatcagcccgaagcaaatcatgaatttttataccggacagacttgatcttgtactggaaatagatccctttcttttatgtctctcaaccataggtcaagttgcaatcacatcccttggccacaaaaccatgtataactcgtctctcagacttccaaaatcgatgcaaattcgaaacagttttaattgatgtgatgcctatgtagcatgttatcctggtcttttaggtgatgtggtacgacagcattgaacggggagcaaacaccgagatagcgagacaagagaaatttaactatttgccacataggaatgtcacctcttacaaactctttttttttaagaatttgccattttcgatgaagtgacgtgccaactcatactactagcatgcataggacatacaaaatgtccattttaccccttatgggaccaagtcagcccatcccctccctccatctctcttcatctcctgctagc

SEQ ID NO: 28991 - DNA, 333 bp, Oryza sativa
aaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtaga

SEQ ID NO: 28992 - DNA, 1501 bp, Oryza sativa
ccgccggctgccctcgagtactggacgaggaggacgggacagtcaccgatgactgattcaggtgagtgcaacaccaatacaactttgctattgctaatttgtcattgccagatgaaaaattgaagttctggaacattgtgatttcatctgtaatctgatctgctggcttttaaattcagatttgttattttgtagtgtaatttatataggataaaccactataataatgttattttttgattattaggctatgtagtcgagaaagtatgcatcaggtagcaataaaatgaattaaatggtttggcaactttatgcatcgagaagaaattattggataaaaaatgataccattatcaatgacttcgcatctagaaatataagaatttttttaggtaacatgtacaatgttttgtatataaatattatttttgaatgcaatttaaatgtttataatttaataagggcctctatgtcaagtttcgcaccaagaccctgaaaagtcaggaccggccctgcgtacggagcaagggagcggcgacgcgtggccctcagcgaacccagccgtgcatggactgctgcggtgcacagagggaggtagcaacgcgcgcatcccttggcgaacccggtggcgcacggagaactcgatggcggcgagcaagcccttgtcggctttccatccccttcctgctaccgccggattccctaatcaattcttcggctttccctctcccttcttgccgccgttggtttcccctcccacaccggtgacgacctcgacaacagtgctctgcaccgagctctccatgatttgaagtcacgacgtgccaggggcaatttgtcatgatgagtcaaaaagtgcccactcttgcctagtcagcaccaaaacactaaataaatgggtgtggtgtctactggcaaataaccaagattacatagtttcttccttcaaaagtgatttcgtgcggtatcccacagctaaaacatgaagttatgatgtcctgtagcaaaatctgcctattattagtgagaatattttggtcttttcttcttctcttcgtaactccttagaattttagaggatgattttttttatacatagaatatcgtgtagttcacatgagtgttcaatgatgcacaaaacaccatcgtgtcccggttcttatcataggtgaagtcgctgtgacgtttcaagaggttgttcaacatggagcccaagaggcagatgtgggaagcgctcgcgcgccacgatccagctacaccgagtggatcattcagcaagcacaacaactagagcctccgcgaagtggtcaccagcttcctcctcgcgagcgttatacacgtcgtcggtgttgacctggttctctagttgttgtccgaccggtctgacatgtagccgtggaggacaagattgtagtgagatccaagtggtgtgtagcgcatcgagtgccgaagacccaaacggcgcgacatacaccacctcatgggcatcatcgagttccta

SEQ ID NO: 28993 - DNA, 1501 bp, Oryza sativa
gtttagattctcatgagttagctatcgaaaagctatttcacagaatattaatctcccaaacattttctctgggtgaaacgaaaagggacggcttgttttccaaatactttaccttatccactcatatgaaatttgagaaattgacactttacattatgaggattcctttgaaacaaacaaaaaactaacaataaaagaattttaatgcattggatttctgtacgagcaaaggaatatgtcttacttcgatatttttatggaatggaccgaagtgcatattttttagagaaaaactagcatgaggttcaatctcatgtttattattcctatatgacgcaaagttttacgtttttgatatgtgtcatccaaacattagttttggaagtctagtgtgtttttaatccctatggacattcaatgagtataatactttgttctcgtattttctttttctgtttttacaatcctagtatgctcatagaaaataattaaaaaaataaccgagtgctaatcattattcactcctaatattgtacatttaaaatagcactatcatctctctctgtcattttaggagtttcaaccaattttaatttatttttcacatctagccacacacacaaacaaataaacaaacaaaactaagagataatccattctatgcgattgacaaaacatgaattctataatatgccgctgacaaagctcagttctataatataccatcgaacaattagttttcttcctaacatgctatcgccgctagtcaacagttagtcaaattccgttaagagcaagaaaatatatattttacccctagggtatcatgcatcttcatcgatttcattggtcatgatccactatttcttctcatcgatgaaaaatagaaatacttgtcttttcatcatccaagattttttagtgcgacgtggcattgtgcaaaatctcaattttatcctaggtgtaaaatggtcatttttcctctcttaatggcgtttgactaacgacgatgacatataaggaagaaaataagttatttgatggtatattgtagaattgagttttatcggtggcatattgtagaacctacgctttatcgatggcataaaatggattgattcaatccttagagtgtgtttagttcacgtcaaaattggaagtttgattgaaattggaaaagttggaagtttgtgtgtaggaaagttttgatgtgataaaaaagttggaagtttgaacaaaaagtttggaactaaactcggccttaattaaaaccctcatccatttgtgatgttcttcttcgtacctcacaagtatggatatctgccatcaccccaccaccaactccgtacccttttggagtgaagaaagaacatgtggggccaaagaacatacatgtcaactaccctcataaccatctctacttttcgtggaaaggaaaaataatattgtgaggctataggacctatatgttagttagaaatatatataaaatttaagagat

SEQ ID NO: 28994 - DNA, 252 bp, Oryza sativa
aataaaaggaagcgaaaggaaaggagaatctcggcgcggcccccgccctcttaaatactacgccgccgcggccgcaaaagctccgagcacatagcacgcgcgcactcgtctcgccgcgtccacacccatcggctccaacaccgacgagtagctcggtcgccggggccgccgccgcgcgcgcgcgccaccgtgtcgcgacttcctccgtgaccgggccgatcgatcgcgaggcgcggcgcggcgaggccggca

SEQ ID NO: 28995 - DNA, 1501 bp, Oryza sativa
agacgaaaatgccccttagctattcttcttcctccctctctccctccaatggctgaataggtcgccggcggtccgtcgctcatgtcgtcattggctggcaagtcggagcagggtggcggcgtgcgatggcagccggcagagacgacacaagcgaggcggcgcgtgacggcggccgacgagtcggggcgtctcctccccccctctctctctctctcgtcgcggcggcggcagcaccgaccgcgaccacgaccggcgaggacgacaagtcggggttgggcggcggcgcatgacggtggccagccgagaccacgcgagcacgtgatggcggctggtgagtctggtcggggctgcagtgcgcgacgatgtccaagatgacacgagcgacggcggtgaggcagtggagccggtggtggtcgccggcgaactattcagctgatgggatggaaggagagaggaagaagaactatggggcattttcgtctgggatggtatttgaacaaagacaccttggttgaggatggtattccagcgaaacccatttaaacaatggtatttgagcgaatcccattttatacgatggtagatatacaattttctcgcatggaaactatatgtgtattagaatttcgaaccacgtatgggtctccctgtgttaatttggatgcataaataaggataatttggtgtatttattatttgatgaaatttctatttggtcttaggcccacgctgtgacggacactgtcgggttgttaccattctgtaagggcatccacaatatagtctaaaagtgtccataagcaatacaatatttgtttcagccacctagtaacattgtggaactagtccatagcaaagaaataacaaaagctactcataagcatatgggctgcccatagagaataaaatatattatttgtctctacctcttctctcctcctactactatttgctatccatatacattgtgaatgttacaatagttaaagtttgtataagtggatctatctatatggactacttttgctatatacattgttgttgccctaagagctgtgatgtgggaggcatcttatcgagattgctaaggggcgatcgatcgcccctagcgatcagggttcggtccctcctccctccacctggtttcttttttggtaccgcattactttcctattttagtaaatttgtgcaccaaaagtttgtacacctcaagtttacacatctaaagtttagagacccaaagtttataagtcaaaagtttatatatccgattcaaatttgaatttaaattgaaatatttttatatatagtatttctatacatctaaagtttatagacccaaagtttataagtcaaaagtttacatatctgttttaaatttgaatttaaatttaaatattttctatatatagtatttctatacacctaaagtttatagacccaaagtttataagtcaaaagtttacatacccgattcaaatttgaatttgaattcaaatat

SEQ ID NO: 28996 - DNA, 231 bp, Oryza sativa
ggatagataaggaacacataaacaggccagggttgcagacaaggcccagcacgattttcggccgtaaaggagaacaaggccgggacgaaatatgaggcgtatccgacacggtcgctatttactctcctactcctcccttttattactgcgggaccgcgtcccacgagaagaaaaaaaacaaaaaacaaaaaccaaggtttttcttcttttttttttatcctttcttgagaa

SEQ ID NO: 28997 - DNA, 213 bp, Oryza sativa
ggtctttgttgcttaaggaagaggatagccacaaattgaatggatattgcaagatgttagaggcaagggtcatggagttgtatgcaaaatatgggtggaaccttagaaggagattggtgtagtagtgtttctcttttctcttttaagtgttgtcactttggtactttttttatccttattgtaaagaattcgggtctaagtactcttgtatga

SEQ ID NO: 28998 - DNA, 163 bp, Oryza sativa
agactccgactccgatgagtcggaggaagaagagtcgttcgccggagacgacaccggaccgggtggagagtccggcagcgagagcgacacggcggaagaagcgcgcctcctcctccgctgcccggcggccaccacacccgtgctggcactgtgcaattcaagc

SEQ ID NO: 28999 - DNA, 264 bp, Oryza sativa
tgacgcctacgaaatatcttctgaattttgatgtctatgtcataatatctagtgattcataagggtataccagggtaatagaactgacagtggtatgccgttttacttaaaaagaaaaggcgaaagtattgggacttgtctgattatacaattgttgtaaactcttaacaaaatttgtgaataggcaatcagctgattagcagcacttcttttagaataaaagaggaaatagagcaatgttctgctaaaatctctacagggaga

SEQ ID NO: 29000 - DNA, 771 bp, Oryza sativa
ggccaatgggccttaatgatcctaatataaagtctccacaaatatattttgagttgatcaaaagacgtttttttttttcgattttgctatatctcactcgaaagattttttcttatctctcactcgattttctcactcaaatttacagtgtattttcttgtaagttacagtgtaatttatgaaacttacactgtatgtaacttttgtaagttacactgtaatttttgaatcttcacatgtaaattttaaattttgtatttgatttggtctttttcttgaggatatggtaatttaatgttcattatggtatttcttaattgcttttttctttttattatatctatcggattttaatacaaagattaaaaatctgtgtgatacgattataaaaatctttcgaaagatgtataggtactcccttttttttttgacagagaattcatcaagacgttgttgggctaaagcctggtagaaaaaaaggaataagttcacccgaggtccctcaacttaacagcgagatttttcgaagtcccttaaccacaaaaccagaaatctccacccctaaactatacaaaaccgttcactcaaggtccctaggcagtatatatgggtggtttcgctgacatggcatcctagtcagacaaaatttttttttaaaagtaagtaggacctacatgtcagccgcacgtttttttttcttgtccttctcttctcttttctcgcttccctcttcttcttcagtgaggaggccggtggcgggcggagtggcga

SEQ ID NO: 29001 - DNA, 177 bp, Oryza sativa
attcctgcagccccacacaacatggtgcaaatgtgcaactacttgtgattcatgaacaaaaacattagaatgcagttaactcacaagaggtgtcttgatgttataatgttgaagtagctttccagaatgccttgtgtcttctgatagtatgacatcagcacatttgaggatacgcaa

SEQ ID NO: 29002 - DNA, 1501 bp, Oryza sativa
tgcctccgcctcgccgtccagcgcgacgacaatgtcgtgctcggcgccggactccaggaaccgcgccctcgtggaccagcacccacacccgacgaggagacactggccttccgcgtccgtcactgactcctctggtggcagcgcgggacgaggcggttccgcgccgccggcgaccgccgcatcgacctggcgtgggacctctcacccgcgcacacttcccggtctcgggttcgcctgagccttcctttgggtgtagccgacgagccgccgtcgcgccgtggtaccgccccgcagccacagcagctgtgcggctggaacagcggtggtggccccttctcctcctctttctcccccggtgagtatagatggacagactacatcggcgtcgtgcgtgcatgcatgctgcattcttggcgtattagttttgtgcatggatcttacgaaggtcgggggaggacggcgatgatggtgtgccacgacgtcgagatgccgttcctgcgggggatcaacgtgaaccggccggcaccagcggcggagacgacgacagtgaggggggcaactgtagcgaggaggaagaggagcccagcgcgacctcccccaacagcacgctctccagccggcagcgacgacgagaactgcggcggcggcggtggatctcgtgtaccgcggctggggcagggatgggagcagcagcagtagggagaagagaagagaagagaagagagaagagagaaaggagaagaaaataagatatgcagctgacatgtggaccccacatgctttgctaactaggatgtcacgtcagcgaaaccacccatatatactgcctagggaccttgagtgaacggttttgtatagtttaggggtggagatttctggttttgtggttaaggggcctaaaaaaatctcgctgttaagttgagaaacctccggtgaacttattccaaaaaaaagacaggttgaagcccatgggctggtttttctagcttgcagcgatgcacgctggttgccacatgcggatgtacaatacataggttgttgcaacgttcgcgggccgcgaacgtccacgtactagacgcccctcaaatcagtctctatcataagaaagaaaaatgaatttaggatatcgtaataagaaaaataaataaatttgactaaatataacccatggtgacgtatcgactatcaattaattaagcaaacggcttgcaacctctgattgccagctaaaaaaatccacgatatattcttgtcctaagtacagtgacttatgacctctaatcccaactacaggtctacagcgatcaaatcacttgcgccactagcaaaattgacgaactggatttactgtttataaatgaaaaccacttcgtcgctcactcgcttgtagtctccagccacacaaccgtaaaggtccacacctcttctcgcaaccacttgagccactcgcaagtctcaagccaaaatcatatcacagtcgccatggaactctcctcaacct

SEQ ID NO: 29003 - DNA, 449 bp, Oryza sativa
  unsure (1)..(449): unsure at all n locations
aataatggtcaaaattgttttttggagaccgtgcccttgtccaaaacgacaagtattatcacccggagggagtagttctcaacttttttcaaagattatgttgatttagatcttactcgttttattaaatgtgacctagctacccaaatgatcgcaagagcttttttacaatataagatttagttaatttttacttctttacgcttacaaaatcatgaaacttttatttacttgacatatttgagtagattttacaaatggtggagtaaaacaatctaaaaaaagagtagcattcctatgccaaacaacattaccattagcggctaaattgttgtactatancctcttggactacgattnntncagaagtggcanccatattncttctacctatatntgtgtaatcacaattnnnttatatcctgcacaannaatatactgtttacttc

SEQ ID NO: 29004 - DNA, 821 bp, Oryza sativa
gacgcgatgacacacgttggcatgaacacgtcgtcaaaactactcctagtagctaggacgatgccggcgatgtgtcgacgatgggtcgaagcgaattaatcctctcgatcgcctgtcactcggccacacgcttcccgccctcgatgatggcgcacgcatgcagaagaaaaacatggaagccccaggtaactctaacccttttgctattttccaattagttgatcatgatgagttgaatataggattgctgttgctgcaaatatttcccttggtaataactctgtagagataaatgaaacatggatacaattaaagtcaaagagttggcccaggctaagcttgcagaattaagatggaaaaaagaggaggagaacaaagccatagagatgtctcaaactcaagcagttggtaatgatgatgggggacagaaagaagtgtatgatgaggaagaggtgaataacacaaatgatgactctcctaattaagggtcctgtgcagaagaagagaggtggctccaaaaaacaaaggaaaaaaataaatgctttttctggaatgttagaggtttgggaaatatagccagaaaaaaggtaattgaaagaggtgatcaaagatagagatgtagacctggtctgtatacaggaaacaaaaaggagagtttttcatatagagaattaaaatccttccaaggaaataagagctatgcttggtcttggaagtcagctagaggaacctcgggggtattctactaggaattaattaatgcagaagtgatggaggtgatggaaaatcatgtaggtatgctttttccttgagctgtgaaa

SEQ ID NO: 29005 - DNA, 480 bp, Oryza sativa
aatgccatagtatggagtatctattttcatatattgtggcataatactttaattgcttaactgtgtaagtaatgcatggtttatcctatcatatcatatggattagccccatgatgcattctgccatatggcacatgctttctcagggcaaaagcccccgttttttttttctacaatagaagtgcagcaggacattcgattttccctcctttttcaaatacacatctttagagcactcaaattgtgttcccaaatacctcattctacagttttgagatgaccttttatcatctttttttgtggtatatccatccatccctttacctatttccagtgttgtttataattatggactagagcacacacaccatccgaaaaacaatgagatatcagatatattaaggaattgagggaatacaagctcgtggtttcaccaaagttgcacttaaatagctgactttgacatactttttgaacagc

SEQ ID NO: 29006 - DNA, 281 bp, Oryza sativa
tcccaagtactaccaagtagcatcattgcgcattgcccgaaacgaaaactcgaaccaagcccaacacggtcaccaacggagaacaactcgctatagcgacgccgacgcatcaaagcatacaaacaagcaaacaaaaaaaaaatgaataaaacgaaccaaccccctttagtgccttaagaactcagagcgacacatataaccccatggattagaccaacaagccgtacacctcccagctcgatacccaagtaagtccccaaccccgccaaacccagcagaaa

SEQ ID NO: 29007 - DNA, 1501 bp, Oryza sativa
gacgagtggaggatcggcgtcaacctgtcggagcagaggagggaggaggacgacggcggcggcgtcgtcgtcggcagggacgcgatccgtgccgccgcggcgaggctgatggatccggacgacggcgagagccgagagatgaggaggagggccgcgctgctgcgcgaggcttgccgtggcgccgtgcaggacggaccggacggtggctcgtcgcgccgctcgttgaacggattcgtgaaagatctcgccgacgggagacttaatttccagtgagagaacagcgtgaattaaaccaaaaaagtaaataaatgtactagcgtgaatgcttgttgtgtatcagtatccacgtggagaataatggaagagaaaattttactttaggtaatctgttgtacgaggcaaacatcatccctgttctatcgaaacactctcttagattaccagcctaagaggcttttacttatggcagatacccttttactgaccaacctgatttttacttgcggctaacttaatgtgacagttaaatactaaatgaccggtgttcggaaaagaaaatatttgagcccactgcaagagaaatgtactattcgatcatggcaaatgaagcttgaaggttacgttgctagtgaggaatatttctcgagaagatatcgctgggccgctccaaccacacttacaaactagcggcaggaactctggaggaccacatcaatgtgggtttctagcatcataggggtattgtagtaacttcctgtgcaccatcggggttaagattataactccacatttatgtttggggactatataagccagtcctaatctcatagtaaaataccataccatatattgggctttacaactcgaactcatctcgttcttagaataggcgggaaaaatgatacttttccgcctatcctctgttgatctgttacccaaggtcacgaaataatattttattatcaatgttttgctttgaatagttccttaaccaatatttttgttttggattgggtatttttattttcatggtgttttagaccatccttaattttaattatctacatctaacttgttacatgaaaaagaaataacttgtatatagctgtgagatttaagagtttattgatgagtaggaatcgacgtattctagattgttcaaacaatcgttcatatgtttgagacgagggtcggtagtcaaaagtgaaaaagaaaaaacaagactaccctgtccaaaataagaacgtcgattaaaagatgttttaaagtaaactatcagtaatgaaatatgatccgaaatgagaattactcaaaatgttatattatgatcatgccatcacacatgatcgtatcaatatccatcgacacgtgcacatgtgggcatgcgtgtgtgggcagcgtggcgccggcacacacaaagggagaggggagagcgagaaccacacgcacgcacgcacgcacgcagccacaacaggggagagattgcgagcgcgatggccgc

SEQ ID NO: 29008 - DNA, 1501 bp, Oryza sativa
tgtgaggtatacgtacataaatcaacagaacaaatcaaactacagcaatatctaaggttcgcatcagcaagctacgacacggtgacacttgtatatatgtgtggcactgtttgcctactggtattattgacgacaacccaagaacaactaattaattaacgaactgaacctataatagtatttacgacaaccaactatagttaatgaaccataatatatatactacatatatatatgagtaaatatttggagtataatgtagtactactgtatcaatcaacgccacgaaggaattaattaatagatatgtgtagctggtcaattagttaattaatcacggggcgttcggcgggcatggaccagtggagggcttagtagggttgtgcgtgcagtcggaagcccccgatgacgtcttgctcgcagacaccagcggcggcggcggcggcggcgactcaacggcgccgccggcatcagctccggccagcaggcggcgcggcggcgccaccgagcggcggcgtcggcggcatgcagcgacgccgccgccgtgacgagcagcacgagcaccatcatcaccgcggtcgccttcatcaatcttgattaattagttccggcttaatcttccttaattagctagctatcttgcagttcgcttcagcttggctaagcttgttgatatgcgctaggttattaattgctgcaggtgtggtgatcgagcatatgagatgtacttataatatatactagtagctcccagtccaagctcgatcgagattatctcgccgttcaaacgcgatcaagagaaaaaatagggtgaagtttcctagctgcacgattgatcgacagcgttcttgacggatcaaactggaagaattggtatgcatggtttctgatgaagaagtactactccctccatttaataatgtgacactttctagcatttttcatatttatataaatgttaatgaatctagacatatatatatatatatatatattcagagattttctactgtgtttggagtgcgtcaaatctgttcatggcttccaatctaacgatccacatacatgtgaaaaggtacttaaatatgtgggccaggcattacttgaaaaaggttagatatgtaatttggtttctatatttcataaagagaggaagaactaaacgggaaacttttctgctgctccggcggccggagcgcagagagatgataacgtcttcagtctgttgatgccactgcacacggcttgcacctaatctgtataactaatgaagaaactaactacggcgtctaggagtacttgattaatgtttgcagatcgtgtaactagatgctaattgaagaccacataattgatgattagaactaagtaattgatccacgcgtctttccatatatccgcatgagatttgcatgtgactctgaagatttccaaacgaaaaattgattgatgcgcctccgtctctttgtatggattactttctaaagacaataaagatgga

SEQ ID NO: 29009 - DNA, 1501 bp, Oryza sativa
tattttgttcaaatattgggttatccaaagataaacgtgtctggaaatctggataagcagaattaccaactatttttatttcagaatgatgcacaaacatggaagacattagctggtcattcgtatgacgtacgatccacatccaccgctagttcttaattcaagctatctaacagtgcaggagagctagctaattacagaatcaaggtgttctagctggcattcgcctgatcctccgttttcctagtgaaggtaacaccctgatccctcactggagtcagccgctgcttctcttcctctacttgctcgagcagaacttgcagttcagcctctgtcaagctctccaatcgtttctggaacaaagagcaagaaacttcaggtcagtcactcatactcttggtagtaacaaacactgcatactagaatgaacaagtgtcaaacctccatgacttgcttctcatagtccctgagctgctgggcgtaggtcatgtccttgttggccaccctgaacatgtacgtcgagatccaccccaccgtcatcccgagcacgatgatcagctggacggcgtttcctgcttgcaagggatcgactccgaccagctgtgttcagttgtggcaaggatgtgaaagggaaggcatacatgttcgtcagtgaagtgtacttgatgatgaagtcaaagccaagaagcagcgaactggagtagtgatggagaagagagaaagaacagacgtcacctccagcccgtatttgaggccgtagcctaagagtgtcacgccgacgccgatgagcagcacgtccttcctcgtgtatccgaatggcgtctgtgaacaaaacatggtcgtcacagttgggttcaggctttaattttttttcaattcatcaggcgtgtggtcgtgtggatataccttctcttcggtggtggaattggtttcatctgagctgctgcttcggaccaccagacgcctccgctgtcgcagcactgatctgaacatctggttgggccgtaacacaactgcctcgcctttgcaagaacagcaacaaaggttagacaggtgacatccgtgaagaaggccgagaggcgagggcaagaaaaggaagaaggagcaatcaataccaatgggctgggctacaggtgagctggccatcctggcagagcggaggccggcggcggcggcggtgaccctcccggcggagctgggggaaatggacgcgatgggagcggctagcgctgccggcgccatggtgttgccgagctgtgctctctgctgccgctcggctttgccgggctccgctcctttatcttatcccaaccagtttgacaagaggacacggctgagccgcgcgtacgtacgtctacgggtcgttgcggtctcgtttcctgcgagagagaaaaatatcgcgctcggcgtctggataaagagccggtggcgctcgcgcgcgcggaccagacacgacacggagcccgcgcggacgcgtcctcattcatggcctcctcttccg

SEQ ID NO: 29010 - DNA, 456 bp, Oryza sativa
gtagtccgggatggcctggatacccaacgccccacatatgtctctgatccatctgcgatccagcagcgcttctgccaccgtccgatgccagcgcacgtgggccggaacatgatcgtacgtagatggaaggggcaatagatcgaacgcaaccttcttgcagccaattgtctttccagaagaggatcatgtgtccattacccaggtgaacttgaacaaagctgcgacgtaaagaattttgtcgcagctttgttcattttcaatgatcaatcttcagtccagtacagaaaccagcagaactttgatttcaggacatcacagatctgcacaatgcgcgtaaaattcaccgataaattgaataagacaccagtttaatccgtcaaaaacgtcttctgcgtcagattgcacagttaatttcgcggaaaaatatcatcaacttggtcgatcatactcatctga

SEQ ID NO: 29011 - DNA, 1501 bp, Oryza sativa
cagatgaagtccatcgcggcgtgcgtgttcgagaggttcagcttcaggttcgtcggcggcgagggacggccagggcttgtgttctcggtgaccttgaggatggaaggcggcttgccgatgcgagtgaagaagaggagggattcagtttgttagaatgtaaatgttctctttgctacttgttgcctttcatttattccaggttgagttctggatattatccattttttcgcctgatagtagcaaaattataaggtgacagaggattggatgggcaatcaggttgttttacaaataagtgtgtaccaaagagattggcacagaggaggtggataaattgtgttacacagtggagcatggagtgactatgatgagatgatctgaatattaaaattcactggactgtatcagaaaataaaagggacgttctactacagaatagaaaaattgatgagtttatttgagcaactgctcaagttagcatttaggccctttggcaaaatctatgctcagaatgcagtcaagatagatcagaggaaaaccatggcaatgcagatcaaggagaacatattcccacagcaaacaactactaaatactgcacaagcaaaaaggctaacttgaatttgtgttgataatgtacttcacacattaaccggacaccgggtgaaggatttgcaccaattgttatggttgagtataaccgagaacgtgggataaaaaaatacacttacaattgtgacaaagagcgacttagaatgcgattcaatcagaacattcgtttcttcccagtgggggagttcgtctttgtgcagagaacccttcttcctttggcgcgtctgcgcttcaggacctttcttccggcagtagtcctcatccgtctgcgaaaaccatgtgtacgggcaagcgacttcctagatctatttctcttggtcatgcacagagcagcctttccagccctaatctgcagaatccgggatcttcctgttgtaactctgttgtagctgaattcaattcccaaagatgaacctgaaatatgtaacatattaggatactgaaatcatttgtaggttggaacaaatatggtttgatacataagaacatggatttgctaaatacaacagtacagcacagaaaccggctatttgattgcccttagtttgtgtttttgttctctaagatcatttggaaaaaaactctagtatgtaaagtacagttcattttccaaaaggataatatcattgcaatagttcctttaatctaacgttattggcttgttttaggagcattttggttttgctttaggtggcaaggctattaattgtaactgaactgtttaaaaagttgagttgtccagttaaacgttcttgattcagtgatttcgttagttcgtagtataattatgttagatgatatatttcataatgagtttactaaattaagctcatgcgctcgctccaaaaagtggagtttcctgagtttttgtgatgttttcatgattctgtc

SEQ ID NO: 29012 - DNA, 560 bp, Oryza sativa
actatcgatgataatatcttactatcgatgtttctctcctccgttactttttttttccgaagtacatattagcctcaaccaatattcctttccttgctaaatcatttttcctatgcaaggtggcattttttccaaagaaaagaaaatcattttactcccctaaagcacttaatacttaaactatttttttcttcattttatccctaaactattagaaatggttcactcttgtattttaagctgaaactttttaagctataaatgatatcattatcaaagttctaaaatgttttcatgagtatttgcttgaaatttaaaactttcatgtttaaattagtcacagtgttttcaacctacgtaaacaatgataatttttttctaaagaatattgagaggtaaactataacgcatcttcaattctaccaaattttaatacaaaatatgacttatatagagagaagagagaaataccattaagagtaacgaaagagcctgtaacctagtggttataagagcctcagtagcaccataggtcctgggttcgactcccaatgggagtg

SEQ ID NO: 29013 - DNA, 1501 bp, Oryza sativa
ctgacgaatatatcacattcgtaatagattaacctattctgaggtggaggaagtagataagaagtagaccgttgcttctcatgggatttgaattagctcaaactaatttcatgaccattattctttgccacatttaacattgttcatcttctcctcttttcttcggtgtgttgtaaaggatagtagatgatatgcacaactatgtttgttgctttaccatacgaaactatctcctaatccttaataaaattggtcggcatctctagccgggtttgcaaaaaaaaaagaaagaaaaacagttcataaacatagaagtccacaaaagtgtgtagaaatttagatctagaagcactctcaacttggaggctgctacaaattagacgtccgatctattacaaaagatcggacggtgttgcactatattatcacaaagtgtttcacatgttgcaccactccacgaaaaatgtttcgatgaaaatgtttcagatgtttcatcaatcgaggaaaaatgtttcattgcttgaacaaaattgtttcaatcaaatgcaacatctgaaataggttgcttgcaacactaagaatcagtaaaatgcaacaccaaatccaaacaaaattaaacaccttaatacaataaaatgcaacaagataaaacaatatgctgcaacatcactaaaactccaataaaatgaacccatctttgtcttcttctacggctagctgctagaatcaagaaattgatgcttgtgggagaagaatagtggcacaaggttggcgacctcgcccaagaccagtcgcattgtccagtcctcaccgacagccaaatctagcacctctgccacatcaccatcgttgttgtgtggccgtcggcgaggtccagcgcctcttccccaatcctgcgttatctgcactctgccgccgtgtgatcgctggcgaggtccagcacctcctcctcaatcctatgttgtctaccccgccatgtggccgctgacgaggtccatcgcctcctccctcccatgcgtcgccttgccccgccgctgtcgtgtggctgccgacgaggtccatcgcctcctccctaccacgcgcagccttgccccgctgccgtcatgtggccgccagcgaggtcgagtacctcctccctatcacgtgccgccttgctccggtgtcgacaccagcgacgatgcctcgccttggcttgcaaccccctgtgtagaggcgttgaaaagagagagactttgagaagagggaatgtgtggtggaggaggtgactgagatatttggataagaacacgaagcatttttcgtctaacttattgaggccaaagtagtaacccagttcaatgttggaccgttgattaagcatcaacagttgagaattttcagaatatgccatcgaattcgcactactttcaggatatgccacccaattcgtgctactttcagaatacgccatcggagcacgaatttccttcgttccgtgccactccgtctcttccgtccatag

SEQ ID NO: 29014 - DNA, 436 bp, Oryza sativa
gtattaacatccgctgtccaacgctaacccacgttgtgacaggcccaaccatccacctaaactatccaagttcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcatagaccgtcgcagggcccatccaaactccatcacgcccacccttgcctggatgcgtcggctaga

SEQ ID NO: 29015 - DNA, 1501 bp, Oryza sativa
tctgtccactgtcatagtcacatgcaagtcaattcaagtcttgagatacactaatcttcaatccaaagctagctgtactggccttttgtcagtgcacaatttggaccacatggaccacatattcacatgcctctctcaagctctcagcaaaattctcagcagtgtacagtatactcttgtatgcggtgtacttcctcgtgggtgtaaataaggcttttgcttaattccatcagaaattgctgctccactcttctcgctcaaagtgttctctcttttattttggagatgcttttcttgcccaaagttgagctcaagctcactttcatctcctgggaagtttgcacagtgccctgtatgacacatgctcgctcaaatcaacctttttctcttatgatttttcatcgtcagtaaattccaagcaggtctgtatatgttaataaaaagaaaactcgaatgaaaatgaaacttccagcctactacgtacgagtacatagtattgtgttgttaatggcaactccactaaaatggaaggcttttccagctcgatggctcaatccatacccatacctacacccaacggctagtttcgcgtggcagccgcggccaatcatagccgtccgatgctccgcttcctgaccgttgcgattcgaagccctcccgaccgttggagcggccgctccccctccgctccacgtaaaaaaggcaacgccacccgacacagaggacgcgccctgccctagctcgctatatctcgcccctcctccacgcgccgcctccaagaactgtataccaccacgcatcaatcacacgccgcacgccgacgccgattggttgatttgattgattgattgggcaagaggaggaggaggaaggggattgtttgctgctgctgctgctccagagctcgccggagccgcggtggctgcagcgctcgacggcggggaagaggggtcgcgggcggcgcggctgcactcgttcttcgcctcggtgatctccgggatcttcggccagggcgaggaggaggaggaaggggagatggcgacacgcagccagaacgtcgctgccgctccgcagccgccgcagaacagaggtgagcgaaaacagcgtgtctcagatctttggggctttggcggctgcgcggattcgagttcttgtcgtgttcctcgttagtttcctgttcggatcctgtcccaagattgggttttttttttttacacgagttgccttatctttgggtaggcttctcttccccccaaacttggtactcatcggttcattgtccagctccagcagttgatctttgttcttgttcttattatttcatttacctgctttttgattggatttctgaagaaaagattccaatttgatccctatttggtggtgttgttcagtccgacttctcaaaatcgcgaaattctcatagcgtctgtctcctgctcaatttcaggcaatgttgccgctctgggaaagcagaaggccgtcgtggccggcaggcccg

SEQ ID NO: 29016 - DNA, 293 bp, Oryza sativa
tggactaggaattgcttagccatgcttagttcaactagcacacattggggatctcatttaaaacctagactataggtttatatgataatgttgctggtgttggttaaataaagtgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagccgacgcatccaggcaagggtgggcgtga

SEQ ID NO: 29017 - DNA, 1501 bp, Oryza sativa
tatggattaaagaaaatgtattaatgtgttacccatctttttctaaacgaaatattcatcttaatctaattttatgtggctatccatttagattggatccttttaatattaaggagttcaaggggtaatttgtaaaaacttactgtaataagagtaggcggagtccaccacaactgtcttcttttaaatgagcacaaatatgcaaaataaaagtttatgctatctaaagtgtacttttaacatctcaaactgaaaaagaaaaaaaagtgcaaaaacccattgccacaaaagaagggatcaaacccaaaaccaatcgacaattacgagccaacagagtcatagattactcaaaacacgtcatggattactcaaaaacactccacttgtgcactcgctcgcgaacacagtaacaaaatgtgagctcaagcgaacattcccagctcgttccaggagctttccctcccattctcttctcctctatatcaccccgcaaccatgcctctcctccattgtttcctccaccgatggctccttccacgagtctcctctcctggtcctcctccgacgacgacgacggcgccggcgccggcggcgagctgtcccgccctcgcaggcggtggcgggcgcttgtcctgtgagtcaacggccgagtcaaccctgcgttcttggttgggttcagagatggtttggttgctcatgaatttgtgttttttttgttctttggttggttgcagggggctcggggtgaggaggaagaggagcatggagggggtgttcgggttcagggagatgatgggggaggagttcatgggccatgtttccttcccctatctttggccaagcatggcttcagtaatagtggtcaatggatttctcattccatactctactttaaacccctcaatttttcttaaatttctttaaaaaaagtcccgtccctttatttttagccccccttgttgcccaaagttcgccctggggggggacgggctctaaaaggcttagcggcttcaagaataacacaaatagccccaattttaaaaacccttttccctttccttcttttgcaagtttttttttaccccaaattggtgcaatttacacatgcatctaccaattttgagatatattatcgattttgtgcaacattcagagcaaagatatgttagattgataagttcatcccaataaaagaagagacatgcggacattgttgttgatttcaacttggatattagaatttagaagtgctccctgtccgctgacctgaaatttgtgcttttttcaggtttcagaagaagtagagaaagcaattttcagacaagtcagcacaccagcgcctccaaggtgaggcttgagacatatactagctttcatttattatgattactaaatttcacatgtaataaaaaaaatttgatgtttagtttctttctgctctaacatacttaatttggttctttcatctgcagactgctagcaggattgaatcagcagcgtc

SEQ ID NO: 29018 - DNA, 325 bp, Oryza sativa
ttttctaatcacatcaaaactttcctacacacacaaacttccaacttttccgtcacatcgttccaatttcaaccgaactttcaattttagcatgaactaaatacatcctacaggtcagataccgggcgacagacaaagctattgggaagagatagagagatatatgcaaggaagcacatacggattcggacgacttaccaaggtcctggcaaaaacatcttcaatttttataatagtggagaagtgtttgcactctactttccaaactactccggtatatacatgactttttctctcctcatatgcttcacggtatagttggcca

SEQ ID NO: 29019 - DNA, 1044 bp, Oryza sativa
atctagaagagttcgagttcaagaaggatgcgatatgacagttatctgttaattaggcatagtttgttagtttccttttatctttaggaaagtgtgtttagtgtccgataagaactttatcttttcctttttagtttctttcttgtccgacaaggactagtatctccttatgggtataaatatgtacacccggggtcattgtaatctatcaatcttcacgatcaatacaattcagcgcatcgccaccctttttaccttttctactttattttatcgtccggcgtaacttggcacccgacggagggctgcatcggtgttcgatctccggcgaaggggtaagtccaatgttccgtcggtctaggcagttgtatcgtctacgtcggcgtcgttcaaggctgcatcagtatattcgacctcttggattgctctggtttggatgatatatttgcctacctatttatcatatgtctctgttaatctagacttagcatatcaatttagctctatcggctgcttctggttttagggtttctgccggtatcggctaaatcgtgttgctagattagattagcttagacatctaccaccttaaaaatcagtcaacggcttgattgtctagatattatgtttcttttcatacttagtgctgcatcacttaagtttgatctactaagtcgtgcttaaaaccataatctctatcctgcttattgattgccaacaagggtttcatcgcggtttcagccggtgagttatctgaacgttgcattggctcataaggattgcacatacatgtaagttggatttagccgatgacaacaaaggtttcactgtttaatctaatcttgtggatttcatgacatcggacctccagccgatgtgtgctttaaccttcggatcgatgcttatttatcatatcattgctagccgattggtttatactggattatattgttattttattgcatcatcatcagccgattgcctttatatcattatctacattggacatatagccgattgcatagaccctatcgctatcggctg

SEQ ID NO: 29020 - DNA, 1501 bp, Oryza sativa
acgccaactagtcaaccctagtggtctttagggggaaaaaaaatcgaagatccataaaaaagttggatcttggcattttgcttcgtactcctactactgttgtttcaccgtgaagtatagttggccataacgcccgaggcccaacggcccggcccaaggcaggggattttggcctggcccaggcacggcacggcctgatcgttgtcgggcccatgccggcacggttcgggtgttgggctgtgcctggacctatgcctcggcacggtgggccggcccggcacggcacgaactttagcgaggtgaaatagacttattttcaaccatatagacgtatagacgtattatatggcacgactagagagtagggacgtaaaatagacttatttagttttttatatgtcacaacccaaagagtatggaggggaaatagacttatttcaaagaaaacatgatgggctgcatgtgccttcgggccggcccagcatggcccgacccttattgggccatgcctgggccacagtggagcacgtgggccgacgtggcatggcccggcgtattggtcgggttgtgccggcccaacaaatcttggcccgagcatgatcgggcctggaccatgccatgccgggcagcccatatggccaactataccgtgaagcatatgaggagagaaaaagtcatgtatataccggagtagtttggaaagtagagtgcaaacacttctccactattataaaaattgaagatgtttttgccaggaccttggtaagtcgtccgaatccgtatgtgcttccttgcatatatctctctatctcttcccaatagctttgtctgtcgcccggtatctgacctgtaggatgtatttagttcatgctaaaattgaaagttcggttgaaattggaacgatgtgacggaaaagttggaagtttgtgtgtgtaggaaagttttgatgtgattagaaaagttgcaagtttgaagaaaaagtttggaagtaaactcggccgtccatctccgatctataatactccttccgtccctaaatatttaacgtcgttgacttttttaaacatatttgaccgttcgtcttattaaaaacttttgtaaaatatgtaaaactttatatatacataaaagtatatttaacaatgaatcaaatgataggaaaaaaattaataattacttaatttttttgaataaaatgaatagtcaaatatgtttaaaaatatgtttaaaaagataaacggcgtaggtacggagggagtgccttcctttccaaggagccgaagccgacatcccgcctgccgccagtggctgcccgcttacacgtacgtttgtaggtgccctgtataggctgcaacctgcaatactgttaatggctttggatcacgttaatttagattgccagcagcccatggagtgatttggactgtacatgtatgaagttggttcagatgctgacgaacaagtaataatcacactttttctttgacgacctatgtcgacg

SEQ ID NO: 29021 - DNA, 1501 bp, Oryza sativa
ctgtgcgttaggtgcactgtacacttagttctcacataaacagataagctataacagtactgccatggtgtcaccttaccaattacagtactagctctctactatggtttccaagcttcacaagcaacgccgcttctcttgtaaaaatgcctctagtttacttcagataagttacccaagctcaaggctgggaagtactcatcaacaaaatcaccacaaacagatcgtactagcagacctgcagcgatcatcatactttaaatgaatccactatggtcttgagaactttctccgacgactgccactgcttgtcgctggcacttgcgacgaagagcaccaccgtgttccccttggcagtcgccttcgccagattgtgagaaccggtcagtgccaatggagtctctagcacatagctgtagtactgcacctcagaagaattgcccatgcatcagagttcagaaacatttagcactccaaagactgttgattcaaatagctgcacaagtagtgtgcaagttgttagggaagtgatcaagtgaagcttacagtttggccatcgatcttctccacggaggtatcgacgagctcgtcggagtcgaaggtgttcccggtgacaaaaggccccagagaggcgattagcctctcagggctaccgatgtcctcaatcgtggcgttcggcctgttcgtcaggcggatcaacggcgaggccaccacctgcaccttgccctgcttgtcgtcctcgaatttcacctccacccacggctcggcgcacttgggctggcagtagttgccggacagaatgttggccactcgcgtttgcttccaggtgggtggcagaatgaactcgtaaggttgcacattgcctggaattggtgaacaatcatattgagtggattcaacacatctcagtatgtcacacaactaaatcaatttctccaggcagagacgacagctaaccaaatcagaagccagaagccaagcaagcacttaccagctcgaagtgcaggagtgtccttggaagtagcccggaagaacacgaacccggggttggacgccgccggcggcaggaccgcgccgacctcgacctcacgcgcctcggccggcaaaggcgccttcaggaacgccgcgcccaatgccgcccccagcaacagctccctcctgtggctgacaaccgccgcgaggggcgccggccgcggggcagcgccaccagcggcaacgacagcggcggcgctgttgtcgtgggtggcagaagagcgccccgagcaggaggtggacggccggagtgcacggagtagcggggagaagacggaagaggaggccatgaatgaggacgcgtccgcgcgggctccgtgtcgtgtctggtccgcgcgcgcgagcgccaccggctctttatccagacgccgagcgcgatatttttctctctcgcaggaaacgagaccgcaacgacccgtagacgtacgtacgcgcggctcagccgtgtcctcttgtcaaactggttggg

SEQ ID NO: 29022 - DNA, 298 bp, Oryza sativa
ttcatttttttgagatattatagttatatgctccttctgttttgacttctttcttaatcaaacttttttaattttgattaaatttatagtaaaattaattcagtgttatagatgttgctaaatttttctacaaactttgataaacgtaaagatgtttgaaaaaaatcaaaacgacttataatatgaaacggaagaaaattatattatcataatctgggtaataatatgaaatataatgtttgtgagaattttggggttctcggagaagctactagataatccctcaaacggggccata

SEQ ID NO: 29023 - DNA, 501 bp, Oryza sativa
actaagttgtagagatttgtctccttgtttatcgaaaaaaatatgttggttgcgggctagacgtctccatttggttgcatcttattgattttacggaaatcgaagattgcttgtcacgaacattttcttggtttctccgttgacgtttcacttttattccataagtttaaattttgtacattaagttggattccttgatttttgaaatgttctttgtaataccccgagtttcgaattagtgtatttcgggatatattaaaacaaacgcgcaaaagttcaacttttaaaccgttgtttgaataggcgatcagggaccgtggatgcatagagctcgctgaatagtgcaaaatagactaagtttgtggtaatcggagtcccaaggtatttccggtgatcgaattaatgtgggctgttcgattttctttaacctctctctatataaccaacagaaaaaaaaaaaagggtcctgcgccccagccgccaccactcctgcgccccagc

SEQ ID NO: 29024 - DNA, 1501 bp, Oryza sativa
ttttttcactttttatctccctttctctctcctttcctcctttccccattgcacagcttcctcctttccccatcgcgcagaaaacggcgggcgaggtggcactggggcggcaccggcactagggcgacaacggcggcggggcggctagatccacccttcctctcctcccccgaagcagcggcggcgttggcggcgcgacggtgccagagaggggcgactagatccacccctcctcggttgaggctgcccctctcctctcgccatgccggcttctcccatctccggcggcggcttcttccctccccccttgccttaccctctcctctctggtggcggtggatcgagtaaggacgaggaaaagcgcggcagccatctcaggcgtcgagtcgagtggagctggagggtagcgggcagctgtggcggcgctacctctctctccgtcggtggcctctcccctctctagcgctgctcctctctcccctctttcccctgtggtggtgatggtggcatcggggaagagcggggaacaacggtagtgccggcgacctgcggagccgggggcggcgacgagccccacgacggtgccactcctgtctcccctctttcccccggttcctcccccggatgcatagcccaagctattcccctccctccccaacactctaacaaatctgacgaggaactcgtggctaactttggctctccggacttcactttgttacgggagtagcagatgtggtatggaatccatgacgtggaatgttaggattgaatggtacatgtatacagttatgcaccgtgaatggcctaagtgaacatccacggttccacctatccctctcttcccgcatgttggagtactgaaatgggtcaccaaatgatgataccccatctgtccacgtctattaggaatgggccgttctaggctacatagtacacacctagcacaaagctaaactaagctaatgatggtacacagtagacgtttgcaggccatccggcccattaccgccgtcccaaaatacttatttttgagtttttattaccaattatcttgtttagaagattatataattattatttattttatttgtgacttactttattatcaataatattttaagtatgactttctttatatttacactaattttttaaataaaacgaatgatcgaaaattgaaagcaaaaagttaaaacgacacctaatttacagagtcaaaatgacatctaatttggtacggagggagttacaaaaatacgctttaaaacttacaaagcgtatcttatggcacctcgagggcccaaggctcaggcggctccgcggctatgcgccagcgccacctatgacctatacccgccgatgccacgtcatgcctcaccgaagcaacaaagcctcgccttttgtctcctggctagccccacacacggccacaccacgcgccccgcctcgaagcaacgcatttgatttccgcctcgtctcgtctcgtctcgtcacgcgc

SEQ ID NO: 29025 - DNA, 398 bp, Oryza sativa
acaccccaaaagagaggaagataaaaaaaaaataagaaggaagaaacaaaccaatctcacaaaacacaatgctagaaaaagaaaaaaaaaaggtttctgatgagcaaaggcgaaattgtgtgacgagtgacgaccagtctgtctcaccaaacgcacataggtacagaacacagcacgaacaccgaacaagaccaccactactagagactctgctacagagcagtacaaggctaactgaaaccacaagttttttttttccttcttttttttacacggcggagcagagcagagcagagcagagaccgacaggtatgcaaaacgcagcaagctttactagacgaagcaaaggatctctcttcttttttttctttttctgttcccttctctgtcacgaaagg

SEQ ID NO: 29026 - DNA, 1414 bp, Oryza sativa
tgatgatgttgttgttcttctttcatctttttttaagatggtgttgttgttgttgttgttgttgttgttgttgttgttattgttccatggtgtcgataccgtgacttgtaatctactccctccgtcctattttaagtgcaaccatgagtttccgcgctcaactttgatcgtccgtcttatttaaattttttttataattagtatttttgttgttatgagatgataaaacataaatagtactttactcgggacttattttttaattttttttaaaaaaatttcaaataagacggacaatcaaaattgggcagagaaaaccatggctgcacttaaaatgggacggagggagtatggttttgtgacgatgactaggatctgtgatggtgatgttgactgttgggagttcgttgtgattgatttcggagggcaaagcttggttgattttgggggcgacacaaggtggatgtgctcggagctggctttttttttttatccaagtaaccttaaaggtatcggttcctaaaccgacatctttgaggagactcaaaggggctgcctgcttgatactggtcaggaaattcggtacttatggttggttcccacccgacacataggtgcatttctatactagtgcaaactagtaaacgatgtgttttttccaaaaaaaaaaaaactccctccatctacttttgatagtcatatttccaaatctaaaaaatttatttttgataggcatatttcaatacaacaacttatcatcttaatgcctttcttggatttaatgcgtgactcttcattcttccacacaagattgtctacatgagcatcgagaaatgcaaatatcaatgaatcgcttgtttacgaggaatgactagtagcacgtttaaatgggtgataagtagaatcacttatccttggtctgtgtgccaagatgaaatatgactatcaaaagtagatacatgaagtattctatagcaaagttattttataaaataataataatttatttttagctaatatttaattaattatgcgctagataattacatcattttttcatgcaggaaaggagaggcttccaacaccttggttcgaacacaccctgaaaatgccatggttactgcccgagaaattttgttggacaagtttttcaggaggtatattaaaacatgaatattagggaataacctaatatcaaataattagaagagtgaggctttgaacctaggtcgcctagcccaccacctcgtggagctaaacagaaaacccctaggcttttctcaaaggaggtatatttgtaaaagaagtttttttttaataaataagctagaatgtaagaaatccagactgtggaactgaaaagagtatatgggagaagatgaggatcgcctgccaaatgccagctgagacagca

SEQ ID NO: 29027 - DNA, 219 bp, Oryza sativa
gccaaacgatcttctacataagtgctctagaatatattctatgtaacatttaaattactttattagacggtatttaatagcattttagtatatggtacatatatatatatatatatatatatatatatatatatatatatatatatatatatatactcataacccaataggagggaggaaaattagacttattctgaggaaacgcacgatggcccatca

SEQ ID NO: 29028 - DNA, 375 bp, Oryza sativa
tcctgccccccttttgtggctagcaattttagtcttattgaactgttaccaatacttaagcgcacgagtccattgatattacagaacccctcagttttatttacaatgaagggttgttattgacctgattttgtttaaatcttgaagagttaggagtaggaaattgatggagctgttgcttgccttcccaatgccccccaatctaatcatgtacattccacaagagctatctaatcattatactggcacatttcagaagtaaaaggatgctcaatttcaacattgaaatcatatctattgctcaattacagatgtgatatggtaccccacttgatttatcgactgaatgggtgttcttgtgtgttgcgttgtagg

SEQ ID NO: 29029 - DNA, 752 bp, Oryza sativa
tttaaccgtacaaaaatacgtcacatttgatacttagtacgtgtgttactatatttaaggacggatgtagcaacacatactataagacgttagtaacttaaccggcatatacatctcaactaaatgtgtactcacttagtttcagattataagtcattttgactttggtcaaagttaaattactctaagtttgattaagtttgtagataaatatagtaatatttataacaccaattattgaatctataattgaatatatttttataatatatttatcctgtattgaaaatattactttttttctacaaagttgattaaacttggaacaatttaaatttgatcgaaatcaacatgacttaggctgcgttctttcaaaggagattggggagattgtcactcgttttccgcgcgcacgcttcccaaactactaaacggtgtattttgtgcaaaaaatttctatatgaaagttgctttaaaaaatcatattagtccatttttaaaatttaaaatagttaatactcaattaatcatgcgctaatggttcacctcgttttgcgtatcttccccatcttctcaattccctctctctcaaacacagcttaatataatctgaagcggagggagcaataagcatggtgattacatactacgtagtagatgtgaagaaagggtgttgtgctgttacagctacagctggtgatggggataataaaagagggagagaggcaatggcgactgtgccggcggcaaga

SEQ ID NO: 29030 - DNA, 672 bp, Oryza sativa
gtgacactatagaatactcaagcttcaaatggaaaattacaatcaaaagtgctggtattaccttgttctttttttgcatcacagagattcatttttcaacaagccttttgcttatgatacataattttaatgcctgttaggaagacaagctgtctcgacctccttgctttggttgttggaaaaaccatatgctatgtactatatatatgccttcttcataacggtagcacaaaaaatatatgatttggccttgcttgattgcaactttgtcagtatggaagtatcctatgcatcattgttgatcaacatacatccacatatataatttgactgtcatacctgtattagtttagtgctctctggcttattcgttgttgacatgaaacgctaagatttttcgagaaaacgctaggtcagatggtacggaactgtgaacatcacagtatgtatatgagttctgggtattaaactattaatcatacagcctatagaatgcagtgcaagaataaccatggagaaaaaagcatgtttgtaaaatgttgggtcaatattaaaacaaatgatgggcccacaatttcaacccttcaagatcttaaaatcaccatgttgctatttgttagttaatgctttttttttcacatatgtcttgtacttgctccgattgacaggagg

SEQ ID NO: 29031 - DNA, 354 bp, Oryza sativa
ggtttgcgtttggttgaagttaactttgagatgcatttagtagtacacgcgacattctcgtcggtttaatcaataatcaggagttgcatttggtcatttggtaatcgcgcaaagcatggtggaaaaagaaatgcagctcgaattcaggatccccaaaatctccgcctcttctgtttccgattgactcagaattcaaaaagtaaatctgcatcacggggggagagaccatgttcatcttctgcacgaatcgcgaggcaaactgcccctgttgccgatgtggctttccgctgactctgttgtgatctgttgccgcagccgcgcggaggtgcgaggcggcgcgatggctgcggcaga

SEQ ID NO: 29032 - DNA, 1501 bp, Oryza sativa
aggggataaatcttttggctaaccttgtaatgtctgcccagtgacgctagatatgaaggcctggaagataaacattctgtcaaaaaatgtgcaatgcaaagctacatgtaacgacataataaagcagttgcaactttcacaatatattttaccaagcacatgccccaaacttggcatcccaattcaacaatattcaataatgtaattcaaagaccaaaatgaattggaacatattagacacaggattgacagctaaccctagcatcgaatttggtgttcacacgaagaccagcaacaattgaataattctacacggatccaggagaacaatcaaacaaaacaatcttgcgactaatcgtccaacgttataccttgaagaagaaacgcatcgcccaatgtccaccaaggaacccctggcacgtaccaacctgcgggatgtcaacacgcgcaaatcatcaagcagtggatcgcctaacataaacactatcctaccataaatcggtagaatagcatccacatcttacccgatgagaagagcccgaatgttcgccatcaaccaaaaccctcgtgcaaattcacccccacctttgcccaaaatcctgacaggagacaaaaatggcaggaaaaaagaggttagtacctccccaatcggagatcgccctagcatggaagaatgcggcaaagcaggagttgggatataatctaagcgagccaggtctaggcttacttcctagctagccaaaggaagccacttggctggatctcttcggggctaaccacttcggagggaagagccgaagaggagaggaagagggagaattcgagttgtgtgcctcggtggaactggaagggggaaaaacttggatgctcaccctgtggcgctagcggagacggggtacagcggcaccggatttggaaatctcagtgtgatctgtctgttgtcagtcttgacccttgagaagaacatgtggccaggtagggctgggacttgtgccgatctgggcccctcaacgcaggccgcgttgtgccaccaggtagcgagggcccaagcgcaacccgtcctccgctccacaagatgttgttaaggggggagggcttggacaagaacaacctggcccatcctcccgtgggtcgggtgggcccttgttctgtaggcatgaagggggcgtaatctcagccctagtccatctgagcacccgtcactcgaccggggtcgcgcacagtatgcctctcgctcgcctctgagctcgcaggcaacagcgtatgcgagttgaggtaaaagaaacgggagacaaggatttttatacaggtttgatcgaaaccagtgttgccattatatatcaatatcacacgagtacacaatattgataacgacctaatctaatattggcgatattggagacatatgttcgacggctagtaatagtccattttctcaaataagaacttggcgatattggagatagctctagatccctcttgtcggcttttgtagctatgt

SEQ ID NO: 29033 - DNA, 334 bp, Oryza sativa
taaactcttttctgaaacaactaagggagtgcttctcaaacgacacggatgagacagtgcgtctcgtccggtcggagtatgtgcaatgattcagtcttttgaattgatcaagattggcacccggccaacagctttcaaacggccacccgggcctggctgatcccatcagccgcagattttccaaacatcaaacccattccacaacagcaaatttcacaaggcagtagtcaaacaaaaactacgataggaatcacctcacatccgcccatgaccgtgggcacggctgttcgaaaagttttaataacctctgcagagggggtacacttttcccaca

SEQ ID NO: 29034 - DNA, 171 bp, Oryza sativa
gcttcagttgagcttggtgcagcaaaagcaaacaaagaaggcagtgaggttagagagctcaaagaacaggtgttcacttaactcctgattgctcatttatataaactatctagatgtggtacttctgtttagatttatataatcatcgtttttctctgctcttgtttcaga

SEQ ID NO: 29035 - DNA, 1501 bp, Oryza sativa
cgccacctgatggtccgcgagcggtccaatgatgtcagtcaaaggaagggcctacgcttaatcaagtcataaagtgatttcgaaaggagaatgcgggatgcttatcgaatatacttacgttgatggcttcatcacgttccgccgcccccttttcataaaggggcacagggatgtcactcgccgtggtcgggccactgatcatcacctggccgacgcggcgctccacgatttcgctgctcagacctgttaatcgagaaccaaccttcgataaatcaagaggaacgcgaacacaagcatgtcaagataaatgcgagaaagataccccgaggagaaacccgggtcgcgtcctctggcccggaatagtcataagctggatgggcccgagcctgaagcggctggatccgcctaccaacgaagtctgcaacaacttcatatcccgacaaaccctgtgctcggagatcgtcgatgatgtcgataaacgactgaagagagggggtcaaggggggctttgcggtccaagacggaatcttgtccggttgatcttcaggaaccacgaagacagggttcgagttcttgatctcaagataaaaccacctattccgccacttgctgcgagaagaagggcactggaagggaatgtaacgcgacttcaggccatcccgaagtcggaacccgacgcaaccagataccctgttggattccatccaacgcagttcgtagtaaaagcgaaaaagatcaagaaaaggctctaccccgatgtaggcctcacaaagatgcacaaagatgctaaagaaggcgatggaattggggttcaaatggagaagagaaagaccatagaaattcaaaaccaggagaagaaattcggaagatggagggagaaaaccgcagagaacacaatcttcgatcgcaaccatgcgacccaagatgagctgaggattagtacctcctgcttccctctccatggttccacggccaggaagagcgccatcctcctggagtttcttcaacgttgcactggtggaagccgatttgccgaggtccattgctgatcgaaggtcgccggaaaacgagcctaggttgttgaactagggtttcttgtggtggcggagaaggcaaatagtgcttgcaggtggtgtgtgtttaacaggtttggtggacttcaaaatggactctcaaaattcctttaaataggcgcactaccgacggtgcaaattccagggaatagagagagatgcccgccagaaatttctgggtccgttacgcgcggcggttttctggacttcagtataaaattcgctcgtgaccgttgggcttcaaatggcgtgctcgactatggtctatctccgcggtcctcacaccgggaatgacaacagtctcgacacccgaagtcgtaaatggttgcacgagttcattttaagcagaagtcggggggctactgtcagggttacgggttaggcataccctttacccttcgatatacgttacatatcgatatggcata

SEQ ID NO: 29036 - DNA, 1501 bp, Oryza sativa
acaataaaagtcaacaccatatatatttaaaaacggatagagtaacattcataaacaacctatcgtagtgaatgagtatctaacctatcgtagtgaatgagtatctgtgcgtgtatatatatatactagctaaatgacggtgctttgctatggattaaagaaaatgtattaatgtgttacccatctttttctaaacgaaatattcatcttaatctaattttatgtggctatccatttagattggatccttttaatattaaggagttcaaggggtaatttgtaaaaacttactgtaataagagtaggcggagtccaccacaactgtcttcttttaaatgagcacaaatatgcaaaataaaagtttatgctatctaaagtgtacttttaacatctcaaactgaaaaagaaaaaaaagtgcaaaaacccattgccacaaaagaagggatcaaacccaaaaccaatcgacaattacgagccaacagagtcatagattactcaaaacacgtcatggattactcaaaaacactccacttgtgcactcgctcgcgaacacagtaacaaaatgtgagctcaagcgaacattcccagctcgttccaggagctttccctcccattctcttctcctctatatcaccccgcaaccatgcctctcctccattgtttcctccaccgatggctccttccacgagtctcctctcctggtcctcctccgacgacgacgacggcgccggcgccggcggcgagctgtcccgccctcgcaggcggtggcgggcgcttgtcctgtgagtcaacggccgagtcaaccctgcgttcttggttgggttcagagatggtttggttgctcatgaatttgtgttttttttgttctttggttggttgcagggggctcggggtgaggaggaagaggagcatggagggggtgttcgggttcagggagatgatgggggaggagttcatgggcatgttcctccccttctttggcaagatggttcagaaagtggtaatgattttcatccaacctactagtatttattacctttccttcagggagtggtaaaaaaagccatattttttgaagttttttacccaattgtgaatttacacatgcatctaccaattttgagatatattatcgattttgtgcaacattcagagcaaagatatgttagattgataagttcatcccaataaaagaagagacatgcggacattgttgttgatttcaacttggatattagaatttagaagtgctccctgtccgctgacctgaaatttgtgcttttttcaggtttcagaagaagtagagaaagcaattttcagacaagtcagcacaccagcgcctccaaggtgaggcttgagacatatactagctttcatttattatgattactaaatttcacatgtaataaaaaaaatttgatgtttagtttctttctgctctaacatacttaatttggttctttcatctgcagactgctagcaggattgaatcagcagcgtc

SEQ ID NO: 29037 - DNA, 1501 bp, Oryza sativa
gcgacgcggtggaacgtgaggacggggaggcgggcccagaggccgcgccaccggcgcgcgaggacggaggtgtgcgcggcggcgcgggcgcagcggagggccgcgaggatcgggaggaggatgtcgtcggggagggcgctgaggcggtcttcctcctcctcctccgcctcaccgccggcggcgtcggggagcgcggtggtggagccgcgcggcagcaggcccccgcggcagcattccatctccatctggtgttcgcggcagaggtggcacgtgaccccagccgccgccgccgccatctctcgtgacgtcgacctcgaccgccgcgccgccgccgacgatggagatttgcgagagaaatgaggatggattagtaacggcatccaaggaagaagtttaaggggcgagtgattttttcgtggctgacgtggaaatccaacatttttattattttttttatttattttctagcaaaatgcatataggccttgtttagttctcacgtaaaaacttttcacactatcacatcgaatgtttggacacatgcatggaagtattaaatatagaaaaaaactaattatacagattgcgtgtaaaatgtgagataaatcttttaagcctaattgttccatgagctgacattatggttctacagtaactaattgcttatgatgaattaattaagcttaataaattcgtcttgtagtttataggcgtaatctgtaatttgttttgttattagtctatgtttaatacttcaaatgtgtgtccgtatatccaatgtaacacgtcaaaacgtttcacccatgtaactaaacagggccttattttgttacggaattaaacaaattctcatcagcaaattataaagatataacctattatgaatttgagagcttcattctaaattctatagaggtttttggttgtcaagttttcactcttataaagaggttctagttattattaggtgcaaggatgatataattgataggtatgagaggtgatctatatttctactatactctttaccacgagagagataaatcaagcaattgctgattcgttgatagcagtgccggttcggttgccgggcatgccgcacacatgaccaataaaaagtgtgaggggatttataactcttcttgtgctaattagtcatggcattgaatccaaatgatttaactaatctccagaaacacgcgcgcatgcatgcggtaaaaaaggaccaagtgatttaactaatctccagaaaatctctcacacttagggtctgtttggcacagctcctgtcacaccccaatccggtaccgccgtacaacggcagctgacaggagcgtgtcgtaggaagcggtccacacggcgcggaccgcttcctacgaaaccgtgatctcagtaccagtcctaagacatagcgctggtacccacggtgacaaatatgaatcattgcaatccttaaaataaatagatgacttatttatcttaacttaggttgcagctcaga

SEQ ID NO: 29038 - DNA, 683 bp, Oryza sativa
tgatcacaacgttgttgttgcagtgcttgtcccagtcctctacattgtttgcttggcgattcatcagaacacatagaaaaacgtaaagcagagaggttttcgtgcatctgtggttgacttcgatgctgatacttaaacacaaatagatggttggccaactcataatgcacacatatgcttcaccatgcctctgaaccctaacatggctatgctacctgcgaagcactgaatcactcagtggtatgtatatctcatagagaagttttatctctggttgcttggctttctctccgactcttgttttatctactgtcgaagaggcgaacagttaagtatttgttggcatttctcattttacatcactaataaaactttttaggcccatgttggatgagccccaacaggtttactgctagctgatatggtttggaagggcgggcaagattccggacgatttattcagccagacagccacccgatgtcaggtttcagagtttgatttgttagagcaaggtcaataatatagcctactgtcagctcctaaaaatagccatgtcatctatagtaaacagtgtagctaatgtgtacaatagaaatactatagcactaatattttttatcttagtggaccctccatcttctctaatctccctctttctccctcccctttccttccttttagt

SEQ ID NO: 29039 - DNA, 488 bp, Oryza sativa
gatttaggatgttacttgatttggggatatgaatctcacctgatttgggagaaaataaagagattaatagtaaattaacaatgaaaaaaaaaacaaaagcggatcaaccgggacgtggctctatcatctttagtcccggttggtaacatgaatcttactcccgggaatctgaaccggtctttagtcccggattccttctcccggttcgctacctgggagtaaaggtagttgtgaaccgggagagatgtggggttctccagtagtgatatataagattggcatacgtgaggtgataccttgaagagaatgacactgctagtgttggcaccagtaaaaaaaatggttgcttaattttctggacatagacatacagtagaaatggaaggtattgggacaaccactacaatctaatagaatcgataaagagttaaggcattccttcatgctatgggccctaatatgagctcgacatattcaagttatgagca

SEQ ID NO: 29040 - DNA, 1501 bp, Oryza sativa
gaagtgaagatgaagtgaagattagggtttcgtcctgattctcagccgtcgcctgtggtgttaggtgttagtttgttggttccgctgctgctgctgttgttggtgtttcctcgtccgtgtcatcggttgcattcttgggctgttctgagctgcaacctaagttaagataaataagtcatctatttattttaaggattgcaatgattcatatttgtcaccgtgggtaccagcgctatgtcttaggactggtactgagatcacggtttcgtaggaagcggtccgcgccgtgtggaccgcttcctacgacacgctcctgtcagctgccgttgtacggcggtaccggattggggtgtgacaggagctgtgccaaacagaccctaagtgtgagagattttctggagattagttaaatcacttggtccttttttaccgcatgcatgcgcgcgtgtttctggagattagttaaatcatttggattcaatgccatgactaattagcacaagaagagttataaatcccctcacactttttattggtcatgtgtgcggcatgcccggcaaccgaaccggcactgctatcaacgaatcagcaattgcttgatttatctctctcgtggtaaagagtatagtagaaatatagatcacctctcatacctatcaattatatcatccttgcacctaataataactagaacctctttataagagtgaaaacttgacaaccaaaaacctctatagaatttagaatgaagctctcaaattcataataggttatatctttataatttgctgatgagaatttgtttaattccgtaacaaaataaggccctgtttagttacatgggtgaaacgttttgacgtgttacattggatatacggacacacatttgaagtattaaacatagactaataacaaaacaaattacagattacgcctataaactacaagacgaatttattaagcttaattaattcatcataagcaattagttactgtagaaccataatgtcagctcatggaacaattaggcttaaaagatttatctcacattttacacgcaatctgtataattagtttttttctatatttaatacttccatgcatgtgtccaaacattcgatgtgatagtgtgaaaagtttttacgtgagaactaaacaaggcctatatgcattttgctagaaaataaataaaaaaaataataaaaatgttggatttccacgtcagccacgaaaaaatcactcgccccttaaacttcttccttggatgccgttactaatccatcctcatttctctcgcaaatctccatcgtcggcggcggcgcggcggtcgaggtcgacgtcacgagagatggcggcggcggcggctggggtcacgtgccacctctgccgcgaacaccagatggagatggaatgctgccgcgggggcctgctgccgcgcggctccaccaccgcgctccccgacgccgccggcggtgaggcggaggaggaggaggaagaccgc

SEQ ID NO: 29041 - DNA, 427 bp, Oryza sativa
cgggccgtgcttgggccgggccaaaattgcgggctttgtgccgggccgtgggcctcgggccatatggccatctatacctctactacacctgcacaccaaccagaagggatctctcaatttctttggacttcctcacttctagcggcaaatttaataactcctcggctccacttctttcccccgttttctttcttgttttcaggcaccaaatctctgctgtttatatactcgagtggtgtttttggatgcaattaggcagcattctgcggcaaatttagcatatagttttttttttctgttctgtttttggcgattgttttctatctgtgtggagtagtaagcatgtgaaaggagctgagaggttgaagcagcagttggatttgatgttcttgccaagaccccgacattttctcttgattctttaaga

SEQ ID NO: 29042 - DNA, 412 bp, Oryza sativa
ttattcctggccacgaatttaagcaggtatcagtaaatacgcaaatttctaaataactattcctgaagaaataacattatattttttccgatcgatttcatcgtatatgcagaaaatatccaggaaaatatatagtgtaaacccatcacgagagtgaaaatttagaacttaccgttggataaaaatgaacgttcgagattcgtctacgttccatgagttctagtaaaatttttactcatgaatgaatccgcgagtaaaattttatccgtgatgacgtagacgaatatcaaatgtctattttttgatttaacggtagttttcagatttatagatacgtgccccgtatatttttcccatatgttgtgtgctcgtaagcacagatggatagcaacaaggaaaagatgcaggatga

SEQ ID NO: 29043 - DNA, 1501 bp, Oryza sativa
gaacccagccttagtaatcgtaggcatttttgtaactagctgattccatgtgctttgcgatggtagaacaatggcgccatcttcttcaaggctccttcgcatcttgacgggagatcccatcagttggaccctatttggatggaagtccctatcacatcggatgtttagacactaattataaatattaaacatagactattaataaaacctatccataatcttggactaatttgcgagacgaatcttttgagcctaattaatccatgattagtctatgtgatgctacagtaaacattctctaattatggattaattaggcttaaaaagtttgtctcgcgaattaacttttatttatgtaattagttttgtaagtagtctatatttaatactctaaattagtgtctaaatacagggcctaaagttaagtcactggatctaaacaccaccttggtctaataaaccagaaaaaaaaagctaaaatttgattttaaagttgatcgttagatatttttaacataatttttttaacgttaacctttaagttgctatgaataaatatataaaagttttatcaataaaataattttttttctaataaactgttttaccttattataaaataggtgagccttggaaattgtctgctgaccaaacggcgccatgcgtgcgcggtgtaccttccgtccgacatctacagtaatgattctacagtacatgaaagtgcacacgggtcaccaaccttttttttctttacgcgacaccaacctcaattaggacctgtttagtttggcaaaagaatttaccaatacatgtcagatcggatatacaaatacacatttaaaatattaaacatagtttaataacaaaacaaattacagattctgccaggaaatcgcaagatgaatttatgaagcctaattaatccgtcattagcaaatgtttattgtaccacaacattgttaaattatggcgcaattaggcctaaaagattcgtctcgcgatttcctgtcaaactgcgtaattgttttttttctacatttaatacctcagacatgtgccaaaacattcgatgtgatagcgtgaaaaatcatgtttggaaactaaaccggcccttgcacggtccgaaaccagcgctgtccaactcagccttactccctccgtctcaaaataactcaacctattctaggttgttcagattcgttgttttaaaatgggtcacatcccatactaggttgatttattttgggagagatggattattttataaagcagtgagcaactgagcttgttcggttgttcctcttggaaaaaaaaaacacaagggatcaagatgagttagctaccaaccgcaggaagaaacactgaagaaatgtgtgttcaactcccaacgatagcttagctcaagctagctaagccatggcggagggtgttgtgggctcactaatcgtcaaacttgggaataccctggcgagtgaagcagtggagctcgcgaagtcgttgc

SEQ ID NO: 29044 - DNA, 204 bp, Oryza sativa
aggttacagcatggttggcccgacctacaggttgggaggcttcggatttgtaagtctctctcgtctgttaaaatacttcatcatctactccagttaattttactgggttagtgaacaagatttgatcaattttgtgatgtgtttctttcaggcatttccgataggatcgccgattgtgcacgacatatatatagcaagccttca

SEQ ID NO: 29045 - DNA, 177 bp, Oryza sativa
tccttgaaaaaaagttagaagtttgaaaaaagttgagagtttagaaaaaaaaagttaaaagtttatgtgtgtagaaaagtttttgatgtgatatgatgtgatgaaaagttgggaatatgggggaaactaaacacggccaaagaaccgttgttcttctactacgtgcctaggctggca

SEQ ID NO: 29046 - DNA, 152 bp, Oryza sativa
gcttcaatctatatctatcccgtcccaaaatataacactggtacgaaatgagaatatctaatactattaatctggatatgtgtggcatgtctagatttgtatttctagaatatgttttatccgtactaagttggttccattttggaaccagt

SEQ ID NO: 29047 - DNA, 1501 bp, Oryza sativa
cagcaaagttgtatttctcaaacattgtctcaatctatttatcgtaggattcaatttgctagttagtgatatcttaaaaaacaaatttcatagtacagaacagccagatgggagaaaacaacctaccattttttcacgatttttcacaggattgagtggtggatctgtcagtagaattttacactcagaaggatcaacctaaagaaacaaaatagaaatacattgatttacctagagctaagagatttcaagacacataacggagaatgttgatgaattatgagcatataaatttaaaagggtctgatgttaaagtaatataaatcatatgaaaagtcatactttcagctcactgtaaaatgcatgatcccatatatggcccatatcatcccaactttgaacaatcccatttgtaacaggatatgatacgtcaagttgatgcctcaagtcagcacaagccgctccaaccacaatatcctgcgtggaacacaatcacaattataaggtgtactgagagagagacagaatgagggaatgccagaaacacaaagatagacattgatttcagaccgtcaattcctgctcctggagtgactcctcataacggagcaatggtcgcccaacaacacaagggaacacagatgtagggaagttctctcccgcaaagccacactttacatactgcaacattagccattaggtaccgaattagaaattaacaagatcacctatgaatatgatatgttctgctgttgtttaaggctttaagcatatcgaacatcaagccacaggaatgatgtggaaaatacttaacagaaactaagccaaagacaacagcataatttcttttggaccgcaaaatatcaaactaatgtggtttatatgaatgaacattatctattccagttccgcatttggaaggacattatctaaagattcaacagagaacaataatctcatcgtattacagcaatttttcctgcctatgtggagaacaataattccaccatactagagcaatttcccccttcaatttcttgcaatgtgcacacgtatcatttcatcctagattaattacagctcagtagtaagcagcaaaacttattcggcacaaatgaatctagagcacagatgctaattactccccaaccaaagagagagaaacaatcctatcgtatatattcaggaaatttcagaagaaatccaagaaaccgtccaagaagaagaaccgggacggagggggtgcagatctaggggcaggagcgtggaggtagagagggagggagggaggtcgccacgctggatcagggatcaggctgcgggaggagggggggagggcgggcttaccccggtgccgttgtcgcacaccaccacgttcccgctgtccattccgcctcgccgtcgccgtcgccgatcgtctccccgcgcgcgcttgggaagttggaagggagagggggaggaacagaaggcgagagagtaggggagggacggggacggggtt

SEQ ID NO: 29048 - DNA, 1501 bp, Oryza sativa
cgccgtggtcatcgtcttgttagtctctgtactctgcacaccgtcagccagccagtatatattttgttgggttgaattgtggttgtagttgttggattgttggaaactttggaatatgtaccaacctcggtaccagtcaaatgccaatcatacagagtcaacacaagctacaattattctcaggccagtcccaagccaagacactatacatagttttcataaactccatgtcacgaagaaactagtactccctctgtttcacaatgtaagactttttagcattgcccacgtacatatagatgttaatgaatctaaaaatatacatatgtctagattcattaacatctaaatgaatgtggacaatgctagaaagtcttacatcgtgaaaccgaggaagtattagacactactctttcaatgcaaacacccttgttccatacttaaatttaatactacttatctcacgtaatgttttggatgttgtgttgaaaccatgtctcacgcaagaaccggtttccttccctttcctcattcattcatttgccacatcatttttcattctaagtgacggcttatttaatgctatggataccattctagtcattgggttgggattggcctgatatactccaaccatcctaaaatactagctagagtatgtggatgtatttattaacaaagtaggtaaaaataattatgagaagttgtgattagttgagagagaaatgtatgttaagaaattaaatgaagaatatagttgtaattggtgagatcaaatggtaggtgtgtagagagttagctccacttatttgaaacaaagcttgagtggtacaaatagttttagtttggaagggagagaatatttatttttagcatataaagtgctctccaattaaaatatttcaaggtatcctcgtcaaaatatatttgttttattttttaaaataggattgattattaaatagaagagttatgaaaaaaaactgtcaagacaataagaaagagggatgtacagacagattatacctgatcggtattttagggacatacggtacaactcatcgagttaaatttaacaatgttgtgggaggcaatggtggatgttctggtaactgtaagtggatatgctcgtgagcactcaaatcatggtggagctgcaggtttggtaaagaagatggagcgctttgaatttgtattatattcatcatgcatttcttaatatctttactcaggtcatgtttagcttccagaagaaaaattttcatgctatcatatcgaatgtttggacacatatatgaagtattaaatgtagtaaaaaaaaccaattacacatattgcgtgtaaattgcgagacggatcttttaagcctaattgcgtcatgatttgacaatatggtgctacagtaaacatttgctaatgagggattaattaagcttagtaaatttatcttgtagtttcctagcaaaatctatagtttgtttttttattaaactatatttat

SEQ ID NO: 29049 - DNA, 195 bp, Oryza sativa
agtaggataggctggtaaagtttggcaaatgagggaaagagtttggccatccgtatggcttggagagtaagatgaagaggctgttggagtcggtcatttaaagttgctaaattttggcttgaagagtgggatggagagactgttggagatgctctaagcacatgaatcttttccttttgtctccctcctattagc

SEQ ID NO: 29050 - DNA, 299 bp, Oryza sativa
ggttgggctctgttttttttctccttttttagcagaagtagatgttggtggttatgactgaagattcaacgagtatgtacttaaaaaaaatcatattcttgcaaagcaccacctcctagatgcagcaattatctgtttgtttgcatcccaagccataaaatattttccaaatagaatttctcagaggcagtgatgagaaaaaagaaaccatttcttccatgaagcaggggatctgccctaatttgatattgccatcaaagtaacttgccatgttcctgaagatgatctcctacaaaaga

SEQ ID NO: 29051 - DNA, 1501 bp, Oryza sativa
ctctgaccgggataagaggctgtgaagcccctcatcattatgatgggatgggacggagcacgccgcacgccgcttgacacactgacagggcaggggtatacagtcgtagtcccatcggtcattcgaccagtcacagaccggtctgatgcgcagcacgccgcattaaatgcagcttggcgcggctgcatggaccgctttaaatgtagcaaggtgggcgttaggcacgcccacctaaccctgtacacgtgggctgatacgtggagggggtcggggcagcccgaccccaagctgggagggggcagccgccgctccaccccaggctcgacccccctcggggggagccacgtgggttcgggaacggcccgaccccaagctatgagggggcagctgccgctgcggcccaggctcgaccccctcgaggggagccacatggggttcggggcggcccaaccccaagctgggagggggcagctgccgctccaccccgggctcgacccccctcggggggtgccacgtgggattgggggcggcctcctccctctcaacgtgatacccccgggcccatatcaccgacaactgagtttaaagtaaaatcaatggttagatgtttttctttttctaagaattattagaaattcctctaatttattagagcgccacgtggtgacttaggaacgtttataggagtcacatgtggcggtttgagagcgtttgtaggaaatttaatgtgcttttaatatataataatggatgttcgatccattgtttctattttcttaagaaacctcgcgaaacatttactactgacaaatgtatattatttgtaccatcgtcatcactttaattggttcatatgcatataatttgttatatgcttgcatgtgaattagtaaatatggaagaaatatacttaccgtaaacattgtttctctatgatacgtgagacccgtataatagttaaaagaaaaactatagtcaatctaaataatattaatattcatacatagtaaaatatatcagaaaatcgaaatgaattttaaagttggttatgcgtgcgtacaaacaacggacatgctcgtagcctattaatattcatatataggagtattcacatttttaatggtctatgcatataaaatagactaatttatctttatatctaaaagatatggaagccatagtaatattcttttgttttttacctctaagtccattaaatggtaatgtatactatattttagaacacttacgtacaaatcagccgatttaatttatctcgtcggttgagcatatttcaaaagacataattaattagatattattgcatccaactaaaggtacaatttttttttataatttttatgttattcatagttaaatttgttcttttcacttacatattatatatctattttttctatgcatgcttgcaaagtaatgtatgatgatgtaatatatgttgttaaattattttacaattttttatgacaatttggatgac

SEQ ID NO: 29052 - DNA, 326 bp, Oryza sativa
gtggcttgcctcgctcgagatcttgagcttgatcctcgaaatcctcgtactacggtcttcgggctccgaaactacacgcgaaacgggacaactcagcaaacggcgaaaataaagccttattattgacctctaagcgtgccattagatagatctcgagatttgaggaattttggaagttgaacggagtcaaacggacttacggttggggagatattgaatttctaagattattggatttttggtctaaaggaaaaggatttatttaaatcctttttgaaaaagaaaagaaaagaaaagaaggagggagggaaattagacttccctcg

SEQ ID NO: 29053 - DNA, 1501 bp, Oryza sativa
ggcccatattgttgggccaaatattaacctatatttcgacgatttaggcagaactttatacgagccgtttaaattctaacggtccttatgggcctcaacgtctatccaagacgagcatgatcaacaaaatatatattttcctctggtttcatcttcctcatcaatggtgacttctgttcatagcacacctaattggatcaaattaaacaccacatccgaattccaaaaatcaactaggatgagccacatgatcaacaaaataatagcctttgggttcacacgaagacaaaatagctagaaaaaatgtgagccattggatagagggagtagtaatactttgtgaagtttcctcggcctactaagaaaaaaaatagttaagttgtgaatactccctctatactcataaagggagtcgtttaggacagcggcacggtctccaaaacacaactttgatttcttgtttctataaaaatatttattgaaaagtgatatatgtatacttttataaaagtatttttcaagacaaatctattcatataatttttatattttcaaactcaacaatttgagagttatttatgatttatattcccaatatttgacttaaacattgtcctaaacgacttcctttatgagtatggagggagtataattctactatgtataccttcaatattaaagaacaaaatatttacaaatagaccctcttactctatctacgtgactttcctttgggaaaaaatatttacaaatagatcattgacatctatttgataagatccaacaacaaataaaagaacaaaataaggaaaatgtaataatgtcgtgcatataattttacaaatcacattataatgaaggacggtttacaaatgaacctcattttaatttagattcatatgatctgactaagtttcagaacattcaaagttatatatatcagtgatgagcaaatatatgtatgtgtgagatatactaatgtgactatcagctacacacccgtctaaagagatgttatgattaacatcattacaaatttaagcccattattactacaataatctatagacatatttaataagatagggagtttatagttgtcggaacgcccaacataatacagtagcatatattaattctagagagtaggagacatagaccacatgctcgagctagcatgtttggctggaccattagaaaaataaattttaccgttacagaaaaattcctgtggtgaaccgacagaaactgccgtcagaaaaaggtccatcgaagaattcattttcctgtgggtttctgcaaagaaaaataagtactgacggcacaacagaaataagtacaacgggtttgtaaaaattcaatttctgacgtggacacattagggaaaaccatcacagtgttggaaccgtcagaaaaattggtctttgaagccaaaataataataataaaaacagaataaatgcaatgctaatggcattttcgaccagtacatcaaaattta

SEQ ID NO: 29054 - DNA, 1501 bp, Oryza sativa
cattctctattgaaatttttggacagaattatcctgagttttcaaaaacattgcccacttgtagacatgttcactactaaaaaatggccaaaggtgccggttcctaaaaggccataggtgtcggttttccaactggcacctattggtcagcattgatactagcaaccggcacctataagaaaaatagaatcggcacctttagcattgctcgagccaaaaaaaaaaagagctggctcgaatccaagccgaactcactaagtgctatcagtgtgcatgcgcccatcccaaaatcaaattcccaaaccccaaaatcatccacaaatcgtcaccaaaataaattgacatcacagaatgaacatattcaacaacaaattcacaaaaacatgttctacaaatgacatcacagaataaacatatactagcaaccgctagccgcctcccctcttgagccgccgcctgccgcctctccacctagcggaatcggcagaggggagggcgccgccacaacccgtcgcccgccgcctgccgccttccctcccgccagatccggtggaggggagggtgctgccgccgcccgtcgcccgccacctcccctcttgcaccgccacctgccgcctcccctcctgctggaatcggcggacgggagggtgccgccgcaacccgttgcccaccgcctaccgcctcccctctcgccagattcagcagaggggagggggccgccgccgtccatcgaccggcacctcccacttgcgccaccgcctgtcgctacccctcccgccggattcggcggatgagagggtgccgccaccacccgttgcccggctgccagtctcccctccagccaccgccgtgcgtgagagagaagtgagaagccgagagagagaggcaagagagagacagacgagagagacgagagaggtggagtattagataaggttgagtgcatggttgactcatatactccgtagggtataaggccaatgcgttggcctagatcagctcggaggctcggctcggtttggatagatgatttattataaattataggtgccggtttttaattaaccgacacctatgattttacccttagtagttaagtacctgtaccaatacttcaatatttttttacatcgtgcccatcactcaagagcgttggatttttacctttttagaatgcaaacaccgtagaacttctcgatcttttttcaacttttaggccccaatctgcatttccctggggaccctaaattactagagacagccctatgcttcagctggcctagaaacatgggaatgggatgctccactcgctcataatcactatgcacaaatgcatgcaagcgtccatctaaaaatggccaaagcccaccacttgccggtccgccatgaatctatcaaagcaagatttagctgcttcataaacttaataatacccaattacccatccattcgatcatctccggttaatttcatggacacaacgacgaccatggcgcctctc

SEQ ID NO: 29055 - DNA, 1501 bp, Oryza sativa
ttttatttggtattagaatatgttaatatttgtttaaacttgcagattggcggtcaggccaacctcattgatagaacgatccggctgttggatgtaagatagtccctagaataaaatagaaagcgggcaacaagactattcgagagcactattaatgtactgtgccttgtgtcatttctaagacctatgttatgaaggctcctatatataatggctgcaaattaataatggtcctagcttttttaggggcctgatcagattatagcttttttaggcaagatggctaaaattttagcaggatttcttatgtatttaccaaatttggcaacaaactaaacgtatatattttttagcaactttaaaaaattggtatggttgaaaatagcatcacggtgaacagacccttagtaatgaaaaatgaattggtctttctagtttctagttttgttactatgtaataataatgtgacatacttgtggtggtctctgttcagagcttgcctatttaaacacgcatggtttaaatggtgttattttgcttttgcaaataattgtaccatatttgcttcttagtgtaatatatatgtttataattaaaaaaactaaagaacttcgattggctgacgaaaaaaagagacttaatgctactgaggctgctgagtagtgtacgttatttcgttgggcattagctcacccggatttgacatgttccaacgtgcatgccgcttagaactagaaattcgaacattgttcacatcttgaattttggggctgcattaatattttagatgcaaaaatgtcggcactttggtggacgccagttctactgaccttcaattctatgtactttggccgtgccacagtctgcgagatatatatagcccgggctgacaccctgtgcctttttccttttgtttcttttgatagagtgttttttttttgttttgttatgtagcgccagacgtaaaactctgcttatctaataggcaaagcttgattgggatcctccaaagtaaattcagagtgacgtggtcactaatatgtaagcctcaccacccatgggtcaacatgtcatttgaccatatcaggtgaaaagttacgttagaggattcctctccgaaaagattatatctattttgaaagtggacctctcggttatttaccttgtgccagctacgagaaagcactactagaaaaagcattttcgctgatgttgagtatctttttttgcaggcgggtagatctctcggagccaaatggctgcctacgaaaatggcaatcagggtcaagaccttcatctgcctgcgaaaatatatttttataggcggaccacataagacgccgcctacgataatattttcatttttgcaggcggacctattaagaggcacctgcaaaaatctcattttcagaagcgcactgctaagagctccgcctgcaaaaacccgcatccaactataaaaaaattcagacttatcccactcccccaacagccactcaa

SEQ ID NO: 29056 - DNA, 1501 bp, Oryza sativa
ggtgggtcggacacttcgggcgggtggctcggactttccggtgagctactctcgacagggagacgtgcggccgcatgctcgggttgattgaagctggaggcgatcggcgttctcgatcggtggattcgaacactctgggcggggtggcccgggcctttcgataagctacgttcgacagggagacggctagacgtagcgctcggatcgttcggtggctgggaagacggcatgcgacttatcggcttcggctcgcgattagattgatggcgttcaatcaaaagtcggagcgtgtggatcctataggctgttttggaggtgttgacgaggtatttgcgtgacagactgctacggagaaagcgcacatatgaaaagcgacggaatcaagcagaagggcagtcaatttcagaccgtcaatgcgctgatcaattgtgttagcacagcaataagcattggttgcaactgaccggcggtattcgtcactggcgaggttcagcgggaggctaggtggctacgctagaggtcgtacgggtgcgtggaggctgaggaggtcacggagatggcggtgtgcacgtgttggtgttgaagccgggaccatggaacgtggccagagcctgagtagcaggaagtcggattgcacaggactcgatctggagaggttgtgacatggaaggagtcggatatgtttccaactcggatgcatagcacaatagagaaacagattgagggagagacctagtcaagcacggaaggggaatcggacgaggattacgatctgtccatgaatgggactcgatttttcccaaataaaagcagcggaggaccacgggattgcaacaacgcaatcgaaacaaaccacaaggcaagggcgagatcttacctctgatttcgtgggcagcgtggtttggggcggcgagttcacgggcggctggaggcgtcattgcaggcggcgtgcagcggcgtggtgctcggcgcggcgttcgtcgtagctcgggcaggagcttgcggcggcggcggcggttcccggcgaggaaccggcgccggacttcgacggcgggtgctcccaggtggcaggcggcggcttcccaaggcaggcgacgcggcggctcctcgcgaagtcggcgcaggtgacggcggcaggaggtggcggcgcccaggcggtttccgaggcggggcggcgcggtggtcccttgcggggccggcggcacagaacggtggcgtgaggagcaggaggcggcggcgcatcgggagaacgcgtgcgcaggaggaaggggagcgagaaaaggccgaaggaaggagaggaatcgatctgattcctttgaccgctcggtttgattggttttttgaccgaaaaaaaaaccgaaccggttttttggagaaaaagaaaaggggttggttttgtccgactggtgactgtgcaagtttagtcggtgggtcaattaatcagggcagatcaatttaacagggcaacagctgttgagttgattatcgtcgatggcggcga

SEQ ID NO: 29057 - DNA, 1501 bp, Oryza sativa
tgtgcagttatatggtttttgggcccggttttcattataaatagggtcaattctcttcttctaatatatccggtagaactcctaccatctactgtttaaaaaaaaaagaatgctgaaaaaacatggttgcagacaatggcggaactagaaattttaagcagcctgagcaaatcaataaaaactctataaaaccactaccgacttatcaaatgtttatatgccgattttactaccaaattgaacacacagcagcttttctaataaaagcatagtttaacatgcatgtaaattttcactagttgaacaacaagatgatttgtaataaaaaaggatgattcatatggctagtactcaactcaatcacttcagccacagtgaagcatgcttgttccacggcttctaattaagagtttagcctgctaactttgtcagaaatcagcaaatctgtagacttgtacacaacgaaatcagtagacttcaatggatcgtgcagacgaaacccgggcaattcccccgcgtgctggtccggcggtgaatccgcgcgccgctggttgtagattccaattatgttgttgagcgaaaatgctataggaacatctgaattacaaagagccattcctcgttcgattttgtgcattacacaccaacatgtcccggtcagctacttaccttgccaactgggctgggctaggcatgtggcttaaatgtggcctggatagtctgggctagacattaggcctcacaaagtctggttcgcgtgctaccgtatctcagctaggacggctacgagtgacatgtttctgtacgtgacgacctcaagccaggggaataagtatttaatctgcaaaacccacttataggtcagacctataagtgagtttcgcggtttattcatttacacccttacctccagccatgctcgctctcccgcatcaggtgtgtgcccggcaatagtcatctctgcctctacaagcagagcctatgtttcttctgccttgttaatgcaccgtgcaaatgtaccaggttctttctgagtaggaaaatcatctgaaatatttctctaacatcgcacagtaatgctaattgatttgtaaattgggatacatatataattggtaatatatgcatcttagcttgcttcatcttggtatgactatttcccatttttgtggcgaagtcttggttgcacatccaactcagatcatcccattcacgatagctggtgaagattcagtggtacctcgtcaagcgacacattttccttctggactaggagcaagctaccactgatgttcttggattgctttccaaagccatctagacactatacattgtttgctccattggttaggcaataggaaaattgaagcggcggctccgttatagatagacccgagaagttatactgcatctagagtatctgaactgcgtgttgataaaaattttactcttgatggatggtagacaaacaatgcacttctttgcttcaccatgcctccca

SEQ ID NO: 29058 - DNA, 621 bp, Oryza sativa
agactaccgtgaaggccggcggcgccgccgcccaccgctgccatcaagcaagctcgaggtggcgctcgtgcaagcctctcggcgccaccgccccgcacatctcttggatgatttgatgatgactaggtgcattgggaaggcacactggtggagaaaggggctttactcccggttcgtaacccccctgtagtcccggtttttcaaccgggactacgaatccgggactaaagatcgctatctttattcccgggtgaaaaaaccgggagtaaaatccatttttagtcctggttggtgttaccaaccgggactaaagatagagctcaggttgctactttattctattcttttcttcattatttttaatatattgattcaccctatcccatcccaaaatcccaaatcaatcatccccgaatagtctccaaattctcaaatcaatctctaaatacataacaaaatcttaaaaaaaattacatcacaacttctacaaaattcatcacaaatacatcacatattcacatcacacacaaatcaaatacatcacatattcacatcacacacaaatcgtctcatatccgaatcacagatttataaaaaaagaaagaaaaaaaagaaagaaga

SEQ ID NO: 29059 - DNA, 1501 bp, Oryza sativa
cgaatatgccacgccaacctgaatttgttacttgctcgaacctccgtgtaccaggacttgagttggttctgccacagttcacgccgagccacccgacgagcctacgccaggctcaccgccttcaggatcgtgcacagcaacaccagcatgcctatcttccatgactccacctgcaacagcacttccttgtaacttgtacaaacatgagcttgtcctctcaccagtcataacagtcttgccgtccttcatgatattcatggtcttcctatcaaaatccacctgatacaaccaacttgtctcatgtaggctcccaagcgaaatcaaactcttccttagtcccggcatgtgtctcacatctgaaagtagcacctcgtttccatcatacatctcgaacttgacatcacccactccaacaacacgataactcgtgtcatcgcccaagtaaacaacaccaaaatcaccagatttgtatgaagagaaccactcccgcttcgatgtcacgtgataggaactagctgagtccaacatccacgcttctccagacttctcattagacactgtgagagtctcatgactgctgctatctgaatcatcaccacgagctgctaaacttgcaatgccacctttcctcttcttcagtaacgggcaattcctccttatatgtccaaactcatgacacttatagcaccgtgcccccttatccttgctcttcgacacccccgcttcatgatcatgctttgccttgaccagcaaactctcagcctgagaagcctccattgcctcgtttttgtttgatcttctcaagtctcgtgcaagcaacgatgaaattttctcctcagttttgacagtatccttgccgtgcatcagggtagtcaccacatgttcatatgacggtggaagcgagcacagaagaattatggccatgtcttcatcatcaagtttcacatctaacttacttagatccacaaccaactgattgaagacgtccacgtgcttcctaagatctgactcctcttgcatctgcaaaccatacagctgttgtttgagatacaacttactcgtcagcgacttggacatatacaggcttgccaacttgtcccaaatttccttcggcgttttttcatccatgaccgggtacatgacagaatccgagagactcaagcgtattgttgcagctgcctgcgccttcatctcctcccacttgccagcatccatcttttccggcatcgtctcctcaagagccttggatatcccttgttgagccaatagatccttcagcctcatctgccagagaatgaaattcccggtgccatcgaacttcaccacctcaaatttggaaaccaccatcgccgccatcgacgataatcaactcaacagctgttgccctgttaaattgatctgccctgattaattgacccaccgactaaacttgcacagtcaccagtcggacaaaaccaaccccttttctttttctccaaaaaaccggttcggtttttttttc

SEQ ID NO: 29060 - DNA, 1501 bp, Oryza sativa
gagtgagattgcgtgcagcatcacaacagagtgagattgcaatataacttgcctgtaactttttagagaaacactaggataaggtcacgggatataataccctcacctatgcatgcactgtgactttttttccttcctcgcttgcgtgaatcttggattgagtctaatgatctaaaattacgtgaaaagttacatacaagttacactgtatagtatgtatgttacaatataattacactacaattatgatactgtagttacatttgatattttttcgagaaattttgtcaagaaatgtaaataatggttcggaggtggctaggcgatgaagctaaagacctgaggtccggcccaaccacctgatgtacagcacaattctttccagcttaaccaaactgggctgcacttgtgttacaactatgccataataaatttaatagttttgagaaacacgattataattcaccttattgtaaggatgccattgcatccctttcaaaattggactcatgcttgatatctatttggaatccttttttggttattgtattttttatggaccaaaatacccctgcatacactttagatccatatgaacatgcttcattttagatcaaaacccaaactgcaacgaatcattgcgatgatatatctatcacacaaagagagaaaaaaaaagggagaatctaggataagaagaatttacgaaggaaaaaagggaagaaaaagagccagtcgaccccgagccggccatcccctccatgccgtgacctgccgtccccaagctcgcactgccgtcaaactcgatcaccggccccgacatagctcgccaccgccagatatgctcttcaggtctagctcgtgcctcgtacaggatggcatgaaaccaattttgaaagagttgaattagcatgatgaattatattagcattctttgaaattagcaaatttataatggtttggatccaatgaaccctaaataaaattggccaaatatacctgcaatcccattgaagcccaattaactggatatgtgagcctccctctatcctgcttgggcccaactgaaatgatcacggctcacttgggctgaaatttctgagcttttaagggctattttggtttgaagccaaaatgtgccttaccaatgcaaattgtttcgcactttgaatagtattttattagtgtttggtttgataccaaaatataccaataacatacaaaaagttactaaaattttagcacaccaaaacttgcctacgttttggtagtaccaatatttttggcatggtagcaaaccagacacatgctaagtgacaaattgttctttcgatgcccagcactagctaggccatggcaattgcttgactgtcccttgtatagtacacacgcttaattattgagcattcttccccacaaaaaaaaatattattgagcattcttcactagcacatgcacatgtacacattggatgccatccaaaggcttatgttaccatgta

SEQ ID NO: 29061 - DNA, 583 bp, Oryza sativa
ttacaatttggaagttcaaaatacctgagagcatgctacgttttttcaccaagaaactgaaatgaaactggcaccctcaagttttgagacttagttggtgtcctaaactctcacagttaacgatgcagatattattttccagggactgaaattcatacattgttatgtcattagacaaagtttcatgtctacaagtcagttagatgttgtttccttggattctatttttgaatattctttgaggttcagagcaacagcgacacaaaatgcattgtaatggtcatctagaacttacaggtcttttccattgctagaaattaatttattgtcatgatattattaccactttattttgtttttcttggtacttttcctatgattcaatcagattggctaagtttgagtgcagtcatattttagcagttaaccagtcattgggtgcaaaaagcccatgtcaagatttaaggcaaagtttctcatatgaagaaccaatgagatgttcagctgcgtacttgtataacatatgcttccatgatgtgtatgaaactcattctatctttcaattccagagcaaagcagcaga

SEQ ID NO: 29062 - DNA, 690 bp, Oryza sativa
acctagctatgaacaataatactccatatgtagggttgtttagctgacaatttaactttagcacaatagttttcacaagatgtaacaagccattatcacccttaagacaagttgtagcaagaaaatgtaccaatcatgaatggtcttgatttcttaaaagtggtactataccatagctacacctatccctgtgtgtaagatgatcgaccacttatggccatgaaatttaggccctaaaatcgtatatttcaatctacaccgatgcattttaatatgcttagttctcttcatttcaccttttttttcaaagtcctttcttggcactggtaagtgttcgatgacaaccatggctacttcgaatggttgtatctcgtgacaacaatgtgagtgtgtgttccaaacaataagaattccattgttccacttaataagaaaaattaagtgcctcttcagaaaaactaaattggtaatattgtcaaatttttgtaggataaactaaatatgttgtaaccaaaattatttatacgttatcaatgttaaacgcatccacatgtttatcgacctttaaaaaaggtatagtttaaaatggcaccaatctaaataggctctaaattggtgtagccattcttcttcattagatcaccactacttaaataggtggatatgcttatttagtatagctttttgttg

SEQ ID NO: 29063 - DNA, 1501 bp, Oryza sativa
ttgtacatctcacttgccacaaaagctgaagtgatgtttcggtgatacttctccaccccttgtaagtagcacttgtgctcggtcacaatgctaactttccaataatcatttcatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccgtcaattacctcgttctccttatactcccagggtacatgatcaccctctgatataacaagtccagagaagtcctcatttgcccaatcagtggccattacatcacctttctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattaataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttatttgacattgtgcttgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctagatctacacatatgtgctgtgtgctacagatatgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgttttttttggatttttagtgaatataatgaaatttcagagaggggggactgggctttatagggggaggcaaaaatcgccctcccccagggcggcaagggggccgcctgcaaatttcgttgacggccgtcgcccgagagcgaacggccgtctgccacgtcattttcgccgccctctgggatggcga

SEQ ID NO: 29064 - DNA, 1501 bp, Oryza sativa
caataacgacatagaaaatgttaacattgtaataatgatattgagtcacttactcaccttgtactttctctgaacagagattaacccataactcaataagatcatccatgcatatttggcacatcaatcccatatcttgcaaacgctctttcacatccaagttcaaacccatagcttcaacggtatcatgatccttccgttgcatagcttttgatatagctcatttgtgatgctgaggtcttgttagggaaaaatttttagatttggttgtcacatagaacatacggacacacatttaaaataataaatatagtttaataaaaaaacaaactatagattttgctaggaaactacaagataaatttactaagcttaattaatccctcattagcaaatgtttactgtagcaccatattgtcaaatcatgacgcaattaggcttaaaagatccgtctcgcaatttacacgcaatatgtgtaattggttttttttactacatttaatacttcatatatgtgtccaaacattcgatatgatagcatgaaaatttttcttctggaagctaaacatgacctgagtaaagatattaagaaatgcatgatgaatataatacaaattcaaagcgctccatcttctttaccaaacctgcagctccaccatgatttgagtgctcacgagcatatccacttacagttaccagaacatccaccattgcctcccacaacattgttaaatttaactcgatgagttgtaccgtatgtccctaaaataccgatcaggtataatctgtctgtacatccctctttcttattgtcttgacagttttttttcataactcttctatttaataatcaatcctattttaaaaaataaaacaaatatattttgacgaggataccttgaaatattttaattggagagcactttatatgctaaaaataaatattctctcccttccaaactaaaactatttgtaccactcaagctttgtttcaaataagtggagctaactctctacacacctaccatttgatctcaccaattacaactatattcttcatttaatttcttaacatacatttctctctcaactaatcacaacttctcataattatttttacctactttgttaataaatacatccacatactctagctagtattttaggatggttggagtatatcaggccaatcccaacccaatgactagaatggtatccatagcattaaataagccgtcacttagaatgaaaaatgatgtggcaaatgaatgaatgaggaaagggaaggaaaccggttcttgcgtgagacatggtttcaacacaacatccaaaacattacgtgagataagtagtattaaatttaagtatggaacaagggtgtttgcattgaaagagtagtgtctaatacttcctcggtttcacgatgtaagactttctagcattgtccacattcatttagatgttaatgaatctagacatatgtatatttttagattcatta

SEQ ID NO: 29065 - DNA, 265 bp, Oryza sativa
acatgcatcacaccttttcttacgcaaagtacttaaaaacttttaccataacacatcacacctgtggccaacagacgctataaaaacaaagggttaattagatctatgtcattgcaaatatatcgcactagaaaaataacattactattcatgaatcggttgcatgctactgcaatattttaaagttagaaccgtatcactccctcacgatttctctccatccccatccctcaattgccacctccacttcttcgtctttgatagc

SEQ ID NO: 29066 - DNA, 1501 bp, Oryza sativa
gggtatgtttagttcgtgaaaagaaaatttttgaatgtcacatcagatgtttgaccagatgttggaaggggttttcgtatacgaatgaaaaaaactaatttcataactcacctggaaaccgcgagacgaatcttttgagcctaattaagccgtcattagcacatatgagttactatagcacttatagctaatcatagactaattagtctcaaaagattaatctcgctattttcatgcaaactgtgcaattagtttttgtttttatctatatttaatgcttgtccaaagattcgaggtgacgtttttagaaaaaaaaattggaactaaacaggcctaagcataaatataaactaaacaatggactatcggtctctctctactcctatgacaaggaaagtatctgccggatttatttctcacctagaaaaaaaaaataagtctagagagagaaaggggctgtaatggcgtgtaggagagagaaagcttattgctaggggggtagtaatggcgtgtactcactcgagtagtcatgtacagcagcttcagttcatccatttctactactactctttctctctcatctttacttgcaacttctgataggctgctgctgcctgtgttgtgtgtgtgatcgatccctgtggcttcttttggccaccacagcctttttgacgtttcccggagcacttctctttctctctctctcattctctctttcttcctcgcgctacagacactgctcttgctgctgctgttactgcttgcttgcttgcttccctccgcttgctcagctggaaaagaaaatctgaatattcgcaagaaactgatcttgttcattttaggcattcattcattcattcctgcagctagccgtttcgattctggggctataaatcggcgccttgctgggttgctcttcctactcgtgcttagtttcttttgcgctgtgttttgctagcgttggttgggaaatttttgtgagggtgagcattcttgacaggtgagagcatttgctcatggtgatctttttcttttgttggttttcttggctttcttgatgtttgtttgagggttttgcaagtagagtgggtgtgtcctggaatggttcttgatcagtgatgaaaaacaaaatcttgtctttgcgatgtttgctccatgttttgggagattaagggcgtcaatctttgcaagccagctgccagattgttgcaggcctgaaaggcacattttttttcttttttgttcagggcttaaaaggggtttgctttgtttctctggggaattcttcctgtggcatctgattctcatagcctataggccaataaagttgcttaaagcttccttctttactgctttcctttcctatcctatcttatttaactacccactcaatcacatttattaagcctgatttctcttattgattgctcattgtggcaattgttagatcaccctgaacaagcagaagaacaagggggagaagttcctgcttctgtagaga

SEQ ID NO: 29067 - DNA, 560 bp, Oryza sativa
ggtgcgcgaatgtcgagacgcaactagatggttacagggggacatgatataacaattaacaagggaggatcaatgcaacaaattaggtgggtccgccaatctgccttgcagacgggacgacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaaacggatttacggttgggaaggtattgaatttctaagattattggatttttggtctaaaggaaaaggatttaattaaatcctttttggaaaagaaaaagaaaagaaaaggaaagagggagggattatagacttttcctcgggcggctagggcgcggcccaagggaaa

SEQ ID NO: 29068 - DNA, 1501 bp, Oryza sativa
gacccacattatatgctttagagatagtagaaactagcaataaattcatgccctaaccaaatttataggcctttaaaatttgtttgctatcaggcgtagccaaaatttaaacttttaaacttaattttagagttaatttagggatttattgtctatttcctcgaattgactttatataccatcaaattgactggttgcttcattcacgtaatgtcggcttaccacagtaaaaacacattggtctcgttcttttcttcaacaagagttggatgaagattaagattttcatggcacgcttttcaaactgctaaatggtgtgtttcgtgagaaaactttttatataaaagttgctctaaaatatcatattaatctattttttagtttgtaataattaaaactcaattaatcatatgttaataccacctcgttttgcgtaaaaacttcatcttcatatattcaggagaaaaagaacaccaccattgtgcgtgactaatttggatggaaccatacaccacaactcacagtatcaatggtaccaaggggtcgtttgattcattacttcaccttgtcaagtcacaccttagttatgccacagtctgttatgtaaatatttatttcacggtcacaacttaggctgcattcgtttttttggtttggagaaagactttcagcgcaaacgaaacgagaaattaattattaaccaccataaacttgaaagatagatttcatgaccgtacttttgtgccatgccacacttcgttaggcgtgggaaacttagataccaacgaaacagcttttgcttattatcaaaaagatcatactcaacattcttccatgtagatttatctataggtcaaagtttcaactagattttatttggactgcgatatatcaacatcgaggtgtatattttttaatgagcgaatgattttttactctcatagtgaaactattacgtcaaaacgatttgctgcaactttaaatagaactccaacagtgcttgtgattttatcagagaactttacaaaatagaacttttgttcaactaagatctgatccaccagtctgcaggtacacatataatacattgttttttaagataaagtattactcttactaacttccttcattgcaaatataggaacctagtatcggataagacacgttccagtgctactagattattatattatgaaatggagagaatacattgttataagttgggtctaagttgagtctacatattaaacacgcattatagtcccagataaaatagtttaatattgttataaccttgtaaaatgcccgattaaaagtatagtaaattggtaagtatgaccggatattccgaagtttcgtgaaatttactttcgaaattgatgcgtttgatttttgtcgtccatcatctgtgaacagctcaattagcagcgcctacgtgcgtcgaggaggaggataaaacaaagctcttcggtcgatgcgaatgcgatgcgcacggcccaaa

SEQ ID NO: 29069 - DNA, 217 bp, Oryza sativa
atggaagtcgttcggctggacgaatcgattctctcgtgtgtacgaacattgtaatcatgttctggaatttgagattgttgagagaatcaaagtcaatccacttcctttaaggtcaatccattcccctcgccgaaagaactagaagattctgaagctcgtctaatttaatggtggtctctggttcagagagattaaaagatatttgttggtcccaaga

SEQ ID NO: 29070 - DNA, 1501 bp, Oryza sativa
atgtatcaattatattttgtatgtttgtatctgtcgtatacatgcctatattgtgtggtttacatatttaatatcgtgatttatttaatccatgtctctatatttccaacaatatcatgacttgatcgaacaactctagtttatattgatctggccctttgttgggttgcatacctgctgtattttctctcccattttttgttcattcatgagttgcgtagcccactgcaaatcctcaattcctcaccaaaacatgaaatctttctgttctacctctcatgtcatcaagttcatgattcatgattcatggatatccatgggatgggttgtcttgacaggaattgacaaggaaaggattgctttatctttctatgggctttgtataattccatgtaggtgagaacgtagtttcccaaaactttgtggatcacctgtcgaaccttttgctttcttcataaagtatcaaaaggttggagcatctctctggggagatgaaactggtgcagataggctagtgattgcttatcgtttgatttttttaagttaaatttctttatgattgactagatttatagaaaaaactagcaacatctataacactaaattactctcactaaatttaacattaaatatatttgataatactttttccaaaaatttgggcaaatataaaaaaaatgatttagaaagcagccaaacgacttagaatatgtaacggagagagtatgttttagcactttgtataccatgctttactgcttttttttttgtttccgtgtatgtaaaaggtttccaaacattctgctgtaacaggaatgtttacatgtgcgaactgtcaactgtttgacgtgcgatgggagaagtgtgtgtgttgccttttcatgacatgaacagtatgcatctccgtgcaaatgaatcaagcaatttaccttcgaaaagccgcatctgcaaaactgttttgcgatcatcttttaaagaaataataattggatcaatctggaatacaaaccgaccttagctcagttggtagagcggaggactgtagtcgttgcagatcaatccttaggtcgctggttcgaatccggcaggtcggaatatgattttaatttttccttttttaaatctcctcatctttgtgcagcaccgggggaattgatgaagccaaatagccaatgtattgctcaagatcttttttttaacaaaaaatcatgacataccgtaaatgcaagtaatgctggttcgaatccggcaggtcggaatctaattttaatttttccttttttaaatctcctcatctatgtgcagcaccgggggaattgatgaagccaaatatccaatgtattgctcaagatcttttcttttttttaacaaaaaatcatgacataccgtaaatgcaagtaatgtttgtatcatgctttgccaggaatcacatggagtaaacgaagttcagcagaagtctagaactccagatccacatagaaattcttttagtctgagaatc

SEQ ID NO: 29071 - DNA, 1501 bp, Oryza sativa
atgaagtgctacatcggtatttttcgtccgcttgcggattttatctgtaaggttaagaaataccaacatgtatggtgacgtggcttggctattagttgactgggatggggttattgtacatgtcctaagccaactataagcacatgtcaaggagatatagatttatggttgtatgtttgtatgagatgtgtgactagattttaatgataaagtatatatttatatgtaactattatatgaacagactattaaattggatataaatgatacatttttagatgatatgtatatttttagagtgcctatttggtagagctgcaactcttaaatttatctccagaagttaaatctagagtggagttgtggagtagcctaaattcatggcctgtttggcacaactccaaccccaaaatttagctttaggagttggatttggagtggagttgtggaaagctaaaacccaacttcaaatctctagttcattttgtgatagcgctccacccagcttcagctcctattttaggtggagagacgatcagatcgaggcgaccaggcgcaggggacctccatctccctccgccagctccacttctcgcctctcgtctctcgcatcctccttatctggctcatgtctaggtggaggtaggtcacccgaagcaggttatggtggtgtagatcaaggcagggcggcaccaagaagctcccggaggtacatcaagcttaaggtcatcgtcgctgtcattgttagctagacgatggcatggtgattcggagaggagaaatcttattcttgccagactttttttttgttggattcttttttttcctagtatgttttcctctgctcctggttgttctagatgagatttctcatttgagaaaaaatccctcttaaaatttgcaatttacatttagatccgctggacgttttgtcaccattaatatgtcatcggatggctgcgaatgagtgggaatacgtggcacacttttccagtcgagaatctaggctgagttataatcgtggtgccacgtggcccaatcacaagacggagctgtaacccagaaatcggtatataagattttaggtggagctaaaattatttggctgagctccagctccaagagaggtggagctagagctagagctgtgccaaacaggcctgtaaggcatcaattgttatttgtggagggttgtttcacaatttctccaaatttcggagatctccccgcaatttggactggaaacgatcactcgctcccttgtcccctatcctctcgccgctggggcgctgggcgctgcctgccgcctccaatggctaaacccctcctcctccccgctaccgtcgcggcggcagcagcagctcgcctcccctcccgcctcgccgtcggcgcggccccgccattccgcgtcctccccttcttcctctgcccgccgcctcagagccgcagcctctccttctcccccgtctccgccgtgtccacggccggcaagcgcggcagg

SEQ ID NO: 29072 - DNA, 438 bp, Oryza sativa
ttttttccttatttttttatataccgttcttttacatgtgtaagagtgtgcgcacgtaataaggattctttttttatctaaccaattttttcgtcattaggctgtaagggttgttttttatctgctcagttttttcatcaccaggccaaaccctaacgtcaccgctatgtcgatctacctcatcatatgttctctcctccaattgattgcaaaaatcgattccccactactctccctcgtcatttcctctacatgattttccctttcaatcccactttgatttattggatttaatcaccatttaaaagttactgttctatcccgagttttccagattcgtttcaattttgataaaaacagaaagaagagattgagtgtatcaaaagcccttaaccaattttgaaagatcgagaaagatttgaccggatttgatagaaa

SEQ ID NO: 29073 - DNA, 247 bp, Oryza sativa
aattttattgttttctttttatttaattggttaaatgatctttgtgactttaaaattatttcttgagctccgaaaaatttgcggaaaaatccggagagtattttagggcacaaagaatattacaaaatattctcagctaatgatttttaaaggaaatttttaattccctcaataattcacttgattaagttgatttaacttttatttaatttctagaaaatgtattattaattgatttttattcccg

SEQ ID NO: 29074 - DNA, 1501 bp, Oryza sativa
gcaatgcctaaagtgttcgtggtgtggtacaccgtttcctctttattttttttaaataatttgcaattgagccatatgtcatgacctttgccttgtttctttagtattattacttcccttttactacctgcagcaacagcggtgggagtagggcttgtgcaccataccttccaatatagctcatcttcctcatcatgttgcggacgacgtgctcaatgagatctgccattaggaacactaagagagactattagtagtggagggtttggtgacgatgaataccgtggagacgtgcactttcctttccactgaggtcgtacctctatagattgggggaaagttgcctcgtatactgccggcgatgtaatgcttgaagtgtctgtggcgcaacatgtcatttgcttttaaaaacaatatcactcaagccctatatcttaaaattattgaataatgttggcgatgtaatgcctaaagtgtatgtagtggcacataatttcctcttagttctttttgaaatagtttgcagtcgagctctctatcttgaaattttcaaatgcacccttctttgttctttagtattatgcttccaccctttttttttttactattctgaagtagtagtgagcgcagggttagtcgattatatttgcattgaggcaaaaaagggacaaagattgtgatccacattatatgaaatggtatagtacatgtgcaattaggggcattaatttagtgtgtgttgtataattttgttctacacccatcaaacaaaaggaggaaaaatttgcttccagtttcattatattagaaagtaatgtttaacatgttagtataacaaaaataccttacggagacatctttttattactatagaggcattttcaaaaatatctcattggggccttacggtgaattgcctatacaaatgatgacacattttataaaatgcctttgtatcttgcaatatttttatagtcacattttttatgtctataagagagtagagacatttttctagagggtttggattttgtgacaaacataccaaataattgtgaaaaaaactgtggtagagacattttctagaggcattggattgtgtgacaaacaaaccaaacaattgtgaaaaatatgtggtagagacattttctagagacattaaagtgtgcatcaaacataccaaacaattatgaaaaatatgtggtagagacattttctagaggcattgaactgtatgaaaaacataccaaacaattgcgaaaaatatgtgacagagacattttctagagacattggattgtgctacaaacatttactattgtaaaaaatatatgatacctatatttttcataaacaattgtgaaaactatctgccgctgatgcaatgagcttgccgccccttcgccgttcactcctcacgtgtcgcagctaggagtggtaatgtgccacggcccatgggccctttcacaatccatcttagccttcaaatatttttagctca

SEQ ID NO: 29075 - DNA, 1501 bp, Oryza sativa
catggcacaaaagtacggtcatgaaatctatctttcaagtttatggtggttaataattaatttctcgtttcgtttgcgctgaaagtctttctccaaaccaaaaaaacgaatgcagcctaagttgtgaccgtgaaataaatatttacataacagactgtggcataactaaggtgtgacttgacaaggtgaagtaatgaatcaaacgaccccttggtaccattgatactgtgagttgtggtgtatggttccatccaaattagtcacgcacaatggtggtgttctttttctcctgaatatatgaagatgaagtttttacgcaaaacgaggtggtattaacatatgattaattgagttttaattattacaaactaaaaaatagattaatatgatattttagagcaacttttatataaaaagttttctcacgaaacacaccatttagcagtttgaaaagcgtgccatgaaaatcttaatcttcatccaactcttgttgaagaaaagaacgagaccaatgtgtttttactgtggtaagccgacattacgtgaatgaagcaaccagtcaatttgatggtatataaagtcaattcgaggaaatagacaataaatccctaaattaactctaaaattaagtttaaaagtttaaattttggctacgcctgatagcaaacaaattttaaaggcctataaatttggttagggcatgaatttattgctagtttctactatctctaaagcatataatgtgggtcttgcatgccaataaggaaaaaaaaagaggtaactccttatgataatgatatatgatttatgtagatatttgatgaaactcgtgtagtattgaaaagttccaagtttcaatcaactcccacatttcattgacagttatattttttctgttcatacttcatagtgtagcaagtaacttctttaacaaattgatcacaccactatatcagatttcataggatgaaagggaaagatggacttccaacattcctcctatagaattgtctcgttgcagtcgtcttatcaacccgatcaaaacatagacgattcacatcaatgcaatggagaactggagaggatagtgagcttacaaaagagctattcccctttcaactggatctttgtcttcggggcttcaacttaggcttgaatcaaaccatacactgctttgacaaagattaacagacagtttccagtaatcgttcccagaaaaagacaaacatagccagttcagaatatgtgctcggactaagaaatactccatccatttttaataagtttttagagaaatatagcaattgttataacatcaaattagttttattaaatgctaacattcacaaaacaatatgtttatttggtgttgaacatgttgctttgtttttctattaacttggtaaatttaataagtttgattaagaaaaaagttcatcttataatatgatatgaaatggagcgagtaataaacaaggaatatataaaactttcatcgatg

SEQ ID NO: 29076 - DNA, 563 bp, Oryza sativa
aaattattgcaaaatcatatatatatatatatatatatatatatatatatatatatatatatatatataagactttccaattttgtaataattaatgtatctgtatcctcttaaatattatcataaaattagataatcggtccattcggttgaaaagaactggccagatcttgttcctcggtagaattgttgggcgacatcgcatgggccagagttttcctagtaaggtgatattggtcgatctgatctggattttcctctttcttaaagctttttttttgtttttgccaattttagcgtgttatattcagccctgtttgctgtagaggacagagatatcactcctatcatctaaacagacattacattcctttattccttgagaattatgtggtaaccaaagcttcttccctcgtccgctaaaaaaaaccatacaaaaaatatatgtagaacttttatatttgctcttagcaatttaaaaacaataaaaaaactgtatgaaaagccaaaactaaacattgaatatatcaagtttgaaattttaacaggctagggacacacga

SEQ ID NO: 29077 - DNA, 1501 bp, Oryza sativa
ccatgccgtatctggacaagtgggtgcagagcctcagatctgccttctacgacgcagaggacatcgtggacatccacgattaccttaacctcgccctccacatgcagctttgtcgctttggctgcaaaccaaaccaagtgacctttttttcccccttctaattcaaattactaaccatatttataaaaaaataaaatatcaaaatacgttcaatattagatatattaaaactaatttggtactataataaaaattctgatttactatccgtataataataaaaaagaattgatacattgcactaccaatactagtattcgtagagcactaaaccaaacaagcccataattcccatggccatgatttatcttaaaaactaggggattccccgtgtttgctgtgggaattactaagtaattttcaatattatttttcgttacaattcaggtaggagtaaaaagaaaaaaaatcaaatctcagggcttatcgatatttatcaagaaacaaatgaaattcgcactttaatgtagaacatgtttataagtatatattaaatattataaaaataatagagatttgtaaaactattgtggaaatgatgtgagatgtggtgattgaatatgcttgcgtgctaatttgtagaattaaatagattgtggatgctcttgcatgtttgcatgaggttgaatatgtaattattgttagtgggtgatgatgtggtatggttgcatgtgaaactttagagttagtgggttataactttacagaaagtatagattaaccatggcacgtggccaaatcaaatggcaaaagaccggcaagcttgaggatgataagatatatcaactgaattcggagattgttccatcattagcaactctattttggaccttgctcagataaacttgttagtccacaatggtagtatactttacaccttctagccccctcctccaccttcaccacaagaagtttcaggactgggggagataaaagtagtactccttccgtctctaaatatttttgacaccgttaactttttatcacatgtttgaccgttcgtcttattcaaaaacttttgtgaaataagtaaaagtatatgtatacatataagtatatttaacaatgaatcaaatgatatgaaaagaattaataattatttaaaatttttgaataagacaaacggtcaaacatatttaaaaaagtcaacggcgtcaaatatttagaaacggagggagtaccatttttacaattttgcttaggtattcagaatggcctggagactagagtgggtatgcatgggaataatatataagtaattaattgtgacatgacggtgaaatccagcttgcaaattttgccatttttttaagcacatggttagttcaaacacgtgacagttgttttttcatttaattttcaagattaaacgctgaagctttagtacaaagttgcttgaaaacatcgtagaaaggaatttttaaggctcatttggaagaaa

SEQ ID NO: 29078 - DNA, 160 bp, Oryza sativa
agcgccagcctgctggtggaggggaaggccttcgctccgggaaaggccgtggtgccgaaacacggcgacaaccggacgatggtatttgccgtgttttttgaggtggggcttcagtttccatgcaacgttttgttgccggagatccttcttcttttccagg

SEQ ID NO: 29079 - DNA, 1221 bp, Oryza sativa
tccgccgccgtcgattgcgccggcgccgtcgcctgcgccgcctccaagaagctagggttttggtgtggggaacgaatggtgaccgggctgttcgagccggaccggagctggtctaagcacacgtgaacacgagggcagaaacgtccatacgaaaatatggtaccctaaaacggtggcaaagcgcgcgcggggcgtacattgtggtatggttccaatttgacgaaatagtagtgacatgcaccggattccggaataggtgtggcatttttttgatttgccacaattcacgtggcatagatccaattaacccttaaaaaaaacgcaccgtttagcagtttaaaaagcgtgcgcgtggaatacgatagggagcggttaggaacccaatgctccaaacacagccttaacctgaataaagttgagtgcatttggatgttatgttcatgtttgatttctagtagtgggtgtttatgttgtagcttgtaggcacttgatgtggttggccattgtcttgattataacctccgagagatatgatgttgcaatttttttgtattaaatcagatatgaaatgtatggcggtatggaactgtggatatatgagatcttacatgtaactaaaaacaattagcaactttaatagtttagacataaaatgagttagaaatagtcttaggagactaaaagtgatcaaacagaatcaattgtgcgagtaaaacaaacttttccctccaaatcatgacacaagaaattcgaatggttccgtagtccatcaccctcgctcagtgactcatatcaccccacaattcacatattcttaatcccaaaatacatagattttctttttactaatactcagtttcaaaaaaaccttttaaatttgtttttgatgtgtctctatccctccaacattgaccagtcggcactcacaccactatatcccttccccttgtctcctcacctccctccctccctccctcactcactttcccctcctccctccctccctctaaacccacctccccgtccaaatttaattcacctcaactcaactcaaatcctcttcttatcctctccccaaattccaaattccaattccaaatccttcaccacttgcccgtatataacaccccctctcctgtacacagcggctcgattccattccatttccactccccaattcacactcagatttcttcttgcggcggcggcggcggccaagaa

SEQ ID NO: 29080 - DNA, 462 bp, Oryza sativa
gataaacaattggcatatgagattattggttttgatatttggagattatgggcgaactggttttggagatgattgatttttcaggtgatgaacagggttactatttttctcgggtccggtcagaccgggcaattgctgtcggtcaaaccagcgctatgcgagcggtcagaccggccaacgctgtgttggtttcggtttcgggttgtttgtttggatatccgtgattgtttcatgtttatggcttctagatggatactatacgtatgtaatactgttgtttgctactaatgagttaagttggagatagcttggtctcggaatatggtttctttatttgattcatgtgtaagtgacttgatgcctcgggagagtattgccggtgatggattgggagtcgacttggggataaggcgatgtccatgacggtcaaatatcatgcgggatacttaggatagagttcaa

SEQ ID NO: 29081 - DNA, 1501 bp, Oryza sativa
cattaagaaatatttggccattcaacctctctttaatagaatcaagtaatccatcatatgcaatgtcggccaaatatttgtcagttattttcaaattgaaacatcggtttttaacatctctaagcctttcaatataatcagcaacagattcattgtatttatgcctaaccgatgttaaatcatccaatctaagctcagtttcactagtgtggaaataatcatgaaatttttgttctaaatgagcccaggtaaaaatataatttgccggtaaagaagtaaaccatgtaaaagcagcactagacaaagataaaggaaacaagcgcaatttacatgtatccatattactagtctcaccacattgcgctaagaattgatctacatgctcccatgtggtcctactatccacaccactaaacttggtaaattcaggaattctataaccacgaggatgtgggatcatgtcataaaaatctggatacggcttttggtactccctagcacgatcctccgcttcaatcccaaatgtattcctaataatggtactaattaactcctccatatttttaggtctatgtggatctggtggtgtatttggtggcctaagaggtggttgttgcggcgcaatataattatattagccatacctagtatcgggaggatatccctattgtaggcattagggacatgtggaatagcatgactaacagtattaacaggtgatgaataatatttaaaatcagtactgctagtcgtggtatggaaacctagagaaattctcagggaaccggtctgaccggctatagatagcccggtttgaccggccaagcacccggtcttaccgaccgatgacccggtctgaccggtggtaagtggtgcggtcagaccggccacaagaggcccgatctggccaaaatagtaggcacggtttgaccggcctagggtgcggttagactagtgtcacgaccagtcataccgttagctaggttttgcatatagccgattcctgtgtaatcgcctgtataaacacccgttgatccccccatagcactataagcatattgtataggagtaaaactagaaatagtatatgcatctacacaacgatcattaaccttttgattagtaaagtatgggttgggcgaatcggaggttacctttggtgaaactacaacttgaggtagcgggatgtttactctcacgacgccttgatcggtcctaatatattgtgcagtaatattgttgaatccgttcccgcttgttatagttgatgaagaaatttcttgattaaatccggccatatagcttatagccaaaatcgttgaccgaatagattaatatacggtcttaatgtttcttcttatgttactgttcctagcaaaaaattggagaaattgaagcttcacagaaataaccgatacagtaggaatcggctttgttgttttttttttatgtgaacagaagtagatcggcttggatagcctgatctttgttttagcacgtg

SEQ ID NO: 29082 - DNA, 1501 bp, Oryza sativa
acatgagcaataatttgcggttagtgactagtaactctgagacaactcaatttattgataagataagtgtcatttgcacatactattagagcaggtacaatagcaggctataaactagttataaacatatttcgagaagataaagggctattttggtttgatgccaaaatatgccctacaaaattgttggcattttaaatagtagtttggctagtgtttggtttgatatcaaaatatactactaagagacataagttgtcaaaaacatttggaactatcaaaatttgcctatggtttggtattgctagtattttggcatgatagcaaaccaaacaagcccaaaagagaagagagaaaaacagcgggctagagatgatttgtagccagctgcagtacggactctaagatgcaatgtgtgtacaacaggtgagaccaaatattaatagtgtattatatgcttatactccctccgtccccatatgtagcaacctaggatgggattcgaatgtgtgtagtccccatatgtctattctcatcctagattgctacgtctatatcagctattaaattgactatagatgatttggagctagttgttggctatattattaaatttgcccttagcaataaaaagagagagagagagaaaaaaaagtagtgctaatgtttaaccctcaggtgatgtgcagcatgtgctagcgtagcatgtacaaagtttttaaccggtactgaagggagtatatgacaagctgtagttgatgtgattttcttttccaaaacacagcgtgaacgtatacgctgatcatatacgaccacgcgaaatgatcaaccctgtttgcgcacgcgtatatggacgctctatccttacgagcactttcgagtgattgagtttttacattgataaagttaccacattctcccttcgtttcatattactataagttatttaacttttttcttagcctaacaaattaagtttgataaattttatataaaaatttagtaacatctaaaatagattatagtttaattaaatataacattgaatgtattttgataatatatttgttttgcgttgaaaatactactatattttttttttataaatttgattaatctttaaaaaatttgactaagaaaagattcaaactgacttatagtatagaacgaattacatatgagtatatctttctagttacccgtaaatcaaagcattcatattaaatttagaacttaaaactcgcgcgaatatgttctatcacaggaaatctaaaagttagctttcgctcgatcgattcgagaaatttgacctgccgaccaaacagggcgatatgtactcccgcaccatatgtgattggcagcttggcacattgtacagtacttctgcctcactgcctcaggatcttcactctctggcaactgcaactgcaaagcaacaacacaggcacagcctcctctgatatgtagcctgcaactactctctccgtttcataatgtaagt

SEQ ID NO: 29083 - DNA, 477 bp, Oryza sativa
ccatatacccacaatgattgattctccgactggttacatgggataataaatcatatggttagaatatgtataggataagactcgggtattgcgttgtcttgtgtatcaagtaaataacctgtaatcttagtcggttatgattgtaaagtagttatagagatttaaaccgtaaagataaagtctctatcttgtaatcccagcttctccaactatataaggagggcaggacgccttattggggggcataaccacaattgagatcgtcagatcaataccacaatcagcggaatattttcccagacaggagtaagatattacttctcattgagagggtctgaacctgtataattttttttatctcataacccatctactttcctacttgttcgctaccccttttagtattgctgaaatatagttttgacagttggcgcgctaggtaggggcagcgtcaagttttctcgccgactagtgcga

SEQ ID NO: 29084 - DNA, 1501 bp, Oryza sativa
tacatacatagaaatgggatgcattgggagccaaaagagtgcgtcggcagcttgtcgtccatccaagatctcctgactaccagtgctttggttgcaaagtgttgatgcagataaccctctttggtttaactgtaacagaaatgcccgaacaaatcgatctcggtcaaccatgtaaacagtgttgaggacgaccggaaacgatgaaatggaaggggtagataaaaagctgattggctgctttcagaccaggtggaagttgtatggctgttatagaactcattgaattcttggtagcgggctcccaatattgtcgaacaaaaagtttccatagaaacagcactccctccatactcgtaaaggaagtcgtttaggacaatgtttaagtcaaacattggaaatataaatcatgatcgaataactctcaagttgttgagtttgaaaatataaaaattatatgtatagatttgtcttgaaaatactttcagaaaagtatacatatatcacttttcaataaatatttttatagaaataagaaatcaaagttgtgttttggtgaccgtgtcgctgtcctaaacgacttcctttacgagtatggagggagtatttcagaaacacagtaatatataggagtattttgatgtccattgatctacaacacgcttactgcaggcatacaaataaattcaatttcctcaagtactgaaattcagtggcagcagttcatcccaactgcacaatcgtagtgattgcgtcaaacacgagagatatatagtatgcacattggagagctaaccattagtcgatttcaagaatcattcaatgacacaaagtagatgatagacgtcaacaaaagcgagattttcagaagctgataaaggttttcaaaaggagatcattagcagttacccattcactcacaaaaacgactaggcttgaaagagatcaggaacgacagtacaacagccacaattgcgcagctgctggtcagtggttattacacttggagttcatacgaatcaaccagaagcaagcacataataggtgtttttcttcaagcatgcataatagtttttgcatcgaataataacttttccaaccacaagcagatttggtcctcagacaaaacaaatcgacactatatatcatgtgttcagattctcaatgatacacttcatgagagttttcgatctcgggtggtctccagggattctgttgaattgactggacattttgataccattcgaatttattcctttaactcagatctaaatggcttccattggatcattcattattttttttcgaattgcaccaaagtcatagaatttattcacaattagcatttctctcaacgaaattttgcttgagatatatcgaactcactatcccttgacccagtggagacttttcttcggggtgagaaccaccagggtatgaatgaaaattttattaatattggcaaaaagtgagaacaaaatctaatgagataaatgtcattttt

SEQ ID NO: 29085 - DNA, 1501 bp, Oryza sativa
gatgcgtgcaaatcaacagttattaattcttatttttaatattattaaatatagaaaataaaaaataactagcagagaaaatattaagatggatgactcaatatttgtgtatttttcatttttcaacaatcaatcattctgctgtgtttagaacattaatataaagtctacatgtaaatttaataactaccgtattggacatatgataaaatttcaatattaataataatatcccgtgcaacgcacggatagacggctagttatctgaatttaaagacattgttcgattataccagttagctagctgacattcagtatgtgcgcaacacactatcgccagttccctttgcttgatttcatcgcatttaataagtttggactttataaggatgtgcaatcacacagtgtgttttcaactgtatctctccttaatttcctagaagataaaaatgaggagaaatagggtgagaacagggcaactcacagctagcatctcggcaaagaccagtgcttcacatgcttacaatgcagttacgttacaaacgtagaactaggatgcatcgggaatcaaacgagtgcattagcagttagccaactatccaatagttcttatccaagttttgatgctcttgtttagctgtaacacaactacctctgccaatagcttgtggccttccggtcaaccgagcaaagcattttattgcttttagtttttcagtctctgccgtctccatattttctagacacccaagagtcaaaatgtctcatagaaatagcatggttgtgcttcagaggtgctcattgggaacttttttcatccacacacaaaacgaggtagctcattagcatatcattatttaagtattagcttaaaagcttcaaaatggattaatataattttttagaagtttttctatattcattttttggaaaaaaaattgtaccatttatctgtttgagaagcgtgctaacgtgaaacgatggggtagaatttgggaaacatgagttacaaaggcagctaagtatgaaacacagtaacagcagtatcgtaattccgaagccaatctctacagaattaattcttacgcatgccgtcaaaataaattcagttttctaattgaacatactaggtaactaagatgcacacattaatagattttcaattcagaggcagtagtttatcccaatgcaaaatcatagagttgtatccaatataagatgaaatatacacattggagatctggccagtactagttgatttgacaatttctctcaatgtcaccaaggagatcatagaacacgaggcagctcatacacatgaacaaaagcgagaatatctgatccagattaagggtgtgtttaattcacgctaaaattggaagtttggttgaaattgaaacgatgtgatggaaaaattggaaatttatatgtgtaggaaagttttaatgtgatgaaaaagttagaggtttgaaaaaaaagtttgcaactaaacacggtgaaa

SEQ ID NO: 29086 - DNA, 1501 bp, Oryza sativa
ggaatttgatatcgggtacaaccgggtcagagacccggatccgtttgtggaaagctgagagagacgcactcgggcccactcccaacggtcggggatgcgaaaagttgaccttacctgaaactttgcagacaagcccctcaactttcctgacatttgattaattcgtgaaatgtttctctcattcaaatttcatataactgaccactcaattttatatggacagaaaacagaaaatgcatagtatttttttaagataatgaaatataacatagtatgaaaaacaatggaatgcacaatggcgaattcatgatgcaaattgagggaggctagcgtaaaaacatagcatgagtggagcaatattaactgaatatttcccgatgaaatccaaatgctcatatcatcaaaagaaaaaaaagaaatccaaatgctcatatcatcaaaagaaaaagaaagctttctctacattaattcacagctaaattaacatatccaaaaaataaatctatgaaaaaattggaccttttatataaaaagatatggtcttgatcttttcattaaaaaaattgatattgtctaattagaggcaagtcttccaagtggggctggtgtctcaactagccccaacaacctatccgccatcagaaatgtaaaaaatatatatcaaattagaaaatagtattgtctcagttttaacacagaagagagcaattggtttgctttcagtacggattatgggaacaatctatcatgacatgtttcaagaatcaacaaaaacccggcaattttttgaggaactccctactccggcagcaagggacttcggctcaaggcaaaagaggacatctgtgcctcactgaggacaactgttaaccagcaaatctcaacggtatagttagctccatgccctagtttttttcctgaaacctctcaatcccatattaagcatctttctcactgataaaaatcttatggaagagtatttccttgtcctcttaactttggtgatttacatgtagagctgtaaatactttcctttggcctgtgggagaggccagcctttttatctctctgttccaacctctgcctcaatctgggtctcgttttatatgagcaaactatcatatatcctgttaatcttgccttatttactgccagaaaaagctgtactattgagcttgaatgcatgtagttctttttgttttttgagacagaatgcattttgttgagagaataatgatacaacactcttactgagagcaccaaaatttcaaaaaacaaaaatattaaaaatagaaaaaaaaaatgtatccagctaacattgcagctggaacatcagtatcataattgtcaagtaatttgaggattttaacaattgatccaacccgtgacccctctcctgcgtaggtggctcggggtgaaaaccctagccgttgccgccccctccaccctatcctccatctccttgtgctagtgcaagttgctggccaaccgtgcggtgtga

SEQ ID NO: 29087 - DNA, 1501 bp, Oryza sativa
ttccttctccaccgcaaatccccaatctctctaccccaactcctctcgacggcatcaataggttgggcgtcatccctgtcatgtcagcaatggaatcccggatgctggtgaggaagtagctctccacatccgcagcacgatgtctacgcctgagacggagatgacggggtggaagatgtcagaggagatggcgaggaaagttgccgggcatggggaggcatcatcgtcgttgtcggtgggctgcccacactcctcgaacatgtaggcgctgttataataaatgggctaggcccgatttattctattaaatctcaaaggcccataataaatgttaaggataataataccaccttgggaattaaacgaggagtatctcaacttaaatagggagttattggaggctccctgttgatcggttgaggtggggatcggaaagccacacgcgcgcgcgcgtcgggccgaggcgtgcgttgcgatgcacctatctctatccttttgcaacggaccaatcccaagattgcctctgtaacgggcaggcgattcaattccaagagattccctccgtaacgggcatgtgattcaattccaattgatctcgcgtcgttactgcggcaacgggcggatatcgctcctgcgctataaggaaaagtaacaggcatgtgattcaattccaattgatctcgcgtcgttactgtggcaacgggcggatatcgctcctgcgctataaggaaagagctaatccgatcagattccgctgcttactttccatctggtgttcttcctcctcctcctcgcgcgcgcattccgctgcttactttccatctggtgttcttcctcctcctcgcgcgcgcctggtgctgctactgttctgcttccccgcttctgatcgcttgcgcgcacgagagattggaacgagtagggccttcggaaccacacctttgcttgagatctgcatcgggtaggcgggtgatcaggtttttggggagtgcttccgcacgactgctcctcgtcttttgttcgtcgccgtcgtctgctacataatgtcttccgccgccgctgctactgccgcacctagagatggcacgccgggagccagagccgctgcgaacgacaacatcaacggaggcagttctgccacacaatccagcggagggacattcacagggtataaccttcgcttactgttatttcatttttttcatatctatgttagtcgcaattctattgcgttctttgtatgatgatgatgcttattatatcttaagcatgctcctggttatgttagattttatcactagatcaccccatattgttcatgccatgattattgtcttaatattttagattaaaatatgccgaaatatgactatatttctaacaatccaaaaacctgataggtcattttcggtagttggctttgctgctgcactgaaaccacatgcatttgatggttctaattataagaggtggaaaacacgtgcactaatgtggttgacagtga

SEQ ID NO: 29088 - DNA, 589 bp, Oryza sativa
acaaccaatgtgtgacaattcaacactgacaaggctaaaatgcaagaaattaatccagttgaattcagatctctattttaactattttgtatgtacttctcgccagatggaagataagtttaaatgaaatctaacaccagatggaagattcttggttaaatctcattattttgctttggctcatatgggagctcctaatattaacaaaactatttgaaagttaaaaatgcctcttaaagtaaagattttttttggtatctatgtcgaggagtggtgttaacaaaagataatctggctaagcggaaattgaaagggagtaagatctgttgtttttgccacagagaagaaacgataaaatatttatttttttttattgtcggctagcccgataggtttggtctctaatccagattgcttcaaacatttgttcgcctaggaacgtatcacatatgtttaggcaatgggttttatgacataccaaagagtttagacctcttgtcttcctaggggtggcaacaacttgctgggcaatttcgctcaaggaataacatggtttttgataggaaaactgtttcttctcctttgcagg

SEQ ID NO: 29089 - DNA, 1501 bp, Oryza sativa
ttaggtctataaattttaggtatataaactttagatgtataaaaatactatatataaaaaaatatttgaattcaaattcaaatttgaatcggatatataaacttttaacttataaacttttggtctctaaactttagatgtgtaaactttaggtgtataaactttaggtgtataaatttactaaaataggaaagtaatgcggtaaaaaaaaagaaactaggtggagggagggaggggggaggtggggagtgaatctgatcgctaccccatccccagggcgatggatcgcccaacagcatttccgctctacgtacgtccacttgatgaagcttatcaggcctcggaatggcatcagtcagcagtggccgacgcatgattttagggatgggagtatgaagttaaaaaaaatatcgctcaacataaatgatggaggcctatataaaaaaaaaccctatcatgaacattgttaaaagtaaagtgattttaatgtataataaattactaaaattaaaaagtactaaacaaaattatgtatcaaccatgctttgtgaatcttttggtgtataatgaattatgtatggggcaaatattattgctttgttataaaatgatttgtttgccttaagtatatttttcttaagtatattttgatgtgattacagtataaatatggtatttattgcgtttagtggtctttatgaagagcgaacatattcgcctcatcttggttttaattctgtgtccgccactgtgtaggcgctttgctagaaatcctggcattgctggggctgacttgtgcaattggtgacgaaaatttctgatgcttgatgtctccggaattctgctgttggttatgatgtatgtgcagcagcgagctattggtattgtgccattttcgttgcagttctgcgctgttatgcttggtgtagaatgcattggccagactcatatgctagaggttaatacctgctgcttttcaaatgttacgtgaatctacttgtgccatgaatgaaacaataagacagaaacataaatcatccaggtttgtagtttgtttcacatcactcttgtttgcactttgttgctgaatttagttgtcccagcaacggcttgaccgcttgagcaaaaaaatattcccgtcaaaccaggtcatttttgagttggggcactttggggttagcaggcattgtgatgccatttttgaatggtccgcaccaactgcgattgggaaggagacataatgggatggcggcagctgctgtaaatggggtgaataaacttgtcggcgatggcggtggcggaggctctgatggggacactaggcggcgggggaggctcgacgtcggcggcagacagtggcggctgtgctggatgcgagttgggtagaatcaaggagttgatttagattttgtgatgaaaatattggtggtttgctaatgttaatttggagattttataagatggttgattttgtggagtgtgcagtttcggttgaccctgg

SEQ ID NO: 29090 - DNA, 406 bp, Oryza sativa
tcatcataacctttttttctttttgttttgaagagtcgtggagaactactccgtccggctggagccaagatggtctcaacgctgactccggcacggagattgcttcacaggtctcttggacgcggaggtctcacatgacttggccaaggaaattggttcgcggaccagaggccacgtgaatctcatcatgacctttttttccttttgttttcaagagtcatggtgaactactccatccggccggagctaggacggtctcaacactgactccgccgcggagattgcttcatcagtctcttggacgtggaggtctcacatgtgatttgaaatgtaattgcatgatattgtacctactattgcccgaggcagggcaacagcggtggtgcgagccgatcttgagcgcgta

SEQ ID NO: 29091 - DNA, 1501 bp, Oryza sativa
ccgccatagcgcagatgtgtgcatgcgctgtaatttcatgccatagctattgatatccatgcctttgtgggggagatgtctgttggtgatatgccctagaggcaattatagaaatgattgtatcacatactatgtttacatattttatatccaacattgttccttgaaatagataactcattattggttaatgaatacgttgctatttctaaaggatccctaatcaactatcataagtgatacaaatatgttcaaatgatcaacacatgtattaattgatggtcatgtctcatgaatcatggtatagagatatcaaattaataatgtggacacatgttgggaaacatgttgttggatagacccaacataagacactgcaagagccatatgtgctgtgtcatcagtgatctcatttagtgttggtattgaatccttagacctaagattattatggttcccaacgtatgtagtagcttacttagggactgctaaacgctactccgtaattgggtagttgtaaaagtagttttctggtatgctatgaaacatgtagtgggatatgaataatcaagatgggattctcccctatggagagatatatctgggcccctcgatattatagattatggaagtgcatggccatgccaaaggtgattgaggaatcaatcagaagttacataatctatcacaagttcgagtgaatgatttagctattaaatgatggcacatatctagccttgagtttaatcgatatcgtgaggcaaatggggttcatacaagtatgcactagaggttcaaccgatatgatctttgtgtatgctcggtgggtcaatacattttgctaggggccactgttgacacgttgaccgaaaaggagtgtacatgaacctacagggtcgcacgcttaatgggccggaataagggaattggatggagatacaatatgagcataattcgaatagggatctgaataggagtcctatgggccttggaggttcgagtcatggatcctatatatttatgaggggggtgaccggcggtgtgattgcgtcacgtgagaaaccctagccgccactaccctcctcgagcaaaaccctagccgcgcgcggacgctagcacgtctgcgcgtggcattccatccctattcgtgtggataccggtagaggtgtcgttggtttgcggtgctgatcggtgtgagaccatggcgaagagaacgcacgaggaggagaatgtcgagctgctacgatcgactacttcctctacaccaacacgcgctatgtcctcgatgttcccccggctacttagcatttacttccactgcatagcacatcgagtggtaacgatctatgatctaatacttgcatggtttctggtttacgcggtagaaaaattttgatttatgctatcatagcctacaatgtcaacggtcctggcagacaagttaagaaaattcttgccgatatgctgagaagagcttcgactgctgcagcttccaggtaga

SEQ ID NO: 29092 - DNA, 232 bp, Oryza sativa
ttagtccctcccaaggtggatcttaggacatcaaaagatgcttggagacccctacaacattcattcaaagcggatttgaagctccaaggtcaataggatagtttaatttttgaaatcgagttttaggaaaaaccgtactattaagaggggttccaagtgttgttctgagatataaaaagtgctcttagtgggttccttgtggtagaatatttttgggagccatttttgcaaa

SEQ ID NO: 29093 - DNA, 186 bp, Oryza sativa
tgtgggttagtcggcggtcgatatcatgtgtgagtggtatgacagcctttattaggagttgtgtgcctctttttcagtgttttaatcaagattaagataattgcacttaatcttataagaaagattagtttccgagccgtctgttttcttcctttctcttatttctacctatcctcctccagatgg

SEQ ID NO: 29094 - DNA, 495 bp, Oryza sativa
cggcgagacgtgggtcgcgcaatggaagatggcggcgctcgagttcaccacgacagcgactgcggcggcggctgcgggcgtggaccggacgctgtgctccggctgtgccgtctactgcttgctgctctgccaggagcggttcagcgggctgggcacgccggcgtggctgctgctgccctgctcgaccacctcgtcgccgttgttcgtcgagcgtccggtccgtggactcgaccaaaactcaaatgatagaacaaaaccatcagatagattaacaggtagaagcacagaatcatcagtctcagggcgcacggcgacctggcgtctctgccaatcacgtgaacctccagggagccacgcatgaaaaaatggccgttggccaccggctccggccgcccgcgtgtccctccctttgttaccgtgaaaccaatcgctcccttcttcctcctcgtccgtcaagtcttaggcagacgacgatgaacgagatgcgacaagcca

SEQ ID NO: 29095 - DNA, 166 bp, Oryza sativa
gccgccgagctcgtctccccgcgctcgctgcctccgctgccgcctagcctcgcctccctgcgctcgctgcctccgccgtcgccgggaggagagagagagagtgtgtgagagagagatagaagagagattatgacatgtgggtcccactttttttttaatacataga

SEQ ID NO: 29096 - DNA, 180 bp, Oryza sativa
tgtttggtatgatatcttactttcccaggaccttgataatgaggctgaaacttgaaagttttggaaatagttccatccagttcagaatccaggagaatgattaggaatcacaatatgttccaagctaaatgaagcactagatttgaagatttgccttcgtagttgcattctgctcttaga

SEQ ID NO: 29097 - DNA, 1037 bp, Oryza sativa
ctacacacataaacttttaattttttcgtcacatcgttttaatttctttaaattttcaattttatcgtggaactaaacatagcctagataaggtcatcaagtagtttttcacctctctagtaccgttctatcttcagattaaaaccttaatgaaatactcaatttgtatactaaggtttacgtgggcacacccaagataaaaaaatcttaggtccgccactgtccctgatccgatacgaaagtacatggttaagatatctagactaatgttcgattcactctcaaaaataaataaagggagaacggataaaaaagaggcgtaaagagatggatcgatctgctctagctggcttccacccccgctagcttttgctctgcccatccctgctcctgcttgctattttctactgctgctgctttgtgctctgctgcctgctgcctggtctactcttcgtttgttgctgccgtggttactgatgcaagctgggaattaaaaaatattaaaataacagatgtgccgagcaagctgagccagagaggaaagaagaagaaaaaaaagagaacagtggaaatgttgtagccaagggggaatttccactagttgtcgcaataaaaaccgacaacttttgaaaatgtccatttttaggtttggccttagatgtttttgtcaatggagatataacctctaaattcttaatattgttttcttaggtgtcccagtgtgaacggatgacgtgaaatatctacgttgcccccctaaatcatattctctctgaatctcctcaatctttctttctcctgcaaccattcacattactggtgatatccgaggatgctggtgaagcattaatttacatcggaggccggctggggaagaggatgcacaaccgagggtatggtccaaattgacatctaacttttcaaagcttcaccaaaattcgagcatacatggcctcctttgtgaagcatgacatctaacttttcaaagcttcaccaaaattgttaccctttgtggtgcttgccgtgttgttcaaagc

SEQ ID NO: 29098 - DNA, 1501 bp, Oryza sativa
aacccatgatgtcatccattagcctcatcatggtcggaactattcctttgcacatctcaaaggagaacattagtcccaacaaatcggttgtcatcctccacttgatgaccaaccggttgcatatgaaatatatgaatatgttcgttgagtattcattaacaccacaagtgtcatatactcgtgcataagctcaagtgcaaagattcaatataaataataggtgaacatggatctagaacatgtgcaataaatgtataggatttgctcgccctaaatatatgcatacaaataactatacaagagagacaagtgtatgtataattaaagaagaaccaatggggtctatcctatacacatgaagaaggcatgtagcaatgataaagtaaacaaaaaaacataccttcatgatgtccatgtctcaatgtaaaggagactaaataagataagactcaagtaaacattagtctcacacttatataacaataacatggaaatgatatatatgaacctatcaaaaagtaggagataagaagtgatacatatcgctctatctccatgcatttcatccttatcatgattaaggtccatcacaaaagaatacatatctaccacatttcattatcaggaaataacctagttgacaacttatgtaaaagagaggttaatcccataaacattggtttatcatctatcaccaaagcaacaattacacaaattgtttaatccaagatctttcaatcttttctctctttggtaatggataataacccgatataaacaatatagagagatgagatgaaagatgattttgaatcaatgtagagatcttataataaacaaaatatagcataagctcccccctcaagatgtgcatacatatggatatgaaagaacacatatgcacataataaatcagaatcaatcaggagctcacattatattttggatccacaagagagaccaagttagaatatgtgatgtttaatacatacctctcatcatttttattttcatatccaaatgagactagtcaaagaaaagctcataaaaactctagtctcatataattaaatttgtcattaatcaccaaaactaaattaaggcatttgaacttacacatggccactgcatactttctctggccagatagtaaagaggaaggttgcagatccacgaagaggaggaggagggcacgcaacaacaacgaagaggtggaggctgcggcgtcgacctagggtgcatgcggtgacaaataggaggtggagctcctggctgccatcaagtggagctagagaaggagagaagggagagagcggggagctcgtggtcaccattgtcacctctggcctcgagcttccgctccatcgtcgggccaactccgccaccggtgcctttttctctagtggctgacgccatctctctttgcctccctctctgtgtgtttcttgcccatcgccgccgccgctgcatccagcggtggaataagaagagaaaagaaggg

SEQ ID NO: 29099 - DNA, 1501 bp, Oryza sativa
aacattcttccagcatgcatggagctatagatagatctttttccacttcgtatttcttctctttctcattaccttggttattctcagatgcctgcaaaatattagtgtccaaaacaataggcacaaaaatacgttcgttttgtaattcagacttagttgaagacatcacaatagcatctttcttggtatctctgaaaatctcatcgattccattcttcatcctttgaatattattttcgaaaatttcagtaaaactcatgggtaccaatttcattttccaaccattatgtctaaatgtgcatgtgttagcaacaaaattatgcgatccattattatcatatacctatggttgaccaaacaacaaagaacatgcttgcatagggacaagatcaaaattgccagtatcatggtaatttccaatcgaaaagtttattctcacaattctatttaccttgaacttaccacaaaagttgaaccatttgatctaatatggatgatgatgcggttgtgtaggcaactcaagtttctcaaccaaatctgaactcacaaagttattgcaactctcactatcgattatagtacgacatgctctatccttaaccacaaactttgtttcaaataattcgtggtactgccattgctccgctttgtccatttgagaacttagcacttgttgcacccatgtactttcatcatgtgcaccttgttggtatcgctgattttgagcgtcactcatacatgtcattgcaaacacaaaaaacaacaacaaacaatgaaggttatccctaataatctgctatgcggtgtagtggtgctcctcaacaactcagccaaatggagcaccttaccaagctcttacaagtgtcttaccagcaatgctaaggatggtacaaccggtggctagttcgtgacaccttgaaggacgtgaagtggcgattgcaaggatcaaagcggtgctgaccagaagtatatatgtgtagcttgggaggcacaatatatagtagcaaaagaacgcaattatgctaatcagaaaatgcaaagttgaataatagttcaaagtactagtcaatgtgctggcctagcctagactcaactctagctcaagcaaacacccgacacccctaaagactagatatgaatcaatgcacaactctgcactctgataacatactcaaaggatgaatgattttttttctttcttagtggggctttttttaagcacatttctgccttttttttcttttttttaggtgcagctttttttttcttttttttttctttgcacctttccgccttttctttctttctttattctttttttaacttttttgtcaacaaaaactgaccactgacctcgaacagggactcaaatataaatctgaatattacagggactcaaacgcaaagtgcaaaactaaaattggatcatctcaaaaatggattgctcatatcatgtaggttccacttttataaaaatatctcaaatccactacttaacaga

SEQ ID NO: 29100 - DNA, 1501 bp, Oryza sativa
gcctacttgcaaaaatcgacctatttacacagacggacttgttaagagacttgtctacgaaaatcggtggatagcatgaccggtcacaatacttcccctataattttttaatcctcctagataaaccctatctctctctccatgttctttgctttccatctatagtctcgcatccctcatcacctcccattcctctctctcaccccctgctcagtgggagcgcagctggcgatggcaccaccagtgacgaggggccagaggcctcgcatgtgcacggaagtgacaatggcgccacattattagcatgggagcagcggcggcgatttcgtcgggacacgctgcaattggctctagtgacggcacccttgagaggacatggtagcggtggcggcctcaggagtggtggggcacggtggcagaactccggcggtggcaagccaccacacagcgacagatccaccaccaccgaccttgggagtagcggggcctcagcggtgacgacgatggtagatcgaagctagggtttctattttttttgctgcaaaaatcactttttacacatgggtacatgtatgttttttacatacacctagtgttaggtgggccgtccacccgttcgcaaagatcatttatgcagtcgtcatgataggagatggaaccatggaggcatatatgcaagtatttggccaacatgtccaatgtccaccagattgggacgtcaatcctacccgtggtatgggtatattaccgtgcgcctgatatttacgtacgctggtttaatatatttttaaaaaatttgctacatactccctccgtccccaaggttggctttttttttttgagggagagagtaatatttagagtttgtggtttttgttattgaacaccttaaaaggcatgaaacgacttgtcggagaacgaatctcctctagcagggaagcaacgaacctcccaaaaaaaaacaaaaaaaaactcctcctttcatgattcaaccaaagggcaatttgagatcgagcctactttgtgtgatgaactcaaaacacaatcaagtatacttgtgtgatgagcggtgagccagatatgttcctgctctgtccgtgctcgactcaattcattgtcaaccctagcgatttccattaatgcaatgactatatgaaatgcaaagatgtactatatgactactagttggatgcacaatagtgctactatggaaccccttttcccctctaaataagtagcgcatccctaggcaaaatgactttccaataatcacagttagtaagggatgcatgcatatgcatgatatagtgatgtctgttaatcgtggcaaattggcaatgcaatttgttgttgaaaaataccaagatgccaatactacgcccacttcccgcgcgctctatataaagccatgcgctcccatcgcttcttcctcacaaactttccctcaatcagtcaatctgtatacagcaactcagcgatcttatatttacccaacacacca

SEQ ID NO: 29101 - DNA, 1501 bp, Oryza sativa
tggagctagcatgaagggcagcggtagccagcttggcttagactaggctaaaaatagccagtcatggcggtggcgtggcttgttagaggaggcaaagctataccttgctgccagccagtcatggtcgatggtggtcaggagagataaaggtatagagggtgatggagggtcgcgtcccttgatgttggccgaacactctctctttttttttttggagctccacttctccttccgtggagaaggtagtagtgggataacaagggtaggcttgggccaccgagacatcgctgcccaaatctagactctctttgaccggatgtggcgagcaggctactggatagcggatcagagggatcctgaggtagtgcacaggggagcggtggcatggtagtaggcgctaacgatgaggcatggtggtggtgtgggttgtcttcctaatggttggcttgatatcctatctatttgtcgagctcctcccccctctcagtagggagctctgtaacaggatgaagaacagggtgaaggtggcgcatggaaagttttgggctgccaagacaacacaactccaaccgatctctccttggtcggatctggtgaagaggctagtggagatctgagccagcgtagcgaggagtggagatgggctagaaggcgttgatggcggagagcagttgcggaggacgtctaaccattttcccaacattttggatggacttccttcaatcaaccgtgaaaaaaaaaaggcttatgggccgttcagtacgtataattaattagcccaagcagcagctcagcccattcctaaccttgcacgcatcagttgcactgttctccatgtggtttagtcacgttgcctgaattattttggctcgtcagatcagagctgaaggacatatattggattctattttgtactgggactaattaaccataatatatgttaataaattttcacctgagaattatcaagtgtaaatatagtatagtcgtagtaacttatatattacaccctccatttcataatataaggtacaaatacttttaaaagttgtttcataatataaggcgtgtatacattcatgccattaactggcaccacttttccactaaaatattattatttaaatcctccaccatcaagatctctaattttattgggtgcatgcattctactccctctgttttaggttataagatattttgattttggtcaaagtcaaactgcttcaaatttgatcaagtttatcgaaaaatagtaatattttcgacccaagataaatttattataaaatatatttaattactaatttaataaaactaatttggtaatgtaaatatcattatatttgtgaataaacttactcaaacttaaagtagtttgactctgatcaaagtcaaaacattattagggtaatctaaactatgaggtgataataataattttttggtttttgggttaagggtggttgtgtcttatatttttgaatggagggagtataat

SEQ ID NO: 29102 - DNA, 1501 bp, Oryza sativa
tagatctagcatgtatcggctagtactccgataccactctatattaagatattaaagcaagcagaatataccaaacaaaagcataatatacctaaatgcgataagatcttaatataaaggacagatttaacatgtcagtaaagcatataaaacaaatgtagttaaatcaggtaagatcggctgaaactccgatactaccctaatcggcaaccaagaagcaggctagagattgagattctaatcacgactcataagatcaaacaactgatgcagctataagtatgaaaagaaggacaatatctagacaatcaagccattggaagtttcatagagtggtagatatcatataatctaagccaatgttgatatttaacctaatcggctgccatctattgatagacgttagccgattgtaggttagatagcgatattgccagagattatataggatatatgataactctacgaattacataaacaagattagagtatcataaagatggaagcactaatcccgagaacgcaagccgtcataacaagttttacctcttgttgaagatcgaaaccgatgcagctcaacccgaaagcaagaactcgtcgaaataaaactaaagcaaaaagggtggcgatgcgccgagattgtattgaacgtatgtgttaattgattacatggggtgcggggtctatttgtacccgaaaattacaaactatgtccatatcggacatgactcctatctctaacaaactctaagatatcataagtctttatggcagacttttgccaaaacatatatctaagaaaattacataaaatatcctaagtaatatatacaattgccttctcaggattctatccatgcgtggcaatcatcttgaagcatatcaattcaacccgatgtcttacaccaagtcgtattgccagaatcggctgcatcaccaaaccaagtctgacttgaacttagccgatctaatcgtagccgatccggactctagccgattcctactctgtttctgcaacgatcttcatctttgattccgcttcaatctaatcctcatctccgatgctgatattaccaaatttggtcgttaacagtcgtacaccgccaccacgctcgagacgtacataccgcgccgaagcacagagatgcaagcctgcatgcgcaacagctcgacttcagcgccctttccctgtcatcgtcgtacaccgccaccacgcccgagatgtccatgaccgcaccgaagcacagagatgcaagcctgcatgcgcaatagctccacttcagcgaggcaccgtggggcgagtctgctgccttcgcctaaacaagtacccgtcctacgagatcgaccgtccgggactccctcctcaccatcaaattaaccaccaccgcttggttagtactcacatcatcgttgttagcttaatagccgccgccgctatgcagatgggattttagatattctgcaatctactgcaccgacgggcactagggattagcagttt

SEQ ID NO: 29103 - DNA, 1501 bp, Oryza sativa
atccgagtcctgaaacggtttgtgcaccaaggcatttgaatgctcgtcgtcgaaacaagatttcggcaataataaaaaggggtggctatcaagttaggaaagtggataggtttgaagacaaggaattttatacaggttcaggccttcttattcaagaagtaatacccaactcttgtccggggatgattccgccgagtatgttattgattgcataaactggaaaaaagatcacgccctaagaggcacacagacctctccttatataggggaagatgtccgctttacaaaatacagtccatatcctaacggaatatgggattatagataaaatacaatcgtaactgactaagatcccgagtatttccttgacatacaagtttagaatctaacccgagtcctcatagagatattctatctatatttggtaccgtatatccgactaaattataatgtcatgtagatatggggtatccataatctccacagtagcccccgagaccttcgcagttgacaaaatagccttctcgaaacaaaaaacaataatccgagtgctttaattcaacttgctccagcttgccgagtgctaaaatcaaaaactgcgaagggcgaaaataaaacatggtgcatcgagtagatgcacctaattaggtgtaacccccgactatgtaattagttgaaaaactaaacatgtagtcaagaaccgagtggttttatagcgaagcatgcatggtacttagtaaaatacccagccgactgcttctcaacttgaacatatcaaggataaaaaatacaaaaagggccgagtgataaacactcaaaaggtccaaaaatagacatatttgataggaatccgagtaaaaaactcttaaaatgatccaccaaacatgataaaaaatcatggtaatcaatgagtctaatagcctaggctatgacccttaccataactaaaataagcatataacatgctaaaagaatgactattaataaaccagtcatcttaaatcaacccaaacagcttttgcagactaagaaagcttacaaaaacggtataacacctttctgtcgggcacctttttatgtgcatcataataattccaaagaattattgaatcacgttaaaaaggattttaacagcatctggccacatcatcgtgagcacaaattgccaaagcaaaaagcgcctaagtccctagggatcacaacgggccacgctgattataatattgggctgaagtactgtacaggaccaggcccattagtactcccgataccctaaaaacaccgaagtccaagcgtcacatcgtcttccccgccgaaactctcgccattttccccatttcctgctacagtaccaaactgcgccggccaaactagggttcatcaatccgctccaatccatcttcaaaaaccttacgaaatttctccccgcgtccaccgctccgattccccatccctttccagccgtatctcagaccaaattaaaccatccagttcacattca

SEQ ID NO: 29104 - DNA, 898 bp, Oryza sativa
agtgtttagagcgagtacaataagatgatataagcgagttatacatatagccacatcatatttatgcttatgtggaggagaggagaaaaggcatgctacaggtttatagccagctgcagcacaaattctaataagccatgagagttcaagttttatgatagagatgactatcacatctaatttcattataatatatacatcattaaattaaggggtaatatgcataataggttgcctctaccacacaatcgcaatatctctaacactctcatatatttcttgaaatttgtgtagggttgctccttgcatgagaggtacctatttctctctcatatttcttctctcctctctcctctacctcatttagccctatgtggtatcttagggcttatacttagatgcccatagtacttgccctgagagagaaatatggggaatgcattaatggtagttaggctgtgtttaattcacgctaaaattggaacggtgtgatggaaaagttggaagtttatgtgtataggaaagttttgatgtgatgaaaaagttgaaaggttaaagaaaaagttgggaactaaacaagggtttaactattgtattattagtagactattaagtgagtaatgggttaatttttggatatatgttaacttgctcactatatggttcatcacgtcagtgtcttacggctgcagactgcgcctaaagcattttcccagactctctcacaccgaaacgtagagaaactcgcgagttggccccacgtgtcatcctcacgaccgtgtccaacccagggacccaaaccgaccgacctcccaccacatcccccgttccgccgcctccgcttccgcatcgcgccgccccggccacgaccttctcccgccgtcctggaaccgggcga

SEQ ID NO: 29105 - DNA, 1402 bp, Oryza sativa
aaataggagagaactagtgatgcttgcaatgcataagtatattagaataataatattctactagtattaggtatactaaccttttgcagggaatgacaataaagtggagaatcgacatcaacatagacgataaatcaatcggacgatgtcgagagatagacttatgtatgaatgggccaagagctcagaattgacacgatgaattgggccaaaattcacaagtctacaaagtgaagcaatagaggaagtcgccagccgaagatgggctggtttgggccagcccatggttcagcaaccccatgtccactgttgaggctagggtttggcatggacgtccaagattgcaccccaatgacagttggagggtacttcggacaattccccttccacaaccatcataaccacctctatataaaggcttcactctctatacttcaacacacacctcaagcaagggctctctcattcctctcaagtttagtttagtagtatctagctggtggaatagaattagaataggaatcgggagtccggaagtcttcggaagagttcgggtatggctctagtagctttcctttcctcttttgtaagctttgatgtagtactagcattcttttctagccacatctgtagtgttgccctctatcatagtacattagtatcgactttacattatgttcttgttatactgaatatactgctagcttatctaggagatgttttggtgcgggtatagtgtttgcttatgcaattactctatgtcatgacgatgatattagagtagtatctggtggtttagacgtggtgtctaaattacgggatatcattatttagggttatatattgcggatgagaggtgggccgctgatggtgatagctcagtacgggtattcctccgcgcctatatataatcctaagttaatttcctggggagggtattcctccgtatttagccccggttggatggtcatgacgggctgtcgtaaggaactcggcagtcaggggtggcttctcgaagtaccaggagggcatcggatagagggtattagctagtatatcagttaactagaatgtatatatactatgtatattagaagtacaggaatagattctctttctcttttctttccacctagcttagattatttattatgaggatgagtagaaatgcttgtgtgtcactctacccttggattatcttaacccctgcttagaatatgattatcacaagtaatatataaattattagttgagttctctctacatgatcttcccacgggaaaaaataaatacgatacccttggaatactctcgggtgaaatgctacaatggtatatccgtgcgcttgcggatgaactctgtaaccataatataccagaagtgtttctgcgccattgctggg

SEQ ID NO: 29106 - DNA, 1496 bp, Oryza sativa
aaccaacatgtcctagtctaggatgccaaaacattacatccttatcaaacttagcaaccaaacatgttatcacaggtgaaacaggattttcaaaatcagctttaaacactctttcatagcgagaaatattcaacacagaatcaccacaagaatcaaatactttacttccagttttcttaaagtgaacatcaaaattttcatcaacaatttgtgaaactgaaagcaatttgtactttaagtcctcaaccaaagctacgtttttcaattcaaacttatcatttaccttgaccaaacctgtagcgagaacgacactagtagaagcatcagcaaagataatcgattcagtcttagatgcctgtttgagggaagagaaccaatttttatcaccggtcatgtgccacgaacaaccggaatccacgatccacacgttctccttcctcgccaccaaagcttcattgtttttcacactttgaatccgattcaccacgcggcatgaagcaaatactggagatgttctttcccttatcttcatcttcactctctccatctacatcgcttagtggcttaaaaccggcatagactttttcaaacatcttcttgagattctccttaatcttcttccccttaaatgtgctcttgggcttgttctccttggtcttctctccaccattgtcttcctttttcctctcccaagcttaggacaatgcaatcgaatgtgatcaagagcaccacattcaaaacaacggtttggaccacctcttctcctctacttgacattgttcatagctcgagcaaacttgaaagtaaccaaaaccaagtactcctccttgaattgttcgagttgctcatcggacatggcattaattaaagcaagaatagtagaattcaatgaagaagcaccaatatccaaagaagtcgaagaagaaaccaaagcactagacttagaatcaacttcacgagaaagaatattcatctcatgtgttttgagttttgtgtaaagcgaatccaaagtcaaagcaaacatatcaacagactcctgaattgatgtaactttcatctcccaaatagacatgtcaagaccattcaaaaagtgacgtgaaacctcagattgtgtgtaatttatatcataagaagaatcaacatatctaagatcactcaaaattttgttaaacctagaaagatagtcatccaaagcttctccaggtttcatctcaaattttatgtactcctttttgaaaacatctcgacaaagttctttaatattggtagttcattgatgaaaatttctcaaagcaatccaaatctcatttgcggtttgaagaagagaaacatgatcaaaatccgaacgagaaatcccactcaaaagaatattgcaagctttgcaattatttttaaatgcagtttttaaatcagcaatattaatttgataaggaatcacataaggattagaaacttttctcaaaatatcaagatcctcagccataatgtaagattgc

SEQ ID NO: 29107 - DNA, 1501 bp, Oryza sativa
gctttcatatatacttctcattctctatgtatacccctcacaaacatcaagagctccctgcttcaaagaaaaccagtggtactaaattttctattgggacaaaaagcagataccatggcaattacttgttgcggctaaaattgatatccatatgaaattgagaattttcatctgtttggaacaggaaagtgggaattaactttaggcatgggaagcaacaggaatacgggtcaggatttccaatactcttaaggcctgaagaaaacacggaaaatagcacctaaaaagcactgcgctagcaatgtgaacttcctagcctgagatggtgtcaccagcattgcatgcagttgcttggctggccatgcaattcaggacaatctggctcctggcaattgcatcccaacaacactcttggaagaggacagtcaacttgatcagagcagctgctacatgcttgatgcttgccaaacattctccattgctcacatcttctagggccttgttgacacttcaggatggaaaggtgtactaactatagtgagcagactgcgagccgcgaattaactcttcctgtctcacaaacatatttcattggttactggccttatcaatcctgcttgttgacaatcatcggtgatcttcggtggcttcgtgtgacatgaggatgcatatggctgggtgcatgtttgccaatctgtagtcatttcagggcgtgtgctgtgcctggtgtgctaacagttttggattacaaatttttgtttaatatatgtgtggtttataaaaaaacaaatggtattaagtttttttccatacttaagggcaataaatacttatatgtggtttgtttctattttttgccttgaaaaaggagtacagctatacaagtgcgcaattgctcgaaattccccgcgcgcccatataacatttttagaggaagccgattgagagctaagctttcattcatttgagagagaattacgatcactggctataaaatcaaagtgtgttttgattattactctgtgatgaacaattggcatctgagattattggttttgatatttggagattattggcgaagtggttttggagatgattgatttggagattattggttttgaagccgatttttcaggtgatgtacagggttactgtttttgtcgggtccagtcagacagggcaggtgctgtcggtcagaccggtactatgtgagcggtctgaccggctagtccgcggtctgaccggccaacgctgtgtcggtttcggtttcgggttgtttgttttgatatccgtgattgtttcatgtttatggcttctagatggatactatacgtacgtaatactattgtttgctacaaataagtcaagttagagatagcttggtctcggaatatggtttctttgtttgattcatgtgtaggtgacttgatgccatgacttgggtataaggtgatgtccgtgacggtcagatatcatgcgggatacttaggctagagttcaa

SEQ ID NO: 29108 - DNA, 1501 bp, Oryza sativa
gatataaatacaagtccccctaggaggagagggaggaggatcaacacccaacacaatcgacatagaagccacaacatataagcctacatacgccaagacacgccaccggatatcaacttcagggataagcatggctagtaccctacggtgtctccggatactgtcaggagagacgatagcgctatctctgatctcgccgggcacggattcgaggagaaaggctaccctgttgtcgactacgagtcagatcgtcagaccgccatgtcaacaatagttagataggctaccccaaatattgtactggtgtgattatcatgaataagagaaatactggcttcggccaacaggatgtagggttattacctaacaattcaggggcccgaacatatataaaaatccatgtctccatctcttttacctcagtctcgcgtataccctagtaccgacgatccccataccatgcaaataccggaatcacgacatcaaacgtcgacagatgcaatcttacattatggctgaggatcttgatattttgagaaaagtttctaatccttatgtgattccttatcaaattaatattgctgatttaaaaactgcatttaaaaataattgcaaagcttgcaatattcttttgagtgggatttctcgttcggattttgatcatgtttctcttcttcaaaccgcaaatgagatttggattgctttgagaaattttcatcaatgaactaccaatattaaagaactttgtcgagatgttttcaaaaaggagtacataaaatttgagatgaaacctggagaagctttggatgactatctttctaggtttaacaaaattttgagtgatcttagatatgttgattcttcttatgatataaattacacacaatctgaggtttcacgtcactttttgaatggtcttgacatgtctatttgggagatgaaagttacatcaattcaggagtctgttgatatgtttgctttgactttggattcgctttacacaaaactcaaaacacatgagatgaatattctttctcgtgaagttgattctaagtctagtgctttggtttcttcttcgacttctttggatattggtgcttcttcattgaattctactattcttgctttaattaatgccatgtccgatgagcaactcgaacaattcaaggaggagtacttggttttggttactttcaagtttgctcgagctatgaacaatgtcaagtagaggagaagaggtggtccaaaccgttgttttgaatgtggtgctcttgatcacattcgattgcattgtcctaagcttgggagaggaaaaaggaagacaatggtggagagaagaccaaggagaacaagcccaagagcacatttaaggggaagaagattaaggagaatctcaagaagatgtttgaaaaagtctatgccggttttaagccactaagcgatgtagatggagagagtgaagatgaagataagggaaagaacatctccagtatttgcttca

SEQ ID NO: 29109 - DNA, 339 bp, Oryza sativa
aagctgaaacccattggaatcccctcatcgacgtgaagccgatctactccacctccggtcgagccctgtcgatgactccgtggtggtcggttttcgccgtcgtcttcctcagcatcgcagcgccaagctgaagcccggccatcggttttccttcgccgaagattgccaaaatgtcgccgtcgtcttctcttgtccccaaagcagttgttgcttctatggtggatgctagttgttgagctggaagtagtgggttcctaacaatctggtatcagagccagcctggtttcccccatctagctcttggtctagttgagaaagttctcatcaagtagggtgcca

SEQ ID NO: 29110 - DNA, 292 bp, Oryza sativa
atgatgtgtgagaagatgtatagaaaacaagagtttattatcgaatctcttaattctgaatttgctagattaaaatatcttattcccaatgatgatgattgcaaaagttgtgaggtcttaatgaatgagatttcaaaatttagagatgttaatgctgcacatggtttgaaaaatagatcttctctagctcttggatttgctttgcacacacgcactttggatgagttgtttttgactaaaaagttgttgtaaaaataacaaattgcttttcatgctagtttgatgtttaaca

SEQ ID NO: 29111 - DNA, 792 bp, Oryza sativa
ctactttggtttgagggttatgacaggttgtcataagaaactcgtcaacccagggtaactttgcgatgcatcatatcgggagggcatagctgtcacgccctgaagtacccctcccttgctctaaattcataaaataaatcgttcgaagaaattgtttaatttaacctagagagaaaccctaaattaataaatgcaaataataatcggaatcggcatgtggaatttttcttgggttctacatgtcaaaatacgctaacaggatttttagtggaattttcagagcattggaaataattttaaccaattaaaataagcaaagtgcaatattaaatccctgggaaaatcctttttcctttttatccttcctttttccccctcttttcctcctttgggccgccggcccatctctcccgccccctcccgaagtccaggtcgcctccccctcactccctcgggcgctgacaggtggggcccacctgtcagcaccttccccaacctccagccggagggacggcctccctcctccctaccgccccgcgctccctgccgccccgggccacgtcgcccactcccccgcgcgcccgcactccccgcgcccacgccccactcccgctcaccccgcgcccgcgagatggccgggattcaaatttgaatcccgcctctctctctctcctcctccacctcctccactactccggcgaaattgcgccattcccggccacgactcgccgcctcccctcctatttaagcacgcccgcaccttcctctctctttttcctttctcggccgagc

SEQ ID NO: 29112 - DNA, 194 bp, Oryza sativa
agatcgaatcttaaactcgccggggtagagtggttgttatcctccttaggtagattagatcttccccgactgatttgaatcaaagtcaaagagcgaggcttgttgaagttgtcgatggcgaggaagtcaaagctcctgaggcaaaggcgaagctggcgactcataaaattgattccatcgcactcctcaatagg

SEQ ID NO: 29113 - DNA, 195 bp, Oryza sativa
ttatctatgtaatatgtaacagatcatgacttgggtattacgtttccttgtatattacggaacggcctaaagttctggtttgataatattgtaaagtagatttaggaaaccgataccgtattggttaaggtttctatcttgtaatcctgccccccatcctatataaggtgggcaggaggccctctagggggcata

SEQ ID NO: 29114 - DNA, 1501 bp, Oryza sativa
aggggaggagggaggggcggcccgggagaaacagggaaaacagagggaggattgaaggactttgggctggactcggcccaaaggagggaggaggattatttttagtttttctttttagttaattgttgttgttgcttaatatataattccggtgctctgaaaattcaagtaaaatttgagagctccttttagaccaaggagaatttaacaaaaattttctgggccacattcgaatttttcttatacgtattttagtgtttgccaatttcttttcgaattgtaattaattctattattccttttataaaatgatttttattttgggatgaatttatcaggacgtgacaggtcagaggtgtaccactgtacccacaagacacaacctcaacatcatgtcaaccatgcgtcgcgatacttaacaagtacccgaatagagattgtgacaataccctctgcataacacaattcaaagcagtttactattcctggatcataatcacccccttataaacaaggcatagactccccagaaacccccgtgtgcttatctccgccacttcacagtctggtgctccagaatgaaccatactatataaaaagtaaagccgttgcccacgctggcttgtggttggcacggttaatgtttcacaaccgaaaatcgtgaaccggtccttaattgtcatgagcacgaccatcaaaaccatgcgctcacaacccaccattatcaagttttagttggcaaattaattaattaaccaatcacgattaaccatcgtgagctatcattaagccatcattaaataatagtgaatcataagttatcccatttatatgagctaatgtctctaagcatggctaagcatcctatgcacttttagctaaaactatataatgttctagctaatccaattattaatcaaacgacaaagtataacaaaggcaataggttattcccacccaatgacattcgaaaataaatgcagtagttgaatagaaacaatagctttaaacgggatcaacatgctcaaaggattgtttgggatatgtgtgacttgccttgttggccttggaactcttcaaagtcttctcctgcaaaatcggactctccaggaacgtcggaatcgaagcataaaagagcaaaatcaccaaaacagcacataaacaatcatgaacagtacatgtggatacttttaacctgtagatctcaattttagaaaaatttagagacttgaaccaactaaatccgagctaagatgaattagttatgagtttttaaagattaaatcggattaaatcaattatttagattttaattgaattatgacggaataaagaattatttttgaaaaggaaaaatgatttattgcgtcagcgggctcgggttcatggtggaccgggtgcacggggacggtgtacggaacgaacggccgagatctaatctagacaaaacgaacggccgagatcgatctaatccaccacgggtctacggatgacacggcgc

SEQ ID NO: 29115 - DNA, 1501 bp, Oryza sativa
ggcttctcgaacgtcccgaggcagtagccgccgccgtggaagcagacgagcaccggcagcctctcggcgtcgccggcggtgggcggccggtacacgcgtagcttgagcccgtgcgtagcgtcgtacacgaggtccttccactggacgcccggcacgtcggggaagtcctccggcggcagcagggcgccggcgccggagccggcatcggagcggacgacggtgccgtcgctgaggagctggatgacgccgcgatagtcctcgacgacgtgcggcgccggcgcggcgtgcccggacatggttacttcttcagtgtgccaacgcttagtgcctaattaaacacggttgtttcgtttaagtaagcagatgggctaattaattaattagataattaatcggttgacacgaagcttcctaatcctagtcgttgccttgatcgccaaaccatgactttggctgtcaagacttagtagatatttttctcttttttttttgagaaaaagatggaaggagtgttacttttcagaacgggacataataaaaaaaaagttttataagaaccacttggtacttttctgagtattatagaagaacaacttcactgaacaaaaactatgtagccatgcacctcttggctcttgcaacgaaatttacatgaccgtacttattactagtatagactatagagctatgattttatccggaaatttgagattacagtttgaatgttcgtgtgatgagatcagactcttgagtgatccaaagaagttattgagtccagcatcagtgatgctctgtctcagctttcgacttacgttatgcgtaagcgggtgatacagagtgcaattctgacattcttacgcgcatgaagctctttttctacaattttgctgccatttttacaaacaaaaccatttttacggcatatgaagggtgaggtctggagtcaatacttttgtttgtaagaatttctggagaactaacgagtctggcgttcggatgcacatgcgatacgacacaaccatacaatattttgatttcaatacgtttaaatcatgttattttgcgtttcaaaaggattgagaaatttacctcaaaattgcaaaagtgatggacgaagcctattatgagtactgttcgccgtctagtcctttttcgctgctagctttcctttacatttttggatttgtcccatttccgacgaatgtcagatgtactccttttcctactagtatgacatgataaatttttgtgtgttcgaaaaaagatggccgaagcccatatttccccaatcaatgggccgtgcagccgagagcctgagatggcagttattcctattgggccagaaatatggtccaatacccaattgaaaagcacttagcccaggcccaagcgcatgtactagtactcccgaaaggaataagtctgcattgagtcccttaaatatacatcggatctatccctcaacggcaaaatcaaatataatgactccaactgttaaaac

SEQ ID NO: 29116 - DNA, 1501 bp, Oryza sativa
acaaattctttgttctggccttccggggtttctgttcattccgtgtctgtactcatgaccatttatattcgcctagtagaagaattgacaagattcgtaaatattttgacgtttagcgtaagatttagttaaacctttaaaacttgagataatctaaaaaatgccattgacaaacattcaaatccaataaatatcattgataagtgtgagttttaagaaatgtcaacgtacaaatgacttttcttaaaaatattatcgccgttagggttccgtccattctgcattgcttagtgctataggatgaacggaaccctaacaacgattacatttttgggacaaaatcgtttgtacgatgatattttttggatttgacgcttgtcaatggtattcttggattatctcttaaactttgaccataaatagttttcgtatgtgtagatttgccttcaaaagtaatatcatattatgacaaacttgtgcatttaaaaagaaaaaaaaagattgtatgagtagattttcctctagaagtaatattataaacttttagattttataatacaaaatggatggtgaaagtttgaaatgtttaaccaactcttatcctagacacagacaaataagaccatcaaatacttactgtacgaccgatggaattacatgttgatagtacttgcatacttactccgtccacaaattatgggtacaaactcccaattataaggaagtacttttccaatccatccaaagcatccattattgtatcgctaggcatgatttttctaagctgatgaagtcacatgaaaaggattgacatagaaaatagcattcaaaataaatttgattgaaatgtttaaaccattctcgtccaaacaagaaaataactggtgaacaagccagctgtcagctgtgtcctctttgtatatgacctccaaaaaggcataaatttgaagcagtaaaattaattttattgaaaatttcgggttcaaccatggcacatgcaaattcaataacacgagtgtggagattatggatacctcatatctacatgacattataatttagtcggatatacggtaccaaatatagatagaatatctctatgaggactcgggttagattctaaacttgtatgtcaaggaaatactcgggatcttagtcggttacgattgtatttcatctataatcccatattccgttaggatatggactatattttgtaaagcggacctcttcccctatataaggaggggtctgtgtgcgggggcgtgatcttttttccagtttatacaatcaataacatactcggcggaatcatccccggacaggagtagggtattactttttgaataagaaggcctgaacctgtataaaattccttgtcttcaaacccatccactttcctagcttgatagccaccccctttttattattgccgaaatcttgtttcgacagttggcgcgccaggtaggggcagcatcaagtttttgctgactaagtacga

SEQ ID NO: 29117 - DNA, 1501 bp, Oryza sativa
gcctggagcgcgccctggggcatgccgccatcgccatagacgaggcggcgacgcgccccgtctcgccgtcctccgtcgtcgcccgcgggtggcgatgtcgcggatcctccgacctccctgagcgcctccccccgcccaagatttcgacgagagggggacggtggggtgcgagcccgacggcgcgggttctgctccccgtcgtcaccgctagcgttcggagagaggctgtgcgccactgcccgttcggccattgggctgagcgggagaagcttggcgcacacgaaagaggacgagggcttcgaaagacacgcgcgccccctatctggcgcgccagatgacggagcgtggggctcctcaccgggagaccgcgcaggcccccctttgccggttcggccgggggcgctaagtgaggttcttcgccctcaatctgaggaacgtcagcgagaagaatcgcacaagacacgggcgacatagacaggtttgggccgctgagaagcgtaataccctactcctgtgttctggtggatctgtgtgtaaaggaatacagagagctcgagagcgagagagagttccagctctagcacccctcctccttttttttctctcccttctctcttaggcctgggcctcctttttatctgatcaggggtcaccacatgggcctctggctgcctaagaaaggaaacatgctttttacaatgagggctagtctacagccggaagtgacttctgacaagcagagcacgcgcctcctgctccgctcgcctgctttttccgtggacgcccatttcaaccttcatttaatggccagcgacttccttgccgcgcttgcgctgcagcctggaatgaatctgatcgggactgacataccaactccaggagtcagcacgccagctccggctagggacgagagccgggaagccctcatcattccgacgggacggggcgaggcgtgtgacaggccgcctgttgccacctaacccgcgatctgaccggtctatgaccggtcacacaccgcgactggtcacggaccggataagcgtgcgctgcgccgcattaaatgcggcgtggcgcgctcgtccaacctgctataaatgcggttaggtgagccccgctgtgctcacctaaccacacacgtggcgccaaaaccacagggggtcggggcgccccagccctcggggccgaaacgggagcggcccgacccctcggggagacagagggaggggtggccgtgtcaccctcgggcccgacccccccccaagggggtcaagccacgtgggtgaccgcggctgcccaagcctcagtcacgataccctcggccccatgtcaccgacagtagcccccggcgttacgccagggcgatcgcccccctcgagggaagcgctcgggcgtgacgccaccccttaggcctggtgacaggtggggccggtctctacaggcgggcagaaacccagcggtcgcaaatcgcgcgcatcggcaagggaaaaccgaccgacaataa

SEQ ID NO: 29118 - DNA, 1501 bp, Oryza sativa
aacggtgccaaccacaagccaacgtggacaacggctttactttttgtatagtatggttcattgtggagcaccagattgtgaagtggcggagataagcccacgggggtcactggggagtccatgccttgtttataagggagtgattatgatccaggaacggtgcactactttgaattgtgttatgcaaagggtattgtcacaatctctattcgggtacttgttaagtatcgcgacgcatggttgacatgatgttgaggttgtgtcttgtgagtacagtggtacacctctggccagagtaaaactattcgaatagccgtgcccgcagttatgggtgggtctaacaatgtctttcgtgattagtttcatgcctcttaccatattaaatgacgatgataataatttgtttagctcctggtttagaatggtatattcctggtttggaggtagaactgtgcagccgggtttggttgttcagaatggttgggcctatgcaacgggtatgttgtatagcgttggattaatattgtttaattaaatactttgcaattttattaaattctggagtatttattaaatgccatttatgcaaatgagactatattatgccattctttgttattccctgcatttgcatatttgctgcgtggcttgttgggtatgtcatatactcaccttttaattattcatcaaaggaagagttctacagtgatgctgaaggtgtgaaggattaggcgtagccctggtcaagctgcttgtgggatagagtcgtctgcgccgttcatcttatttttccactgcttggatttttattgtttgagaggaactatctacctctgtaatgactttatattcgcttattaattagagtaatgattgcactctattatcaatttgttattgtgtgcctcggctgattcctggacgagggtttacacacatgtaagcgtttggaattttggatagaaattccgggcgtgacaagttggtatcagagcctccttgaccctaggttatgccaaacggttacctatagaagccctctaaaaatattgaaaaagtagaactgttctcctctctttctcttttaattaaaccaagctaatggcatatgcagtttatagtccctttatttgttctcattcaaaatttactcattattttgtgttgttagtactgtacatctattactgtactaatggcccattttttatctttcttttcagcagaaattttacaacctttctttttatcatgttgcaacataatttagcatgttgattttataactctctcttttattttattttgaaacctgttattcagaagtgcaaaaaaaaatttgtgatcccgttttatactgtttcaacttatcttgcaaagattggtttactttatttatttaccttttactttgattgtctagctttattcaaattaatccaaaaacttgtgctattaattggataaatgtcttaactccctcctttcacttgtctttaga

SEQ ID NO: 29119 - DNA, 462 bp, Oryza sativa
tagatacatttggaatgcgatctatcttacttttggagtcaagcaaccccgtaatagttcacacttgtttggaaattggttaagaggttttgaacctaagcttaaaagacaaacttgggtaggcatagcggcgagttgttgggctttgtggctcagtagaaatgacttagtctttaatggctacaaccacgtatcttttttgtaggtaattttcaaagcaactcagttgtcaaggctttggtctttgcttcttaaagaagacgaaggcattgaagtaatcgcgaagtgcaagcttttagagaagcgtatgatggagctcttctctacttttgggtggaactttagaagaaggattgaagcttagcttttagttcctcttgcttgttatccatctttaaaacttatttatgctttacccatgtaacgggagagtcttatgtactcgtgtttgtgacttttagg

SEQ ID NO: 29120 - DNA, 260 bp, Oryza sativa
gatatggatgataaataatgacagaatatttagctttgttggcatatctgtattttcctttttctcatactcatggtttctgtattttgcttagtgtgataaatactttgtcagatatttgtcatgtcatgctcctcatacttgagtctatgatttcggttagctgtgctagccttggtacttttattccttccataaaggtgtgatcatgaatagtaatttcaagtcttggaatgttttgtgctagaatattaggggta

SEQ ID NO: 29121 - DNA, 1501 bp, Oryza sativa
tagaatattaggggtatgaatgctgagaataaactgttgtctttaaggcagaaaatcggtgagagtggttgccagattttctgtatacaagaaaccaagaaggaacactttgagctctctgatatcaagaaatttgcccccaagcgttttgattcatttgcttttgccccctccgtgggtgctttaggtggtattctaattgtttgggtctcaagagtcttcttagggactccaaaagaagttaaccccttttttgtgaccgtggaattaacttctagattcacctctcaagtttggtccttgacatgtgtgtatggaccatgcaatggccctgaaagatcagattttgtggcctggtttaaaaaatattcagattgatgctcaacagaactagctgttcttagaggattttaatttttacatatctgtgcaggaccgaaataaaataggagctgatatgaatgatatctttattttcaatgttgtaattagttccctaggtttgcttgaaatccctttaaaagggagaaggttcacatggagtaatatgcaacaagatcctttactggaaagactgtattgggtatttacatctgcatcttggactttatctttcgccaacacaactgtcctccctttgaccaggaatatctctgatcatgttccatgtgtggtcaagattgacaaaaatccttaagtccccaatcttcagatttgaaaatttctgggtggaagctgaaggtttctttgatattgtccagcaagtttgaatgttggatcctggctttgatgctcctgcaaaatgcaattccttcaaacttaaaattctcaggaagaaactgatcctttggagtaagaacttgtccagactcatgcttctcttgacaaattgtaataaagtcgttgattttcttgatcttctagaggaagaaagatgcctttctttacttgaatagaatttcggggaggcagttaagcaccacatcttaaaacttctgggagaaagttggtattcaggaaaatttattggaaaaaaagatgtactaatataaatggatgatgctgggagaagaaaacaccaaattctttcaatccattgccacaaaaagatacaaaataaacacagtttctcaagttatggatcaaaatggtcagatagtttatttgcatgatcaaaaagcaagtcttttctatcaaagtttcgaaaacagtatgggtatctcttgctccccaagaatggtctttgatttgaatgatctctttcttcctagggcagacttggaatacttgactgatatgttttccactcaagagattgatagtctcataactttaatcccagctgataagtaccaggcccagatggtttcaatggttttttcatgacaaaatgctggcacatcattgctcattttcatgcagaagctacagacttgcaggttctcaataattcttacatcactctggtgccaaagaaacctttctccagagacagttaatg

SEQ ID NO: 29122 - DNA, 1101 bp, Oryza sativa
ttgttgttagaagtatatatacttgttttgcagtattagtatatcctttttttttaagtagtagtagtacataacttcttttttcatttagtaccactatacttaggctgcttgttgttagaagtatatatacttgttttgcagtattagtatatccttttttttaagtagtagtagtacataacttcttttttcatttagtaccactacataccactttttaatttaatgtcagtacatgtatacctttttttccggatatattatgatatcttggaatgggtatatactgattttttcttggatgaagtatatatactgatatcctccctgaatgagtatgtactgatcttcccttggaggaagtatatatactgatctctttttgagtgagtacatacttatctcttctaagagtgagtacatacggatctcctctgagaatgagtatatactgatcttttagattagtagtggtttatatttctttttaattagtaagtggtatatgcctcttcttagtcagtataatttttttttaatcagtatatactacattcctgagaagtttatatacttctgtttgatctgtatttactgcgtttctcattgaaggagtatatgctagaacgttttttagtcggtatatgctagtattttttttgtttggtcagtacgtacatactatttttacctggtagtatcaacgatcaaagaacagtacgtatataccactaagcagtgcatgctgtttaaacaaacgagcagtgtgtaatcatactgattacaataacgagtggtatgtaagatataatcgattaagaagtacagaaggttaagttataatcaactaagaagacggtaacagtacatagatacaactgagattaagaaaaagaaatcatagctacagaggaaaaactgcatcactgcatcgccatcgtcgtcagactataatcttaagctaagctaattgttacatctctaccagaaaccaaatcacaatgggagatgtgcgtacatgttcgtatctgcggtcttccaccgttgccgcgtgattcattagctgggaataactctacaaactggcatcatcgtgca

SEQ ID NO: 29123 - DNA, 436 bp, Oryza sativa
agaggtaccatcagccctcccaatcttagcagtatgatgcacaaaaatacatttcctggggttcaaggcactgagatgccttagtatcatcatggaacatgctttagtgtgaacatataattatctcagatgtttattttattaactggggtatgatgaagaatcacatggatccctgtaataacaaaatattaattgccttcataccatgtaaaacaaacacattttgtcaaaataccaactgccgcgagaattacaagtgggacctactgcgagtctgcacatgccattgacacactcggtcataatttagatacctgtattttttttttgttggcatggaagaatataccccatgcttgcatttcagccatgctgtttttatgttcttttacactttattcactgagatttgacactgatattgttgtaaata

SEQ ID NO: 29124 - DNA, 1501 bp, Oryza sativa
acaaaaagcaattaaaaagcaatattttttttctcgtgggacccactttataaagacctactacttagccctgctacttattacctagttaggcaagatacattggtgttgattatgtgatgtcttctgtacgagttatagaacaaaatcacagatggccttgagcttttgatggagagatgggcctggcccgtaattgctatcaatgggttgtgatttaatttaggctgtgccaactggtaaaccagatgggcttttcgctgaacggacgactagaatcagtgcgttcaatcttctctttatcgctaccagtgcagttgatcgtatctcacattcacgcgatcgctttggcaccacggtcatttgctcatgttgatacaaattcatttgcatttaataaaggccagtttctaccgtagtggagcggaggcccgtcgccgggaggcttgatccctttcagggttccacaatatatgtacctcttgtaagccgccgtgcggcgatgtaatctcacctcagatatagtgaatatattttgctggctggcgcccgtggttttttctctcctattttaaaaggatttttcacgttaaatctcgtgtcttctacgattgatctattattttttatcgtttattcgcttagcgtttcctaacagctcattgcattgagaatctatccatgcacgtcgtactaccagtattcaccgtatgactaattaagacactaactaattgagtgctattcagtccactttgctacgttcttagtctttgtgcaaaagggaaacacgtttctaaacttgaatggaggggctaaaataagaatctttgtttttttatgtaactaattataaagaaaaataatttaatgaccctcattttataaggatggttacaagaagtttgatattatagccaatagttagctatgaaaattcacaaatcgtagctcaaatccaaatccaacatggcaatccttattatacaagaaggatattggtttactgtactttccttagtggtaaaattggataaaaattaaatgatggatgattttttagagatgtttttaaacactaaaaatcattatattttgggtccgcgtgaatatgcttgcttgcttgtatagcagccggttaggcgcatggatgatggacggactggtgtatccggcctgcattgtgtttcaggttcaattttacggagctgaaccgattggtattgtgcatgatggagctgaaccgatcagcatcaaggcctcaagcagtgcgatcgatgcatggcaatggagtaaacggcattgattgattaggaattaaagttcacaatgagcggttaatttgcaaataaattactctcttcttccccgtgaacctcgatgctctcgtctgttacgctgtaaattccagaatgcagcaggcaaaacgagacttcgacttcagagttcagacgcaggccactgcacactgcaactactgcaaaaatggcttctgaaacaa

SEQ ID NO: 29125 - DNA, 1501 bp, Oryza sativa
tctaattaataagcgaataaaatgtcattacagaggtagatagttcctctcaatcaataaagatctaagcagcggaaaataagataaacggcgcagacggctccactccacaggcagcttgaccaaggctacacctaatcctccacaccatcagcatcattgtagaactcttcctctaatgaatgattgcaaggtgagtatatgacatactcagcaagccacgcagcaaatatgtaagtgcacatgataacaaaggatggcatagtagggtttcatttgcaaaagcagcatttagcaaacatttgagaatttaataaaacagttaagtattaaacaatatttgtcggtgatatgggaccaggagtatcatgaccagaggcttgaggcagacgcaatcgcccacgtggcctggcaccttcggggacgtcgggcccgagggtgaggtgtccgccctcctcctgatttcccccgagggggggtcgggttacgcttgccccggccccgagggccgaggcaccccgaccccttaaagaagtctgcgccacatgtatgggataagtgagcacagctgtgctcacctaacagcatttattacagtctggtcaagcgtgtcacgctgcatgtaacgcagtacagcacgctcttttatccggtctgtgaccagtcacagaccggtcagatcaagggttaggtggcgactggcggtctgacgcgcgccttgccccatcccgtcaagacgaaagcctctaggcaactcgtctcaagccggagctagcgtgttatctcttagagatggcacgttagccctggttagatttataccaggcttcatcctaaccattacaggcaaggtgttacacgaagaagggcaaacatgcatcttgttaaactgacacatggtggacaaaagtgaccagtctgacactggtcgcgtcagcaacgggcagccacgatcccacgttgtgcccgtctccgccgggagtggaggtaggtgtgggctgtcccatcgaagtgtcattcgaacagcaaccataccaatctccgtccataaagagaagaaaagtccagtttggaaggaggagggtgcatgtggtatccccttgaagtataaaaggaggaccttgcccatagagaagggggttggttgattcttttccagatttagagcttagaacgggggagaagttggctgacacttggtagctcattcatacaccaatccacaaaaacacaggagtagggtattacgcttcccagcggcccgaacctgtatacatcgccgtgtctcgtgtttcttcctggcacgcgatctttccacacacagcgagagcttgagatctcaccctaagcccccggccgaactggcaaaggggggcctgcgcggtctcccggtgaggagccacgagctccgtcatctggcgcgccaggtagggggctcagtgtgtgttttctgagctctcatactcttccgtgtgcgccaagtttcccttgttctgcctaa

SEQ ID NO: 29126 - DNA, 591 bp, Oryza sativa
tttattttctcctaattaatactttccttgcatgattctttctaatttgcacccttgactcatgctgcttgctgcatttgcgcctccggcttgctcctgtggtggtagtggtgtccccacatgacataatcgttttctaatgtcaaagccaatttgacctccatagtaattccaatagttttgagcctcatctacagtgctaaatgtcatgcgcatctggggtacctagctaggtatagttttcttcttctatctatctaccctatagttcaacaaatccttttactcattcatcattcatcatgttacacatccaatggtccaaaatcatccaatccaacgcctcagattactccacatctccccctcctctcctccccgcacccccatcgctctccaccacgcccccattgcgcctacgccctccccctctttcaggttccggcccccgccgattccctcgcgattcccaaccctaacccccgcgccaccgcccctgccactcaggatcccccgcctctcccgcaccgcatccgcgcctacctcacccccaccccaatatcgccacgatctcctctcctcgcgtcgaga

SEQ ID NO: 29127 - DNA, 1501 bp, Oryza sativa
agaattagctaattccgaagggagaccatgggccccaggtatgcttgggtattttacagcatttgtttgttgacctctcatttctcttccatgcgtgcttcatttatttgacagtaatcgtaaatgctatccctctgttaagagaaaccaatcagagttttagataaaaaattgcagtaggcttgtgtgtatggctaaaatcatgatgcattcactttacattttaacctcgaaggactgcatgaacttctgcatattgttgcatttctattgactatgcatctgccatctccagtaggatgttagatattgacttgtttttgctgtttcatggggacagcacttgtgattatattgtctgaattttgtctgtatgggaaatacttgcattgtccccaactccacattgagccttaggtgcctttacttttgacctgtagatttcttgcttgaaggtaattatcaggtgcgctcaagtcatcatgaagtggattttggcatttgggtaattgcacaattaggggccatatatttccaatatagtgaaggaaccaatactatattatgttttgtcccatctttgctgcaacctatggagtctgattcattttgtctaagcatagcatataatcatgtctctacatcttttttccccacttcttttatcctcatctgtttaaagggtcatcaaaatcctccaagatttacctagttccattgcttcccaccaaaaatcctgaaaagaagattgtgcatatcagtgatgaaaatttagtgatcttgatttcttgctggagaagtcataccaattcttgtttattgagatcaattatcaatagggcagtgaacagctgcgttcgttgtaagccacatctactgagatgtgggctgtctctgtctagtgaaagccgcaagctgttatagtgtcatatatactttttttttctgtgtgtggccggtaagtgaggtccagcaaattgttaacactaacattggcagtttggcccatatttattcatcaactgggttatgaaggagagttgacttagctttagctgttccatatatttctatttattgcaggacgcctggacctagtgctaagctatttaaaacatttagcaatgtacatatggtacatcaaaatatattaagcttgctttttttttttgaaaagttatgagcaagctttttttcccttgaaaagtcataagtaagcttatttttttctgaaagaaggaaacagtctggtgtcaactaaatcataagtttgagattaataattgaccatttattttccagtatcctaacatttaatttttggcctcctatatgcccgcacgtttagcatagtttaacagtccaatggggcaaattcaggactattccttatcaatgatgagttcttcaatcacgcagacttgtagtaacaatgttctgaaaagcactaagtgaatggcacctgctcactgatcagtcagactgggcatcctcctaggca

SEQ ID NO: 29128 - DNA, 1176 bp, Oryza sativa
ttttatttgtttcatctaatttttattatcattatttcatttatttttacttttcttttggatacacttatcctactacatttcctgtctctttaacacgaataccttttaaaattttccctgtattttcatttcagcacattgtactctatatgcaattactgcggtaattgattgtacccgtagactggaaggagcacaaaagggatttgtgttttctgctccatttgatataaatgagatggttgagacatataacaaaaggactggttttaaactaggaaatgaacctcaagataagttatatgagacttatgataattgtccaattgtcatggaagttctaaaaagtgatgggattgctatattgattggagcttctgatgttacaacaactccagtcccacgccttaagattcaaagttattttcgtgttgaccctaaggatgttctttatataactagattgttggcaggaggcttcccattagtagcagggattcgtcacggtttcctatttaattacttaagtgatggtcagtattattgtgccccaacatgtgagaacactagtgatgctcatgcagttgctttgatcggatgtggagtagggtctaatggcaacaaaacagaaacattttacaaggttagaaattctcacgggataaaagctcattctcattatcagaagagagagtttggtggagacttcattgtgtggtcatctgacgttactgatgtctggggtttgtatttagcccagcatgaatgttgatgttgcgtgactctaccaagtgtatggggtttgtatttagcacaacataaatgtttgatgttgtgtgactatcaagtgtatgactgtatcgcttgattattagtttgagaaactatgtctatgtctgggggggtttatgaatgttatgttgtgtgactactaagtaagtgtgtgactgtatgcttgattatcttgaagaacaaattatttgtcttatatattcgcgccactcttttaattatgtattttattgttctaatcatgcattatatatatatatatatatatatatatatatatatatatatatatatatatatatatatatatatatatatatatatatatataactaaaggaaaatgatgccagctaagtttgtttactcggccttttccaga

SEQ ID NO: 29129 - DNA, 312 bp, Oryza sativa
tgtgttgttgtgtatcatctttaattcttaggctgctatcacttaagcaattgatgcacttatgttgattttagtattgaattatcgatcaaccttagcctagtaatgattactgagcaaatatcaggccaatagaatttgttgatctgaaaaaggctgctatttctgctatgattttaagatgttctaaagctatgtaatgatcttattgctataccatataaacaatcaggtagacaaaacaaacttatgttgtaacaccccttaggtatgcacccgctactcaactttggcgtggacggctccatgtga

SEQ ID NO: 29130 - DNA, 289 bp, Oryza sativa
cattttgagttcccggattagggaaattagacatttttcattaaatttaattagcctgctctattgttggatgtctcatatcttacatttcctatctgttatgggtagccttattcctgaaaattagatatagcctctgggttgctaatagaaataaatctagctctgttgttgtagtattcttgtttgttattttttttccaatgtttccttgtgggcagcaatgccacaatgttagaagagcatactatgttgctttttgttcctccttgacatgatatgcttaagc

SEQ ID NO: 29131 - DNA, 484 bp, Oryza sativa
ttaagtatctcagtaagtgtacaggaaggattgtaattctcagggataaccggcggtttcaccggtttgaggatggggtatgctcttgtggggatttctggtgatatatcttctgatgtacctcattctcattcatcatgtttttctggtcaggcattttagattatatttcttcaggaaatagatctttacaggttcagtggctggtatgaaacacaaatctattgccatgctgttttggcacagaaaaaaacatgccataaccttcaagctgaaacagctggactcagccatgggtctattaataaaacaagacatcggtcatgatatgttaaggctagattaataatctggataacaggttcactgcaccataagttgagactggtctgagcttccgtggtgcttgaagaaggaatggtggttctgagaaggtacatacaagtttcataccccacttgagagggccccataaacatcagca

SEQ ID NO: 29132 - DNA, 328 bp, Oryza sativa
tttggcaatgctaacaatggtataggttgttcgcggagcatattatccattcatgtgaagcaggtttgagatcatcagactaacattgatcatgaggaacattacgggcgatgagtgcttctgtactagtgcaaacgaagtactaaatttcagtgtcaaactgtagacagtaacattttcttgatatatgtttatagaagaaaatcttgtgatgcggaaaagtgcatgtgcaaacatcgtttcattgcgagattatggtattgctctgaagtgaagaaatatcatgtgcattgagagcaaaggtgttcccttttttcttgagtgcaga

SEQ ID NO: 29133 - DNA, 209 bp, Oryza sativa
aaaacgcgtgaccgctccaaaacgcatgaccgacgatcctacaaaacggttgcgcgggacctcgacggtcccgcaggttcaaaattcgggagcgaggcagccagtgatttttaacgttgtttagcactatggacactgtgtagccctgtttgacacagttttgtaaggcggtaccgcaggttcaatgtgcggaactggccataaacagg

SEQ ID NO: 29134 - DNA, 217 bp, Oryza sativa
acaaaccaagccccgcaaaggtcatcgcattgatttgaacaagatccaataagggagatatgcctacctaataagggccccgatggtgccctccccataaagtggtgttagtctaatcgatgatgataccaggcgagacacttgaatatgttcgttgataattttattcctattttcgggagttcattacaatgatggcttcttccatttacctagt

SEQ ID NO: 29135 - DNA, 1333 bp, Oryza sativa
tgtcctcctcccacttcttcgttcgctcagccaagtttttgactgcgcgacagtccgcgagatcgtggagggaggtgttgtggacggagcaccacttgctggctgggcgctccctgctgggagtaccagcctctttctttttgtcgctcgcaggcctcccctttcgggtggcccgcggagcgccctcgacggcgaggacgtgaccctcgtcgccggaatggaccgaccttttcttcctcctcctgtcacgccgccctgtctgagcggcggatccgggggcggccgaagctgccacaccggaactgaaggggttccaggtccaggcctcctccttacgagccactcggtccgcgagctgaaaaagctctgcggtagtctggggctctttggagggaatcttttcgagcatgcggttgtgccgcacaccccccctgaacgcgtagatcaccgcgtgtgcagggatgcaaggtatagtattgcggacttggcagaaacgctgaatgtacgagcgaagggattcatcatcccctcgctgtactgcgtgcaagtccgcttcttcacctgggcgtggataggtgccttgaaagttcatggtgaactgctggcacagatcctcccaggagtggaccgacgcgggtggcaggttcattagccaaccccgcgcctgtcccttcagggccatgggaaagaaattcgccttgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctgatcctcacgtccatgtcgaggtgacaccctggacgaagaggcaccctccgttgcgcggggagtacgccgatcactacgtcggcgctcaatgtcgaggcgggcatccggctcttcatgctgatcctcccgagtcggaggcgccgacgagggagtggtagccgaatggcgtgcagcggccgccgctcgccgcgctctccgtcttgacgacgcggaaccggtagtggcggcgccggaggtcttggtggtggcggaccgtccgccagcacccaggcgttgctgtgccgtcatgaccaagttggccacgtcgtccagccatcgctgggctggagactccgggtcagggacgacaggcgggtgacgtaggagcgcgccaacagcctgaagcgcgccttgaggcgtgctgccgtcgccgtagacgaggaggcgacgctccccatctcgccgttc

SEQ ID NO: 29136 - DNA, 210 bp, Oryza sativa
aggaaagtattaattaggagaaaataaatgtcatttccttgtattagagaccaagtgcctataaggcatgtaatcagcaacatttgcaagcaagcaatatgaaaccaaatttcctaatctccctccttccctaatcctcctctttccaccattgagcgtgcatggaagaaccctgccgccgcacctgatcctggctacgaactccgtagc

SEQ ID NO: 29137 - DNA, 1501 bp, Oryza sativa
gcccgatccacctgcagcgacgactcccgcgttgaatctgacggcgacggcggcagccgcagatttggtggcaccgactgcgccgatggctacacgcgtggcggtggcgctggcttcccgcatcggatttgacagctacgacggtggcggtggcttccggtgatgatttttttcctctttcgcttggttgtcctattggattttgtgtctatgtttgcgatgaattttcacagaatccatcatgcatttggttgttgatgcgaactctggatgattttttttttgtcttggagtctcatctcagatgttgcggacgagggattttttttaaggggggggacggacgaaaaattaacgtgttgagggacaaggtgacgatcggaaattttaattagttctattaagaggtgccttttttaaaaaaaaactaacgcttataaaatattataggtgtccgttagtttaaaaccgacacctataatatcttataggtgctggtaaaaaaccggtacctatgaaaaccgagccgagtcttatccaaccatccacagcgccaaagccgagccgccagggcccaccgaggagataaggcaccgagatccatctaatttttttactctctcattttcctctcctctctctcttggtcttctctctcgctctcctctctccgaggcggcagtgcaagaggggaggcggcggttgacgggcggcagcggcgggtggagacggtgcggcccagcggcggcggcgacggcgatggctgcgccctcccctccgcggtgtacagcgggaggagcggcggatgcccggaggcaccctcccttagccagatctggcgggaggaagggctacggagccgcgccgcctcaccgtcctccgtgccgcccgcctagaaagcagcgcaaggattgatgccgtcattgccgccgtcccacgtcaagctcgtccacaaggcctacgactgcaccaagcacttccgccaccgcacgtcgcctgcaacccgacgtgcctcctgctacctttgtaccgcagcctcggattctatcatttctacattgtcacttagatggatcggatttgggagggaggtaatacatgggtattaggtttcttgtggggaacaaattcacgaggtcgagattaaatttggtatttgcgtgttgtttttggttgtctagttgattgattgatttggagatctagcttgtggattatttttttttaagacagactcggactcaaacgattgggaggaacgaattgcacggatgagtgaaaaatcacgcataccgacaaaaattaggtgacggttggaagattatgaatcttttaattagttaagttatagattttgttggtttgagctatacctggaaatctttgtcgttccggatattcaggccggtgaatatcacagaaggcgaaacccaccacgtgcattacgagcagactggatctggaaaaggccgagtaaacaaacttagctggcatcattttc

SEQ ID NO: 29138 - DNA, 1501 bp, Oryza sativa
gaagagaccgatttcaaagagaatgcggcatggcaagttatctattaattaagaatagtttgttagtttccttttatctttaggaaagtgtgtttagtgtcatataaggactttatcttttccttttatctttaggaatgtttctttcttgtccgacaaggacttgtatcaacctatgggtataaatatgtacacccggggtctatgtaatctatcgctacgatcaatacaattcggcgcatcgccaccctttttacttctacttttgtttttacgttccggcggaactaggcacccgacgcggggctgcatcgtcttcgatctccggcgaagggataagtccaatgttccgccggtccaggcaattgtatcgtctacgtcggcgtcgttcaaggctgcatcaggacattcgagatcttggattactctggtttggataatatatttgcctgactatttatcatatgtctatgttaatctagtcctagcatctcaatttagctctatcggccatctctcgctttagggtttctgccggtatcggctaaatcgccttgctagattagattagcctaggcatctactaccctaaaaaatcaatcaacggcttgattgtctagatattatgtttcttttcatacttagtgctgcatcagttaagtttgatctactaagtcgtgcttagaaccataatctccagcctgcttcttgattgccaataagggttccatcggggtttcagccgatgagttatctggacgttgcatcggcttacaaggattgcatacatattggatttagccgatcgcaatgaagatttaattgtttaatataatcttgtggattttatgacatcggacctccagccgatgtatgctttaaccttcggatcagtgcttattatatattgtttctagccgattggtttctattcgattatattgttattttattacatcagtcgattgcctttatatcatcatctacattggacatatagccgattgcttaaaccctatcgctatcggttggtatcggcatcggctggaactactacatcggcttgtcagccgatcggctgatttatctactgtttacatatcttgtcagttgtaggatcaaactgactggcatgcccgcatctcatcaatctttggacttgcacaggagctaagcagatctcccaggccagtgtgttcgattttttcatcaacactagcgcaccaactgtcgaaacaaaatttcggcaatataaaggggtagtgcacgagacctaaaagtggatggatgcggagacaaggatttagacaggttcaggccctctcgatgagaggtaatatcctactcatgttggggatttgaatccactgagtgtagtattgatctgacgatcaggttgtgtgaattggggcaggattacaagatagaaaccttaaccaatatggtgtcggtttcctaaatctaatttacaatattatcgaaccagaactttagacagttc

SEQ ID NO: 29139 - DNA, 1501 bp, Oryza sativa
tatttttaacatgtagatctcaattttagaaaaatttagagacttgaaccaactaaatccgagctaagatgaattagttatgaaatttcaaagattaaatcggattaaatcatttatatagattttaattgaattatgacgcaataatgaattatttttgaaaagtaaaaggggatttattgcatcagcggctcgggttcacggtggaccgggtgcacggcgacggtctacggaaacgaacggccgagatctatcctatccaaaacgaacggccgagatctaatcggtctacagcggctcacgggaaacggcgacgatgacgtcagcagtgatgtcaccaccggtggcggctcagcctcgcatgctcgccggcgaacgacggcgcggcggcgcaaacggagggcatctacgtgttgcgggcgacgcgacgaaacttactgaggcacgaacggcggtggacggtgaccggacgacgacggcgacgaggaagaagcggcggcgaccttcggcttgatgacgacggcggtgctccggtgatctacggcgacgacagagggacagacgaggtcggcggcaactcggcgaacacggcggtggccttcccacgcgacgacgacgaccggagcgacggcggcgcacgactggacgaactgcggcgacggcggcgctaggcttcacggggctagggcgctacagacggcggtgggctaaggcgagggtggcggcgggtagaggagacaccgggggtccttttatagcggctagggggcggcgacgaaggcccacgacggccggcgacgggaaggaaactttagggtttggagcggaaaaacgaatccgaaccaaactcgaatccggcaatttccaaaccaaattagcgatcgattccaaaagggaaaaggtagaggagatctcggggatcatttcccctctattaatttcaccgaagaaggaaaagcacggccgaattggaagggcggcggcggcgcagctcggttagggttcgggcgcggcggcggctggaggtagacgaagactaacaggtgggccccacctgtcaacgggcggtcgcgcgcgcgcgagcggcagctcggctgcgggctgactgggccgactgggccgagggagagagagagaaagggttttgggccgactttcggcccaaagccaaaagaggattttaaaaacctttttttcaatttaaattattcatgaaatgcaattctatttattaaaaatacttccttggctcaaataaatcctagaaaaatctaggaactatagaatcaagtaaagtatttaataaaattttatctggcccacttttatattggaatttattattttaaaattagatcttctcttctaggcttttaaaattatttctaataattcgaattaaacaacaatttatatatttgggatttttagggtgtgacaaacctaccccccttaaacggaatctcgtcctcgagattcggatgaactagcgaatagatgc

SEQ ID NO: 29140 - DNA, 584 bp, Oryza sativa
tttgaaaagagaaatggaactagcactatctaaatgaggaggtttcattctccaacaaccatataagtttctttatgatgaaaagcaacagttgaaacatgatctaatttacaaataaaattgaaacacatttcatgataagactgaatgtagaatattatcgagggggcatttgcccccactcacttaaaattaactgggggcattggccccaacttgccattagatcaacggatcatcctcatttgcccccactcacagtaaaattgatcggggggtttggccccaacttgccattagatcaagggatcatccaaagatttatgtgattttaatgtaaagggagaaattacacatcacacaagctatatagactacatggttttattatcaacacttctactgaagatcttttttacacctattatctggatatgccacgggactatccaatgagttttggtattcaaattgtgaaggcataaattactcagcagacaacatatacaagcgaaacatgcactttttataaaggacactgccacataatgtctcctccaccccggatttttttggtaggatca

SEQ ID NO: 29141 - DNA, 1501 bp, Oryza sativa
tccaagatctcgaatgtcctgatgcagccttgaacgacgccgacgtagacgatacaattgcctggaccggcggaacattggacttatcccttcgccggagatcgaagacgatgcagccccgcgtcgggtgcctagttccgccggaacgtaaaaacaaaagtagaagtaaaaagggtggcgatgcgccgaattgtattgatcgtagcgatagattacatagaccccgggtgtacatatttatacccataggttgatacaagtccttgtcggacaagaaagaaacattcctaaagataaaaggaaaagataaagtccttatatgacactaaacacactttcctaaagataaaaggaaactaacaaactattcttaattaatagataacttgccatgccgcattctctttgaaatcggtctcttctggataagcttcctctagtagatcaattttcttaaccgactatagcaagaatccgacaactgacgacttgacaactttcatcagctaatctcaggacttcaaagccgatgctgactctaagccgatgactactccgggcttaccaaatttcattgttaacagctaggtaggggttgcgttgagtttacctgtcaggaagtgcgatggaatcaactgggattaatctcaacaatttcgacgacttcaatctttgacatcgaccggtttgccgtttcaataaagtattattagattgatttttaatctagattggtctgctattcgatttttgtttgtatgcatgaactggtggttgatgagctctgccgactacttccaatgacggcatcataccggagggccatccaggggtgtgcacatgcatgcggcatgcaaacagagagaccaatatctagtggctattttttttaatcgctcacgatgcaagccacgctgcacgatccggttcatcggtctaatctaatttctgttagattaatttctaatcagagattgatattgtctttttggttcctattttgcttgtccgcatatatactaccggcggctgagttgctccgatgggtgccaacaacctgacaagccgctgcagcgctgccatgcaagacaagtcgtaagccggccgcgtcttcatgggaaccatgcgacatgctgaagctggcaggcatgcctgtgatttaatatgcatatgtgctctcgccatgcctacaccgtgcacaggaaagctcaagctaggaaatcacggttcccaggaaacatgcctgacgtgctgatctaatcaacacgcatggattaaatatttaatatgccatgcaatagatgttttcctgtatatgatatgcatccatattttcatgtttactaacagaatctatatgcttgctttgtttttgcatatacgatggattcattgcatgatgagatcgatctggccgactctagcgctactaatgggcaactcgccttaacgccacctcatctgccgttgattggtcctcgcctacacggttggatggtca

SEQ ID NO: 29142 - DNA, 1501 bp, Oryza sativa
ggacaaactgaaagggtaaatcagattttggaagacatgttgagagcttgtgctttagacttcggtggaagttgggataagaatctgccttatgcggaattctcatacaacaacagttatcaagctagtcttcagatggctccttatgaagcactgtatggtcggaaatgccgcactccgcttttgtgggatcaaacgggagaacgccaggttttcgggaccgatattctgagggaagcagaagaaaaagtaaagatcattcaagagagattgcgtgtggctcagtctcgtcataagagttatgccgacaatcgccgtagagatctaagttttgaagagggagatcatgtgtatcttcgtgtcacacctcttcgaggggttcatcgtttccacaacaaaggaaaattggcaccgcgttttgtgggaccttataagattgtcagtagaagaggagatgttgcttatcagttggagttaccgcaatctttggcaggagtccataatgtgttccatgtgtcacagtagaaaaagtgtttaagggtacctactgaagaagctaatcttgaacagatagaagtccaagaggatctgacatatgttgagagacccatccgtatcctggaaacagatgagagaagaaccaggaatcgagttatccgtttttgcaaggttcaatggagtaatcactcagaggaagaatcaactagggaacgagaagatgaattaaagtcagctcatccgcatctattcgctagttcatccgaatctcgaggacgagattccgtttaaggggggtaggtttgtcacaccctaaaaatcccaaatatataaattgttgtttaattcgaattattagaaataattttaaaagcctagaagagaagatctaattttaaaataataaattccaatataaaagtgggccagataaaattttattaaatactttacttgattctatagttcctagatttttctaggatttatttgagccaaggaagtatttttaataaatagaattgcatttcatgaataatttaaattgaaaaaaaggtttttaaaatcctcttttggctttgggccgaaagtcggcccaaaaccctttctctctctctccctcggcccagtcggcccagtcagcccgcagccgagctgccgctcgcgcgcgcgcgaccgcccgttgacaggtggggcccacctgttagtcttcgtctacctccagccgccgccgcgcccgaaccctaaccgagctgcgccgccgccgcccttccaattcggccgtgcttttccttcttcggtgaaattaatagaggggaaatgatccccgagatctcctctaccttttcccttttggaatcgatcgctaatttggtttggaaattgccggattcgagtttggttcggattcgtttttccgctccaaaccctaaagtttccttcccgtcgccggccgtcgtgggccttcgtcgccgccccctagccgctataaaaggacccccgg

SEQ ID NO: 29143 - DNA, 330 bp, Oryza sativa
catccaattagcactctcccactctgcgtgggacccaccactccgcacgtctcctcacgcctgcgcacgttgtggataccagctgcaaaccccaatccctgcaatcccgagtcggatgcccgacgcgtggatggagtcgggatccggttcaggccgctcggctccaggcgcattgtgagaaggctcagttagggtgagcggagtcatcgagcaggacggttcgcctttctctggccgtgatttcccttctccccatctcgtctccattggactagaatcacctctcctccacgccgtcggctcgctcacctacaattgccctacctcagg

SEQ ID NO: 29144 - DNA, 168 bp, Oryza sativa
aatatgctctgctggaagatgacctgcacacctcttactggttatgataatcttcctatgatattatatccattatctgacaataattaggatgaggaagctagctaggaccacggccatttcccaacaaactcatcacatgctctccttgtttgttgcaagatgcag

SEQ ID NO: 29145 - DNA, 325 bp, Oryza sativa
ttgaatccaactcgtaatatggaacaatgttagattaagagatcctatggataggaaacatctgtgtacatttttctacgagatgaaactggtatattttatattagtgtagatatagaaataagagaatagatgtatggggagtgagttcagtcaatgacaagtgggttgagatgagaccttgttaatcttaccattttgcagctagctcacattgtccaatagaaaacatacagtaactatatacgtctggttcagcactgaacccaacgaaccactgaccaacttggtgatgggtcgaccaccggtccagtttttttcacta

SEQ ID NO: 29146 - DNA, 1501 bp, Oryza sativa
tcgtgtgctgcattcaggaaagatgtgaggcaggaactattataaggttgaactgaaagcctttcttaactctgtttgatcgaggccatgttgtgtagcggtattgatgatgatggttcttatggaaaacgaagagactaggacaagttccatcaaccttcttgataacaagcggatactgtacctgcttcattttggttaagagtgttgcttgaaatgaagatctcccaggtccccatgtgatatcacatcttctctgaagcttgtatatataactgaaatggacttgtgtcctgaaccgaacaattgtcagcatcatgcccaagcagaataaacagattggaggaaaaacaagagttcgaggtggaaggaatctgactatgacaagatgggcctacacctacctagtggctcaagtccaacatctcactgatgtataaggttcaaaacccatcgtaaaccacaggcacgtgacattcttcatccaaaggaaaccaagagttccccagccccaggactgcagataccactttccatgcgttgtttgtccctccctgcatcacatgcaatctgacatgtttctggggttgattccggtatgtggactccattcaatgactgtttgtttcctgaatcgactgcacaattgtggttgatggatgattgccagaacaagccgttgatgaggattcttgtgggcatactgatggactggtatttgcattgcatattgcatatggttcctagtagtaggaggtttgtgtgaatgttttgatcggtgaggctgagtgaacagtagagtgttggtaatcctacggctttccctcattttatgatgggttgaggtatggtcgagtttccattcgagtgagttttcttttttctgggtgacgtactgacttagatcagtttcatcgtgtttagttccaaaataattcctcaaactttcaactttttcatcacattaaaacttttctacatacacaaacttccaacttttctgtcacatcgtttcaatttcaaccaaacttacaatttttatgtgaactaaacacagccaaagtcgtgccaagtaaattagcaaacgttcacctgcgatgcatcttgattatacaaacagacgcttcgtcttgcttcccagaaatgaaagaactgccgttcgatgtttttgccgatatgaccatgagaatttcattatcaaattgcacgaacggtttccatcgttttcttttggtactcattatttgtacttgttttcttggtacctagtagtgatttcagaaccctaggttaggtgttaaccatgcatcttagactagtgtatcctgccggccggccaaagtcatttgcttttttttactctccagtgttgcactgaaaatataagagattattgcatcgagttgccatgtgtttgtccatatcgtcgcctctaacactcaaatcgtcccgtgcctcaggcctcatctataaaatcccttgtgcattctccaactcgcaa

SEQ ID NO: 29147 - DNA, 1501 bp, Oryza sativa
ttgtactcttggaatgatgacgggcaaaataaattcttgcaaagtgtaggtggaactatgcatgactatcatcaaccaggtgttagagatgcataaagtggttccttctgagttacatgcctaaattgcaactagatgaacctgcctcctgttctaaatgtgatatcttcaagatgagcactatggacgctgattggcattttggtccattttctgtattttggaacctgggcattgctgatcgactaccggaaaggtctgcataaccatgtttggttcaaatttgcggagtgtcatttgcctaagcctggaaagaccatatatctacaaaatagtgtatcatgcctgaactgtatgaactctttagctctggaacgctgcctcaataaggggaaatgatatcagtggttctgtatggttgcagccaatggaaatttggtgtgctctgcctgtctgcaatagacttcttaaagcatgctgcagatctgaatacaaggtggctgaagaggttaccttccaatttttgggctacatgggtgcaccctttaacatacaaggtccatgtaaagagcttatggatattaagttgtgttggtggttcatggggtatagcttttgtggagaacaggaaatgataataaaattgatcgaattacagagaccgttctgatgttttcaaatgacacagacaagctggtgatgacttggcaaccatgaggcaagtagtttcttcatccacagcagaagttgcactaagtttttatctgttctattcttataatgcagcttccttaacctctagtaaaatgttagcttgcatgctcttaggatatttgagtcagctctgctgctctagagtaacccatatcgtatgctagatatcattttccttctgagaattggtgattttagatcctgtaccattggaaatttagaaccaagcctatacttaactgttcttctggttgataccttttggaacttagtgaagcagttaatatgccatattccaagaaaccttgttggtgatgaggcttctccttcagatggttatccccatatatgttgatttattgccatgaataagcttagctgaatgcggcatttgtgcctttaggtaacatatgattaatgttttggcaagaaatatgtccatatgacccctagtctacccaacacttccaactataaaaccactcatctgacattttgtattgcttaagtggtgtgataggtaataggttgatggtttttccatgtgttaacaaggttgccacattagaataatgatctggtgggttttgagctagtggtaacatacccaacatatggccctacgagctaggggtgctgggtggaagggagagaagcagtgagataattgtgctcttgtctagtgaacatgcgggagccccaaataatggaatgagttagtgaaggggtggttttatcagtcgccttgctggtgatggcatcatagaaggggcaaagtaaggcacca

SEQ ID NO: 29148 - DNA, 1501 bp, Oryza sativa
ctagttttagaaagatagaaattccgtgcgtcttttgacgcgctcatgttatagcctgtccgcattgtttctgtgattagaaagtagaaattttgaaattttttaaaagtataattttcttttgttaaattttgaaaatcttttaagtttactctattttttgtctgaactatttagggttcctttgtagagtaaaattataattgtattgtctattaattgacaaaataggtgataatattttactccctccattccataatataaggtacaaccactttttttaatgttccataatataacgcatgcatgcatgtaagcaattaactatgatcttttctccattaaattattactttttttaaatcctctactctcatgttctctaattctattggatacatgtattatatttattaggatgatccaaactacaagataataataattatttcttggtctttgggttagaggtggttatgccttatattttggaatggagggagtaaaaggcatttgtttgcaaatatatatatatattttatgagctaaaggatttaatataagtatctatgttggaaaaaattatacttgttgataaaaattaaagtctaaccggaccccactgatctatacctgatattttgctccttagtaaaattcttttaagccccatcaatccttctagatccttccccacttctcctttgcattttctcttttctctctgtgtaaactatagtatctaggtctattttttttcttagtcatgtttgattctctttttgcctatggatgtttatttcctttttctatcgagccatgtaggactcaggagatggttcagcacttcagcactgttaccatatttttgcgcttatttttttctctcgtataatttcaagatttatttgtagtgtgaaaggtgccacgtggcccaatcatcgtttgcatgcacagccagcattaaaagataatactagaaaatagacgcgccagttggcgcatcctctgattatataacatgcgtgtgctatttagtgcttcttccaagtgaggacacatgagctggcgttttccgcggattatacatgcccatattcttcctagcaaggactatttaaaggtttctaaatttgaaaactaaatcaagtaaaagagtaatgcatttggtcataattcctccgtttcacaatgtaagtcattctagcattttctacattcatattgatgttaatgaatctagctagatatatatgtctagattcattaacattaatacgaatgtgagagaggctagaatgacttacattgtgaaacagagggagcatcatttaactttaatgaataaataaatgtagcctaagagaaaatattttgaatattaaataatatttaattttgcattgaacatgcataaatactgattatgtatttttattttattttacttattattcatgtctagttgactttgatctaacttggtcagttggtctca

SEQ ID NO: 29149 - DNA, 1501 bp, Oryza sativa
tgtattcagcagagaaacctgactaaaaacctgacattaagtcatggactaagacattattatggtaaaactttttttgtgaagtttgttttctttgaggtagtaggagaactttctaaaattgttgtatgttgttcagaaatttaactctgagatgtaattcaagtttgattaactttgtactaacaacatatgttcttaaccatgttactttttttacatcttgaatgtaattacatgttaatctctccagggaatatggcacacaaaaaattatcttatgcgcgtacatttgaactgaatttttaaccacatcgtcctcttccccaacatatcgagcccacgagcagagcaaagcagaggcacatagatgcaccttccatcaacgtcatcagggacttcaccaagatcttgattactcgtgaaggccggaaccacgaacactggtgccctgtcagcaaccgagcagattttttttttactgaaaaaggtagagagactctaccttataaccattgtattaatggtagtcaaggtgttgcataaagagttacaaaagaaccggatgaagagggaggaatagaagaagaagagaaaataagaaggaaaaaaggaaccgagcagattttggttcagaacaagtgagattcagataatcggactagtggctaactaactaggaaccttaacacagcaaaatagtaaagtaattgatgaaatcgagctggatttgacaacatatagagtgcagcgcaagaacaagaaatgaggaataaaaacttttcgcatagtttgtttgtgactgcttcgtggctttatatcgagtccagactccagagctacgcgataaagaatgatgactacagtacggcaaacaaagcaatctgtagtccgtcgcggcgctttgtagcccttggatctccataaccatcccagcgaaccgttatcctttaatcccaaccgttcatccactctcccgtgtataacacacagccgcgttctgatttctgaatcttcaagtttcttcagttatgcaatcttcagagtctcacgcgcgtggcgcagcggaggcatccgccgttttgtgccaagcattatacatgttgttactagatcctactcacccagatatatcgtcttttccttaaccctctttatcccacactcttatccgtcctgcacatccatcttatagagcaggtttataggagcttgtgccagtgcttgttcttcgctaagcacctgctcctctctatccctctatcttttcctattatacttgctcttaagaccacaagcctctatagcagggttgtcatcactatgacttcggcgcaactatgccatgttgactttaaaagtcaactccttttgacttacaagcaagccaagtaaatactcctaataaggccgagttcgccacaataaattgtctgagatagtatcgttctccccaaacatattttcgaaaatgctaaatgatacgttttataaaaagtag

SEQ ID NO: 29150 - DNA, 1501 bp, Oryza sativa
tgcaacactggagagtaaaaaaaagcaaatgactttggccggccggcaggatacactagtctaagatgcatggttaacacctaacctagggttctgaaatcactactaggtaccaagaaaacaagtacaaataatgagtaccaaaagaaaacgatggaaaccgttcgtgcaatttgataatgaaattctcatggtcatatcggcaaaaacatcgaacggcagttctttcatttctgggaagcaagacgaagcgtctgtttgtataatcaagatgcatcgcaggtgaacgtttgctaatttacttggcacgactttggctgtgtttagttcacataaaaattgtaagtttggttgaaattgaaacgatgtgacagaaaagttggaagtttgtgtatgtagaaaagttttaatgtgatgaaaaagttgaaagtttgaggaattattttggaactaaacacgatgaaactgatctaagtcagtacgtcacccagaaaaaagaaaactcactcgaatggaaactcgaccatacctcaacccatcataaaatgagggaaagccgtaggattaccaacactctactgttcactcagcctcaccgatcaaaacattcacacaaacctcctactactaggaaccatatgcaatatgcaatgcaaataccagtccatcagtatgcccacaagaatcctcatcaacggcttgttctggcaatcatccatcaaccacaattgtgcagtcgattcaggaaacaaacagtcattgaatggagtccacataccggaatcaaccccagaaacatgtcagattgcatgtgatgcagggagggacaaacaacgcatggaaagtggtatctgcagtcctggggctggggaactcttggtttcctttggatgaagaatgtcacgtgcctgtggtttacgatgggttttgaaccttatacatcagtgagatgttggacttgagccactaggtaggtgtaggcccatcttgtcatagtcagattccttccacctcgaactcttgtttttcctccaatctgtttattctgcttgggcatgatgctgacaattgttcggttcaggacacaagtccatttcagttatatatacaagcttcagagaagatgtgatatcacatggggacctgggagatcttcatttcaagcaacactcttaaccaaaatgaagcaggtacagtatccgcttgttatcaagaaggttgatggaacttgtcctagtctcttcgttttccataagaaccatcatcatcaataccgctacacaacatggcctcgatcaaacagagttaagaaaggctttcagttcaaccttataatagttcctgcctcacatctttcctgaatgcagcacacgatgagagcaacttgttataatcttgacaagctggcagctgaaagtttctacagctccgtagtacataatcaatatctactatcctttctcccaaaagaacaatgcctgcttatgaatcaatcatccga

SEQ ID NO: 29151 - DNA, 1501 bp, Oryza sativa
cagctgacaaaaaaaaattcagccggcagtggtgtagcaaccccccctcccaaaaaaaagggggaaggtttagcccaaaggaatttgtcaacagagaaatagccgtctgtttataaattatgagagtagctacatgatagtggggacaccttaagatccactgcacttaggtggccctgtttagatcccatcccaaaactttacaccctgtcacatcgaacgtttacctgcaggctaaaagataactaattacatagattgtggctaatttgctacacgaatcttttaagcctaattgctccatgatttgacaatgtggtgctaccgtaaacatttgacaatgacggattaattaggcttaataaattcatcttgcggtttactgacggattctgtaattagtttttttattagtgcctgaacaccccatacgacaccctatataatacccgatatgacacgcgaaaactttacacccctgaatctaaagggtgttgctagttggcgcgtgcgcaccagcagctcccggcgcaaaaagcccattagcccttttttttcttttttttcgcgatttgttttttcactgttttttttgcgatttttttcgcttttttttcctttttttctgattacttttttttaatctttagtacacttatttttttccaaatattttgggtgaaagtttttaaatcttgacttgaaaatttttaaatctgatttgaaagtattcaaatctcgagttgaaagttttcgaatctgagttgaaagtttttgaatcggagtcgaaagttttcaaatctcgagttgaaagtttttaaatctgagtcgaaagttttcatattttttcaaatcttaacttaaaatttttcaaatctgtacttgaatgttttcaaatctcaagttgaaagttttcgaatctcaagttgaaagttttgaaatctgggttgaaagttttcaaaatttgtcttacacatttaaaattcgagttaaaaaatttcaaattaagttgaaagtttttaaaatttgacttcaaaagttttcaaatctaacctgaaagttttcaatctgttagtagaaaaaaaatcttccaaaaaaaagaaatcttatcttaattaattatcgtcattatctactaataacttagttagttaggctaacctttccggaatcgctcgccaccaacgcgtacacgcgcgttagcttttccggaatctaaacacccccttacattcaaaagaaaagtcataatgagcgattgatcgctggcggcgatcgtttttttcttttttttttcttttcctcttttattaagtttatacacctaaagtttacacatctaaagtttatccacctaaagtttgtagagcgaatgtttataagtcaaaagtttatatacccaattcaaatttgaatttgaattcaaatattttttatatgtaatatttctatacatctcaagtttatacacctaaagtttatagacccaaagtttataagt

SEQ ID NO: 29152 - DNA, 1476 bp, Oryza sativa
cattttgagacaaaaaatgacttaaaataaaaaaaaaatcaattacaaagttgtagatcgcgtcgagggctacaagtttgatataaagtttgtcttcattagagttcacatgaaaaagttatgaattgtttttaaatataaagtttttagactgtactatttgacccagatgatattcaaatccaagtttagggacctgggtgacacaactgaacaagttggaggatctaaacgagtgatctgtaagtttagggaccgggatgacacagtcgaacaagtttgagaacttgaatggtcgatttgcgagtttagggactgagataacacaacgatataagtttagggaccggtgatggactggatgtatctggagtgattgacctgattcattccaaaagttagtattttgtgggatcaaggggactgggagcatgttgaacgggacagatgggatcgatatcaagaaggccaccacccatcatgcttcgccgcctactcctccgcacacagcacactaccatctgagtgcctccaatcgccgccagtctgcctctgatgactgatccctcttccaaaccgttaccctttggagggatcgatctatcccttgcggacattcactgttttggtttgttttcatagctgtctttatgtcatcactcgtcactcaggagtaaggttataagtggattgacccgcgaactcacttatttcgatctataagtgggatctataagtgggttcacataccaactcacttacactatgccaaaccatgctagctgtgacgggcctaaaccatcatctctgacggattcggcccctcgtcagagattagtggtcagtgatgactctcttcacctttgacaggtgaagggtcgtcagtggtgaccagcccctatgacgggctatgtatagaacccgtcacaggtaactattatctcaaacggcccattagtttgtgagccgtcagtgatgtctataatccagaaaaaaaaaagaaaaatagattgcaacctgtcacatgtgtgaaaaaaccctagcaagaaaattggcgcacactgccatggtggtgcttgctgtcaccgcatcaccatcacaaaaacttcaaactgaccgacagttcatcgtcctccatcaccgcatcaccatctcatatagcaatcattcacaaaaagggatggcaagaatttatcatacaacaatatcatatcattcacaaaaggggcacactggccgacagttcgtcatcctccatgatggaccagcgacgggagacgcaggtggaggcgccgcgctcgcagcggccggggagacggcggaggatctcaaagaggcactcctctgctgctgcaccaccaaacaaaaatcaagaaacaagaaaccaccattagagcccacattctcaaaccaaacacctcaaatcaacaacaacaacaacaagaagatttaagtaaaaaaaaaacaacaacaaga

SEQ ID NO: 29153 - DNA, 420 bp, Oryza sativa
caatatccgttgtgcgagtactttcgacgataggccaactacggtataacgctggggctcactctgttttcttctatataaatcatgcttgtttacggtttacataatgcctgataattacatctgctcgttatatcctgataatgctagaagatccatgcagttttttgagtacatactcgatattctctgctatatattttgccttctagaaaatatttttcaggaacaattgagcactcgattaggttatggtcgagtacactccattatcgagaacattctcgacaaatgcggagttatcgcacccaacctaccaacaaagaccaatgacctatctcatagcaccggccatggctggactactcaagaaaaggttgttaatggataattcctcgcgaacatcgtcggcttgatcac

SEQ ID NO: 29154 - DNA, 1501 bp, Oryza sativa
agatggaatgacatggcctttaggtaatctaattttttttttttttacaaaagataatcaaagattttatcacacttggccacatcaaagctatacttaatctgactttgccgatctttacaaggagtcagcattaagttagaacaaacaaatggcttattagtccatgaccactcagcaacatatatatcaggatcaccatcatcattatcagaatcactatcatcagggcaatccacaatactaacattgggttttttttgtcattggacctaacaaacttcttactttccctaacccggctttcttgagccagagctttatgcataagttgactaacatcaagaaattgttggccaactaatctttatttaataggagcaagcaaactactagaagcaagatcaaccaaacctctttcagttatattcaaactaaaacatcggtttgtagcatccatagacctcttaatgtaatcagtcacagattcattatacttttgcctaaccgatgttaaatcgcataacctaagctcagtttcaccagtgtaaaagtaatcatggaattttgttataattgagcccaagtatgaatataaattgccggtaaagaagtaaaccatgtaaaagcagtaccagacaaagataaagaaaacaaatacaatttaaaagtatccgtgttgctagcctcaccgcattgtgctaagaattggcctatattttcccatgtggttctactatcctcaccattaaacttagtaaacttagggaccctaaaaccacgaggatatgtgatattatcaaaataattaggatacgactttccgtaaaccctatcacgattccttggctcaattccaaaagcgcttccctagtaatgttcctcacacgttcctccatatttttaggccttggtgggtttggtggcctaaagggtggttgcggcggcacaatattgttatattggccatatatagcatcttgaggatatccaatagcaggatcattataggaattaggtatataaggaggaatctgagggttaacagtagctacaggaggattaggtactggataatggtataaaacaaaattattagtggttggatctacctcctacacaagaactattgcaccggtctgaccggccatatggccggtcacaccaaaggtcggtgcgatctgaccggctagagaaccgccggtggtcggaccggcctaatggtcggtcaaaaccggtatagtgggctccggtcagaccggccgcagctgtacgatcaaggaggccaactagaggggggtgaataggcggttttaaaacttttggctaaaaccgagttttgtatgcggaagcgtaaatcaaaacggttttgtacaattcaaaacctaaatcaactagtctcaagtaagtgcacaaagaagctagcctatgttaaagtttgcaagcctagggtgataatagcacaaataagctctagtatgtaaacttgctcaaatgtaaa

SEQ ID NO: 29155 - DNA, 239 bp, Oryza sativa
ttataaacttgacttagtgtatacggtatgctacctgggccaaattagttttacagattttggcatcttcggctggtgacttcataatgagaacttcacctttggaaattttatggtttctataatgaatgtggacattttggaagtctcatcttggatatgattctgagaaaaaaagattattactttccattcgacctctaatccaatatcatttcttcattctaagattctcccgt

SEQ ID NO: 29156 - DNA, 206 bp, Oryza sativa
ggcggcgacaaagagctagggattgggctagcggcgggctatggtttctgccggtggcaggctagggctcagggatgaatcgaggagctaggggtttcaaatttgatttttggaatttttgttttttggctaaaattattttcgcatgaaaatcttatttttgcatgcggttgttttgctcatatataaattttgattttcgcaga

SEQ ID NO: 29157 - DNA, 236 bp, Oryza sativa
catatggcaacccagcagtccaaatttacttctaatcgctaaccactagcagtttatcctcttgacagttttggcagccttagttgtattaacccatttaattacttgcttttgttgtcttcaatctgatgtggtaatagcagtgacattctactggggacatgtgccaaacaaagaaccaataatccccttgtcagaagggagcagtaacagcagcagctactgcccactgtcga

SEQ ID NO: 29158 - DNA, 168 bp, Oryza sativa
ccaccaaccgggagtaaagaggaaaatctttggtcccggttggtgaggctagcgccacgtctctggttcctatcctttttttttttcattattctttgcatattgatttcacaccaatctcaccaaaatcataaaatcatcacacatttcaaatctcctctctccagg

SEQ ID NO: 29159 - DNA, 473 bp, Oryza sativa
tatggtagaagaagaaaaggtaggcaaaaaatagattgaagcatagtcataaaatatattaaagcttatctgctaaagctgctacgtgcaatgaaacttgaaagaaacatagtagctaaatcagccgcaactcaatctagcagaatattcgtcacaagcaacgtaggaagaaaagaatattagcgcagaatggttcacgtttcacagtcaattagccccttgaattgaagccagttaacataccaaattgtcaaaggtgcaaacagccatgcaacatgacaaaaatggttgctgcataagtaaaccatatacttatatagcttaacagaatgccaaagcagaggacgacaatccaatttcgatacagtagatctatattgattccttgactgctgctaccctcaaaaaaggttggaaatggattggatctataaaatactgttacagaagttcatttgggttgtttggagata

SEQ ID NO: 29160 - DNA, 1501 bp, Oryza sativa
aaattaatcatctccatatatgatttgatatgttgcaaaacggtagtgctgcggtagtcgtgatcaccttagataccttagacaagacgctttggcacacgtgcaaaaggcaaaggtgcatatgtgccttgtgcagcgggcaaaaaagagaacttcggacgctttatttattagcaaataatatataagatgatttaaataatgggtccaccggttatagtgtaagtctacattagttaatatagattttaaattgttgatttaatgggtacataatataatggtgtagactttattttgaaaccatgcattatttgagaataatagtccaatgtaataaaaaatagttccgatgatttaaataatagatccatcggtttaagtgcacgtataaatcaattaatatagatcttaaattgtttatttgataggtacacaatataattgtgtaaaatttattttaaaatagtgcattatttaaaaataatagtacaaaataatgagtacccatgtttaagtggaaactatattgtattattaatttaatggtcacatataatggtttaaattttatttctaaaaattgtagagctaatttagtagattctttgtgttgtaaatttatgattatttaaaaaagtatatagccatattatataaatggaaaaagaagaaaaaaagaaaaaaaaaagaaaagaagggcgtacgtacatggtaagtacctatatatccccacgtacacatgcacgggagaaggagaggtaggacccatagtatttggtttgttttaagatcaatttcatctaacggtgtgtaatgttggacccaccaatttaagtgattaaaggtagatgttttgctttttcttagaatttctaagattttctctaatttattagagcgtcacgtggcagcttgagagagtttgtaggaagtttaatgtacttttagtatatactccctccgtttcgttttatttgataccgttgattttttagcacatgtttgaccgctcgtctcattcaaaaaatttaaataattattaatttttttcctatcatttgattcattgttaaatatatttttatgcatatgtatagttttacatatttcacaaaagtttttgaataagacgaacggtcaaacatatgctaaaaaattaacggtgtcaaataaaacgaaactgagggaataatagataagaagaatggtcaacatattaagaagtcaacggcgtatcagttaaattcccctctgattttttgacctgctctacctgaaattccccatttcacgtctcttccgtgccggactgccactcgccggatttcacatcctgcaatcgaccagcccggtgagcaccggcgagtcgccgtggaggccacctccggttgctccgtcaggcgacgcgcggctcggctcctgcgcggcgctgcatccacggcttcttccaactccaagtgagtgcgtactgactaagcaacaaagatatctttggccg

SEQ ID NO: 29161 - DNA, 1501 bp, Oryza sativa
cctacctgttgggatcgagaacttgccatcatctggtctcaagatccatctagtaaatgtttttacagattcggggagccaggatgtaatatctgctaagtctgtgttgcggagaacgtttgaagtgcatcaacctagcgccgacttgatctttcacttttgaggtctttgcttggcacaggtggacaatttcttgaagcgatgactacgagccaagaagctgctaacaaagctatgcaataatgtggtataaatgtttatccaatgtatgggtttgatgaacagtacatgcttgcttgcattctagtgggagaatatgcaaatgatgtcccatcgtttcaccatataccttgcaaacagtatttgagaaaattgtgtataccattcatatagcatttgaaatatttgagaacattcatatagcatgtgtataccactccagaaaattgtgtaaacttaacacacacattaaggggataaggacgcttcagtatctattattatatactaaaaatccattaaacatcctataaacgctctcatatcgtcatgtggcactcctataaacgctcctaagtcgccacacggtgttttaatatattagaaacatctagccctcgattttcctttaatctggcaccgccgtacaacggtacctgacaggagcgtgtcgtgggaaaaatggcgcgaaccgcttcctacgaaaccgcgatctcagtaccagtcccaggacatagcgctggtacccacggtgataaatatgaatcattgcaatccttaaaataaatagaggacttatttaccttaacttaggttgcagctcagacagcccgagaatgcaaccgacgacacggacgaggcgaacaccaacaacagcagcagcagcggaaccaacggtctaacacccaacaccacaggcagcagcagggaactaggacgaaaccctaatctttacttcacttcaacttcatcttcggagctgactgaactatatttatatagagagcaagggtgagtacttacgtactcagcaagccaggggaacttaggtggttaatgcaggcttcaagggaaggctgttattttgcaaacagttttgttttcaagttttcaacaatctaagtgtgtgctttctacaaccagagcgagacaagtctcagctcggtcgggaggtgagaagtaacaaatttatttatcacgatttgcacaactcccagagttggcttcaaatctggtttttcccaaaccaaaccaattttccaaacttcccgataatagaggtccccaaacgaccaatcacttccagggacacccggtcccgctgtcccccggacagctaaatgcttcccaagcattaggtttcccaaaccttaacaccttttcataaaacagggtaaaacaaaaactacgctaaggaatcacctcacatccgcccatgaccgtgggcacggctgttcgaacagtttgttaacctctgcagagggggtacactttacccata

SEQ ID NO: 29162 - DNA, 1501 bp, Oryza sativa
gtcaagaattgattcaaatagttcatcctttcaatggagctgtcaacataagatgttttgacaccagagagtttggtgaacatgcagatatgcagcttgtgtgcattcagggattgatggatgtactagacttacaaattgcaagtaaaggcaactgtgtagcagggtaaattcaatctgataaagatttcaaacaaactttagattggccatatgcaattgagcattcaacatataaaaagcacgagttttgaattggtgcattaactattaggttgatactactatcctgaccatcacttttatttgatcacatggctcacattaagagttacccctaaatccctcctgagcaattagtttgctcttaatatttatttctacccatatataaagcactgcttaatgtttttattatgaatggaaagtttctgctgtatgaattatgatataacataatcgttaccatcatggtgttcatttaatttccattgaaaaaacttaaatttgttcacacgacggtgttgagcttcgttactcctatgatttaattcggctcttactttccttattagtttgctctaattgccatacgaatttcttaatatgtcttcagacaattccgggcattgaacacagtacgcagggtcaagttgccttcgggagcatcctaatccctcaagtgcagaatgcagcagatctttgctgcagtcgctgctactacatttctgccactaatagaacaaatacgcggtaaccgcttatttgtactataattgggttcgcgggcctgcccgcttgcacccttagtgaccgcataaaaccacttactcctttttaaaacattgatcaatttttctagcatgtattgttttgtcacaggataatttcacagcaaggatctactatactactactgttacagtactgggttctcgttatctatattgttggataagtctttgtggtccttggtcgtgattcttctttttgcttttgggtagtttcacctttttcaggacagcatctaccctttagcatatttttcagttgctaggacagctgcggttagtaggacaacagcagttagcatctcctttatgcctcatttatgctttattcagtttggatgccctctaggacagcatcccattcaaatttcgaattttagactagaagggtgcagcaataggctagcagccagctatggctatatatatgtatccaacctccctcgggtaggcatggcttttgtgtttagtgaatgaagaaaaccagaaaatcgccccatctcgagtgccatcctcttctcaatgagagtaaccattgaaattctaacatctggtatcagagccacactttcctgtaggctaaacatctcttgttccaccccttcccaagctcggttgagctctcagccagcagcagcagcagcaccggttgctcctccttcccctttcccttccccctctccacgcagcagccccccggaggtgcgcca

SEQ ID NO: 29163 - DNA, 1501 bp, Oryza sativa
ttaggaaattttggtttcataacgaacggctccagaacaccaaagttaaaagtgtcgccacagtcatgacgtactctgcacaacgtttcccctgccatttaccacccacttgataacccaaagctgacaaatcaccagagcacatgaggtccatttgcatcctgactactacacttgggcccattacaagactaaaaccaagcatcacccagttgttcttatgtataggatcatataacatgacaagtgtagatttacaaatgtcatagaatttcctactgttgcactgagtctaacttcatccattatagagcaaaacagaagcgaagctactagctagctcaaaacccgagaggtcaaaaataacgtggctccaattttactttcacaaattagtcctatgcattccaaacatatgttagatccaagggcttacccaaggacaggcatatatatcagttactactgaatgtacttgctatttgggaatgattaacctcaaattgcagtacggattgggtactagtcatcaacaaataagtcaaatctcctgatgcaaaaaaaaaatttctaaaactttagcaggccatccgcgtaagtgtaacgattcagttagaccagcaaaagacgagtatacatgcttcatattctcatggactttcatccttcgtaaatctgccccaagcccctaccgatttcagaaaatttgtgtagctacctagtaccagggacatccgtagcagtgcagattacggtcgccatttcgaatccacagctcagattagaagcatttcacctcgaggacgccgacgacggtgcgctggttgagctgctgctgggagccggagaaccgggtgccgacgtactccacggcgaccaggtaccgctgcgcctgagggttccgcgcgccggccatctccccgcttctcaccccagccacttcgccgccgccgtcagtggcgtcgccctgcgcctcagccggcggcgagggatccggcggggacgacctctggagcttcgccgccggcgacgggtcggcgtgggaggggtcgatggggcgcttggcggcggcggcggagtcgggggtggcggcgctcatggtgattgcggcatgagagagtgagggttctgcgagggctctgcacgctcaccacctcatctctcgttcttacactattacatcttacaaatcaaacggctcatatttatcaccctacaatcgaacggcccagatccgagcccactccatcccttccccagatcgctccttcccctccctccttcccctccgcttctttccctccccaaaccaccggcgccgccaccgacccgccggcgcagtgcggcacccaccggtgggggatccatcctcttttttatcgaaatctagcgctagcctcttgtcctggtttcttggtgaagggcttccttggattggattagctctcatgaaccttctttttttttttggttgcttcttgtaggcaaggagaagccatca

SEQ ID NO: 29164 - DNA, 1501 bp, Oryza sativa
actcaaaatcccttatactgtgggacagagggagtagcaacttattttatttaaaccgcacatatcaatatatattaagccaagtagctacccagccgttggataagcacataaaatcttttaggtttaaaacaactggaatttgcccttaattagcaaattaaccaagtggttttatgtcagatcaagttcgtattggtaattttactgtttacaaactttatttcgaaataatccactaaattatgccaaattaatattttattaaagtggttgactatatctaaaacttcagagaaatatatgccatagttcattttgtaatcttattactagtatatataattggtaggcttagctcaggaaaacaaaatcgtatagtacaactggtagcttgacctcctgatggtcaatatatatgtaccaagtcaagcacagtcaaaagcaaaaattgaccactgttgactctacctcactaaaaccaagcctgtcgcacaccttgccaaattggttaatttcttcaaacttcctacaatccacaaaatcatgcaagctcaccatttgacaagttcaattcggccatattttggagaatagaaaagctagaaccgaaataaatcaaattaccaccccttttttcaggcatgatcctgggtaggttacacgtaaccatgaaggctacaaggccggatggataccaataatgggaaaatgaaataaatgattcggtgcagtctgcgctggaagccttgtgaacaaactccctttcttgacaagtcctccactgccatttgttattgagcaatccctgttagtgatctgcaaactactgtatacacccccatcactactttgcttaaaacaaacacatacattgacacttgattagggattaaaaaactaagtcatggtggacttaaacactgaccttttcttttcattcctgaagtttacatttagaaaattcaaagtggattcgtccctacaattgctatgacatgataatattttaccactcccacacattcagactctactagtgtaatcgatatccgacacggaagtgcttttaataggaaatcaatgaagagatttgttattactccctctatataaaaatccaagacacttattttgtcaccaagataaaggatgaattaactcatcctctatggacaaaaccaattaactatatacatacatacaactaatgagtattaagataattgtttaggtttcgatcaacaatttaatttagtactttaaaaacatgtttccatttctctctcttaataagtgtgcgttaaagtgagcacactcgtgaatatgtgcgtatacgtcttgtgcgtgttcatttttcttgtaatgaataactaaatatgtactatgttttgtggcaccaaatcttttgcactaccaaagcttaaactgattacaaggtacagccagccaacacattcctgaatttcattttccttttgaatgaaagcttacactacta

SEQ ID NO: 29165 - DNA, 1501 bp, Oryza sativa
ctctccaccacacatgcttcaagtggctaggagggcatcctcccttttaaggaggtccccctctcctagaataagcaaggtggtactaaactccacatgcatgccatcccatgaggtgggctttttgtgattttccaaagaattaatcttcgagtgggctaaggcccattcattaattccaacaatcccacaatagaagccaccttcagctgttgctcatcatcacccatcaacaatttgacaacgtcatctcttgggatgtcaattcccacaagatcagctgtgtttgcataaatagtgaccactcgtggatcaattggctcacaactagacttggaagtgtactcatcaagtttgtacctcattcgccgctcgttcacctccttgacatgattcttgatctcttcaatcttcttagcaatttgatgacgtgcccttagcttcctcggaagttcagtagttttcttgataagcccagatctcacatcatacttgccaaggcggtgaacgaaatcatcgatgcaatcttcaatgtcataggacatctccctcacctggtccctccactctttaacctgaacatcaagctcatccatgcatgcgagcttctcaagcagagcctccatgcttctcaactcaccctcaagagacaccacctcgtttcggacccctttgagcttgctgtagcactcctcccttatcagtgtagcgagcttggtgaggagtgagttcatcacgccactggaggaactagccattatggccaactctctctttgctcaggttctctcttggcaaactatatgctcaggaaatgtgagagtagcacagataatgcttgcaggctcgtcttgattgtccagaaggttaattaacttaataatatatttcctcaagatccacgccgtctaaaataatcttacttggagcagcaaagagagcagagtacatgggactaagtaaaaatcaacccactctacttattttagaagcactgggtgttgacttattgccctgaatcaatgtactccctccgttttttaatagatgacgccgttgacgttttctcatatgtttgaccattcgtcttattcaaaaattttatacaaatgcataagatataaatcacacttaaagtactatgagtgataaaacaactcataacaaaataaattataattacgtaaattttttgaataagacgaatggtcaaacatgtgaaaaaaagtcaacgtcgtcatctattaaaaaacagaggtagtatttaggtcattaggttgtaattgttattttatagataactagcatggtggcccgcgcatattacgcggctagcattgttagatttttttctcatataatagcttaaatattttcacattttattattaaaatatattaaaatgataacataattttaaattctgggttgaactaacaaatgcgtgatattttattgtattgtatatacgtgatagttgttaattttgaattaacaaat

SEQ ID NO: 29166 - DNA, 1501 bp, Oryza sativa
atgtaacacacattaactcttgataaaagcccattttctacacccaccagtagagtgcactatctttctaatttatgaaagttttttcaaaattttaatagataaaaaaaatcgaagatctttaaggaatatcatcgaattactttcagtaaattctttattttcattttaaagtatgcataacttaatacagggaatctatttgctatttaattccaaaaggtatccccgccaatcttacagtatgataaaatcttctttggagaaaattttacaagtattttcacttggagtttttattgactaactacaaaaggttcttcagagaaatctgatacatgttttatctacaatagagtatgaagaacacaattccgcatcatgatttctgttgatatgcttggaaatagctactttgggccgtctttgattgtgttactcacctgtgatagtaggtttaatgttaaaggtagaattccctgtaaacatatggaagccacagaaacaacattttttaacctacaatagaaatgagtaatttatcatcaaattagaaattttcttgtgtagttgcgtagataaacgacatcaagaaacaataataaaaagcatactgctgttttatatgtcctggtgatcacatgctgtctcaatctacgtgaaaacgcaatggtaatacttaccttagtaattagcctctgttttcaaggcaaatcatatatatgttagaatttcaatggttactctcattgagaagaggatggcactcgagatggggcgattttctggttttcttcattcactaaacacaaaagccatgcctacccgagggaggttggatacatatatatagccatagctggctgctagcctattgctgcaccctcctagtctaaaattcgaaatttgaatgggatgttgtcctagagggcatccaaactgaataaagcataaaggaggcataaaggagatgctaactgctgctgtcctactaaccgcagctgtcctagcaactgaaaaatatgctaaagggtagatgctgtcctgaaaaaggtgaaactacccaaaagcaaaaagaagaatcatgaccaaggaccacaaagacttatccaacattctccccctaagtcttgtgcgtcgtcttgtggggaagttgggccatcccgatcctggagcagagctcgaggaacttgatcctcccaagaggcttggtgagcaagtccgcaagctggtccttggtgttgatgtagctcgccttgatgctcccttcctccaagtagcttcggatgaagtggtacctcactcggatgtgcttgctccgttcgtgaaaaacggggttcattgccagggccagagcggacttgctatccaccctgagctccaccgttccagtgtctctgccgaggagatcactaagcagtcgagcaagccagagcgcctgggtcgaagcggcggaggccgccatgtactcggcctcgcagctggacagggccaccacctg

SEQ ID NO: 29167 - DNA, 1501 bp, Oryza sativa
gctgctgctgctggctgagagctcaaccgagcttgggaaggggtggaacaagagatgtttagcctacaggaaagtgtggctctgataccagatgttagaatttcaatggttactctcattgagaagaggatggcactcgagatggggcgattttctggttttcttcattcactaaacacaaaagccatgcctacccgagggaggttggatacatatatatagccatagctggctgctagcctattgctgcacccttctagtctaaaattcgaaatttgaatgggatgctgtcctagagggcatccaaactgaataaagcataaatgaggcataaaggagatgctaactgctgttgtcctactaaccgcagctgtcctagcaactgaaaaatatgctaaagggtagatgctgtcctgaaaaaggtgaaactacccaaaagcaaaaagaagaatcacgaccaaggaccacaaagacttatccaacaatatagataacgagaacccagtactgtaacagtagtagtatagtagatccttgctgtgaaattatcctgtgacaaaacaatacatgctagaaaaattgatcaatgttttaaaaaggagtaagtggttttatgcggtcactaagggtgcaagcgggcaggcccgcgaacccaattatagtacaaataagcggttaccgcgtatttgttctattagtggcagaaatgtagtagcagcgactgcagcaaagatctgctgcattctgcacttgagggattaggatgctcccgaaggcaacttgaccctgcgtactgtgttcaatgcccggaattgtctgaagacatattaagaaattcgtatggcaattagagcaaactaataaggaaagtaagagccgaattaaatcataggagtaacgaagctcaacaccgtcgtgtgaacaaatttaagttttttcaatggaaattaaatgaacaccatgatggtaacgattatgttatatcataattcatacagcagaaactttccattcataataaaaacattaagcagtgctttatatatgggtagaaataaatattaagagcaaactaattgctcaggagggatttaggggtaactcttaatgtgagccatgtgatcaaataaaagtgatggtcaggatagtagtatcaacctaatagttaatgcaccaattcaaaactcgtgctttttatatgttgaatgctcaattgcatatggccaatctaaagtttgtttgaaatctttatcagattgaatttaccctgctacacagttgcctttacttgcaatttgtaagtctagtacatccatcaatccctgaatgcacacaagctgcatatctgcatgttcaccaaactctctggtgtcaaaacatcttatgttgacagctccattgaaaggatgaactatttgaatcaattcttgacattatgcagagtttactggtatatcttgaacatcatgtcatatgcatttaacaaattgctcccaactac

SEQ ID NO: 29168 - DNA, 1501 bp, Oryza sativa
tgagagctgatccaactatacataaatcagtacctccttaacattccaagttgttatttgttaaatacacaggagcaacagatatcatatcatttcctaggaagcccaggagttgcttgcctgctgccattattatcaaatcagtaaggaacatgaattattgcatgcgaaagcttagctatcagtcaccatcatacaagggaaaatatgcccaagttataataaaccacgaataacttattttacttcctgagctatctctaagacacagtgaaataccatttcatacgattttgctaatgagtcgcatgcacccagatttttgccatggattatttgatcaatgctaaaatatgatttctcaaaaaaaaaaaatcttctactgcattgtttagaccacttgttctaagctatttatgaagtttatttttcaaaatattaacttattgcattaatcaagcaaacaatccacgtcaataatccgctcaaaaaactgtctccaacaggacctaaaacggatcagcaattccccaaagaagaatcgattttcctaaccagtcacaagcagccacaaatattggcgagaacaaatagttctttacgtctattttgtgttatattaattaagttgtagttgcgagggaatacaagcaactcaacatataattctgcactcataggaggtaattcttattctagttctgagtgttccaatctggatttaaactaaacaatggtgtggatttttggttattacattacacaaaccccagttgctccaatctaacaactcagcaaccgcatcaaaatatctaaatttctacagtacgaacaacttcgactgcacttcaagtggcaaccacaatctcttgatgtcaacaccacaaaatctaaaagagtcttgcttggttaacacaaacacatctattaaaggaggaacttgtacgcactcctgattaagaacaaatctaacggagttggcgagcgtgtgatcctcctccacgatggagaacgtcgaggccgtcgagtccgtcaccgacccatgctccatgatggcttctccttgcctacaagaagcaaccaaaaaaaaaaagaaggttcatgagagctaatccaatccaaggaagcccttcaccaagaaaccaggacaagaggctagcgctagatttcgataaaaaagaggatggatcccccaccggtgggtgccgcactgcgccggcgggtcggtggcggcgccggtggtttggggagggaaagaagcggaggggaaggagggaggggaaggagcgatctggggaagggatggagtgggctcggatctgggccgttcgattgtagggtgataaatatgagccgtttgatttgtaagatgtaatagtgtaagaacgagagatgaggtggtgagcgtgcagagccctcgcagaaccctcactctctcatgccgcaatcaccatgagcgccgccacccccgactccgccgccgccgccaagcgccccatcg

SEQ ID NO: 29169 - DNA, 383 bp, Oryza sativa
cagttgtaatgctgcttaaatgttgctctcttcagagtagtacacaaatggactccatgaaagtagttaaagatgtggtttgatatggttctgggtagcattgcaataaagaattcatttagtctagtactcctgaattgatgctttatttccttatttatggacaatttttgaaggcatccattttaaaaggcattcatatctggttcttcattttttttctttattcttgttttcatctgtgttattgatgtttggttgctagctcaattcatgtttttctcacttatttgcaggtgttagtacaggtactggaacattttaatcaagtcgagtcacctctgcatggttagtgttctgggtcaggcaaaatcgctacaaga

SEQ ID NO: 29170 - DNA, 377 bp, Oryza sativa
tagtggctttttcaaaaatattagaaaaatacagagtccagacaaatcacagaaaatatgttgacaggcataacatcatagccataaatcaaaatttcttgtatgtaaccaaatgttgctaaatccttatacaccagagaggataaatttttgacagaaacattcagtgccatataatgaagagtatagagagagatgaatataattcgaaagcagatttaagaggtacaatacaacaaataagagcccttcaaggtacacccatgaggccattatccctccaaaacacatttctgaaggtccatttgattttagagaccaaggcaataataatgctatggcaagggtcaatttaattttagaaaccaaggttgtca

SEQ ID NO: 29171 - DNA, 303 bp, Oryza sativa
ttcagttgcagaccgagtagtgtgcaacaagcaagtatatattgaggaccaaattaaacacgacatgagactcgactcaactcaactcaaatacctcctgattggacaaatctggaagccagctgcactgcacattcagtttgtccccatcaatcggttgctatgagctgattataagctaaagtggcttatatacatgttcttagcggtttagaaataatattctaaaattaattttaaaattaagatcctgcatgtctaatgtaaatgatgaggctggttgtctatatattttccgacagc

SEQ ID NO: 29172 - DNA, 504 bp, Oryza sativa
ttgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacatttagttgctctattcctcttcctattccattggtaacttacatcaattactcttaattgattgttggttgatggttgtgtagtgaaggatggttcatggctagttgatgacaattagttgctccattcctcttcctattccatgactcttactcttcatcttccattcctcttataaaatgggaatggatttgatctcccgcgagaaaaagaagacacactttcatccattttccaaagctgttgttgctacggtaatcccatcccaa

SEQ ID NO: 29173 - DNA, 453 bp, Oryza sativa
atgcacttttagcccattgggctgtaaatttgatatggtatttgttgcgttcggttacaacttacaacatctccgtcctatttttatttcagttagggtctctctacacatcattcgacaaattttcaggccccaaatttgtcagatttctgatcccttggattagcatccaacggcagcaaaaataaagaaggaaacaaatagaaaaaaaataaaaggcctaaattgggccaaaattgcaacgtgtaaatataataatgggccgataaaatcatattgggccaaaaacacaacaaataattttatgattatagcccaaaatcaatcaacttggcaatcaagaaagctggagaaaaggacagcacatacatcacgtgatcaaagcacacatccagcgaatcaacgcttctcccatccaaaacagatccaaagtcagatcgaagaagatagaca

SEQ ID NO: 29174 - DNA, 1149 bp, Oryza sativa
gttcgaactagatctcttacattttgtttgttctcgtttgggatttttggtgtatggatgtgtttgttgatccgattcggtgtaggtgttctttcgtcaagcatgagctctttttgaaacctattttgattgagttttctcttggtggtcttcgaatctgttaggaagttaggtattatgtgatgttcgtgaactagatctgtgtgaagtagatctcggtagttttctctcgttagattagcaagttagtgtatatatgtgagctatttgaacaaaatttggtgtgcttgtgttttattatgcctttagatctggggatgtttgtgaggtgttcgaattagttgcagttgcgtcctgttcagggtagtattttgatggctggcgcgcattgtgttctattatgctttagttcttgggatgtttgtgaggtgttccgatttatttgtagttgtgtccttttcagggtagtattgatggcttgtgaggtagaattgataacttgacagctagttagtttctaaaattttgtgatgtctgaacttagtttgttgtatttttgtttttgttattattattactgtaattatttttgaattttgtatattgtagtagattaaacttttacagatttttagttgtaagcatgattctactttccatgtcccttggatagttgtaagcatttcctaattttttacttccaagttattcttgtgtaattgacagctactagtgcttcaaaatctactgattgttgtttgtcagtttttttttaattcctatcaactgtaccctgttttcttcatcttcattaacttgctgtgcctgttgattccattcagcttgttgttatgttatttttctgccaccttctccttggtatagcttgtgtgcagctgctatacttctttagtgaaatcttctgcttgttcttttgtttccatcagctgtgtcatgttgttggagtcttgtttccttgtgcactctccatgataaagcatctttagctgtgcactcctatttttttttgtttttcttctaattatagttgtaaagccaagttcatggtctgcatgatttgcctttttcattgttgtttgtcttattaagaaagtgatttagatatttgttttatattttttgtttaga

SEQ ID NO: 29175 - DNA, 402 bp, Oryza sativa
tttgtgggcctgcatgctcatgaccctaccttggggctttcatagtgcacttacgtgtcatttagccatataattctacgtcaattttgctatatatttgtcgataaattttcccctaaaaatttgacagatgtaattacagtacaaccgtaatgtaattacactgtaacttgcatgtaattacactgtaactataatataacttgtatgtaactttcaaaaatctctccataatatattattttggtaaaataaaggttgtgggaacaattttttttcagatatgtgtgtactgtgattttttttctttctcaccaaaacaaatctttataatagatctaataatttaaaattacgtgaaacttacatacaagttacactgtagttacatgcaagtagaga

SEQ ID NO: 29176 - DNA, 386 bp, Oryza sativa
gatcaagacgcgaccaaattaaaatatcagcaactaattaaccaattcaaacgataaaagaaaacgttaaataatatccgtctctcacacgatcttttgaagtactaattttatttcatatcctctggctaaaattcaattaaattaaaattgaggatttatcatttctaggtatcaacttttaaaacatctcctctccacttttcagttcatcaggtaagtccacacttgccgcaggtgagtcagtcgtggtgcttcgccataagtgcgccaacgtctttgcactctgggttaggacacatcagtcgtagcctctccaccttccccatcacgtcatcgacacgatagtgacggagcaccgcaagctcttccttgcggtgctcatg

SEQ ID NO: 29177 - DNA, 306 bp, Oryza sativa
gcaccaatagtgaagaaactcttctcaccatcatatgcgaaatttttttttgcctgatcacttgaattagtttgctcacttgaaaagagctttttcattattgttgctcttccacaacatgaacattggtacctgttttatgttcgctgcgtattgcaaatggtttgccaatacacataataggtatatatcttacattttggtgtgctttacatatttgttctgtttacttttgtattatatatctattttttatttattttgcaatttttttgttatttaataaggataataagctaaaggagg

SEQ ID NO: 29178 - DNA, 452 bp, Oryza sativa
gcggcgagcatctcttcgccgttgatggcggccggacctttgtcaaacgtcggtgcgcgccgcagcgatggcatggaatccggagtccactataaggaaaaaaagctgtagtctgtgttcgtttagagagatttgaagaggattggaggagattgagggggaataatttcacaccacaataagtgtggaataaatcccctccaatccctccggattaaccgaacaaggccgcaaagggagaacaattgccatgtcatcggagatcagaattccgaccctcctcgggtctagctctgacggccttccaaagctaacaacatgtagtcagtcagatcacatggtcaatgtaaccaagacagtgctgaaataactaacattagcctagccacatctgaattattgagtgcaattatcgaaaccgtaattttgtggtgcataaaacaatgggacca

SEQ ID NO: 29179 - DNA, 441 bp, Oryza sativa
aaggtcttaaaagcatgcgttgtacactttagactaccgccgatgaaagggaggaggtatcagtctagatcaaatatcaaatacactatgcgaaatttgtatatatgtccgtgataacatttcaagcaaattactttgactgtgactattctactgccaaaagaggggtgtcaatacaacacaggacacactttcagctttctgatgacagaaaactgtaataggttatgttggattacgtgtgccttgcatatcttcgcaaatacctgggctccacgttcatgtgggtagttgaatgtactctacaaagctcgttgtgacaacacgctgcacctctctgacactgaagtctgaacctaatactcatcccatcatttttcttactggaaacaaattaagctcttaagacaattttgtcaataatgcgcttctttttttagg

SEQ ID NO: 29180 - DNA, 1501 bp, Oryza sativa
ttcatatgctgagactctaatacatacctgcaaaattatgaagtttattaattgaagatcatgagaaagtgagtggtaactggtaaccatataaataattcgccaagcaaacaatgatatattggataaagaaagaagaaacatgatattaacggtgatgctttgtcctgtgaaatttacttgctatattatatatattttttaataaaatgtatatatttttttcataattaattaaaaatagtaatgtaaatcatggtcttgttaccttgcagcgacttggtgccgtatgcagtcccttagaattgcactataatgtattgcaatgtccatgttgtcatacctgtacacaggttgtgtaaatgtaaagaatgaagatcatataactgttttatgggttgaatgtgaagaatgaagtccataacatttatgtcctagggaaaaaaacatatcatagaaatgcatggttaaggaagaactaactgactacttacccagacattagaacatccaaaagatcctggttttcttccaaataatcagaggcaaccatcctataatctaccttttgcctagcaaattcgcagtaacttgagtgacatccttctgagtctgagtaaaaacgaaagaaaaaccctcttaaattataagaagttttaaattatatgtgttggtgcagataagcttcttgaggataaagtgggtcatggtcctatatgggtttcccttatctagagaatttcttaaacaataacttagattaaacaaaatgcagcatctaaattcttgaaaaatatcaaatatatatggatccctttgacatacttccaggtccatgtatggaaggcaaacaactagtagatgaagactattggtattctccttgaagaactccttcgtcaactgcgagcaagcttcatcgactgggtctgcctcgccatttccataaaggatggatttcatctccccgatgcttttggctagatctaccatctacatgttagttcaagtgcgtatttagtcacaaatgcataagatccccctatatatgatgatatgaatgattaaacgtataaattgtagtgtctaaccttaacacaattttggacaaacacaacttccccctacatatgtttattgttttgttgttatactaagttcctgctcattttgatgaaagcagagcgactaatataatcatgcctagttattctagtcaaatcttctgtttaattggcaacaggctcagctgttaattgattctacaataataaggtggtgttttaatccaaggacttaactttagtccctatatttagacactaatttagagtattaaatatagattacttataaaactaattacataaatgaaagctaattcacgagacaagatttttaagcctaattaatctataattagagaatatttactgtagcatcacataggctaatcatggattaattaggctcaatagattcgtctcgcgaattagtaaga

SEQ ID NO: 29181 - DNA, 231 bp, Oryza sativa
tttttagggtttacactgtatataaactttgcattatatattttctattgtagtgaagttatatatgggtatatattttcctcttctacctgctattggctcagtgtgtcgtacgtactggacatcagtacatctacgtcgccatctgcatcggccttatcacctcactggcagctacagttgactgaaccgggcttggctagtttgcctgtctgaaagtgattggcgaga

SEQ ID NO: 29182 - DNA, 672 bp, Oryza sativa
gatttacagagagttacttctcaaccatgcaaaagttacttccaattaacattgaagttacttttattaaatgttaaacttacttgtgttggtgggtactgattaaatttaatttctagataaaatcatatttttatccctacaatgaattacttctaatatcgtgataaaattacttttgtgttgttttaagttacttttataatatatgtaaattacttttagactttattgaatttatttttatatgtctaagaagtaatttagtcaaatctaaaagtaacttatatatatatatgataaaagtaacttacgtatataataaaagtgatttacaaatataaatattttttcatcgtaatataatatgtaagatcttgttgtgaaagatttgtcagggttatggataccacatacctaacagtagttgactaaatctcggcaggacccactacatatcatgtcctatacggaagcaaccttcggatataggaggagttccggataaggaaagacgaccaccacgatcaacacacacaaaggatcaacacccaacacaatcgacatagaagccacaacatagaagcctacatacgccaagacacgccgccggatatcgacttcagggataagcacggctagtaccctacggtgtctcccgatactgtcagg

SEQ ID NO: 29183 - DNA, 587 bp, Oryza sativa
atattggggaaaagaatataacaacctcttatatggtgaaaattacctttgttatatttcccaggctcatgcttcatgatcatgtaattgaacttgaaaaatcaaacgttcatatttcagaactctaatttcgtcaaattcaaacttgagagaccaggttcaaccaaattgtgatgataattaggaaataataataggattagttggttatcctaaataagggccactttatgagcgccagtctaaaacatatatgtatatctatctagactgacgtataatcacaattgctaactaattttctatttgctagttgataatagtatcgttccttgccaccaaatgagctttaacgaaacaatcaccggggtctagtgttttatttgaccggggtcatagctataaaataggaaggagtataaggggactcataagaaatcatcggggtctcctaaccccaataaattgctatagcttcgccctaatgaaatatccatcatccatcgtgcatcgtcgattttaattcctttagtgggcctaatccgacccatccacatggagaggaggttattttagtttggaaaagg

SEQ ID NO: 29184 - DNA, 189 bp, Oryza sativa
tgggcgtccaccgggaaagctggcgagcggggctggaggcgtgtgctctgcttgtcagaggtcacttccggctgtagactagccctcattgtaaaaacatgtttcctttcttaagcagctagaggcccatgtggtgacccctgaccagataaaaaggggaccaggcctagaagggggaaaaagagggga

SEQ ID NO: 29185 - DNA, 455 bp, Oryza sativa
tgatgaagaaactataaaatcatctctaaaattaagttttaagagtaaattttagcttggactaataagctgaagaacaaaagtggagctgcaagaaagcaagcaagcacatatatacaactagctaggaagaaatagctactactgcctcctttcgcaaatgttaatttgacgaccaagatatagggagtattcttttttttttcataattgatgattaattattgctcttgttttcgttcgttcatggctactaccatggtgcgtttctcattctctgagatgctatgctagccgaaggtggcatcatatttgacaaagcctactgtattcataaaaactattcgacaaagtcctgtcaaagtaaaaaaaaatgttgcatgtagccatatcttggattggtgagtgcagatgcaagagtaatatattaatacgtacgtaaatttttttttaga

SEQ ID NO: 29186 - DNA, 513 bp, Oryza sativa
caagtccattgaaatgactatatatgttataataaacttattttacttaattaaccatgacaatggacctttgtcaatatgtattttatcactgaatgaaggcaatcatgtgattagcttgaagtgtttttattgctactgtattcttgtatggattaaagatggtatgaattaagtgtaataacctgatagtactttggttctttggcctttgtatagcttgaaaaatagatatcaggattgattgtagtgcattatgcctagaggttatagctcaacagcacattaccctcaagtgcctggtctggcactggtgttttctgcttgttcttcattttctaaagacagaacaggaagatcatgtactctaaaagcaacccaaaataactttggttgtatatgattactttagcatgacgcatgtcttctccccacaaatataccagtgttcatcacttactgttttgaatagtgtacttatatctccagtcaattaggaattcatgctgtgag

SEQ ID NO: 29187 - DNA, 153 bp, Oryza sativa
tcgtcaactaggtgttggtgttccatgccgccaagttgacgatgactagaaaggttatctcaaatattgtacttgtgtgattctgatgaataagagcaacaccggcttcggccaataggagtagggttattaccttctggtgaaggggtccga

SEQ ID NO: 29188 - DNA, 1501 bp, Oryza sativa
ttacaattagatcatgttagcatatgtaaataaagcaaatttgtaggcagaaattaccggagtaatttttttctagattcacaaataaaatactaattgatttgtaggtagagaacatccgataatttttattctggattcatcccctaaggactcgtcttgttcccgtgttagaataagtcaagctcatacaacactgtcgaatgaatacttagtcaaaccgatttaacagccagctggaaataaacgaatctagccgaatgagtgtctgtttatagtctaattttgttccattttttcccttatgtaaatcaaacttgatatttcaaatttgtgtaaaaaaatataatattccataatctcgtattactccataattttgtcataacttataaacaataaactggtactctcgattgaggggacaggcgcatatgctctcgattgagggggttaaaattaatttatttctcactttgtttagatgtcatggtttgacaagtcctgtctgcttcatggaaacaatcatgcttatgagttgctattgattaattgctccaaatattcagtctaaaatggactagcccaccttaagaaaaacattaatcgatcgggacttgtagcaaaagtcttgatttttcttcgttaatcgcagtccagagctttttgacgtaattgcatcaagtaatcacgatcaccaccgaacccgtgaatccaaaacaagtatagccaacacgaacaattaatcttgggtatttttcttcgcttcagaccagaccaacaagcgacgacttctcaccctactagtagtagtcactactacatatagctggagcagaatggtcagagagatttggacatttttccgtgtgaaaaaaataaccaaattactacctacattttttataaagaaaaaaaaactatgttgttgatttctagacatgattttcaacatcaaacttactgaaaaactatacaagtatcatttactttgttatgacttattttagtattaaagttttattttcaaaacatgacttataattttgttatatttgcgctaaatatttattaataaaaactgtcttcaaacgttatatttaaaaaatctacagcatgatatattataaaatagatgaaaaaggcaaacagccgagagctagctatgcagcaaaatatatatagatccggccaaaaagaaaaaaaaaacgataccattaagataagaccgaggaacaccgtgttggaattattggcaacaagtccacaaagtcaaaagtcaaagctcatcctccccatgctgttgcagtctttgccacatatatgaagccaagcaggtcagtcacgggcttcacgtcgcctcgccggagaagaagacatcgccaacatataccccccctccctacctagactcagatcagatcacctgcccatcgacgagcacaagagcgatccattcctggtttgaatcgagcttggtttgtttggttggttggtttct

SEQ ID NO: 29189 - DNA, 246 bp, Oryza sativa
ctgtcctttagacaaacttgctttactgtactcagggagcctgtttcagatttttcctgaccgcatttgcggtaatatatgtgcattgaaggcatatatatatatatgtactactataagtaagaaaatcaagctgtatcattcaaagaataattctaagtaagcatctttatacaatttcatgcaccaggtgccaaaaaactaatataaaaacatctatgtgaaataacttgaaacaaaacacca

SEQ ID NO: 29190 - DNA, 1037 bp, Oryza sativa
ttttgttctggggacatcttttttctgttctgcggtctgttccttgtgttgattgccatccattcaagcgggtaaatcagatttgatggtttggtggataaaaggtagtatgtgattgttcagcacggtttagcagcgggctagctgctgctaagatttaacatcgatatggaagtttgagaatcggtggactctaatacttgtgcgtgcttccgttgctgccaagccatattgcttattgtctgaatgctcgctcttaaccatttcatgtgctcatatgagcaatctgatttttgtatcaaatatgttatccctccttttttttttacaatagcagatagtgtttatgtgtgttaattgtgaggtcaatttttttttacaatagcagatagtgtttacgtgtgttaattgtgagatcaacttgtgcattacatgtatgtacatgtcactggttcgaacatgttagactttccttgttaatggtgatttttctaagccagttaagtagatggtagcagataaaagttctgtatgtcgactgtagaattaaaatgttcagggcgtgatctgtagaaagatgtagtaggggtggctggcaggttgcagattcaccagcactgttccttttttcccccaaggagtatatagagaggaacaattagcttgctggagaattttcctatgatacgtgtaacatgttttatgtgatctgtcagaaggctgttactggtgcttaggtctatatgtgatttattttttattttgtttgtggtgtcttgttacattgtgtaactggctccttgaagtgttttacggcctttatccgctgcatgtgctaataaacacttttaagttgcacaaataaactgtgggttccattttgtcttatatttttagatttactggatattgcttgggaatgtaagttgcagagtgttgtagtaaatgatattatggtttgttgttctgtgcaatttactctactgttttcaatggaagggttcatatacatgttcccaattatcttatttctgaaa

SEQ ID NO: 29191 - DNA, 268 bp, Oryza sativa
cgtggtctcacccgcgaatattcgcgtcgcgtggtctcacccctcccgacgcgaatattcgcgccagctcggccgggaccgcgctctcgtagagctccctgaccccccgcatagcatcgcatagtttcattagcttttggcgaggaacgggcgagcagccgtgttgggggagaggcgtcgctccgtaccgtaaccctggaacgttgtagccaactacctcccgcgccaaggccaaaaatggcgaggaagtaggcgggggagaagaaga

SEQ ID NO: 29192 - DNA, 181 bp, Oryza sativa
ggggagaaaaagagagaaagagagaatggaggaagaggggaggaaaaagaaagagagaggatgacatatggggcccatatgccaatggcccccacaaatttttatatgtgtgaatgacaaacgggtcccacctatatgtttttaatttagatgccacctaagcgccacgttaacccataga

SEQ ID NO: 29193 - DNA, 818 bp, Oryza sativa
  unsure (1)..(818): unsure at all n locations
ctgtctgacaagcaacaacaaacgtccaacatgaatatcaatagttcatactgcaatacatgtgcagcagaccagcaacgttacagcaaaacttttttttttgaacgccgaagttacagcaaaactgggttacaagaaaccccagcttaagtattggccaaaagtagacttgattagttgactgcgcaatcagctgcccaccaaattcagcataccacagctcacatccaaagctgaaaaccaaagaaattaatcaagattagaaaaactatgttccacctcctattgctagtaaaatgatatctcctgaatcctgatacgtacaagatttttagggattaggagaactaggcttggacgcaggagccatgggggggcttggaagtacaacaatctttttttgcaaccagttctgaaacatgatccaaacaaaagcatgtaatctttattttgttaccttgttcaattagggccaacttttcggggtcctcttctatgctagtaggcggggtgcttcgcaaccaatcttatgtactcactccatactcataaaggaagtcgtttaagacaatgtttaagtcaaaccttaggaatataaatcatgaataactcccaaattattgagtttgaaaatataaaaattatatgtatagatttgtcttgaaaaatactttcataacagtatacatatatcacttttcaataaatatttttatagaaacaagaagtcaaagttgtgttttggagatcgtgtcgctgtcctaaacgactnntcttacgagtatgaaaggagtacanantanngcgtcagccataga

SEQ ID NO: 29194 - DNA, 499 bp, Oryza sativa
ataatcgactaagctcggtaggacccactgtataacaagtcttatacggaatcatacctcgtatataaaagagttcaggatccatatttgttttccaagttctatttggacaaggacaagaggatatctatgggtataaatacaaaacctcctagggggagagaaaaagacaagccaacacaaattaacacgctcagtcagaataggcaccaatacatgccaccagacaccgacatcagagataagcctagacagatccaatctggtgccattagaggccaacaagagggatctagcgctatatctgatctcgccgagtacatatttgaggaagaagactaccccgtcgtcaactaggtgttggtgttccatgccgccaagttgacgatgactagaaaggttatctcaaatattgtacttgtgtgattctgatgaataagagcaacaccggcttcggccaataggagtagggttattaccttctggtgaaggggtccga

SEQ ID NO: 29195 - DNA, 208 bp, Oryza sativa
gatcgagtctactctagtcatgcgtttgatttgattattcgactcgtgaatccatccgaatctgaattcgaccaaggaccaatacactgtttgtttcttttttggtcagatgaaccactgcgagttttcatttgtcagggtctaggagaacaagattacaagaactgatgaatttgattttgaggggcgccgcggctgcaggctctgg

SEQ ID NO: 29196 - DNA, 766 bp, Oryza sativa
tcatttaaatggctcaaaacttctaaaattcatatctaattcattcgaactccgaattgagccattcaacttgcaaaattcatctaaaattgagctctacatgtttgtttactttttatgtactgtttccttagtttttattagagtttttcctcgttttgcgtgccagcgtgtagttcccgtcgtttcggaagatcgcgttcgcaaggataagagttcagaagatccaagtgaagaagcaaggcaagtcacacattccccttgaacatgttgatcccaatttataaatggtttaccgtttacaaataaatatgcatgttttgctaattacatgggatccgggtattacctatctgcttgcttgtgccatgtttacttgatatctgttctttgtcaaccttgggtaataaatcgactagctcatattacttatgtgacctagctagaactatatgcttagccatgcttaattagcactagctcagttgatgggataattacagtattagacctttttagtatcagaatgagctgcgtgctcgagacatctggccatgcttcatggtcgtaattatccaactaaaatgcgactgaatgatgggctgtgggtgcatggttttgctagtcgcacccatggcaattaaagaccggttcgcgggatgccctggaagaacttatcgtacttaccacaagccagcgtgggcaacggctggacttgtagtgtagcttttctctagccgacgcatccaggcaaaggtgggcgtga

SEQ ID NO: 29197 - DNA, 384 bp, Oryza sativa
tgtgttcactgtgcttccaagtgctttacctgtcaaggagcttagcttggatttacatatgtacgactatgacctaggacaggtttgtccctttgttccaaggaattcatcttttggtttgcctttttgtatatttgtttgcttgcttggtagactgccttaccatttgtttggttgtctttcaggttcatacattgacaagaccactgtggagattatgggtatcccatatctacacggcgatggtattcgaactgggtacaggatacctaatgtagatagaatatcttatctgtatctcgggtttgtttcttaacttgtgtatcaaggaaacaccctgagacttagtcggttacgactgtattttacctttatcttcatatt

SEQ ID NO: 29198 - DNA, 1501 bp, Oryza sativa
ttggcaacatattagtagcaatccaaacatgtataataaatctctaccttacaaaaaaaaattggtaataccaaaacatgccaagaatttggtagatactctctccgtctcataaaaacgaatctaggaccggatgtgacatattctagtactacgaatctggatatgatatgttacatccggtactaggttggttttttatgggacggaggaagtaaggtagagaacaaaagagccccataatttttagcgcagtggtaaactggggagtggattttcacccctcgaggggatatcctcttgttgtttgcacatcactcaaatggttatgaaaaaatttgaaagaaattgagaagatgtattaacatgtgatatatcactccacaaacatgcaacttctacatctcgcaaaaaaaaataaattcgtttgttttttcgttgcgagatgtagaagttaaatttgaacatacatgtttgtagagtgatatatcacatgttaatacatcttcttaattttttttattttttccataacaaagttacatgtaaacaacgagatgatgaaaatagtttctccggtaaactgtggtggagaagtggagaaccgaataggccttgcagagagagagggggaggcgcgtggcgtacgtgagcgtggcgtgggcgcgggagagagaacaagtcaaaggatgcgaacgcaacaagacgagcaccagcagcatggtcaggacgacacaacacaactagtctcctcgactactcgtctctcggtcttccttccctccccctcttcctcctcttgctcttcccttccaattccaatcccgcgcgccgatccgatccattcccaccaccaccaccgtcgtctccctcactccaacctccgccacctgcgaaacctaagcttgctgctccgccgacgaggctgatacgtgctgagatactactagtagcacctgtacgtctaagctagagctatggggtgcgtgtgctccaggcggtttcgggacgacgccgcgccgcgctcggtgcagccgctcgccgccgcctacgaggcgcgccggggtcgctacggccctggcgacttcgactccggcgagctcgccatcccgccgcccaagctactcacctcccacaaggtactctactactactaccaccgtaattttctatgcatcatgtgctgcatgtgttggaattttcgagctccatcgatccatcgagatgtgcttcagctcaactctccgccctgcttgcctgcaacttccatcggacagctgcatgtgctgctctctacttcgcgatttgtttctgcttagttaggtagccagccggtgagaattctccacgacttgatgcaccaaacacgcgttgccgcaaacggagcgctttgtttgggttcgaaatctcaatccgccttccacgtccaattcctcaaaatcacaagttgggggtattattgatttgatgttattttttgctgcgtttcttctctcgccgc

SEQ ID NO: 29199 - DNA, 1501 bp, Oryza sativa
ggatcggatcggcgcgcgggattggaattggaagggaagagcaagaggaggaagagggggagggaaggaagaccgagagacgagtagtcgaggagactagttgtgttgtgtcgtcctgaccatgctgctggtgctcgtcttgttgcgttcgcatcctttgacttgttctctctcccgcgcccacgccacgctcacgtacgccacgcgcctccccctctctctctgcaaggcctattcggttctccacttctccaccacagtttaccggagaaactattttcatcatctcgttgtttacatgtaactttgttatggaaaaaataaaaaaaattaagaagatgtattaacatgtgatatatcactctacaaacatgtatgttcaaatttaacttctacatctcgcaacgaaaaaacaaacgaatttatttttttttgcgagatgtagaagttgcatgtttgtggagtgatatatcacatgttaatacatcttctcaatttctttcaaattttttcataaccatttgagtgatgtgcaaacaacaagaggatatcccctcgaggggtgaaaatccactccccagtttaccactgcgctaaaaattatggggctcttttgttctctaccttacttcctccgtcccataaaaaaccaacctagtaccggatgtaacatatcatatccagattcgtagtactagaatatgtcacatccggtcctagattcgtttttatgagacggagagagtatctaccaaattcttggcatgttttggtattaccaatttttttttgtaaggtagagatttattatacatgtttggattgctactaatatgttgccaaatgttgatgatacagagaagaagactctagattagtgccaaattgatcataggaatagccaaacaatttggcttcaatccaaacctatactattactattgaaggtaccaataaattggcagggcacattttggcatcaatccaaaatggtcatatatcagatttactccttcagtaaaaaaaagtctaacctaaaatatcaaattcgttgtaataggatatatcatatcctatcttaggttggattttttttaaggagaaagtatctacttactactactgtttttgttttatattataagttgatgttgaacttctttggatttaaccaaaattttaaaaatatagtaatatttttaattaaaataaacatagacatattatcaaaatgtatatttaatgttagatttgatgaagttaatatgatgttttagatgttactttttttttacaaacttgattagaaaaatcaaaacaacttgtaatatgaaaatgaatagggtaaattaagtcgattaatttcttgaccatcatttagaaacttcaaaatattaatagtaaccaatttttttgtttcaaaagcttaatatcggcctgtagcctagtggttacaagagcctcagtagcacctaaggtcctgggttcgactccccatggg

SEQ ID NO: 29200 - DNA, 320 bp, Oryza sativa
ttccattcagttattggtggctatatcatatgacagagggagtagaacagtaaattgatacggatgaagtagctggtaagcacgtataggagtaactaattgcaatcaaagcgtttgtgcttaccaaccagtattaggctctgtttatttcagcttaggattattataatctagattactgagtcagattactataagctagattgttataatctgtagtagaataagcggttaattgtttctttcctacattattagagcctaaattattgggtttgcaagtctaaagagggagtgggtggcatggtgggtaatttttc

SEQ ID NO: 29201 - DNA, 1501 bp, Oryza sativa
gtatcttagattctagaaggctggcatctgcaccgacaagattcacatacaatattttcattctagaacccaattgacatagatgtatcatcatcatcatatacagcatggggatcaatcgacaagggccaggttggagaaaagttgctgtcaattatccttttcctctagaacaactctaggacactattcatcttacggctttggcatattggtctcttggaaaggagaaatccaaacggggtactaaacctgtgggctgtggccgtattaattaattcggcgggcgggtcgacggcgacggcgacggcgacggcgagcggcggaggaggcggtggtcgggtctctctcgccgcgtacaggtgggtggtggacatggacatcgccggaatgagcttgtgcgagaaatgctgctgctatatctgcatctggataagattgctgagagactggagaaagataatcttgctggataaacttgttggacccggctgcaatttgtggccaagacctcttctcagttgtctgcttcatcgtttctcttttgtttgctctacagctattattaagccgtaaaaaagatttatacgaaacaactgaaaatagtttatgagtaaaacttttatgtttgtttttatcgatctaaaagtcactgtaaaaaataaactaagattaaaaaaaacccttagaatcaacttaaaactaagtttaatttaaattttagttggagtaatctaaaagataaacgatgggaggccagctgctacaaagttcggcctgtttggtggagcttaatatcctgagaaacaattgttgagaagctagctggtgagaatctgaagaagttggaaaacctagcttttggcttctagttcattttccagattctacaactacatattctaagaatctgggtaaaaagctggactgtttgggggagcttctggtaactggagattctatgagaagctgcagctgccagaagtgttagatggatctccctccctaacccaacggctcaaggtggccttcacctgcgccctgatcgggggcgcccagcccaatggctggtgggcccccgtcatcctgcgccatataaagagggatggaggccggggcgacacgacacgaggttcgctgccgccgccatctccacccgcaaaccctaaccgatcgagagggggcgtagccagtgacgggaagtctcaccgctgtaccacgtctcgtcatcgactacgaccgccactgccacgaccgccatcaccatcgagcacaccgttgctgccgcccacgtctagcacgcgacaacaacgatgatgtccggcacctcttcatcctccaacacctcaaccggtcggtctctaaaccctctcgtttcatctctataatgttgttcatccacccaagagtactacccgactagatctaaacctaggtgatcctagagagaaccctaacaagaagctcccccaaacaggagtttgataagtaacactatagg

SEQ ID NO: 29202 - DNA, 1501 bp, Oryza sativa
tggaattcgggtttaggtgatgcaagctgattccatagaaattcaagatcccgcggaaaaattttgaggtcggaagagcaaagccgccgtagaagaaatgcgagaagaccacaatctcatgagtatccggagacgggaaagcctcaccgtgcgctggtcgccacccgatgatctccttggcagggagaacgccgtgcgccaccatctccttaagatcctcctccgttacgtcggacgacgcccattggccttcgaagctttctctctcttccgccatcggtttcactcaaatgtgctgatttgattcgagggatggcttgggagaggtgagggattgaggcggtggatcacgagaaggattttgatgcacttttcggaggtggatttggccggagttgtgaaccctagttcgccggcgcagctttgcactgtagcagggagtggggaaaatggcgagagttccggcggggaagacgaagcgccgcttggatatcggatttttcagttaagggtatcggaggtgctaatgggcctaggcctgaacaatacttcagcccaatacttttaacagcgtggcccattgtgttccttagggacttaggcatattttgctttggcaatattatgcacacaacagtgttgcccaatgctgatgaaatcctttttatgcggtcatataattctttggaattattgcaatgcaagttaaaaaggtgtccgacagaaaggcgttatgctgtttttgcaagcttttttaggctacaaaagctgtttgggttaactaggaatgacttgtttttattatagtcatttccttggcgtgttatatgccagttttcatggtaaatagtcatggcctaggctatttgacttatttattaccataatctttatggtacttgatgggtatctttagagtttttttattcggatgcctgtcaagtgagttcattcgtgaaccttttagagtgtaaaccactcggatttcttttattgtggctaaaaagcagtcggctagcatgcctatttaggcgccgcgtacgcttttgtcatgtaatgcacaatagtgttattattttgtctttcaactatatgtttagtttgttaactaatcacatagttgggggctacacctaattaggtgcatctattcgatgcaccatattctttatcttttcgccctttacagtccactcggcagattttggcttgaagagtttgaagtactcggattatcatctttgagagggttacgatggtcgactgcaaaggactcgggggctactgtggagattatgggtatcccatatctacacggcgatggtattcgaactgggtacaggatacctaatgtagatagaatatcttatctgtatctcgggtttgtttcttaacttgtgtatcaaggaaacaccctgagacttagtcggttacgactgtattttacctttatcttcatattccgttaggaatatagattatcttttgtaatccggactcc

SEQ ID NO: 29203 - DNA, 1501 bp, Oryza sativa
  unsure (1)..(1501): unsure at all n locations
acatatacctcacacttcagatgcctcanatgcataaacatgttgcgtggttgtcgaaactagatttcgacaataataaaagggggtggctatcaagcttggaaagtgtatgggtttggagacaaaggatttatacaggttcaggccttcttataaaagaagtaataccctactcctgtccggggatgaatccgccgagtgtattattgattgtatgattcgggaaaaatcagcatatgcccctagaggcgcccggaccccccttatatcttggaaggagtccggattacaaaagataatctatattcctaacggaatatgaagataaaggtaaaatacagtcgtaaccgactaagtctcagggtgtttccttgatacacaagttaagaaacaaacccgagatacagataagatattctatctacattaggtatcctgtacccagttcgaataccatcgccgtgtagatatgggatacccataatctccacagtagcccccgagtcctttgcagtcgaccatcgtaaccctctcaaagatgataatccgagtacttcaaactcttcaagccaaaatctgccgagtggactgtaaagggcgaaaagataaagaatatggtgcatcgaatagatgcacctaattaggtgtagcccccaactatgtgattagttaacaaactaaacatatagttgaaagacaaaataataacactattgtgcattacatgacaaaagcgtacgcggcgcctaaataggcatgctagccgactgctttttagccacaataaaagaaatccgagtggtttacactctaaaaggttcacgaatgaactcacttgacaggcatccgaataaaaaaactctaaagatacccatcaagtaccataaagattatggtaataaataagtcaaatagcctaggccatgactatttaccatgaaaactggcatataacacgccaaggaaatgactataataaaaacaagtcattcctagttaacccaaacagcttttgtagcctaaaaaagcttgcaaaaacagcataacgcctttctgtcggacacctttttaacttgcattgcaataattccaaagaattatatgaccgcataaaaaggatttcatcagcattgggcaacactgttgtgtgcataatattgccaaagcaaaatatgcctaagtccctaaggaacacaatgggccacgctgttaaaagtattgggctgaagtattgttcaggcctaggcccattagcacctccgatacccttaactgaaaaatccgatatccaagcggcgcttcgtcttccccgccggaactctcgccattttccccactccctgctacagtgcaaagctgcgccggcgaactagggttcacaactccggccaaatccacctccgaaaagtgcatcaaaatccttctcgtgatccaccgcctcaatccctcacctctcccaagccatccctcgaatcaaatcagcacatttgagtgaaaccga

SEQ ID NO: 29204 - DNA, 953 bp, Oryza sativa
atgtgggtgacgatgggcggaacaaacatgatttctttaggattcgtgtggacttatctgtcaagcgtccgttaaagtcgaagttggctataaagatgttagcacagggcaaagaggtcacaaagcgttttgatctttggtatgaaagggtgccgcatttttgtttcatatgtggatatctgggacactctgacaaggagtgcaataggaaaggagtcaacaatgaccagcccttcaagttttcggcagagttaagatgctcccctctaaaaccctttgagaggaaggtgagtaaggtgaaagtaccatcatcttcaggggtggtgcgtaacctgttcttcaggggggcagggagtgcaagttcattgtcctcacgacagaaacaaggagatcagggggaggacttggttccaccaagagtggacgctcatgatggttttgagtctgcaaagaaggaaggggacacacagattgatgaacagttggcgggctatgcagagaaaatgaaggtgggggagacagaagtacagaaggtttctctcccaggaagagagggagcaagccataaacgtggacctgagattcggttggatggtgtggaagatacaacttcattaccttcttgtgagatgataccggctattaagactataagtcagcaagcttcctacggtgatgaattgtctgaagattgcagtggagaggacaggagggaacctcaaacacagggtgcaacaaagaagtcagggagagtcatgcaagctctgctggaatatcaacaaatggtggaagaaagcagcaaatctgtgtttgaatcgggcgtttcttcacgggcactgaagagagccaggaagactgaaggggtagtaaccgggaaggagaatgaggcaaccagccctggggccgctggtcaactgacgggaccgatggtcgggtcccgtcaggagcaatga

SEQ ID NO: 29205 - DNA, 1501 bp, Oryza sativa
catagtagggtttcatttgcataaacaacatttaataaacatttcagaatttaataaaacagttaagtaataaataaacaatattaatccaacgctatacaacataccctgttgcataggcccaaccattttgaacaaccatcccggctgcacagttctatctccaaaccaggaatataccattccaaaccaggagctaatcaaattattaccagttatagcatcttttattatgatgagaagtgtgagactaatcacgaaagacattgttagacccgcccttaaccgcgggcacggctattcgaatagttttactctggccagaggtgtaccactgtacccacaagacacagccccacaacatgtcaccatgtgcctcaataccaccatggtacctcggaaaggagctgtgacagtacccctcgcacaacacaatccaccacagcgcacctttcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgttaatgtttctaagcatggctaagcaatcatatctaatatctagctgaaccaatatataaagctcaactagtcaagttataataacccaaggtatcaaggaataaagtaatcaatgcaaacatgccataacaaaggaatagattcacaccacccagtgacattcgaaaataaatgcacagttgaaataaatagagaatttaaatataggatcaacatgctcaaaggattgtgtttaggatctgtgtgacttgccttgctggccttggaactactcaaattcttctcctgcgaaaacggactctcctgaaacgtcggaatctaaacagaaaagagcaaaaacaccaaaacagcacataaataagcatgaaaagtacatgtggatatttttaacatgtagatctcaattttagaaaaatttagagacttgaaccaactaaatccgagctaagatgaattagttatgaattttcaaagattaaatcggattaaatcaattatatgggttttaattgaattatgacgcaataatgaattttttttgaaaaggaaaaaggggtttattgcgtcagcggctagggtttgcagtggaccgggtgcacggtggcggctcacagaaacgaacggccgagatctttccatccaaaacggacagccgagatcgaccggtccacggccggaccacgagagacgacgacga

SEQ ID NO: 29206 - DNA, 1501 bp, Oryza sativa
caaaactgggtttatctcaaagtgcagccttatgtgaaatcctctgttgccaaacgtgctaatcacaagctctcgttcagatattatggtccctttcaaattttgcaaaaagtgggtagtgtggcttataaattggatttgcctcctgattgtttgatccatccagtggtgcatgtatcgcagctccgagctgctactggattcagcccgccagttcagcaagctttgccatctcctttggacaagttgcaagttcctgaatagttcctggatcactgtattgccaagaaaggtaacactgttatttctcagctattgaccaagtggacaggtggtgcgattgaggatgccacttgggaagatgaggaggacttgcagactcgttttcctcgtgcaccggcttgggggcgagccggttttcaaggaagggagattgtcaggtctactgatgataacctgactcaggagaggctggacatcggcaagcaggagctagggaacatcgacaacgagctggaaggtgtacaggatggaggcgcactgaaggaaggcgttggctcacaaggaaagcgtgttcgtattgctaatagaaagtatgtgggctctgaatgggccgtgtaatgcgtgagttgtaatgggcttgcccagctgagaggggttggtgaggagagagagaaaacggtatatgagacactgttgcgtgttcgaacggcatcgaactggaacttggaggcgatggcggcggaggctccgatcctgttggatcgagagagttactaaagttccagataatttcgtgtgtgatcttgattggtgcttgctgtgagttagggttctaacaaaaccctagcctagccttgcaaggataaggagcagacgtgaagtcgtgaactcgtcgtgccttggcggcggcggcggcggcggctgaggcctcctccacctccttcctagacgagccttctccttcctcctctccaaattgcaccttcgtcttcctcctctactagaaagaagcagcgccttgtcctccgatcctcaacgcccgccgccgcttcaaaccaccaccatcactccggatgccaccgcccctccctgatcgctggggtatctctgggcaaggagctcgctcggcgaagttctcactgctccggtctctctatcggagcctcgtcgcggtcacatcctgatttttgtttcaggatttataaattatttaataaattattatttgaatttatattaaatgttcattaatttacaagtgaagttaaaggtgggaaataaaacttcctaaatataaagcatggatggatttattttttattaaattctccatggttaattatactctcttgaatattctcggatttttcggagctcaattcctaatttttaatcatacaaagagcatttcagtaattacccacatattaaattaatcattaaatggtctaattataattttgttaagtactttgagtgtccaagtattttcaggatt

SEQ ID NO: 29207 - DNA, 1501 bp, Oryza sativa
cttaatgatagttcacgatggtcaatcgtgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatccaggaaaggtgcgctgtggtggattgtgttgtgcgaggggtactgtcacagctcctttccgaggtaccatggtggtattgaggcacatggtgacatgttgtggggctgtgtcttgtgggtacagtggtacacctctggccagagtaaaactattcgaatagccgtgcccgcggttaagggcgggtctaacaatgtctttcgtgattagtctcacacttctcatcataataaaagatgctataactggtaataatttgattagctcctggtttggaatggtatattcctggtttggagatagaactgtgcagccgggatggttgttcaaaatggttgggcctatgcaacagggtatgttgtatagcgttggattaatattgtttatttattacttaactgttttattaaattctgaaatgtttattaaatgttgtttatgcaaatgaaaccctactatgccatcctttgttatcctgtgcacttgcatatttgctgcgtggcttgctgagtatgtcatatactcaccttgcaatcattcatcagaggaggagttctacagtgatgctgatggtgtggaggattaggtgtagccctggtcaagctgcctgtggagtggagtcgtctgtgccgtttatcttattttttccgctgcttagatttttattgattgagaggaactatctacctctgtaatgacattttattcgcttattaattagagtaataattgtactctattaccaatttgttattgtgtgcctcggctgatttctggacaagggttcacacacatgtaagtgtttggaattttggatagaaattccgggcgtgacagtcgcctacggagacaagtaaagctccaactcagtcaatgattgttgattttgattcatggtgagggattaaatatatccatgcgttttgctgtggggaaaaagcttggattttgggggcacttcaggcagatgcgcggttccatgtttaatttcacaagtatttgcagggtcccagctccacttgtaagtgtttttggtgttcatgctaggtttgggcttccttggtaaatctgctgaatacctcgcgagggacaaagacaggatctgtccagttctttttttttacttgtgcaagacagaagattatgtaatccctattacaaaacggaaaggattccaaatacacaaactacttctgcgtaat

SEQ ID NO: 29208 - DNA, 1501 bp, Oryza sativa
acttagctgttcaaatggagatgcgcttcctgatttgttctggtaatgtttcaggtgcatacgttgacagcaagaccaacaatcatgtttatgaatttgaagcatctgacttatgagatacttatttttactaaagatccaaacagccacagtggagttcttcagctggctcagtatttagcttttgcaccgcagctggagactctagaattgcatgtgagtgctctcctgcctttcttgtttttgcttatgcttctttctttgttggctatgtatagattgcaatagttagtagttacatatatttttgtttcgaaaaacagatgttgtatcattcgactcactgccgctgctggcatgagggtgcgggagtctcctacggacatatgccccatcatcacctcaagatggtctacatgagtgggttcaggtgctaccgggctcaggtcgagctgctgtttgccattcttgaaatgggtgatgagcttgagcatgtgaccattgatccaatgacgagagtaccgtatagccctgatttgatgaatttaggcatacctgaggacgagatatgtcaatgggcgaaccgtacctcacaacggtttggtaaagcaatctctgttgtaaaacctccctaggtggtgttggtagtcctgtgcatatacgacttattaccacctagataagtgtttgttcagattcagtactgaaattgctgacacaggggtttctgttttgtttccatgagtaaattgttttttattttattgtttgacaataaaaggcttggacttgtttcttaattttgtgacaactttcatatgtcagttttatttacgagtgaagtacacaattgattcttagactgcgagtgtcatctagctctctaacctctcaagatatactttttgtcgtataggtttaaaaggggttcaaccgacttctgtgtattgatctacaatgtcaatcacataaaaaaacaaaattagaaaaaaaaagcatcatcttctcttattatgttaaggtgagaaaatattaaataattgcatatttaacacaagtttgaaccggtattatggatctgccactataaaaagtgtaattggatatttaccataaaaaatggttggaatccaatatattgccatgggactgacagtttagatgaacactgttacaagattgacttctatgaaaatcaggacaagaataccccttcccaagaaattgaaagattaacacatcatatgccaaaactcacgcatcacgagcttagatggtgtttggatccagggacttaattttagtctctgtatttagacactaatttagagtattaaatatagattacttacgaaactaattacataaatgaaagctaatttgcaagacaaattttttaaacataattaatccataattagagaatgtttactgtagtatcacataggctaataatgaattaattaggctcaatagattcgtctcacgaattagttcaaga

SEQ ID NO: 29209 - DNA, 277 bp, Oryza sativa
ttgttggcgttcttggtgccagtctaatcctggaaacgccacatatatttacatagtatttttttcgtttatgtgaattttgtcttttggggatctaaatgatgcgaaactctgaaaggaaagcgtccaatctgcggattgtggcgttccatgacatttctttcatattgaataggaagatctgatagattcctcaattgatatgattttgtttaaggttatttgctttgtgatttttgttaaattctttgtgcttttttttcagatgtggatgatg

SEQ ID NO: 29210 - DNA, 258 bp, Oryza sativa
  unsure (1)..(258): unsure at all n locations
tttgaaatcantgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgatgaatcccctaatgatttttatcaaaatcattaagttaaggtggatacacatcttgtcatatgatcaaatggtttcgcgaaaaatcaataatcagacaacaaaa

SEQ ID NO: 29211 - DNA, 432 bp, Oryza sativa
  unsure (1)..(432): unsure at all n locations
agcggntttgttgatatnnnnnnnnnnnnnnnnnnnnnnnnnnnnnnnnnnnnnnnnnnnnnnnnnnnnnnnnnnnnnnnnntacgaaaaaaaagttcaactatagatccgattcccccttaaaaacgaaaaataaaaggcaccactccttttgagtccgatataccagccaccactcctctcagtttcaatctataccatgatatctcacctgccatctcttaaaatgcacaccggtgaatttatccggcctcagtgcatcggcaaaaccagccatagtaaaatcacagtgcctataataaggtttttggattgttgagattatgggcatataatgatttaatttattccataaataaatcatgacattacagatgaaaactagcatgaacgcatcattagatctacacatgtaaactacgtagaaaaaca

SEQ ID NO: 29212 - DNA, 235 bp, Oryza sativa
acccttagggctcctttggcagcccaggatcccactgggatcccagcccattccctgggagaaaggcccacgggggaaattgtcacgggttttattccatgtccatttggaagcccacgaggcagggatttcccggcccaatccgcggggaaaccctagggaaaggaccccgaccttcggaggtcgggaatttttcctctctcaatccgccgctgcttctcgctcgcgcaacagg

SEQ ID NO: 29213 - DNA, 187 bp, Oryza sativa
ctatgttcctccttccgtgttggatcagcactattgttagctgacttatccttgtctcagaatcttgtaacatcatattctacaagattgtttccaagttctttgtttggcaattagattgatactatgactttaaaaacaattacaacaactgatcatcgtttggatatgatgttcttttggcaga

SEQ ID NO: 29214 - DNA, 270 bp, Oryza sativa
tccacaaccaatgtgggactattcaacaatctcccccattcacaacattgatgtccctcaaccattcactgccctttcatcgtatccccacggtccctcagatatacaagcccgcaaacatgcacggtccatcaggccttcacacagtgtctctcgggtcagagatgttgaagtagtcaggctttgataccagttgtaggatcgtaaagagcctttctcacctcaaaagctagcctatgaggtgaggggcttccccgtttatatattagg

SEQ ID NO: 29215 - DNA, 235 bp, Oryza sativa
actcctcaactcctgtaacccgtctgtggtcccgctccatacggcagaagatggttaagtactaactgccaccagtaggccctcattcgatacgatttgggaatgttcggccgttcggagccttgcccttgtccacggaccacggatggtggcccggcatacatggtcagacgcttacggttcgtgtgagtgaccggaggatcctactgggcgatcgatcgccggaagatggggt

SEQ ID NO: 29216 - DNA, 1501 bp, Oryza sativa
ggctaactagcatcattgaaagaggctagaaatggttaacacggacagtttgtgttgacctgggcatctggcatgctattagtaacagtctatcagactgccttacagagttatatttatgcatcctactgctgttagtcagtttatttagcgatgatatttttgcattttacgctcacactagccatgaagtagatgtatcaaattcttcaaaattccagacttgctatggatactcgtgcgttcaatgttcagggatagcaaacactgggtcttttttttatagagctaatgtggggtctaagtgtctacaattaagaagtagtgtagccattttatttgaatacaatgcattatattacttcggtaggaatacatgtagcattagcaaagtaaaggataacaaagatcccattctgcctctttttctcacatgtaaaatagttaaaattaaaagtttattcgaattgattacgcatgtaacatcacgataacactttacagagtacttttttttaacctcaattcttaattctattgtttgcagcctctccatcaggtggcaaaaacgctggtcatcgcactatgtcagttggtcttccaggattgatgagcttgttcctagcgttgtggtctgtattggcataagaattttggttccatatcagagatgttatcgcttatgccacagtagaggatttacatgtgacggtgtttgttgattggctgtatcatcattctgtacttggatcagaattcgttttgctgtgtatcaatgtcgcaagtcagaagacttacattgtgttgtacttagacctgtgctgatcaaagcgtaatggatgaattgtttatcttctactcctgctcaacatattttctcgatgtgattgtccaacacaaatagtttgccaatactagcttcaattgcctgtgatttgatcttcctaaaaagttgccttgcgattttgagtggatttcttcctctctgttttttttcctttttgaaaaagaggatttcaattttcagccaagcactgacgacgaaacctacagcctcatccgatggctatgtgcggaaaatacgccatttggcgtattagtaaaaaaaatataatttgtgattaaaacttttacagttatgttcgtagcgacttaaatgacaatcttgtaaaagaaactatgatgaaaaaaactcaaaaacaacttcaaaattaagttaaaaaatttaaatgttggcattggcatatgctgattgggccaaaagatgagagccctagccatcctagttgggctcgttgtgatccgttggatcaagaatacgcggcccacaccgaggagagtaaagcccagagggatagttttccctataagccctcatacaatattgtatttccgtttacaccctgcgaatatttttcgcatccacgttggacttgtcttaaccgttcgatgaaccgtaggcggccaagatagatccaggagagaatggcgaaaggaattt

SEQ ID NO: 29217 - DNA, 1501 bp, Oryza sativa
aataagtggcgtagggaagttggctttgcatttctgtctctatcagggcaaaacgaaacaaagaaaaaacatttaggtgtgaatataagaccaagctccatgatttgggtcgaccagaagtttgtaggcatccagattcctgttttttgcttccccagtcctgtcctgtaataatcgtagtttaatctgaagacgcaacgatgtcagattataccagttcgccttgggtataatactagttgaatgattagtctcagcctaccgttggatatagtattgtagccatttcacatttgggatgatgtttataaatcaactaggaaaatagctaatttctttgacctgatgaaatggaaccatgaaacttaatctagatttgtttagcactgttttgttgtgctggtaacttttaccaaacatcattacaaaattcatttttttttggaagtcacaccagttcgctactatatctgttgtatttggcaaccgtccttttccttagataattttaatacatatatttgtatggttttctgataagtgtcctacaataatattttgcagggaattcccctacgaactctcctccaggtaatatatactttctgaagatagtatgcatggctatttaaacttaagattttcttagcttgttatatgtgcgatacctcactacctgaaactttttgtctggtccgataatttttaatgctatgaatttcaactggaagcagcagcattttgataaagtcatatcagatagatctgtaggaagaaatccctcaacttgagtttgatgtgaacttggaccccaattaaatagatgaatgaattaatatgtatggttagacatgtattagacatggtcccaaggattactgtggactactgttaagcacaatgatttgaaggttcatcactgctgtatgatactacctgtttagaaaatgtttatggtgctaaaaccatagcagttaagacagataataaatgctgcataaagtaggagttagtttggtctgaacaaatttatttaaagatgttacattttaagtcggcaaatcaaccaaataacatgggtgatcaggctaactagcatcattgaaagaggctagaaatggttaacacggacagtttgtgttgacctgggcatctggcatgctattagtaacagtctatcagactgccttacagagttatatttatgcatcctactgctgttagtcagtttatttagcgatgatatttttgcattttacgctcacactagccatgaagtagatgtatcaaattcttcaaaattccagacttgctatggatactcgtgcgttcaatgttcagggatagcaaacactgggtcttttttttatagagctaatgtggggtctaagtgtctacaattaagaagtagtgtagccattttatttgaatacaatgcattatattacttcggtaggaatacatgtagcattagcaaagtaaaggataacaaagatcccat

SEQ ID NO: 29218 - DNA, 1501 bp, Oryza sativa
attaatcatgctttatcatataacaacaacgaaaatacgaattataaaaaaacttcatataagacggacagtcaaagttggacatggaaaccaaggtttgtctttttttaaggacggagggagtaatttctaggcataggtgagacttggtcagaattcagaagtcaactgactggaaggttcagagcagcgtcctgggttagctgttgtagaatttggtagaagtagtgtttactaactgttctagacattattgatcgttaatcatgtgatttggaaaggataaatgcgtgttctatatttccatacagttgctagcaagtgtttttaccgcctacgggggtaatagactgatagtatagttaaagtttgaagcgaaatagagggtttttctatcaactttgcacttttatttacaaataataataataaatgaccatttacaacaactactttggactcatcgcttataagcttaaattaaagttacctaccacataatcatccgatgctaggtgttcggatggatttgtgttgcttcgttattagattctaggtctacgcttcggtgcaaattgttgaaaattcaggcatgtcctctaagagtttgaccacaaacttttctaaaacatcaacatgtatcttttgtgttacagaaaacattcaaacctttatcatcagagggtgcgtgtacaagtacaacttaattacaaaaaaaacattcaaacctttattcagagtagtagaagcagaagccggcattaaagagggagaccataaattggtctgcaatttgcaaagtccttttcaaatagctgaaccttttttatttttaatattgccaaattgatgaatgttgacaaacctggtttgatttggagggaattttcacatatttatatagtagaaatttaaaagttcctggatgtccaattgccaatccccaaaccaaacagaggccgtgtttagtttctcctccaaaaatttttttgacgtatacgaacacacatttgaagtattaaacgtagactaataacaaaacaaattacagattccgcctgtaaactgcgagacgaatttattaagcctaattaatccgttattagcaaatatttactgtagcaccatattatcaaatcatggtgtaattaggctcaaaagattcgtctcgcaatttacatgtaaactgtgcaattaattttttttcgtccacatttaatgttccatgcatgtgttcaaacattttatgtgccggattttttcggaagtttgaagaaaactaaacacagtcagaacctgaaaagtacaattgctgaatgttctcaaatacctgaagaaaaaaaattcctcctttttctataaagcaaaagcttcacagagtccaggggcgcacctacagcaccaagtgtaaccagagcttacacaaaaaaaaggcaccacctttgctcggtgctcgtgggggagagagagagagagagacagatggcgacgcggatggctg

SEQ ID NO: 29219 - DNA, 436 bp, Oryza sativa
aaaacacctgtgaaattgtaacttgtccaaaatatgtgtagttgtattagcgattatgtaatgtccctaataaggtgttcttcacccgaagaggtattttctattcgaataagtgttcttcctctgggaaggtattttctttttgggaaggtgttcttcctcttggaaaggtagtttccactcagaatgagtgttttcccctctggatacttaggtcttgcaaaacctcgtagtgttttgaccgaattggaggaaaaggtgtttgcaccctgctacaacactattagtagttggttggatgacgtggctaattcccgtttcactttgagattaaattttcacttagagagatatgctgaaattgcggcatctaatcattttatcatgttcagttatattttctaactactgttttctcatttgcccgattaacaga

SEQ ID NO: 29220 - DNA, 307 bp, Oryza sativa
tcttcaggtaatatgacagtagtccaggtttttagatgattcgcagcaaggagtgaaaataaattgatcagcactgcaacattgatctttttatgggttgtcgctttagctaccactctgcttatttgcaagctcgtgatattcatactttgaagtcctttcatatgatgctaatttcatattcattgggagcataacatggaataaattaatggtcaaagtatgttattgaacaccatgtaaaaaatatatcccttaaaaaatacatgccttcagtaataataggttcctttatatctctttcagt

SEQ ID NO: 29221 - DNA, 477 bp, Oryza sativa
atgtcttcatcagtctaatacaaatacaaaccatcagccttggaaaataatacaaatcatcaaacatccttcatctacacgaacaaaagacagctcgatgccttgatctcttagttttgaattacagtaatcattacaagttagactgaaatgtaagtcaaaaaagcatcataggagagtttggattcatatgactgagttttgagttttaggtcaaaataaaatggagaaaaaactaccatattgactacggtattgcaaaaaatgcattcttaatacctattatcagcaagatacgtgatgggagccaccatgaaaagggctaagtgcatatgcaacatatatacttaatgcatgttccacgttccttggtaaaaatacctttcttgtgtttctgtttagtatctagctatctaccacctaaaagcgtccagaatacataatggacagaagaacaatgtcaatttaatttctaga

SEQ ID NO: 29222 - DNA, 302 bp, Oryza sativa
acggggcgaggttggagtccatccacaggaggacgacgtgagagtgtccgcagctggagccaaggccaaaaaaaaacccaaagttggtgggaaatgtcaacggcaaccaaagcacaaccgggtaaggaaggggcccccgtggtcctactgcatcctggttagcatccacatcctctttctgattctgtgattcatctctctcacacaggtttcctctccaccgaatttgcttgcattaaccctaccttctcttctacatctggatgaaactcttctcttgttttgtttgttcgtagccccca

SEQ ID NO: 29223 - DNA, 157 bp, Oryza sativa
gaggaggaggaggaggaagtcatggtggtggttcccctcgaggcgcttcccgacgacggccttcctgcagcggcggcggcggaggaggaggacgtcatggtggtggaccgcgtcgaggcgcttcccgacgacggccttcctgcggcggtggccccgg

SEQ ID NO: 29224 - DNA, 1501 bp, Oryza sativa
taaatagagagaggggcaccacaatgtaaccatgacgactacaatgtagcgtagacacgcagggagaggatggcggcgatgccatggactcgtagcggctaggagctatattggttggggaggagcgcccataatcagagccccggggatgtaggcttcggctgaacctcgttaacaaatatcgtgtgttcctgtgtcgtcatctggcatgatcgatgactgaagcgatcgggaaggttagtcgttgttccgctatatcgactaatttttataacaagtggtatcagagcataaggtttcagcattggatcaagaagacatgtggaggaggaaacacgaggtggggattgcgcatcgacaggagatcgtcagccgtggcgatgagatcgatggcgacaacgaggacgttgcggaggcggcgacctcgctcgcgatcagaccggcgatggcagaacgtgaccggaagacggggccgggcgtggccgaaggcgactggagagattggaggggtagcgccatggacggcgcgtccgatgcacgcggtgatcgcggatccgcggcagcaggaggccagtgacgaaagggcgaaaccgacgagcgtggcgcggcgcggcggacgtggagggcctggacgacggggtcgtggatggtgaacacgagggctgcgactgcggtacgtgcatagtcacggacagatagcacaggtgctatcttatacgtacggcgtgcaaagactaacgagcaaaggcaagaagaaaaaccaaatcgagcaggatacaacaatcacatgcgcatggacctggaagctgcagtcttggagattgtacatacttcgaaaggccacgtgtatatgcagttggcttgcattgatatatggctatcgtacagatcaaggagcagcactagcgtctgcatgcatgtgtgtttattgtatggcagggccatgtaaaaaagctgacagagagagattggtgggccaaaagaaatcggctggaggagttggcggaaaaaatcgacttgtcagagtcggatatggctaattcgaccgcagttgttacggaatcagatgcagtcgtgtatggacaccgactcgtggccgcattgatttcctattggttgtgctttaaataggcagccaaggagggagacgaaccaaagcaacaagaagcggcagcgtttttgaaggctacacatctcggcgtcagcaatcaagcgaagcaggtggctcggcgggattggtcaaacgttgtacaaggggccctataggcctactgtgtagaggtacgggtggaccaagccaggccgacaagatcgtgcggagcagaggcacatcgagggcggaagattagtcacatcggattatagcgaacgggggtttgctagtctatatctgagatcagatcacaagacgagattgtgaaaacgaatacatacggtactgagaaaggcgagtattctggtggcgacagaccagtcaggtcgcgggttggcaagatggcgt

SEQ ID NO: 29225 - DNA, 1501 bp, Oryza sativa
ggatccgcgatcaccgcgtgcatcggacgcgccgtccatggcgctacccctccaatctctccagtcgccttcggccacgcccggccccgtcttccggtcacgttctgccatcgccggtctgatcgcgagcgaggtcgccgcctccgcaacgtcctcgttgtcgccatcgatctcatcgccacggctgacgatctcctgtcgatgcgcaatccccacctcgtgtttcctcctccacatgtcttcttgatccaatgctgaaaccttatgctctgataccacttgttataaaaattagtcgatatagcggaacaacgactaaccttcccgatcgcttcagtcatcgatcatgccagatgacgacacaggaacacacgatatttgttaacgaggttcagccgaagcctacatccccggggctctgattatgggcgctcctccccaaccaatatagctcctagccgctacgagtccatggcatcgccgccatcctctccctgcgtgtctacgctacattgtagtcgtcatggttacattgtggtgcccctctctctatttaagagagatgccgggttacagagtccgactctaactccaccccctaacacctattacaactccaagtccactgtaaccaaataggactagtatattcgacacctattctaacagagcaagccgaggagtgataaagaagtaaagtggcggcgatggcaaccacgtagcacacggagctccatacaactctagccaaactaccaacgaaacaatggcgtcttttgtaagcattgtgtcaagggaaatgcctagtcttttgcaactcgtatatctgaaattctgaatgatgatggggggcctttaactcgacactaatacacaatttgttcaccacttttgctgcctgaagctattatcctttgcatgtcaccaaatgcttcgtcataacttgttaatcgaaacgttaattaatagaaacagttaccccatgaaaccaattttgcattgcacacacaatacacgaacatgaatcatgcttttgcagcacacgtcccacatatagttttgataatggttctgtacacggtataagttttaaaattgttcctccaaaagaaaagcagggaagaaaaaagaacaagtagcagctaccgtagtagagcctgcagaagaaggcaagggagagcaaataaggcaagaaagagcaatagggaaaaagatcgagtggcaacttcggctgtgttgagatctagggtgaaaagttttagtgtgtcacatcagatatacggatacacattttaagtattaaatatagactaataacaaaataaattacagattccgcctgtaaactgtgagacgaatttattaagcctaattaatctgtcattagcaaatgtttattgtagcaccacattgttaaatcatggagcaattaggcttagattcgtttcacaatttacacgcattctgtgtaattagttattttttcgtttatatttacatg

SEQ ID NO: 29226 - DNA, 241 bp, Oryza sativa
gcatgcctggaggtcgactctagaggatccccccgtgaagcctttgtaatgatctgagaaatcctctccaagtctatccgatgggtgtccagtaacaatcttgtaaccacataggctgtgtgaggtgtttagtgtctgcatttcattaggtcagcacatggccattcatgaacaaaagacatgggggataatagaggctagagcttctgacatcaaaccttatgggctaaatggagaaaaa

SEQ ID NO: 29227 - DNA, 1501 bp, Oryza sativa
  unsure (1)..(1501): unsure at all n locations
acaatgtggtactaaactccatatgcatgccatcccatgaggtgggcttttatgattttctaaagaattaatcttcgaatgggccttagcccatctattaattccaacgctctttgccatcatcattattattatcagtttttacccaaactccggcataactgttcaattggccggggcttaaattgaagccataaacatccatcgttactataaatccatagtagccatcttcttttggttgtgttatataccctaccatctgaaaaaaaaacatggggcagatagataaataagtatttcataaatttatagtaggtgaaaaatgattgattcgtaaataaaccactttacggtgagtataagaaattaccatactaatagaataagaaaaaaaggaaagcactatgtttattgtggtattgggattatattggcatatactccctccattttataatgtaagccattctagtattttccacattcatattgatgttaatgaatctagacatatatatctagagcaattttacggtctttgaggagggtacctcatagtacttaggtaagtactaaatttataatagaaaaagtggtaccttatgatatctcctcaaggaccgtaaaattgctcatatatctatctagattcattaacatcaatataaatgtaggaaatgctaaaatgaattacattgtgaaacggagaaagtattaatgatcaatataaactaagtgtataagaaattatatactacttcctccgtctcataaaaaaccaannnnnnnnnnnnnnnnnnnnacggagggagtacgtacttacagaaataacgtacttacaaataagaaacaagagttatataccaaatgcaaaactgtttctaaatatcacgtcaaaaaaaaactgtttctaaataaactttggtcttgctccgtggaaaattcaacagtagtaagctttgaaaagaaaactcacgtgaacagcctcgctgtcaacagcagcacggttcaatggctgcacccagtttgatctgtgaacaagctctgcaccacccctctcctgatgaaccattaatcccaaggttacatgacttgtttcgaaaacgaaacaaaaaacgtatgttgaaaaataatcctttttttcgaacgaatttgcatcagaatgcgctcatggctatagcatacacctaaatccactacgcaatgacgatgcaccagcaatgtattgcttaccgatcggttcgtcgaaagcacaggaagaatcatcagcaagcagatcagaaggaggccggggattgtcgccatctcgtcgatctcaatagttagcaataggatttgtagcgatatgtagcaaatgcaataggtcgccgcgtggcttatgtaataatatataggttgccgtgtttgatacatatggaatgtgttcttttggaagaaaaatatgggaaatatggaaatcattttgaatgaaatatggaaggcgactcacgcttcaagg

SEQ ID NO: 29228 - DNA, 1501 bp, Oryza sativa
acccctatactgctcttatcttcaacgagcggtcccgctttcaatgcgggtcgaaccctatggttacccggatggttgaatgctgttaacgagaatagtaattcgcttttcttaataataggacccggagatttcttggttcatcatgctattgctttaggtttgcatacaactacattgattttagtaaagggtgctttagatgcacgcggttccaaattaatgccggataaaaaagattttggaaatgaggggctgtttagttcccaaaaactttcccaaaaacatcacattgaatctttgacacatgtatgaagcattaaatatagataaaaagaaaaactaattgcacagtttgcatgtaaatcgcgagacgaatcttttgagcctaattagtccatgattcgccataaatgctacattaatccatatgtgctaatgacagattaagtagactcaaaaaatccgtctcgcggtttccagacgagttatgaaattagttttttcattcgtgtccgaaaaccctttccgacatccggttaaacgttcgatgtgacgtccaaaattttttatttcaccaattaaacgggcctgattggattgacacttgttctgaatattttatgctgcatttgtgatttgagcagtcgttcagattttgcaactgcaagaagatccatatagtactgcacaaaacgctaggtagctggtcctttttactcttctcttttcttgattagcttgtcttttactcatgtatcccagctagccccattaatgtgacaacaaagacagcacgaaacaagaaacctatcacaatggcttcgtctcaaaatataaatagtgacaagttaaacaactttaactttaactattattaatagcaaaagaataaaaaaaccaattatataaaattcatgttactagatttatccttaaacaaaaaatcataatatgtaactctttttatttaaacatatttcttttatagatatttttagtaaaagtaaaaaaacagttatattttagaacggatggagtttttttttgggtgatagaacgtgagtacatatacgtcagtgctaacatcacatgcattccattattgctctctgcaataagctcagaaaatctactttgcaaatctaatcagacaactgacaaaattaaatttcaagtggactaatgacaacaacaggtgatattgaaagatacttgataattatctacctagatacttaaaaaaaacatatgcgcgtgcttcctgaaattaattaaccattggcaactaaaaccatatgcgcgtgcttcctaaaaccattggcaactagtctatggagtgtgtatatatacagaacttatggacattagacaatcccgatcacccacaatctttgcaacaatcatctctgaaacacgtacaaattgaacagctagcctccaaatcctccctccatggccaacgcagccaaccaacacacctgcgatggccctcaaccgt

SEQ ID NO: 29229 - DNA, 1501 bp, Oryza sativa
acggtctgaccggccacatacctccggtcagaccggcagagcactgagttgggggatttcgcccccaacggctagttttggttggtgggagtataaatactccccttcagcagcaagggggctctcttggcacccaattcaattgcataacaccctttgcacttctctcacacacatttgagcttagtgttcatccatggtagtggttggaggttgttctagccaagagtcaagtgcattttcttccattgtagagttagtgtgcacttgatcatcttcgagccgggtcatcgcttgttactcttggaggttgccacctcctagacggcttgtggaggtgttgcccggtgacctctccgagaagattgtggaggaggcccggtgccggtttgtgagtggcttagttagacttgtccctcaccgagcctagcaacttaggttagttttgattaggtatcatttaattttaaatcgcctattcacctctctctagtcgacatctcgatactacaactgtctgatccaaagatagagaataaagctaactagctaaggttgttcctgacaatcaaacttgttcctgacattacactatctcacctttccgtcactaaggtgacaaactaaagctatatcgtctctcaaaatatcgttcagatggtcttccagcatccttttgtagcattcatccaaaagatcgttcttgttgagatcaatcgcaggctgtacagtgaaatcagattagaaacataagcatctgtcttaacagagaaatcaggcagcccactagtatgctttcctaagactatattcctcaattaccaaatcaaacacgtctgcaaattgaggatttcgccgcgccgagccgctggcagcgccgccggccgcgccgccagtgatttttgccgtgccgctgcctgccgggaggaagcgaaaacctgcatcggggagatgcggtgcatgcgtcggggcgagatacaatgcgtcggacctgatgcgaagaagcgaagaaaacatcccataccaaaattatccctaaactatattaggagattactaatctatcttataaaattaacggtcgagattaattctacttgtagtagaatacttcaagtagagagcaccggagcgtaactcaagaagaaaagataggtcctgtttagatcccacctcaaaattttttaccctgtcacatcgaacgtttgaacacctacataaagtactaaatataggctaaaaaaataactaattgcacatattgcgactaatttgcgagacgaatcttttaagactaattgctccatgatttgacaatgtggtgctacagtaaagatttgctaatgacggattaattagtcttaataaactcgtctcgtggtttactaacggattctgtaattagttttttattagtacccgaataccccatgcgacaccctatataatacttaatgtgacacaccaaaactttacgcccctggatctagacacccctata

SEQ ID NO: 29230 - DNA, 1501 bp, Oryza sativa
gagcagtataggggtgtctagatccaggggcgtaaagttttggtgtgtcacattaagtattatatagggtgtcgcatggggtattcgggtactaataaaaaactaattacagaatccgttagtaaaccacgagacgagtttattaagactaattaatccgtcattagcaaatctttactgtagcaccacattgtcaaatcatggagcaattagtcttaaaagattcgtctcgcaaattagtcgcaatatgtgcaattagttatttttttagcctatatttagtactttatgtaggtgttcaaacgttcgatgtgacagggtaaaaaattttgaggtgggatctaaacaggacctatcttttcttcttgagttacgctccggtgctctctacttgaagtattctactacaagtagaattaatctcgaccgttaattttataagatagattagtaatctcctaatatagtttagggataattttggtatgggatgttttcttcgcttcttcgcatcaggtccgacgcattgtatctcgccccgacgcatgcaccgcatctccccgatgcaggttttcgcttcctcccggcaggcagcggcacggcaaaaatcactggcggcgcggccggcggcgctgccagcggctcggcgcggcgaaatcctcaatttgcagacgtgtttgatttggtaattgaggaatatagtcttaggaaagcatactagtgggctgcctgatttctctgttaagacagatgcttatgtttctaatctgatttcactgtacagcctgcgattgatctcaacaagaacgatcttttggatgaatgctacaaaaggatgctggaagaccatctgaacgatattttgagagacgatatagctttagtttgtcaccttagtgacggaaaggtgagatagtgtaatgtcaggaacaagtttgattgtcaggaacaaccttagctagttagctttattctctatctttggatcagacagttgtagtatcgagatgtcgactagagagaggtgaataggcgatttaaaattaaatgatacctaatcaaaactaacctaagttgctaggctcggtgagggacaagtctaactaagccactcacaaaccggcaccgggcctcctccacaatcttctcggagaggtcaccgggcaacacctccacaagccgtctaggaggtggcaacctccaagagtaacaagcgatgacccggctcgaagatgatcaagtgcacactaactctacaatggaagaaaatgcacttgactcttggctagaacaacctccaaccactaccatggatgaacactaagctcaaatgtgtgtgagagaagtgcaaagggtgttatgcaattgaattgggtgccaagagagcccccttgctgctgaaggggagtatttatactcccaccaaccaaaactagccgttgggggcgaaatcccccaactcagtgctctgccggtctgaccggaggtatgtggccggtca

SEQ ID NO: 29231 - DNA, 594 bp, Oryza sativa
ccctacgattaaatacgatcaacggcgcggattactttctactgcaaatagaaagcattggagtggggctctttcttctttcgtttctattcatgtacagtttagaaatgattttttaaatttgaaattttatttattgaaatttaaaaaataatttttggtttcaaagttttacaaatctacacccctaaacctttctatgacgttacaacgcaccaatgaatatgtgcccgtcataaaaaaaaacctgtttggaagagagagcgttaggggtgtaaatttataaaactttgagaaaaatattttgtaaatattttaataaataaaattaaaacttgaaaaaaaatcctgaaaaaaccggggaactgtctactggagtacagcccatcaaagagacgaggcccatagcccatcggccaccacaatccttctcgattcttctgctctccaccgagaggagcaaggcgaactgcaggcggagaggctgggccacacgataccctcctctcccttcccttcccttgccgcttccaactccaagtctcgctgtgatcaggagctagggtttgtgcgatcttcgggaggaggggaaga

SEQ ID NO: 29232 - DNA, 787 bp, Oryza sativa
tcttgtttatgtaattcgtcgagttatcatatatcctatataatctttggcaatatcgttatctaaccttcaatcggctaacgtctattactagaaggcaaccgattaggttatatatcgacgttgacttagattatataagatatctaccactctatgaaacaaccagcggcttgattgtttagatattgtctttcttttcatacttatagctgtatcagttgagtttgaccttataagtcgtgattagaatattaatctctagcctgctttctggttgccgattagagtagcattggggtttcagccgatcttacctgatttaactactttacgttccatatgcttgattgatatgttaaatctgcctttatgttaagatcttgttacatttaagtatattaggcttctgtttagtatattttactttctttaatatcttaatatagagtggtatcggagtattaaccgatacatgctagatgtatctgatcggctatgctatgaacatatatagtctcgttgttaatatatatttcaatctaagtggtttatactgtctcggcatggcgaccgatttatcccaatcacttgatttaagtatatatcgacatagggattatatatcgttaatatctatagccgatcgagtagatttagttctttcctacttattcacgattgccgatcgattcacatatgacatcggctcaaagataaatgatatgtcattggcaactagccgatcagctatagtttacagatttaaccacggtttctttgtctt

SEQ ID NO: 29233 - DNA, 199 bp, Oryza sativa
ttcgatattagatttggtactggtaatactgatttcagtgtacttgaatgtcgtggttgctatttttgattgtcgttgagacagatactgcctactttcctaaatatttgacaccgttgatttttttaaacatatttaaccactcatcttattcaaaaacttttatgaaatatgtaaactatacgtataaataaaaata

SEQ ID NO: 29234 - DNA, 1501 bp, Oryza sativa
ggggcctacttttcatcctcacctccctcattgtccttgtcttacgtagctaggcggtgacagcaggcggggatgctgcgggaggcggatgagagggcagcggagggcggcagaagagtgccgctcgacggcagaagagcgctgctcggtggcagacggcaggaggtgaaggagagggcaacaacgggcgacagaagcgcaccgctcgacggaggggctcgagggacgtccgtccccggcttcgccgacgacagcgataatagaaataaattatctcttcaaaatagaaggtgtaagagtcttattcgcaagagataaggtctgttcagccctatatcgaaataagtttcttcgagttctacttggagagggagacatctatcagtgtaaatacaagtcccttccatggagtagcggatcatagccaccagccacagtgagaagtaatccgtatgaaaccatagccttgttcaccgattagatctcgtcgggccattcttggcagacgcattgtaatccttttggtattcccatcatcatccatataaattggagtatagctattaccttttgagggacctgaactagtataaaccattgtcttcgtctgcttgatataatctcgtgtacatagcccctagtacaaacatttccctgtaccctccgaatctggtatgtgggtataacccgtcgatgatatcctaaaatatttacatgcctaataaacatgtcttaggttgtgttattctctcaactttctcaacctctaccctctcgttattcacgtggatgtttcccaaactacccaatggtgtcttttttgtaaaaaaaaatatataataaagttgttttaaaaatccatattaatattttttagaaaacattaactaatacttaattaattatgtgctaataagttgctttgtttttatgtgcgcgaaatattagggtctgtttggtagagctccaactcctaaatttagcttcaagagttgaatttagagtggagctgtggaactgtctaaacctagctcaacatttttagatcattttgtaatagcgctccacccatccattttaggtgtagttaaactatttgcctagactcagctctagaggaggtggaggcaaaaatgtgctaaactgatccttagtttctaagtcgaacatggcctaaggcggtgttcggcactgcctgttctcatcctctactccttcgttttccgcacgcacgctttccaaactgctaaacggtataattattgcaaaaaatttatatagaaaaattgctttaaaaaatcatactaacttattttttaagttttttttagcaaacacttattctctccgtccgataaaaaacccaatccaagattaggttttttatggaacggagggtgtaatttatcatacactaatccatccgtgcgggaggtgagggttcccaaccctcacccaagaatacagcctaagtgtttaggtgtctatttgtaaaacactc

SEQ ID NO: 29235 - DNA, 713 bp, Oryza sativa
ccatacaatttaggtctcatagtagtatatagatgttcggttttactgacgtgcatcctagtcagaaaaaaatataaaaaagtatgtgaggtctacatgtaagtgaaaagagaaaaatgtgaggtctacatctctttttttctttaattttctcttttcttttattctcttcttcagttcccggcggcaaaggggtcagaggcagcagcgaatcccttgtcttcctctgctggtgcttcggcgccgagtggctcctctgccggcatcaactggctgcgtcctagccctcctcgttgctactccacctccccactgctttcctcccttcgggtgtccacctcctcctcgttgctactccacctccccttgctcggagggatgaccggcccgacgatcctcgtgatgcctctgtccccgccaatgtcgtcaccattggcgcagccacctgcccggcctacacgctacgactttctcaactccaagctgttgttctgccgccgccgccactgcccccgccgtcgggtgcggccgtgggaaaccacccggggatgacgacgtcatcatcttctttcttctctcttcttcacaagcttgggagggagggggaggtggccggcaggagtgtgtgagcgcggggcggcggcggacggagcaggcacgatgcagacgatgcgcacaaccaccgcctagtttcttcatgtgcgctcgcctgc

SEQ ID NO: 29236 - DNA, 1501 bp, Oryza sativa
ccgttccataaaaaacctaatcttggattgggttttttatcggacggagagaataagtgtttgctaaaaaaaacttaaaaaataagttagtatgattttttaaagcaatttttctatataaattttttgcaataattataccgtttagcagtttggaaagcgtgcgtgcggaaaacgaaggagtagaggatgagaacaggcagtgccgaacaccgccttaggccatgttcgacttagaaactaaggatcagtttagcacatttttgcctccacctcctctagagctgagtctaggcaaatagtttaactacacctaaaatggatgggtggagcgctattacaaaatgatctaaaaatgttgagctaggtttagacagttccacagctccactctaaattcaactcttgaagctaaatttaggagttggagctctaccaaacagaccctaatatttcgcgcacataaaaacaaagcaacttattagcacataattaattaagtattagttaatgttttctaaaaaatattaatatggatttttaaaacaactttattatatatttttttttacaaaaaagacaccattgggtagtttgggaaacatccacgtgaataacgagagggtagaggttgagaaagttgagagaataacacaacctaagacatgtttattaggcatgtaaatattttaggatatcatcgacgggttatacccacataccagattcggagggtacagggaaatgtttgtactaggggctatgtacacgagattatatcaagcagacgaagacaatggtttatactagttcaggtccctcaaaaggtaatagctatactccaatttatatggatgatgatgggaataccaaaaggattacaatgcgtctgccaagaatggcccgacgagatctaatcggtgaacaaggctatggtttcatacggattacttctcactgtggctggtggctatgatccgctactccatggaagggacttgtatttacactgatagatgtctccctctccaagtagaactcgaagaaacttatttcgatatagggctgaacagaccttatctcttgcgaataagactcttacaccttctattttgaagagataatttatttctattatcgctgtcgtcggcgaagccggggacggacgtccctcgagcccctccgtcgagcggtgcgcttctgtcgcccgttgttgccctctccttcacctcctgccgtctgccaccgagcagcgctcttctgccgtcgagcggcactcttctgccgccctccgctgccctctcatccgcctcccgcagcatccccgcctgctgtcaccgcctagctacgtaagacaaggacaatgagggaggtgaggatgaaaagtaggccccacatgtcagtgggcccaaaattttttttgaatgacaaatggggcccatatatatatatatatatatatatatatatatatatatataattctaatgtcatataagcg

SEQ ID NO: 29237 - DNA, 1501 bp, Oryza sativa
tgcgttgtcaggcaccgtgtctttcatagctgcgcgttctctgctcccacatttcgggcaattaatccaaaagtttttttcttggaagaaattcatcatgcatcttgagtttggttgtgactatatgcaaccaaaaactcgaaagttgatcggccaaacctccaaaatgatccactctgcttgggactgatgcaaggctccagcctcttcggaagcaaattgacatgtttatatctgaagaagattacagtgaaatgcagccatgctggggtaggaatgttagtttggtggtcttgtgctttgcatgctgcacgtggcaatgccgcaagctaactgatgaactagttttttctgccaaataaaattgcaggaaattttaatattaagatgaaagatcagtgcaatttaaatacgcgctagttcggctgaactggttgtcagtttgacaatttcaggataggacagtcgttaaatgaaattcagaagcacctttattcagaaagccttttggacttaaagatacaatccgccagtttgcactagatcattttgagtacaagataaccgactattttagattgagcatctacttcaagataattcaagcaagaaccatgtgagtgttgcattattggacaccaggtgtcctcagattatgcatttgacactaattgggccggttatctattttcccattagaaataaaagagatttgtattccacattaagatgtctgaggatcttgacatcaacctattttttttacacgacatcaacctgttaactgaacatcatagtgtcagacttggatgaggaacagtaatgcagaggcaattagcgcccagttatctttcatgccgcgagcttgcattccacatttggaaaaactttccagggttgcactgcctaaccaccctctgatttacactcaccctagtgcctaattcttttctccatttgcctttcatgacaacccaaacccagcttcaaatttggcacaagcgagccttttcccctacgcgtatcagaaaaatgccatttcccagctagtatatgcacggttatttggcacgtgcaacctctgcaatataatcatccgaattccatcacgtagatttctgatttatcgcatattttcacacgttcgaagcatgccggaattcattttcgacgcacgtttcccaggcttaaactggccgtgtcgaattaggctcacattccggtacggcccatttgtccattcggcccatgtccaacacgccccacgggccacggcctgatactcctctaaaaaagcacgtgctaaaaatatccccaattcgaaaattttctcacggcgtcgtcgcctcgccggcgaggtgggagatgaagctctccgctaccttccgatcggcgaagatccctcgcgctcttcctcccaaatccggcgagcccgccgccgccgccgccgccgcgtcggcgtcgtgcgcgcccggtagttcgccggcggaggctgcgaagg

SEQ ID NO: 29238 - DNA, 1501 bp, Oryza sativa
cggaatgtgagcctaattcgacacggccagtttaagcctgggaaacgtgcgtcgaaaatgaattccggcatgcttcgaacgtgtgaaaatatgcgataaatcagaaatctacgtgatggaattcggatgattatattgcagaggttgcacgtgccaaataaccgtgcatatactagctgggaaatggcatttttctgatacgcgtaggggaaaaggctcgcttgtgccaaatttgaagctgggtttgggttgtcatgaaaggcaaatggagaaaagaattaggcactagggtgagtgtaaatcagagggtggttaggcagtgcaaccctggaaagtttttccaaatgtggaatgcaagctcgcggcatgaaagataactgggcgctaattgcctctgcattactgttcctcatccaagtctgacactatgatgttcagttaacaggttgatgtcgtgtaaaaaaaataggttgatgtcaagatcctcagacatcttaatgtggaatacaaatctcttttatttctaatgggaaaatagataaccggcccaattagtgtcaaatgcataatctgaggacacctggtgtccaataatgcaacactcacatggttcttgcttgaattatcttgaagtagatgctcaatctaaaatagtcggttatcttgtactcaaaatgatctagtgcaaactggcggattgtatctttaagtccaaaaggctttctgaataaaggtgcttctgaatttcatttaacgactgtcctatcctgaaattgtcaaactgacaaccagttcagccgaactagcgcgtatttaaattgcactgatctttcatcttaatattaaaatttcctgcaattttatttggcagaaaaaactagttcatcagttagcttgcggcattgccacgtgcagcatgcaaagcacaagaccaccaaactaacattcctaccccagcatggctgcatttcactgtaatcttcttcagatataaacatgtcaatttgcttccgaagaggctggagccttgcatcagtcccaagcagagtggatcattttggaggtttggccgatcaactttcgagtttttggttgcatatagtcacaaccaaactcaagatgcatgatgaatttcttccaagaaaaaaacttttggattaattgcccgaaatgtgggagcagagaacgcgcagctatgaaagacacggtgcctgacaacgcatttcccgccgttttcaaatcaacagaagcaactctgagctttccctccatttctcatgctccctgcgtatataacaagctccatctcggatcgagcgcatgcagcggtgacacatggcggcttctatctccggagctcgcacttgctaccctagcgcggcggtggcgcgacgtggcggcggcggcggccggtgctgctccgtcgtcaggagctcgctggcgacctcgtcgccggcgacgtgcaagccgtcagggatgatgcggattggcaggcagtgga

SEQ ID NO: 29239 - DNA, 359 bp, Oryza sativa
tattcagatccattgtagtcagaggaggataattaattccctttttgcagcatttcaagtcaagtttgcagaatctgtaatcatgttaaagtaggaagtgataaactgataatgattaataagaatcttctttttggacctagaatgattttttcacacccctgggccctggctaaaccagataccaaacctggccacaaagtaccaatttttgtgcacttaataaaaatccccattttttttactagtgtggccctgtcatctctcgcactgctccgctaggatgggaacccgtcactgataaatcagatgcagttacaactacttccagcattcctctctctttagggtcttatgga

SEQ ID NO: 29240 - DNA, 382 bp, Oryza sativa
gttagaagcgttggccttggttggtctggccaatctaggcaaaccatctgtgcctgacggcgttgttctgggtatgataggtgggcccatatggtagtgcactgtggatttgctcaatttcagtcggttttgactaacatgtgggccctccaatccatatgctcgcgtataatttgtcggaggtacacttcgtcgtatggcgggtgtattttcatccaaaattacttgcatacaaatatttaccaatagttatggaaatggttagtaataatctcctaccactatgtttcatactttattttgtattctttatgtaggaattgatggttaaagttaatgactgtcaacagtggcataagttcgaagtttagtgatcctaagt

SEQ ID NO: 29241 - DNA, 376 bp, Oryza sativa
tgaaatatgaaattttaatagttgaaacatttatactatttttcatcatgattataatatatgttgttgtagagttttaattgaaagacattcaatagtgtaatggaattcaaatcagataagtagtttagagaaaaaaattgtatgtatgcatagatgaagtcggagtatagacaattgcatgggtgcccgatattttgctagcatattaagaagcaaattgcgaagctgcagaatggtttcatataaagataatagtacctccattaagccattaacttggactatagaatacactacataaatacactcaaatttgggaaattttggctcatagcaaacaaaagttgtgttagtacaactagcaaatcccaaa

SEQ ID NO: 29242 - DNA, 364 bp, Oryza sativa
cgaattcgagctcggtacccatctgcacgcacatgcggtacataccgatatacgcgtccctgcacatcaatcttcaaattctcgatcggctagctgctcattggtgccgagcgtcgcgcgcattcttgtcctagtcgccggagcatggcgaccacaggacgattgctgctgccccacgacatgtacaggaggctgcaggctcccacggcagcggccgcggccgcggccgcgctctttattttggcgccccaccttccagaggcctaacgctgccgctgccgtaccggaaggatacagcaacggtcgcttcggctccgtcccggcgtgcagcgaggccatcgccgccttggaggagacgtcggcc

SEQ ID NO: 29243 - DNA, 243 bp, Oryza sativa
ttggtcaagggaaacaattttttttacaccacattattgctaatctgtcatgcgaagcttcagagtttcagtgatggaaaacaacaggtttttttttcagatgggaaaaacagcagctgcaagagttttgaggagaaagttcggacaaagaaaaaatcaatcaatattttagcagcatactgaaccaaggtaaccaattgaacaagtagtttcagtaaacatgtatgcacaatgcaaaaggat

SEQ ID NO: 29244 - DNA, 1501 bp, Oryza sativa
tttttccaaacccagaagagaagcccctagatgatgaaggctttggtgtctagctcgtgcctgccgtcaagtgcctgtggtcgtcgccctagtcttccgctgtttttcgtttgtcttcttgtgtgctgggtcttcgccgcctatgtaataaattaattaattacgcttccacttgttaaactctgaattgtatcaacttttggtgtaccttgcctcctaggacaaggaataatgcacgcacgtaaggaacgcccgttgggttatttccggtcgtgacaagttggtatcagagccccttgaccctaggacgagccttagatcccaagccttagcaatattttcaaaataaaaatcgtttcttatttgtgaaaatcctctagtctctctctgtcctgctgcttcatttatcgtcaaaatctaacctttaaaatgttgcttttctcttttgtttttgtttgtagatggccggcagcatcaaccgtcgtggtctggacctgactgcggggcatgtgcgttgtcttggggtatccgcatggagtggactaccagggcaagcaactcccggagcaagagggtgacgatgcagagccccacgctgcttgggaggtcactgtagtgatcctcactggctcacccgagaggacctcgttggcagtcaccgcgggtggagattctttctccgccgcttgccagaacgccgcacccctcgccatcggcactcttcaccagcgctacccggacgagttgcagcactcgccctaccgctaccaccctcgtcgcggaggagcccacgactacgccaccttcagggatgctagctcggaggatgacgctaccatcatgcacctggcgcgcatggtggacacgtatgacgcggcccgtatcgacttccaccagatggtgcgccgcgggttggtcgagaacaacatgaagatcctggagctgcgtcaggagaatctgcagctgaagaaggacctagacgtagtggaggcgcagctgtgtcagctcaagatcgcccagggagaggtctgtcgccccaagcgccgccgcgtctaccgcagcctgaagatcaccgcccgcaagagtacctccaggcctgagcttgttcgtcagtccttggcatggacctgttttgtcgagacccctcgtgccgagcccgcgcccgtggttcctcaggaggagggagcctctggcgttggcagcatggaggatgcgctactgctcaccttccgccctggcccgtcgcagaagtagacgagcagttagtaggcttgcgcgtgtgttcttctcgtttgtttttctgctagagtcgtgtggggcatggttataccggtgtgcggtataactgtgtcggagcctgtctttattttattggcttaagcaacttgaaccttaatgaacccattttatatcagtaataagttcaataattttggtagtcgtgggtgattagctttaatagtctgttctctctcttggctggttctgtatgggatatttc

SEQ ID NO: 29245 - DNA, 231 bp, Oryza sativa
atcatatagcttgtccttctgtcgtagttacaatggtccattgatagtagctgacgtagttggcatagagacaggatgaccaatatagatataatattgcccaccagaagtggcaaaaatattgatggtagtgaagatagtgataccaatcaaaagtgatgaagttgcacaactgtggaggcgaagaaaccggtcggcagcagtcaggtcagccagcaatgaagatgaagg

SEQ ID NO: 29246 - DNA, 1501 bp, Oryza sativa
gagtagtaagttcaggttgaatccccaaaatatttagtggactcagtgttgcatagtggaagtgtatgttaactgaatggctatgatacaatggtgtaccaaccattcatagtatataaaatacactcaagtcttcttcttgaataataatcgtaattactaaaaaaaatgaggtatcgtccaacttcccactcctgcttgtatcagagctggtgcagcattgcaacaaagatacacttatgaaataaaattgagtatggcgtagtcattcctacgatgtattatcgatcatgttacagaagcaaactattcatacaaacaaatacttgatctccattaaactataatttctgacaattactagtttactgaacataataatctgccacccctgcgacttaagggcggattctcttcaaatttctccatcaccattataaaataatacgaatagaactctaaaaccctccacaaaaacatctatagacaaattttccacagcgcaagccacctgaaacggcacatcctaaaaccctcccaatcccccttgtgacatctcggcgtgcgcagaggtggcgaagaagagcacattaaaacttcacaacaagcaccacgagaggaagcatagaaggattctcaccccgagccacggctccgcagccgccgccttcgccgcggtcaccacgggcagcgacagcgccgccgccgggcaccgccgccgcctcgcggccgacgccgccaccgcggcgacgcattgcctcgacgcccgcgcgaggaggcgcgacgccgccaccatctggtcggtccccctctacgtacgcccgcggccgagtcgagggggggaggatcggagcggctcggttggcggcggcggcggaagcttctggaagagaacggcacagctttagcttgcgagaggggaagaagacgatgttcgtggaggaggaggggaaaatgactgttatgcccatggacatttggacacggatgcggtgtgtgtagccaataggtccaggggtatttgcgtctttgcacagggtggttcatgccatcaacttatcgcgcaagaagctttattaagaaaatgcgaatagtagggagtgatataatttgtctagcccatcattttgtggagctagccggaagattattgtgcggttctccaaaagctttttagatgtgttcgtatttgtatagtgttgttttattattattgcgagtattaatcagagtaataaggtaatagtatgaacagtgagatcattaatttacattaacaaagtaagcgatgccggtaaagaactgcaacttgtaaaacgaatctaggtgctccggttgttttgctacagaatgttcttgtgacaaggggtggattagcctttgatttgatgagctaatacagacctatggtgataaaaaaaaagtatgtcagagtctttatgctacctagcatgaaattaacaaaaaaaaaaaaaacaggcacgaaattgactggtcataa

SEQ ID NO: 29247 - DNA, 1501 bp, Oryza sativa
gccttcttgaggaggccgtgcagcggcggtgtacaatggtggcatcctgcgtttttgctggctattcttcttgctccgcaatggcggtaaacggcgtttccccattgtttccctttatcctctcattcagaccaatctcgcattttgagtgcctaaaacatcaaagcaaatatataatgccttgtgctgaaaaacaagggatgtatgaggagtatcgtacaaatggtaagatgaagaagaaaaaagaagttcagtaaaagttggctgatcttttgcatgctggttatgtactaagtaaaaacacactagtgcttgtggaatatttttttccagtttaattcgtattgccttgttagtacatatgtctgataaataaggtactgttttcatcctcctagtatgtactgtcagttcagtcatgtttaggggatggtatggaaggggaaaacagtgtgataattgcaaacgcctctctcttcttcgagtctttttttttttgtcatacttggctccattctcttcttaatataatgatggatagctctccagcgtgttcggaaaaaaaaaaacaactacgaacacctcatttcaggaatttgggtccccctccctcaaataggatactatttcgcccaaaattttcaaaaaactattttaaatttggtaaaatgtttttcacgtttttaattattccggacattctaaaccacgtttaaaattttttgacagttttttttgtgatttccttaatatagaatagaaccctgctcatatagtttatgaccagtcaatttcgtgcctgttttttttttttttgttaatttcatgctaggtagcataaagactctgacatactttttttttatcaccataggtctgtattagctcatcaaatcaaaggctaatccaccccttgtcacaagaacattctgtagcaaaacaaccggagcacctagattcgttttacaagttgcagttctttaccggcatcgcttactttgttaatgtaaattaatgatctcactgttcatactattaccttattactctgattaatactcgcaataataataaaacaacactatacaaatacgaacacatctaaaaagcttttggagaaccgcacaataatcttccggctagctccacaaaatgatgggctagacaaattatatcactccctactattcgcattttcttaataaagcttcttgcgcgataagttgatggcatgaaccaccctgtgcaaagacgcaaatacccctggacctattggctacacacaccgcatccgtgtccaaatgtccatgggcataacagtcattttcccctcctcctccacgaacatcgtcttcttcccctctcgcaagctaaagctgtgccgttctcttccagaagcttccgccgccgccgccaaccgagccgctccgatcctccccccctcgactcggccgcgggcgtacgtagagggggaccgaccagatggtggcggcgtcgcgcc

SEQ ID NO: 29248 - DNA, 484 bp, Oryza sativa
ggcctgcctagaggaagatgagtgagatagggaaagagagaggaggaggaagccagagcctgatgacgtggcgtccagacatgtgagtcccacgctgactcaccagtcacgtaggataaaaatcagggtcaaaaccatcgaatgatgtaaaacaaacggttttataagtttttgactgttttttagaaaaaatgcagcgtcataaatatagattaatcttttctttgtagacatatatgaaattctgacacggagctttggtgctcactgtgtcttctgcgagtgataaatcacatactctctatgctgaaatggtgcgccgcttgcaactattctggaatagttaattgctgcgaatatgctacaatatacttatgtcacgtcggtaaagatgcatgcatgctaatatttttaacaaaaaaaattaagtggtcggcgattgctcttgcaatttgcagcagtcgcaacttgcgaacgacgaaca

SEQ ID NO: 29249 - DNA, 1501 bp, Oryza sativa
tgttggcccgcacgcgagagtagtcggcccagtccttggcaacatttgaattggaccaaattcgaccttactccaaacgaaacaaatttatgttcactgccgcccttcgacaacaactcgaccgaccgctttgacgcctcgatatccgacgtgcactgtccccctggactcatcaaaactatccttccttctttttctcttttgtcgaggttcatcagaaacttcaatgtcttagcattgtcgtccaaactagacctcaccgccgccgccggcggcgccgccgcagccttctccattatgctgcatgtatgcgcaacaggaagcctcatagaggaaagagatttgttggccctatcaaggttctcctcagcaactggcgaattaacaccgtttactgtcgtgaacctcgccggcgaagccacagacgctcgtttcttttttttcaaagcaactcctatgacgtccccaaaggttaaaggctgtgaaaccctagcctttggtaacggccctttccaaggtttacaggtagttgttttttgattcaccaccttttcaaccattttctttgccagttttctgttgccgacgaaatcagaattcatggagcacgaacttacctttggcggcgaactcatacaaagtaaatgttcacccgccttgagtatttcatccacggtgaagccttgatcgatggccttcttgacgaagctctcttccggcagcaccgaaccaccttgcacctcctcctctgatcgatgctcctcacggtcaacttcatcctccgagctctcatcacccagagcccagaagcgtgaccccagcgcaagtggcttgggcacacacaacggttcgacagcatagcattttgtcggagcagaaaacccgcctctagaacaccccttcttatcccaagtcgaaacttccggcgaagtgcggcatggcgttgctgccaacacctccgaccaccagttcctttcatcctcttcctctccctgcgcaactccccaggtttcctttggaacagccggctgtgaccacagatttgcactagctcctagagctaaagttaaccgtcgaccaccatcagcacccttgcctccgaccaccttagctttcatcgggctagctacccccttatcaagagcctccacctcatcggctcatcccattctcttcctcacctccccctctcttctctttcgtgatccctcttcctcctcctcctctctctctctctctctctcacacacaccaattccacctcaaaacgcatgaatatagatgatgggttcatttgtatggccgtatgaagtttacaatgatccctgtattttctatcttccttatcatccttatccaaagctcttgctcgatgtctccgattgtgttcttcaaaaacacctacttattgtttgattgctttggtcttttgtgaagcaaaataaaaaagagcttgaagtggataaaatttttcccatgccttcccatgaaatcagtagcg

SEQ ID NO: 29250 - DNA, 1501 bp, Oryza sativa
ccgcgtttgatgatacggaatcctccacgctctgttccgttcggtcccaggtgaagtccacaccacacgtacatgcaaatgcaacgcaagcgcgcgcgtacgtacaaactgggattgaacaggtcaaggatcgaaacgcgagccaaaatgttcacgacaaaagagcgcggcagttgcaaggaaagcgaaaggcgcaagcgcaagtgggggaggaatcgggagcgtatccgcggcacaggaaaacgccactttcgtggtgatcggcagcggatactccgagcaaaatctctcgtctcctctcctcgcgctcatgtcaaaaccatcgccgccctggaaagcgacgcggcgatcgaacgcgatatcatatcgaatcatctccacttctcgatcttcttcagttggccgtgccaggcgtcaccggatccgcgccttcagatttgggtgactccgcgaaccacttcgcgttccatgtgttttgccttcctactcgctgagtcgctgatgatatgataaggaaagttgctggctgcatcgccaagatttggctggggaaagttggtagcaaccgagaaatcgtccgatcaggaggatttcttggctggtgtggcaaccccatccgatccgaggatttgaagcctgattatattttaatcttgttgtacagaagatgctattttactaatcttcttgtacaggagatgcttatcaattattagcagtttgtttgtggctagatcagaattcagatatgtgccagcatgaccattagcggttaatctttaatttgttctctgaggcatggatgtgtgcagtattattcccatgcaagcatgcgacttcacataagtttgatgaaacgatgtgtgacagactgacagtgtgagtgtcaagaaatgactgtgattgtagcaatatatgtgttgatgtacagcaacaaatctgatgcagcaaactggcaggtcacacatggagaagaattttcttttgctttaccaaatcgcctaaaacgatccgcatctttcagtctttcaggtcatccaacaagaggacaacccaattaactaaaaactaaagaaaaaaaggatttgaaaaaggggatagggagcaaaagaaaatggtggaccatctttcttgctctagaatacaaagagtactactgatgttgccgggggcctattctttgtggagtcaattcctggcaagatttgcagcaaatctgcccgggatcttgctttccatgaggcaggattttctttggtcattacacctgttttccccatcagcttttcttcttttttcatatctccaagaatcctttcacatgcttatgtatatatataagctcaaccacacccaaacgcccttgtaaagcaaagcctttcatgccaagcacacacaccatctgcatcttctcttctaccattcttgctttctccttgtagtctcttctgttctttcagagaagagaaaaacatatctgtgctagctttgccttcttcca

SEQ ID NO: 29251 - DNA, 450 bp, Oryza sativa
ttgtgttatagtactatccagtggttgtttaaattattttgtggaatgcgaaatatacttttcaggaaaaaaaagtttgctaaaagattgctaatgcgtatgataaagagtatgttacgatggcacatttgcctttttgtgttccagtgatatcatatactcctacttgttagtttgcaaataggcaaaaaagtggataaaccctgcatctggtaggggtttttattatggtttagcaaattagtattcttgtggttttatcgtccatgcatagcgccatctttaaatgggttcaatttattatgtaactgttgaaacttaatgcttacataatcggtatacttccacgcctgctgttagagtgcttatgtctatatctttttccatgcataatgctatttcttggagtgtctatttttgttaccttttggtaagggggttaaaataaac

SEQ ID NO: 29252 - DNA, 340 bp, Oryza sativa
acttagcttccatgaatatacatgtgcacgcatatgcatctaaataatgtcatctatatatatacggatctttaaaggagttttcttcacatgatcagtgttaactttcagtttccaccactactaaaataaacatatctacagtttggcactatcggtgttggaaatactaaaccggtacctataatgcttttcccgctccaaacgcgcatccatgggacaccatcggcctgaactggcaccttgctgaagacacatgtgccggttcgacaagtatcagttttttaaaagaatcgacacctataatatattataggtcctagtttattatcatccgaga

SEQ ID NO: 29253 - DNA, 209 bp, Oryza sativa
  unsure (1)..(209): unsure at all n locations
agtgcccccagtcttcctcctcactcacactngaggcattcccctgcactcgagcccgcgtgttgccttgcggtttcacgatctggaaggatgcatctcacctaatgtttgtgttggaatcacagggtgcaatcggcgcgctcgtgcgctgggcagcatttggttcactgttgcgtccatctccatgaattcattttgttcccttcagg

SEQ ID NO: 29254 - DNA, 531 bp, Oryza sativa
tgcgatgcacatcggtgccggcggcatggacaggcccactctatggctgagaagaccgattccacagggttagaacagagacaacgacaagcaatggaggcgacgaagatgtccacgggaggagggcgaggagatggtgttgatggtgcagggggaccttgaggattttgaccgaagaggatgagaactgtttgctaaggcaattaatattgtatcgtattgtttactttcttccctcctcgtgaaccctgttgttatttcataaacaatgcgtatttgttctcgttaagttcgatttgtgtagttcgtaaattcctgaacgttgtgcaatggttttcatgttgtaacaattttctatgtgatgagtcaagttgttaatcgcattttatatttactaagtcatgctgtttggaccgtcgttgccttttttatatatgtgttccctcttcaattccaaatggattatttatgtgtggctatgaatttgccatgtttgtgcagataagaagggatgagcaatagtagcagcga

SEQ ID NO: 29255 - DNA, 201 bp, Oryza sativa
tttatttttcatatagtgcagctcatctcttttctgcttatatattaaccacttcttttttcagtctgtcctactacaggaacaaatgctttcattccatcacaaacttgattcagctattgggaattttttgtctgatagtttgaaagattttgcgataagcttaccagtcactgttctataaatcatgtctctgatagt

SEQ ID NO: 29256 - DNA, 1367 bp, Oryza sativa
gcccaaagaaaaacaaaattaaaagcactggcacgatatatgcaaaagaaggggccatagaaataaaactaacctaaaatgtcagtataactaaacatagattcagagcacatgcaaagcgaataaaaaatgggaataaaaataattagagcataacaagcaacatgaatacaataaaaaaatcatatatttagtatgaactgtatgaaccaaaaatcacattctaatttcaaagaaatcatttgcagcactgtgggtgtgtgtgggaagcggagtactagtagaatgaatcacacagcaatgttacatacagtacactagttatctgcctataatcaatttgcagagtctgcataatacatagttattctcaaaaataacaacaatgcatagttagtttttcatactacacatgtcaaatgtgaataaactacatacaaactgcagatcagcatcaaaactacatccaaaaaatggaaaataacacacatcagaaaaaaagcatttgatccaaaagcacttgatccaaaagcatatagtactctgcatcatatgtaaacttagttctctagcatcatattataaaacgtataaaggacctgtgaatctagcatacacaatatgctctaatttgcatcgggttgctactgcataaatcaaccacgctggttgcatctccaaaaaagcaaatagtcacatacaaagggtacaaaaaatgccacaaaatattaatcctgatgctactccctatattaaacacgggaagttgcaacatcccagcgacgctagccaagcacatatccgtagatgcaaaaaacatcagatccgttatagttaatactagatcgatagttaatccataggtccaacagactagatccaagcttccagcaacgctagcacataggattcaaaaacatgaacagaaaaaatcaaaaataaaaaagcacacacatatgaaccctaaaatacaaataaatcgttgctaaccacgtcagatctgtgatagttggaacaaaataaacaagttctgcactgcaaaccaaaaaggattcaaaatccccaaaaaaaactgagaaaaaatgcaacaaaaatacctagccatgaacgagatggatcaatctccagctgacagcgagagaaattcggtggagagcgctcacgaacaaatccggcgccgaagaagggaagcacgagagaaatcgcctcggcgaggtcgctggctacgcgtcgctcgaacgagagagagagaaaaggaaaaagtaaaacggaacaacccagcggcgcggaaaccgatatcaaatattgttcaaaattggacaacctaaacgggtaagagagaaattacgggatccgataccacaatt

SEQ ID NO: 29257 - DNA, 1501 bp, Oryza sativa
ggatgatcaaccaggcaaaggtcttgcacttgcgtggtgcccacggcttccatattaggatgttgaagttggtggctgtagtacctaggagctgcgctttgtaggccgacgtcatcgtatattcaccgtggctagtgagcttccacactatcttatcctcctcattttctgtgaaatgtacgttgtgtaccgcactcagacattgattagctggctgaccagctctgttgtccaacctgaggttggaggaaggtctagattgagcagccactggtctgtagttgaggcctgttgtagcgtggtgttctttttcttggaggccgcgttgatcaggggagttacatcctttagtcttctcccttccagccaagctgagtcccaaaagcttgctttcgctccatcccctattgttatggttgttgctgctgcaaaaagtaacctatccgtgtcatcacagggtgttcccgaccccacccatgctttttccggtgatctccactcgttccaaagccaccacagtcataaagctcttgcaaattcctccaagttcagaatgcctagtcctcctgaggctgtagggaggcaggtccgtgtccaatttattttgcacttgccccctgtcagagcttcaccgcttgtccataggaactttcttctctgcttgtcgatgacctctagggactcttttgaagctttcaggcccatcagaagaaaaaaaggttgtgaagtgagcaccgatttaaccagcgttgatcgccctgccaggccaatatgtcttcctcgccagctagctactctactcatcgatttgtcgtagagaggtagaaggtctactttgcgtagacagccagtggacagaggcaaccccagatacttcatcgggaagcttgccctagttgcaggcgtgccatgcaggatgtcgtcgaggtccagattattgcatctgatcggcgccacttgcgatttttgcaggttcgtgcatgatcctgataccttcccaaaacgatttagcagagcggcgaaggcactcacgtcctctttggtcggattaatgaagacggccgcatcatccgcgtacatagatgtgtggaagcgcacagctctgcctcacagcttacttagaactcctatgtcggtagccttgtctaataggcgctagagggggtctatagccaagatgaagaggaggggggatagggggccaccctgccgcaaacccttcctgtgtctgattgtttcgcccgggattccattcagggtgatctttgaggtggaagtggacagcagcccgaatatccagtcgcgccatttttacgggaaacccctattttggaggagcgcaagtaggtagtctcatctgatcgagtcaaaagccttggagatgtccaacttgaaaaggaggatcgggcgccgagtcctgtgatatcttctcaccatattcctcacatacatgattctaatgcgatgattggaatattagtaatctgttaattagttaaga

SEQ ID NO: 29258 - DNA, 958 bp, Oryza sativa
cacgtcggcgccacctcggctttgattgggcaagccggtcagtggtcccctccctcagacttccctcccgtgcgcgcggtccacggaaagccgtgcgactgcatatgggcccgccgccatccgtccaaccggtgcaccgctcctaagccccgcgcacccgaaacccgtgcgccgcacctcgcgtgcgcccatcccaccgtgggccgtgccaccgacaagcgggccccacccgggaccccgcgcggtggaatcggtccaccgggccgtccctctctcccccgcgccccattgggccgccctcctcgcaggccgtgccggcccattaggctcgcccgagctgcgcaagtccctcgggccgcgccaatgccacccgagacaagtctgattgacatccctccatccttttctttttccagggatttaataaatcctttttcctttgtcccataaatcaattccttattccaaaattccacaaatcatttcctttggtcccgcatgacagtgactgttaataatattcttgggaatattatttcttcaaaccccataaaccatttctcgtattccagaaaattccgataaatcatttccttgaccagaaaatccaaattaaacttccaaaattcatatcttcccaaccgctcttccgtttgactccgttcaacttccagtaattccgtaaaattgagatctatttaatggcactactaattagtctaaataggatctttcttttggtcttttgtttaggttttcgattgtttgcgtatagttgcggttatcggattttcgtcgatcgcgggttttctcgaagattcgtgaagcttcgtgaagaccttgagcaaggcaagtcaccctttgatcaattgctcctataattgaaaagtcattattatttcgtttgcaacttgcattattagaatcacacacttaacttgcttggcctcggtttcca

SEQ ID NO: 29259 - DNA, 478 bp, Oryza sativa
aagttgaacggagtcaacgggaagagcggttgggaagatatgaatttggaagtttaatttggattttctggtcaaggaaatgatttatcggaattttctggaatacgagaaatggtttatggggtttgaagaaataatattcccaagaatattattaacagtcactgtcatgcgggaccaaaggaaatgatttgtggaattttggaataaggaattgatttatgggacaaaggaaaaaggatttattaaatccctggaaaaagaaaaggatggagggatgtcaatcagacttgtctcgggtggcattggcgcggcccgagggacttgcgcagctcgggcgagcctaatgggccggcacggcctgcgagaagggcggcccaatggggcgcggggaagagagggacggcccggtggaccgattccaccgcgcggggtcccgggtggggcccgcttgtcggtggcacggcccacggtggga

SEQ ID NO: 29260 - DNA, 747 bp, Oryza sativa
gggattttggaggggatttaccttacaaatcaatctacaaagcaatgcccacaaaataacctttgattcaagggagatttgaggagattttgggggaggaggagagagggcgctgtgaggaggaggaatcctagccgcgttgggtggggaaagaagagaggaatgccgggccggcgcactaaggaccctaccttaatgccaacgcggctggtgctaaggttagcggggtcagtgccaatgcgactggcgctaagaaggctaaccttagcgccaaggcggttggcactgagctaatggcctatttttggttgaagtttttttttgcacggtctagttttgaaataactttttgaaaaagatcaatttgtcaaaaaaaaggctgtttttttttaatctagaacactttttgtatgaggcttgattccatagagaatttggtatatggtgggcgcaccaagcatagtacacaaatataaggtatctcatattcaagatactgataaaaactacccgctaaaagagatttcgcaggcgactatcttaaagtgaacaatgtctgtttgcacatgtgtaaagatttttgacgggcggttttcttctctgcaagtataaacacctaatttccatgtgccattgattggagagggctagataaatgcccgtctaaaaaaggagaggacagtagcgtcccctttgaaatttggtgagccccgaagacatcatcggcctggagtcaatattggcttc

SEQ ID NO: 29261 - DNA, 1501 bp, Oryza sativa
agcgagagcgagagagacagagagagcgagcgacggctctctctctctcggctcgcatgcgtgcaacgcacgtgcgagggtggggggaatgatgggctgggagggggagatgggccgggggaggagaatcggcccatccaaaatcacagggaggtaaggtagacttttacagagaaactgatttggatagaattggggagatttagggtttggattcgaattcaaatttgatattcgaactcgagggtttagggatgtatcaagggaaactcaaggagaagtcatggaaaagatttaaaaggaatacttgggtatttgtcctcgggaacatagggtggagtcaaggaaaggattcgaggcgggatttggataattctggattcgtagaagtatttggcgaggattcaagggaagggattgaccttcggatttagatttcggagacttgaatcggaagaggaaatttgaggcggaggattttgattttgatgagagggaacaacgggatttgaattgagatcttggcacaacttagactcgcacacaaagaacgaaaattttcgcaattaggatttttgccgaattagtttttaacgacccacgaaaagcggagcgttacagatccaccccccttacaagaatctcgaccccgagattcgaaggtggaccacacacacgaaaccaaaaaggatcttcagacttcttcacagcttcaggctctgctagtctttcttcaacttattgttgtgtgcttgccgcaaaacggtatggtactctgactcacttagcattcttcatcttactgtggctctgctcttgcctgtggaacctgttcttctcctgctccttcaacttgctcgagattcacaacttttccgtttgtttctacttgcacatggttcagacgaccttgtccgacgggcggtgaggtcaacgaggcagaaccactgtttggtgactttgaactttttggtccagatacgttgggaaggcttgttgttggttggactcgttttgacttgactttctgagggcagcaccatgaatagtgtcccatctcatggcagatgaaacattcgactcctgccttataaccacgtctttttgaaggtgtagggcatggtacggagttgcttccttcatggctattactgttgatcattgtggcttgctgaccaggttctgacatagtcgaacgagacgtagaaccggaactagttgaatgctgagatgctttctgatagtattgtgctggcgagtttgtttttcgacacaaatcttcttttgcttgaatctctagggacattactttgcgtctcttgtattcttgcatctctttcttttcttggatgtcttggcacatgtcgcaggatgcttttgctcttttgtcatcagggaaggttgaacgtactgcattaacatttggcgaatttgggcttccttggggatagaagggcatccttgaggtgctcatattagcttgtagtggtgcatccatata

SEQ ID NO: 29262 - DNA, 557 bp, Oryza sativa
gtttgatgtagaatctgacacttgatgtaaataaagacaaacgactaataattgtaaataacaatataatccagaagaaaccaattggctaacaatgatatgatagaataagcactgatccgaaggttaaagaatatatcagctggaggtccgatgtcataaactccacaagattagataaatcaatgaaacctttgttatcatcggctaactccaacttatatatgcaatccttataagccgatgcaatgtccagataactcatcgcctgaaaccccgatgacacccttattggtagtcaacaagtagactagggattatggttctaagcatgacttagtagatcaaacttaactaatgtagcactaagtatgaaaagaaacataatatgtagacaatcaagcccttgactgatttttagagtggtagataccttagctaatctaatatagtaaaacaatttagccgataccgacagaaaccctaaagcgagagacaaccgatagacctaaattgagatactaaaactagattaactaagacatatgataaatagg

SEQ ID NO: 29263 - DNA, 1501 bp, Oryza sativa
ctacatagacataacagaaagttgctgtaactaagaaagccagatactattgaactcaaatgcccgatatgcaaataaatggcacatcgtcagcctaaaagtatactctagcattaataatttaagaagaaagctacaacgggagaaagtgaggaacatgacaagacatcaaaaactgcaattgtgcatttgatgcaatgctaactacattaattacatcaaatgtgaatttgatatgcagcggcaatttctggggaagttcagactcaaaaaatcaaagtatatttgtggctcagagcattgcaatgtgtgagtaatcataatacatcattgaatcttttcctcatcatagccactgtacaaacaatacaaaagatacataaggcattgacttactaacaactgttatgtgaacacctggaaaatgagaaattggaaagaaggttgataactaggtaggggcctcagctcttgggaaatatactttacaaatcctccccacaggttagaccgtaggagcaaggtttgcatcatcggcccacaaaagatataatcagattattatttgtgacttctggatttcctatgctgcatttcttcagatatgcctcaaacaaagtgaagaaaaccaagagatccatggacctgtcgtacggttcgtcaattcaatcaggttctttcatcatcggcaaaacagaggacaataactggcaagaaagctaaacagcatagtaaaccgaactactagtccggtacaaattgagtgcaagaagcaaccaaggttttgattcatatcactgtcaaacactatatttccgcctatagtgtatgtatggctagagttccataaatgactggttgaattgacgaaccgtacaacaggtccatagtgtacggaaaatatagtgtacactatatttcctgattgaattgacgaaccgtacaacaggttccatggacactatattttctgtactaggaagagtccctagtacagaatcgaatgagctcaggaagagaactagggactcttcctgagacatcaattacatcaaatgtgattttgatatgcagcagcaagagctgggaaagttcagactaaaaaaactaaagtttcatcactggccaatccaaaagactttggtgcaatacaaaaggcttaaaaaaatcagaattttatttttcatgactctggatgtttcctatgctgcatttcttcagagatggctcaaataaagtgaagaaaaccaagagatccatggacccgttcaacgggttcgtcagttcgatcgggtatgaaagctaaacataacttgttttatacaaattaagtgcaagaaaggacgcagtgtacctcatacagttccaacaaacgcaagagatatcatagacgcaaacctacaggcttgcacctcaaaaattcaaccaatattttttattcatatcactggcaaaacactgcatatttctcacaaacacacggggacaaagtagaacaaag

SEQ ID NO: 29264 - DNA, 1501 bp, Oryza sativa
gccggcgcgcctccacatcgccgccaaggtcgccgacggcatggcgttcatgcacaacaccctgtgcggcggcggcggcggcgacgccgacgacgtgaacgaaaacttgtcgttctcatcctcctacgaggaggacgaggcctcctcgttctgcggcggcgccatcgtccacggcaatctcaaggcctccaacatcctcttcacgggcaccatggagccctgcatcagcgagtacggcatcactacgccgccgtcggtggcggctccatcctctggcgccgctgtcctccgcaccgacgtgcgcgtgtacgacgtgctactgctggagctgctcacggggaaggccacggcggcggacggcgccgagctggcgcggtgggtgacggccgtcatccgggaggagtggacggtctaggtgttcgaccgcgcgatgctctcctccgtcggcgccggcgacgccgtcaccagcgagcagcggatggtgcatcttcagcatgtcaccatgagatgcatcgacgcctcctcgccaccgcccaccacgagagaggtcgctgcaatggtgaacaccgtccgcgaggaagacgacgggtcgctctcctcgaaggcatgagtgacactgacgcggacggacaccaagcacttgagcggtgtgtgcagcaatacaaaattccacacaaaattcccggtaacggtgaggtcgagcacgtcgtcctggtggctctcaaggacgcatgctggctggtcggtgactgcgaacgccctgtcggggacgacgaggtgctccgggagcatgtcctgccgctcttccccttcaccaacttcttggacagctgggacagcgccagcgtcgtcgtcatcgacgatgacgtcccgtccgccggtgtggcgctggggggatgtggccgctgagcaggccgcgtgcactcagggcgttgccgccaccgcctcggcgagcaaaccgtgaccgggagaagagagaaaggagggagaaagagagaagagagatggagagctgacatgtgtgtccaagggcatttttgatatttcacgcaatttctctctcctcctcaaccggaaatcattattctaattagcgtggtgtctattagcaaattaccatgtttatggagtgttttcccctaaaaatgactttaggcagtgtcccacggctaaaaccatgaactcgtagtatcctgtagtaaaaatttgccaaaataaaaatcaaggggagtcacctcttcttcctccatctctcatccccttctctccttcctctttctctctctatccttattcctcctaggtcatccccgagctaacatccccaaactcgacgaggagagcggtggcggaggagctcgagcagggcagtcgggcgacggcaaagctcgcggacagcaaccacattccagatctggcggtggaagtggtgcgcccatgcgggcgacgacgagctcgcggacgccaatgccatagttgtcggcgagctcatttgtggagc

SEQ ID NO: 29265 - DNA, 1501 bp, Oryza sativa
gattttgaaagaaaaggatgtcagctattaagtttgtaatatggaaaaaagacccaagaaaaaggaatagtggtgacgacccctgtttttataacaagaatcattcatgttaatagtagtctgatactcacgattacatagctgattttgtcaagtgcacatacataaagtgtcttgcgcgatttattacatcatagagcccacaggcatagactggaacatagaaccaaatagtttggaatgtattcaaaagcagaattaaggtaaggcagcagaattaatgcagcggtattgttattgtcacaggcaacgaccgtatctaagacctactgaacgctatcatcttcggcaacctcctgatagtactcctgattaatttgtaaatagaaagggtgaataccaaccgttcgtactcaacaagtcactgcaacaacaatgcatatggaagatattcaagccaccaccaccaattttgcaattcttttcataagcctaagaaagcatagactaatcaagttttagttccattgttcattaatcagcgacattctgtccaccatctattgtgtttttaaggatagctttccgccactgagtcatcatggttttctggggttaccccttctcgcttcccgagaagttgatctactagtacaaaatcatcatgcaacatccgtttcatcattttaaaagttaagagtctagccaagtgtaatacatgtcccggtgctcaatatctgcgagcacggcttttcaaatagattggtttactcaaactgtagtggatgtacattttacccatacttcgtgacttgcccaacacatgatccgaagtcccaacgaatgagacgcgtcacagcaaagcatttcaataacctcactttggcagtacttgctccatgaacttgatccctcatgcaggcatacacagtttctagcagtgagaggagttctagtgttactgggaagggaaaactcacacatgcgttaagttatagttaagttaggttttaatttggttgcccacatatgcttatccatcgtaggctctccgcctattcacacatctaaatgaaaccaccacttcttgggtaccgcctccgcgcagctatttactctgctagatttatacccatacgagaagtacggtcgtactaggatcgttccatgcttaacttcatggctcggtccttaccagggacgacactagcctttatcggacaccacccaaaacatccagccgccaaattctaaaatatttgtttagttttttaactttctttcacaaatagtttcatcaatgtcatgacaatgaggcgctcatgtcttcacatgccgtatatcaactaccggcagctggagaaagggagatgttgtttcgttttccgtacggacgcttcccaaactattaaactgtgcgttttttgcaaaaagtttctataggaaagttgctttaaaaaatcatattaatctatcactaatctttgagcatgttgaacct

SEQ ID NO: 29266 - DNA, 1501 bp, Oryza sativa
gggatacattgctagtatgggaagataagtaaagtaatgctccactttttaggaatctccattaacatgaaccaacaataaacttgagctgaatcatactagttctataccagttaaactgaacaagaaagaggttttagtcacacagctctgaactcatccaagctaatcctgccatcaccatctttgtcaaaaacatgaatcatcttttcacagtcctcatacctagcatccttatcatcacattttgcaactctaaggaacatatgaactcatcaccgtcaaaatagaatacactgtacgtttcctctaattcaacatctgttgactgtaaatccgcaattgcctttttcagattacttgtgtgcactaaattctaatcctcatcctataagcacgtgagttttagctgttagcaagtaataacagcatctactgacccaatcatcgacgtgacgcacggcattgcaaaatacccaaccaactcgatcgccattttcccgcttctcgggagcttgaaacagagggccggggggttcggagatcaaaggaagccagcccattctggaagcccactgccgggctgcaccatgcttctacgaactgggctaaacaggccgacattaatgtccgtcatgggctgcatgcccggaaattaaagcccaacacgtgcagtctacctccatatcaatctttttgttcgtctcctcgacataccatgccgatcacgtctgaagacgaatcaaatccgtatactatactgccttattctgcctataacaaaacagtaggaaatcgagattcatctacccgttgtctctaatcgactcatcgttaatcttgtatccatcgctaggacggaagctaagctgcaaagtgcaaaccaatcaatggagcgcacacgacgtgtcgattctaaccggccgcctctccgggacgctaatcggatccgcgtggagaccatgatgcggggaagaagatacacgctactgcacagcccaccggaggcacagcgatacactcgctatcatcagcttcctcacagggagatgcggcagcgaagatggctacgggattacttggccagcgttagcgaagagatggatcgaagacggctacaggcacgagccggcatcgacgaccatcgactggagtcgctgcaccggccgaggctgggggagacgagggaggaggcgtgcgccgtgtgcctgcaggatttcggggagaaagacgaggagctcaggatgatgccgtgctcgcactcgttccatcagcgctgcatcttcggttggcttgcgatcagagacaactgccccgtctgccgctcggcgatgtcctcgtacaacgatgttttggaggagctgcacgctgagctagagcaatggatacaggtcttacagctacgattcaacaatgctaattgaccgcgcacctcctatttatgggggtaaagatcaagtttagcaatgtacctatgatgcagtttggttcaaatgcactt

SEQ ID NO: 29267 - DNA, 682 bp, Oryza sativa
tgggggggggagcgggagagttcaaatgaatgagatgtcgtgaggaggacgggagcggacggggaaaatgcaacagaatttattccagctggcaccgctctttatctcgtcccgagttcgttagttttgcttccagaagttactaaaaatgcattgataggtgaaaactgaaaagtattttcaatttggactcccagaaggcgcacgttggcattttagttttccaatagtattttgaattactttatgcaaccggggaattcaagcaatactggaaggtgatcactgatattctttttcaattagatggtcgctgcaattctggtacatgcaggagagccttggcgacagcgtgaataacagtgcttacatatcaccgatttattaagcaatcacaaatgcgcatggcattgagcattgcaaaatgaaatgcagcaaatgtggattgggatgtagtattacaggaacaactactactaggagcacgcttgcaggacagcaagagagctggagacaaaaattcagatactaaaatcttcagggagatgcacacttgcaggagcacggcatcatttgaacaaagcattgatcctcgcattcactcgatcactgcatgctccggagggccaccggcattgtgcataaacctgaatccagtattccagtgcatactgttttgagg

SEQ ID NO: 29268 - DNA, 1501 bp, Oryza sativa
acggggaggggaatttaatcccttctgtcttgttcggtttgaaaaggattacagagaattagagaagatcgagaaaaaataattccacataatagatgtgaaataaatccccttcagtctctctctcgggggattaaccaaacaagacctataggagatgtctcctcatgtatctttttcttttaaattcagtacaaacagacgtggaaagttttaaaaacaattgacagtactcagtccaccaaaaatcaagtttaaattcgacatacacactgagaaaaaaacaattcagatttgaacagtatttttactatttatacgctgaatttgtttcgctatatgtcgatgtgtgagttgacttttgatacaacttatataacatttttatgtgtgtgttgataaattttttggattttctcataaccgtccggatagtttttaaataaatgaggggatgtcccctcaagtctctagatatcaaaatagttttccccgtgtgatgacagagctatcccgatcccaccattttaaattacatgtcatttaaattactttgaagtttgtcttccaaaccaaataatttagcggtagcactattccgtgtaggatcgaatcacaataactaagccaaccagagggggtgaatggttggtatatccaaaaacctaaacttttagcggaaataaaagtcaccgtcaaattcgacggatcgcggtctgaccgaagtaattgcaccggtctgaccgcctgaatacctccagtctgacagaggtagtaactccggtctcaccgcctggatcagctcctgtcgtctgccgccgccgccggtctgaccgcccttacgccgctggtctgaccgccggtgtgccgccggttagaccgccgaaagccgatgaaacacaaattgaataactcttaaagtggatgacgactttattgattctctctgtgtttacaaagtgcaccaacatcactccaaacaaaaaactcgagtaagctcgaaaccctaactcaactatcaactcaattgctctcgaaagcgataccgggaagcctcacactccctgtctatttatacatgaggtaggcagcctaaagctacgaaccaaactcatactagaagtcctaatccccataggaaaccttctcgtacaagaaacaaactttacataaccaatcataccaaatttggactccttccaaattcgactctgcatcccatacgcacacaatacctccatcgtatgccatatggaaacttcaccaaccacgtgtattgaactctaaccttagtatcccgcatgatctctgaccaccatgaacgtcgtcttatccccaagccaactcccggtccatcaccgcaaatactctcccggcatctcgagtcacctacacatagaccaagctatccccaacttgactcattgttagcaaacaacagtattacatacgtatggtatccatctagaagccataatcatgaaacaatctaatatgacca

SEQ ID NO: 29269 - DNA, 1237 bp, Oryza sativa
tgggggggggagcgggagagttcaaatgaatgagatgtcgtgaggaggacgggagcggacggggaaaatgcaacagaatttattccagctggcaccgctctttatctcgtcccgagttcgttagttttgcttccagaagttactaaaaatgcattgataggtgaaaactgaaaagtattttcaatttggactcccagaaggcgcacgttggcattttagttttccaatagtattttgaattactttatgcaaccggggaattcaagcaatactggaaggtgatcactgatattctttttcaattagatggtcgctgcaattctggtacatgcaggagagccttggcgacagcgtgaataacagtgcttacatatcaccgatttattaagcaatcacaaatgcgcatggcattgagcattgcaaaatgaaatgcagcaaatgtggattgggatgtagtattacaggaacaactactactaggagcacgcttgcaggacagcaagagagctggagacaaaaattcagatactaaaatcttcagggagatgcacacttgcaggagcacggcatcatttgaacaaagcattgatcctcgcattcactcgatcactgcatgctccggagggccaccggcattgtgcataaacctgaatccagtattccagtgcatactgttttgagggggaaatttaactatttgccactcttgtgacatgtcaattaacgatttaccacaccttgtcaatgaaatgccctcatgtgtttatgacatgtgggcttagtggcaaatcgttaagcaccactcgtaagagtggcaaatagttaaaagccccgttttgaggcagtacctatgtttcttcaatgactcacgaattcacgataaagatcacatacttgttgtatagcctcatcctctccatattttgaggtaaactttggagtttccaccttgagggaggattgcattggacaacaacgactgtagcggtatatggaatccataagtatttgatatgtttattttcagaaagcagaaaagatgggggtgaaatttcagtcagttttctccagtatagaacaaaaaaacagataaacaaaccaatcccagacatctatcaagtggtcagaattgaatgagatagcatttcttgtggtttgtttcatctctagccgcggcgtatcctctcagtgcgattggtcttgggttggcatcgggaatctgcagagcgggcagcga

SEQ ID NO: 29270 - DNA, 1501 bp, Oryza sativa
ctgattatctcaattctttcattcgtttgattatgaacaaaatgccgtggagtgcagatttttgtttgaagtgcaggacatttataatactgtattagtggcatgacatttggttttgttcgggttcaaaaaacatttggtcttgttgcttactgattgtgctcctttttattttgcaacttatgtgaccttgacctttggaagtgatcaagagaaggagagggcaggagatgcttgaagagttgcttgagcagcaacaggtattgggaaatgttcttgagttttgcttttgcatgcaagttggagatgatatttcttggacagaaatatgagccggttgaagatggatttctaagcagaatgtgggttgaatgcagtttactgatgtcagattgttttggagctgtatctatgattttactgggttagatttccaaacagtactcttttgtaatgttctcttgcttgatgtaatgcttttctgccactatatgagctctgacctagtgaaaactagacacaacctaaaatttcttgcgaggtgacccaagtcgttttgttacctttgttctggctgttagtttgtaatatctattagatttgcatactggattattggtgatactacgtaattcactgtacatgaatatcgtggttgctgttttagattgttgttgagacagataatttagttattatcaggttcagttccttagctcccactatcctgtcctgatagcagttcgatcatcagttttggtctgcgatttcatcgtaggctagtatgcacatgttggagtagtactattggaaaggagtatctactgtttgacctgagcatttgaacaacgctagccccaaaactgaagtcaacgtgctgaatcttgggaagacaaatgatgccttttgccatggaaaaacatttcaaaagtccccaataccgaagcagaaatggtgatgctactactgctatttgtctctcttgcctatttttagagcactcatgtctttctgcctcaccgctgcctctgcctccttccaaatgcttcgccccccgagctctcctcggcgtgcgcggcgcagcgccatccaccccgacaactcctcccagcctccaaccaatccaaacacattttcttgcccgcccctgctccctccaccgcgccacccatccatcgccagccatgcacaccctcgctctgaccaccctgtcacgttgagctacgctcggaggaggacgccacgacggcgaccgggaagaagatgaacccgctccctcccccggccagccggctgtgggaggcgagcatccgcaagctcaagtactccaccatcctccgcggctccgtcgtcccctccggcggcaccttcgatggtgcggcggcggcggcggccaccggaggtgaccccgtcacgctcacgccaagcctctccgtcatctcctccacctccaacaccatctaccagtacgaagacggcgacgacgacatcgactccgtcc

SEQ ID NO: 29271 - DNA, 1501 bp, Oryza sativa
aactattaaaaactaaacaaccgtacaccatttgaaatatatcattcatcttatattaatattatattacatgaaaaatttatttgtagtatacctgtcttcctgaattctttcttttagttgttctattattggccacttgataacattgaggtcaccccatttgtggctaggcaagtcctgttgccgtccaataatattaagatgatattgtagtctttgtagctgctcaattatcatatttacagtcagcaatatacataaatgaattacaatcttaaaaaaaaaagagagttcacatgtcatatacactaaccgtatttgcgaggtcagcacgattgaatgtcatacacatggaatcaagtacttgtatctgttttttttctatgttgacaaccgctaaataccaatgattatctttcatatttattggaataaaaatctaaacaagacatatggagttaggacatatattatattatattatatctatatatataaataaataataaacttaaatactatcaaatatagagagccaaacaataccagttcatggtgtaggtaattcttcactatctttgtaataaagttatcttcatcttcatttactccattgaccccagccgctttcagcatgtcagaaagaaacgggttttcatatttcactttcttatcgttatttgcttgctcactcaaacagtgtatgtacgcactgatgacctgttgattcaattaaaaatctgcaattactaaagaatatgttggcaattaaattgtaacgttgcttcatcataggcagttttacttacatcatcgttcaaaaatttatctccagagagaaggcacgttaagtgacgtttcttgttataaaaatgacccatgtccaccagtgtacaattttcagccgaatcttcaattaaaaatatggccattacatcctcatttgttaattcataatctgtaaaacaaaaaaaaatgaattctgatatcacaaagttttatatataaagcacaaccactcttaaaccaaagaccaagagataattatgcatgcacccaataaaattagaggtcttagtggagagttaaaataataatattttagtggagaagaggtgttagttaatgacatgcatgcatatatgccttatattatgaaacaacttgaaaaagtaattttgccgtacattgtggaatgaagggagtatgtgaaaacaataatgtaccttgagggagatacttgtaggtctggccaaacatagatcgtatcaaatttgatggtacatcaatatttggcatgctgactttggatactccatgctcctcggattccgaattttttgctttcttcgagggtggggttgtaatcatatcagcatgaatggcgtcttgattgacctgagtaccacatgagattaagcaaggatatctatattgcatatggaaattatatataacactaaacaaaaaacacgtcggcagggatgtcaatattatt

SEQ ID NO: 29272 - DNA, 1501 bp, Oryza sativa
atgtagccatcttccatagcaatgtatgcccgttgactagggcaatccttctgcacatggccaaatccatggcagcggtggcactgaatgctgggcgtgcatcccgtcaaagcgacggacgaggcactcttggtgggtacttgcgaagaacctttacctgaatctaaaagtcgtggggggaggtggttttggcgctgcagaaactccggacgcaactggtcgcttgcttgctggtgggggtgtccggaaagagatgggcttgggcagccccaaagatggcttcgcccgcggcatgtacgtgctcgccttgttcttgactttgttgatcacgccctagcaatttcttctctacaagcatagcaaattgaaacaactagttgacaatgttaaaatccttatactcaactatgtcctgaattttgcgcctcaatcccaagtaaaaacgacaaataaaatcctcagttccctccactatgctacatcgcatcaatcccttttgtagctgaccatagtaatcctatacagatttatccctttgttctaaacacatcagtttcttgcttaattctctatgataagatggtgagaccaatctatcgcgcatagctaacttaagttcttcccaattagtaggtaaagctctccctacagctaacccagtccaccaaataaaagcaaaatctttaaactcactagtagtttgtcgaattctatgttgctcaggcacaaggtagacactaaacttttgctctactgtcatctcccaatcaaagtatttctcagcatcataataatccaaaaatgatggtattttaaacttaaccttagaataagaatcatcgggcacacgattattgttaccttgttggtgttgctgattttgagtgccactcatacctgtcattgcaaacacaaaaacaacaacaaacagtgaaggttatccctaataatctgctacacagtgtagcggtgcctctcaacaactcagccaaatggagcagcttactaagaataagtgtcttaccagcaatgctaaggacggtacaactggtggctggttcgtgacaccttgaagaacttgatgtagcgattgcaaggatcaaagtggtgctgaccagaagtatatatgtggagcttgggaggcacaatatatagtagcaaaagaacgcaattgtgttaatcagaaaattcaaagttgaataatagttcaaagtactagtcaatgtgctggcctaacctagactcaactctagctcaagcaagcacccgacaacattaaggactatatatgaatcaatgcacaactctgcactctcaaaccatactcaaaagatgattgattttttttctttctggtgcggctttttttaagcacctttctgcatttttttaatttttttaggtgcggcttttttttttctttgcacctttcaaccttttcttttttctttttacttttttcagcaggaaccaatcaatgacctcaaccagggactcaaat

SEQ ID NO: 29273 - DNA, 1164 bp, Oryza sativa
caaatttttgtaaagtcttatgttccaaacaagccctgaagctaacagatggcaagtatgtgatgtgaactttgtgcggtgaaagcaacctggagcctttcatctgcatatgtagctgttgattttatagatcgaacccatttatgccttttgaatgcatgatcaattttttggtcaaataagggcatctatatagttaatgtggactgatggcatatattatatattaataatatttatttagtcagtgtttgacttgacatacactctgaaactgcatgtataatagaacctgtagctgcttccgtgatcacgtcaccgctgcccacatcgccgatctactccgcggatgccgtttcatctatacgaaatttgacttatgaagcatagcatactgtggtattgcctatgattttacttgtaaggaataaaatatgcaccgacaatagtgtatttaggcgccattgttttgcagttgctgctgctttccagcagaactagcctgatgcttataagcatcagcaattccattgttttgcttatggctgattactggatcttctattaactgatgcattgcctctgcttgcctacctctgtgtgtgttgtgtgcttgtcagcactgactccagatgcgtgcagtcagcatgaagctattgtgtacatactagatactggtgttggattgagagggttgcattttgaagttaatttggttggcatgaatctattgtgcagatactgtatactgttttttttttataaaaaaaaagttggatactggagttccagtgactaattgaaaatcatagctctcttggattgagccttccaagctttgacaagttagatttgagcgtgtttgcatatttcgtacgagtacaggaaactatgcattacatttccatgatactataatatggagtaatctggaattagatggttcacgaagaatgtggtgatattttatattaatctttaatctttctcgtggattagcaactgaaaaaaaaactttttatatgcgtgtctttaccgattaaaaagggcatactgtaaaatgaactacgacaaaatacaacaaattcaactccaatgccacaaccagccaacagccagcgattgtgactcaatgttgaattaattgataaaggaaacaaacta

SEQ ID NO: 29274 - DNA, 1501 bp, Oryza sativa
aatgaggtaaggccggtagtaatgatttgcatctatatggtttagttcgcttgctcctaattcaatttctacatggtcacaaatggagcatgagtttcatggttatttcaaagatgcaagcttgatggagcaaagaccgattgatacttcatcggtcacttgtgaaactatttcggttacatctatccctaagaccggaattgttagtgatcttgtccctgttagttctattgatgttggcaaaaagaaagggaaaagtgttattattggggatcctccgcccaagaataggatcaaaaatgcgaaggccgaagatcataaagttgcaaagaatgagtcatctagttcccaaaagaccaaaaagccgaagctcacttttgagatgcttatggctaagtacaagaaaggattagccggtcaacgatttgataatcaaactagtgattcaaaaagaccaagatcatctcgtagggagagatttgatcaaacaccaaagaaatcggagccatcaactataccaactccatacaaacctccggttgtgatgccatggtattcacatccaatgtcgccatttggttatccttttatgtattacatgccatggatgcctcaaccacctatgccgtgtcatcaagcatggaagcaatcacctaggatagtaccaagtcattctaacttaagacaagaccgtttcccacaaaagaatcggtctggtggatcaaaggtgaaaaaggtgaagaaggtgtgggtgaggaaagaagccaaagctccggaggtcgttactatcaatgaggaatctcaagatgttcatgtacctactggagatgtgttgaaaactatacaagcggagaagactgaggccgatgctgttgctgtcgacatcggctgtctgaccgagatagctgtccggtctaaccgccagactacggccggtctgaccgaccctcctggccggtctgaccgacggcttgcggccggtcagaccaggtctagagaccggtcggaccggggggcattagagaagagtgggaaaattgagaacaacataggagcttccacttcgaccaaaaatatcaagaatcattgcttagctcctggaaaacaaccatagccgaagtggataccttctggcttatctcgctctcaaaataggaggctacaacatcttcgggccataggtaaaaaagaaaagaaggccgaagatgtggagaacaaaacatctaataatttagagcctcaaacaacacctaagcgagtgtggagacctaaagtagtaaaagttaagagatcggtgatttcccatagaagtaacaaatccaatttgatgagagaagaatcatcggtcattagagataagtctcctccacatgatgctatggggattagtgcggtatccatcttgccttcgaaatcatgcaatctagaaagccgattttgcttggggggcaagacattaatatgctcataaaggaatcaagagagatgaacagcgatggat

SEQ ID NO: 29275 - DNA, 1501 bp, Oryza sativa
aagggcattggtccgtgctagttgcaatggattacttaactaagtgggccgaagccgtgccgctcgagaatattacttgtacggagataattgactttatttttaagcatattgttcatagattcggttttcctcagacgttaaaggagcttcttttatgtctaaggaagtgagaagttttgccgaatcttatgatattaagttgttgagttcttctccttactacgctcaggctaatggataagccgagtcgagtaataaaacattgttgaaattgccgttttgccaattgaggtaaatcttggctctcttcggtatttcaagcaagacgacttgtcagttgaagattacaagaccttgatgggaagcaattttgaagacgtcatcgacaagtgtttgaagaatttgaaggagatgaagacacttcaagacggtgtttccagagagcaattaatgggaaatacttgaagaaatacttcccgagcatttggcaagatgcttaggaagtcctatgaccaataattggattatcgcgctgagataacatgttctatgcttttacgttcacgtatgttcactaaaaaggcaggggggcatgtgtttacacccaaatttggcacctatggacgaaataagggaaaattgccaaagtttggaaagtgacgggtttccttcacatggccggtcagaccacaggtgtgtgggcggtctgaccggctagtagggccggtctgactgcaggtatgtgggcggtcagactgtcagggtccgagttcaagtctgttttcgtcgggtctcagatttccttgctcgggaaggtaggtttcgtgtttcctttggtttctatcccgagttggacgcggagaagggcctgtagagggcaagaccaacccctatttaagggacaaggctagttcattgtaaaacccctgaatacaatctacttgaatcgttcttttaccgtgttttctattttaccctagtttagtccatctttgtcggtttgcgtcgtaaaccgtccgccgctgctgcgagagtgcgacacctctttgtaggtttgtcctgaaaaccttccgttttgcccacgagacgggtagttatcctcgtatcgatctaaatcggcctagaggctgattttgatctccaaatcggctccgctagcccatttagctatttttctacaaaacccatcttgatttggccttttggctagatcgaggtggttggcaacttcatatcaccgtatgacatttaggtgttgtgatcgtgcttatcgacttgtcacaaaaagttgccaacacacttttcaatatatatttttatagaaacaagaagtcaaagttgtgttttggagatcattcgctgtacaaaatgattttctttacgagtacatcggagggaatactaaaattgtccctaaatatataaacactaaacacttctggaaaaagtacgaattaccccctgaactatcgcggtcgaccgaattacctcccctaga

SEQ ID NO: 29276 - DNA, 1501 bp, Oryza sativa
agcacttgcatcatagtattactgcatgtctgctacatgtctcaagaaattagatattctaaccggtaagtaacaaatcatcctaataggaattactatttgaccattttgtttgcgaggtaatagaactgaacactgtcagactgacttgcttatcgtgcagagacattaactactacggtggactccgaattgaccaactctacagattcactcagtgcacctgagttgggcgtgattcgtcgtttattcgttagttctcgtgaggatgctcaacggttcactcaagcagtcgtttccttgagagcgaaatttattactattgcttcccttttagaccgattggatcctcaaggaatcatcagacgagatgtgcctttgatacaacaagaggatactatcgcccgttttaaaaaagcttaagagattgcttttagattcatgattttcgttatatgtttaacatttgtagggatgctctggtctattaacgttgttttttgggtcgtagaaacataaattaaaatgtcctattatttcgattatgatgatttgttatgtccggatttggtccggtatgttcgaaccagataaaaaaacacatggttttccgatgatgcatatgttcccccttgcaatgcacgtgttattttcatacacaaattaaaccagaactataatattatgaaaaaatattttacgtcctaattaattgcatccggtttgttcagaccgtttcgaccaaaaaatttaatcgtgatacattccctttattttttttaacgagatatacttacgtgcacggtccaacaattttgttctctcaatttttttccttctaattttaatcgtacccatgatatcggatttattcagtttcccgaagattgatggacaaaataatcgaaggaaggaagaagcgtgaaactgcctcgactcctgcgtacccaggacacgtgataaggcccatcaactcatccagattaaggcctatataatattagtcagtcaagaatcactttcgacttgattaggcccatcaactcataaagattaagccctatataagataagctggtgccctgtttccttgctaagtgttgccgtgatattcagtttgatctgctcgtcgtatcgccgccgcacaactcgccgaataccaaggctggtaaacaagcgccgccgccgtcgcaaaatccaccgaaaccagactacgcgaccaccacacgatggatgcatcgccgtcaaatccgccctcgtcgactccgccacatccgcagactcctccgccactactgttgttgacgacgccgccgccgccgccagtcccgtcgtcgccggctccgccgccgtcgccgccgctgccgccgtcgccgccgccgccattgccgtcgccggctcctcctccgccgcccttgccgtcatcttcggcgccaagcaatgtcagcacagatattgatcctgtaagttaagcacccagcttaattagtccatgaagact

SEQ ID NO: 29277 - DNA, 1501 bp, Oryza sativa
ttcccccttgcaatgcacgtgttattttcatacacaaattaaaccagaactataatattatgaaaaaatattttacgtcctaattaattgcatccggtttgttcagaccgtttcgaccaaaaaatttaatcgtgatacattccctttattttttttaacgagatatacttacgtgcacggtccaacaattttgttctctcaatttttttccttctaattttaatcgtacccatgatatcggatttattcagtttcccgaagattgatggacaaaataatcgaaggaaggaagaagcgtgaaactgcctcgactcctgcgtacccaggacacgtgataaggcccatcaactcatccagattaaggcctatataatattagtcagtcaagaatcactttcgacttgattaggcccatcaactcataaagattaagccctatataagataagctggtgccctgtttccttgctaagtgttgccgtgatattcagtttgatctgctcgtcgtatcgccgccgcacaactcgccgaataccaaggctggtaaacaagcgccgccgccgtcgcaaaatccaccgaaaccagactacgcgaccaccacacgatggatgcatcgccgtcaaatccgccctcgtcgactccgccacatccgcagactcctccgccactactgttgttgacgacgccgccgccgccgccagtcccgtcgtcgccggctccgccgccgtcgccgccgctgccgccgtcgccgccgccgccattgccgtcgccggctcctcctccgccgcccttgccgtcatcttcggcgccaagcaatgtcagcacagatattgatcctgtaagttaagcacccagcttaattagtccatgaagactatcgatacatatatatatatatatatatatatatatatatatatatatatatatatatatatatatatatatatatatatatgtgtgtgtgtgtgttctattgcgatttgggttacttatagcaggcagtacattagctagctaatgttaatgcatggtactgtagattaatgctatacactgtacgttacttgattattaattaaagcacctagctcgccatccactattatattaaaaaattattacttacaaatatgtcaattgcattaatatatactcctacactagcttgtgcgtagtgctcagggttgcttctttacttatatgaggaactcatctctcgcactcgcaaaaccgagggactcattaacgtatgattaattaaatagttttcaattagaacaaatagatttttatggttttataaaataactctaacaacataactcaacataaaatcaacctggccctcagcttattttacaaataatatataatactctgagtggtatggttcaccaagaaaaaaagattaatagctatgatcgagcaaaataaagcattgcaccaacttatgcaacaataatattgacatccctgccgacgtgttttttgtttagtg

SEQ ID NO: 29278 - DNA, 364 bp, Oryza sativa
atttttttttaccagttgagccatctgtccatcgccgtaggcctcttgggctccttcctgtcttggctggttctgctcctgcccagctaaatagttaattattattttttctgttgaattctcatctttatgttggtataaataaatgggataagatattatacatgatttatgatgaatttgataattttatcaactcatgcgtttttcatgtacgtttgtgttgtgcatcttttcactaagccacttttactgtattcattgtttttctttcgttgattcaccagttgaatatgtaatatttgtattcggggttacgggttaggtataccctttacctttcgatatacgtcacatatcggta

SEQ ID NO: 29279 - DNA, 1501 bp, Oryza sativa
acacaccgtttagcagtttgggaagcgtgcacatggaaaatgaggcagatggagctgggaacttgattcgaacacactagcgaagggtggcccgatcttcacgacagtaggtagaaaccaatgataacttgctgtagaaacagtgggtaactagctttatacctgccaaggttggatgcgaccaagcgacggggagagagacaccgaaaccgtgaggacttcgactcgatctccgaacgaccgcaaaaccacaatccggtactaatcctcacaatacggtgcagctgaactggaagccgtagagcacgaactaggggacctcaaagagatcttcctcacaagtccaagaagaactcgcaagaacaaaggggtgtaagatactcaagcagctcggctgcaaaaaccattcaggttatcaaatcatcaaaagctgttttctggaagcacataggagatatttctactaggaacaaccctcctagataggtatgaaacgtcctgaaagtttgaaggacataggctagcccaaaggtctcaacaagcgaattcccgagaatactcgcgcgtctgtttggatagtgagcagccttcagtaaaaatgtcattactccttattgggaagtccaaatgacatggggtaggttgcgttggaaagctaacttaataagatttcacaccatgtgcataatgcactgcgaaatattgtagattgatacagttttgcatggaaagttggaagtcttggcaaactgttggccttcaaagcagtgtccactaatatggccataactctttagtgggaaatccaatggacgagcggtttgttgggtgtgaaaatagactcaataagctttccagaaagtgctcattcaccttcatagcttttgagaatcaaaagttatgacgatttcttgaactagtccgttttgaagctgaactggtccgtttttactggtcctttttcaccgtccgattcagcttcctcttgttgcatattcataagcacaaccaaagtagaacgtttaggtagtataacattctcatctatagatgcatctaatcagtccttccattacttgatcacgtgtagcagtagttgaacttggtatagtcataactgggatgtcctcaacagaactactccctccgtcccaaaaatactccctccgtcccaaaaatactcaacctagtattagataaagttttctagtacaacgaatctggacatactcttatctatgttcattaaacttttttggacgaagggagtagaactatagaaacacagccttagtgtggttaggtgtttgcttaatccgtttccgagtcgtttgcgtccctaattataaatatatgtcaattgagatgttaggtgaataatgatacaaatctatatacctcaataaaagataacagtgatagttatgctacctgcattcgcatgttttataaattagttcccagtatgtcctccattatgcaatagtctaatatatgttta

SEQ ID NO: 29280 - DNA, 1501 bp, Oryza sativa
gcggggttcagtagcgtgttcgttcagaagccggatcgaattgtgtcgcgactccgcccaaatcgactgtttatcaatacatatcggaagatcgggacctaacatccctcatcagttagtatcatagcgcggttgcccgttaggtaatttatctacccataacaagaaaattgccacacaaaaatattgcatccattacctagccaatttgagccgttgcattgttctattaatttttgcgtcgttgaattttagattgcatcgtcgtgtcgagtgctggtttagtttcagatttaatttttagttgtgagtattgcatttgttcatcactttgggttagtcatgtccgtcaatttgggtccagttttgcatctcatcggttgttgctgggaccttgaaaaatcgaatctactaatcatcaggtttccgtttttgtggtttggaggagttttctttgagcggtttctgtgttgccatgtcggttctgtgttcgtgctttttgtgcacacgttgaggagagaaacagattggcatatcggtttgttttctatagggggtttatctgatctgtgtcgtcaaacggaagaaaatctccacatattttccaatcttccacagtagtctgaatccaactcgtccttgtcacggccgacccccacctccacctcacgggtttcttccatgcctcctcctcgatcaccacattgttaggtattttggtggttgtagatttgagtttttttttaaaaaaaaaggaacctacatgcatgatgtgagcattccatttttgagctggtccaattttagttttgcactttgcatttgagtccctacaatatttatatttacatttgagtccctggttgaggtcattgattggttcctgctgaaaaaagtaaaaagaaaaaagaaaaggttgaaaggtgcaaagaaaaaaaaaagccgcacctaaaaaaattaaaaaaatgcagaaaggtgcttaaaaaaagccgcaccagaaagaaaaaaaatcaatcatcttttgagtatggtttgagagtgcagagttgtgcattgattcatatatagtccttaatgttgtcgggtgcttgcttgagctagagttgagtctaggttaggccagcacattgactagtactttgaactattattcaactttgaattttctgattaacacaattgcgttcttttgctactatatattgtgcctcccaagctccacatatatacttctggtcagcaccactttgatccttgcaatcgctacatcaagttcttcaaggtgtcacgaaccagccaccagttgtaccgtccttagcattgctggtaagacacttattcttagtaagctgctccatttggctgagttgttgagaggcaccgctacactgtgtagcagattattagggataaccttcactgtttgttgttgtttttgtgtttgcaatgacaggtatgagtggcactcaaaatcagcaacaccaacaaggtaacaataatc

SEQ ID NO: 29281 - DNA, 398 bp, Oryza sativa
  unsure (1)..(398): unsure at all n locations
tctgtattttcaaaagagaacgaacttagaacttgactcaaatacagatctacatttccaaaagcaaacgaacttaaaaaccgactcatatatggatgacttaccaaagtaccggcaaaaaaacaacttcaattttttataatagtagagatataatatatatataataggtaaagaaatacaaatattacatattcaactggtgaatctgtcaacgggtgatacccgtagaccgaatatagaggatatcggggtatgttggtacaagggtctacgtaatcngacatccagcaaacaaaagacgaagattatactagttcaggccccttgataagtaatagccctaatccagttgatgtgggatatatgacggaaaacacaggttacaaagggaacga

SEQ ID NO: 29282 - DNA, 1041 bp, Oryza sativa
agccgctcgcactgttgtattgcaacttcatacagatcagtgtcagtaagatgtaaagctcatcatcactggccaatcgatgagacaaggtaaacccgtgagatttacagttcatcatagcaaaacatgcctcagaaaaaacctagtgagatttacatgcccagtggttcaaatcctgacacaggttcaacattcatcataggcacagtacactaacatcacaaacttttctgcagccataacaaaagggaacagaaggcaaaatacaaaagcagaatcgttcgtgtccaaactgaagatcaataattaccagaaacagagagctaacaattgtcctactgagttgtaaccaaagcggcagatcaaagaaacaaaacacgaatgtttcagccttgcgtcgattcgattcgtatcaccattgcaattcaagggcctcagaacacgcacataacatcctatatgcatacacaattcaattcatacaagtgcctctgtgtacccaaagaaacactgtcctgaaaacagagcaaagcttttcttgaaagaaagaaagggaaaaaagaatgccattgggcaatagagaaatcaaatcattatgtgcctcaactttcagctccaatgtagtaacgatcatagatgcattgcatcgctcagaagtgacaaaaatttattatcatcggcacaagcacatgagcagttgagcacacagcagaagcagaagcaggccaagatacggctgcttcaagaagcaagagatccagatagctagcaggtgcgccatccaaaaagaaaaagaacgaagcaacagattaagctgaagaaagtaaagtagcagtaacagtaataaatgagtaactaaggtcgtcgggcacggcagaaaagagacgacgagtcacgacttgatcaacgagacgaaaaagagaatctgacacgtggacggggtggattgttcccgtcagaaaacccaacggtctcgatggtttcgtcgcgcgcaaggcgcggcggttgaagggaccgaccgaccacctctgctgctgcagg

SEQ ID NO: 29283 - DNA, 216 bp, Oryza sativa
tcacccgcccactagcaacccccctcaccacgtcacttttgttccatagaagacaagagatcaagttttacacgttttggattcggattcgggcctcctgacagcatcaaatttaaatggacctagccgctgatcttgaaggaatttgggggcctatgagtacttgttggaaagcttatggagtctactttcagatggttttgttcccacttcaga

SEQ ID NO: 29284 - DNA, 563 bp, Oryza sativa
actcccttgcattaattatgcatctccggcgtggcttgctgagtactgtggttgtactcattcttgctctatctttctcccccctttcagtaagagaagctttggagaagaagtcttaggtggagtcttggcttataccccagttgagcgcctgtaaagatggagccgtaggccgctagtccgctgctgtttatttttgattgtcaggcctgaagcgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacactatttatggcaaaacggtgaagggcaagcaaggctccgctacaatggaccatgcgtggggtgaaggtcaagcaagaggcttggcgccgatggaccgaatccggtggtgaagggcgagtgaaggctttgtcatgatggtcgtggtggaccgtgcgaggccatttgaagctatgagtaatccgtatcaattataagaagaccgcaaga

SEQ ID NO: 29285 - DNA, 1501 bp, Oryza sativa
ggtaccataccgccttatgttttgcaactggtgttttggtgactgagacgatgtacataattgtacagcagtacagataccaaggtagatcaaataaacacgagattgttattactcgaagaaaacattggtttgatctgctatatcctactacaatttgatagtaagcttttttttttttcaaggaacaccatttccctttcctccaggaccgatgcttttcatggctctcttttcttaggcgctcgagtgcgccacttgattatggcttcaatttcatccggtggtatgaatgcctataaaaaaatgtaaatgtaaataaacattcatatgtacgaggcaattgcttctgtaaacatatatacacacacaacctgtcacactcatattacattaccgaaaatttgtagggatcaaaccaaacaagtttatcttctatgtgtcaaatatatgtccttttttcccctaaaaaatatttcctccttcttaagaacgacaacttcagttttccacccgttggacttaaaagggagacaaacttcaaaactggaattaaagtttaacccttttttttttgaaaaaaaagaagaagatcatgggcacaagatgaatttaggccttgtttagttggcaaaaaattttgagctgacatgtcacatcggatatatggacatacatttaaaatattaaaagtagactaataacaaaacaaattacagatttcgcctgtaatatgcgagatgaatttattaagcttaattaatccgtcattagcaaatgtttactgtagcacaacattgtcaaatcatggagcaattaggcttaaaaaattcgtctcgcaatttacacgcaacctgtgtaattaattttttctatatttaatactctatatatatgcctaaacattcgatataacagggtaaaaagtttctgtttgggaactaaatgggggccttaattcagaatttccgatgttcatttgggctgagagacccatatggcccattgggctttccacggtggtggaatattccaccatggaggaaaggaatattcccccaccctctccctctccgcccgcttcggttttccctcctctctccggcgagcgccgccttctcaccaccggccgccatgagatctccggccgccgcggagttctccgacgcgctgccatctccgacctctcccgccgcgacgccatcccaccccaggtgagcgcccccccaatctcccccgtcgcccaccctcgcgtctcgtctcgtctcgtctcgtgttggctaatcagtaatccacctcctcctccccctcttcttcttccccagctccggccgccacttctacctcgccgtcgaccgcctccagttcaagatggtacgaggcctcaccgcccctcgtctctctctctccgatggtgaccatgccatgcccagctccgactaatggagggcacacgccgcgtgaattgaaaattttaaatctgtggccgtgcctgtgttgc

SEQ ID NO: 29286 - DNA, 462 bp, Oryza sativa
tcctgcagcccggtagctagataaaatataagatgaaaagttaattgaattaccacttgtgaatagcatacctttgagaatggttcacttctcatgagactaaacataaaatacacttaacaagaagttagtctaaaaaaatacaaaacataggacatgctccccctaaatagtgcatgcaagcttgaattacttgatagaagcatgcacttgtctaatgaaaagaaatgaggagtacaccctataatttcaacaatttgcacataaatgatttgcaagaatatacatgtgccaaacattgggtagtaataatgcatgtaaattgccacaagataatagatggcaatcaaccataagaaagaatattcatgacacttgaagcttgtatatgtagagatgatgtaaaagatttaccattggagcatacaagtccttagtagaccgaaactttcggttcataca

SEQ ID NO: 29287 - DNA, 1501 bp, Oryza sativa
cagcttagttgttttataaacggtaattttggagtcatatatagcaatgtaaaaatgcttatagctttaaagaaaaccaaataaaaaatgttgtcttttaggcttaattttttttcaaaaactagcatataaacctaatcacagagtgccttaatttgaactgctcgtaaaagttcaattatgaatgttcagttgttggcgttgctgtggctgcatgccgcagcaaaaagaagccgaaacaggccaattatctcatattttcaccgtctcgagatttctttttgcagtagaaatgtcctttcgatggattttgtaacacagagtcatttttctataagaaaaaaaaagaggaaaatctcactcccctctcacctcgcgtcgttcatgctccgcccagagcaccacctccgctcgccgccggcgacctccccggcccactccaccatctcctacccgcccctccgccaccgcggcgcgttccggctcccccgcgcggcgcctccccagctcaggggcgccgtgcgcgcgtgcgcgcccgcgtccgcgtcgtcggtgccgggcgcgacggcgccattggaggtggaggtggcggtggcgcaccgggaggtggctcgggagctcgcgtcccgggcggaggcgcggctgggcgcgcggctgctcccctccgccgtgccgcccgacgtcgccaagttccgcagcggcggcggcggcgccgggaacgccgtgggctcgctcgacgtgcgccgcggcgcgccgggatcgacggtaatggcacccccttcctctctcacatttgttcgtcagatcatacagattttagcttgtgcctgcgcgattggcttagcttctctccccacgaagtataagctgctaattaaaatttactgttctgttaattggagattatttctactgcagtaatttctagagcacaattagtcatatgaaatagtgaaattgtagtgacaggcaggtagagtagagcaatcctatgacgaaatgcagtaaattacactgaaactgtttcagtacagtttactgaaactgttttacactgaaaatttgctgccgaactattcgtgattgccctatcaaggtgaacttgcaagctttgagaagccaagatccacaatccaactctttggagcaaattatgattgtttgttagattagtaatgctcaaattagttgatttattagtgctgcgaaacatccaagattgaaatggcaacaattggtctgctcaagcgtttgtgcctcattcgtgatcttttcctaccactcaaagatttctttttactctccaaagaaaaggtatctcaccaattgaacagatacaattggagtggccaaaatgatcaatggcattcaaacaatgttattaatctcaccacttgaacacctgaatcaagctgcctaatgcttagcacagtataataatttcttgagttctgcaaggaatgacaagtggggttgaattattatttttcttgtctacaga

SEQ ID NO: 29288 - DNA, 413 bp, Oryza sativa
cctctaaatattgcactcaaataaattaggaaatctcttttgtgaattctttccaaattcaaattctttgcaaaacctagttatccaaatcaagtattcaaattaggcttctttctttttgtcatcgggccgaaactccattctttcttcctttttggcccaatcccttttcttttatcttctattttcctcctccttcttgagctgccggcccagctaagccgagccggcccaaaccagcccacaccccaaccgagccgccccctcctcccgtgcacggctcacgccgccgccaactcctcttccttcgccgctaaggaaacgaagccggccgccgtagttcgaatcttcacgccattgtcgcccgtgcacttctcgatctcctccacaaccgcctttcaccaccgcctctc

SEQ ID NO: 29289 - DNA, 223 bp, Oryza sativa
gaggaataattaaatacatcttgaagtgaattctatggatcgtaaacatgttaattgcatcatgattggtttgttaacctggaaagtatgtttattgtatgttatatgtcttactagaattatgcatgcttgtttctcttagcactgaaggtttatctaaaactatgttttgcattatgttagtttattgatttggcatctactgtatctctttcattctagt

SEQ ID NO: 29290 - DNA, 391 bp, Oryza sativa
cggtgctcgcgtgtcgctgcgtgcgcgcgcgctcggccgtggtgatatcccttgctcagttcatctgaggcacgcacgaatcgaatcaatcgaaacccattttatttccccttaagagttctttctcgcgaaatcgaattcccccacctaatatatagttagaatttcagccttacgggtggcgaatcctgaattttgtctctggattttgctggaaccatggacagtttctcacttttttcttggtttgttaatcgatctgtctgccagatctactacggtcggattgcttctttagtttgaatctgtgaaaccttttgttttcgatttttcacgtcggctgcttctttaatcttgattgatttctgatgacttccgtttcgattgtagc

SEQ ID NO: 29291 - DNA, 212 bp, Oryza sativa
gtgggaatcaaatgagagagatagacttaaaggaaatttttcaagaggttaaaatggatgttaatttttttacatttttcctctaaaatagtaggaataggaaagtttcctatgttttttcttttctcattcctacgaattaaaggtatggatagtgtaggatttcagttttttttcctccaatttaaaggggctaagctttggtggaaaga

SEQ ID NO: 29292 - DNA, 536 bp, Oryza sativa
cgggttgccagttcggtctgaatcatcgtaggccttgggttaaggcaggttcgtgtgggttcacggccttgataaataatattgtatagttctagaatcgtgtttacaaaatagctttgcgcaaccaagtgtctttaaatgctgtttactgcaaccctaaccctttatagtataactcctttgtactcccttgcatttattctgcacttgtgggtgtgtcttgttgagtacggtggttgtactcagtcttgctcaattttttcccaaacccagaagaggagttcctggaggatgaaggctttggtgtctagctcgtgcctgccgtcaagcgcctgtggtcgtcgccctagtcttccgctgtttctcgtttgtctttgtgtgtgctgggccttcgctgcccatgtaataaattaactatttacgcttccgcttgttaaactctgaattgtatcaacttttggtgtaccttgcctcctgggacaaggaataatacacgcacgtaaggaacgcccgttgggttatttccggtcgtgaca

SEQ ID NO: 29293 - DNA, 1501 bp, Oryza sativa
gaaataagtggctagtgaaaactgttacttttgctgcacagtttcatgatatctatgtatttacctaacaggttgttccatccggaaaatcacccgcagcgacaaaaagccagcgaagaccaggagtttcgtcgagactgaaaggaagattggagaacatgggttgggttggaatcttgctcaacttgttgtggtgatgggcacttgtgctgctgctagtcctcagttgactaactgaaatgtatcgttcgttcttgtggtgtgtatgagagggctgcatttgtttcctagttcatatttaaatcgattctctggtagaacatcaggctcaaagactgtccacgattgaattgaattgaactgtgatgccttgtgttgtatttcagcggctgttgtgatctgcaagtggattcagtagtatccatgctttgtcattacacaacagaagtaataagagcttactgttttgtgaattctcgttaatatttttcatgatgtttggatggaaatggactcaattaaaaattgcgtgcagaagctgttgcgtcataccaggcttggggtctgggggcctggtttgttcttcagataacttttcaagctctgtaacctgaagcaaagcattagtttcaggctttcagctttaaccaatgcctagatagataccaggctaccatcttctgattctggtgacatggattggggtgtttagccctcttgggacatactccctccgtttcgaaatgtttgacaccgttaactttttagcacatgtttgaccgttcgtcttattcaaaaacttttgtgaaatatgtaaaattatatacctacataaaaatatatttaacaatgaatcaaatgtaagaaaagaattaataattacttaaatctgcggaataagacgaacggtcaaacatgtgctaaaaagtcaacagcgtcaaacatttcgaaacggagggagtatatagtatctagttatctaacagacaaacccagattaacatttttccaccagaacgcctacttaatttggtcatgaaacttgtcacacttttggaagtgaccaggatgcagacacatcaaatctttttaattactttttctttttgcaattttcttattatttcactggtggagaaaccatctttggtcagtcaaccaaaatccacaatagtcccggttccactaaagatgatctttagtcccggttggtagctacagtaggcatatttgatctttagttccggttggtaataccaaccgggatctttagtcccggttcgtatgttgtcaggggctgtcaggccctcccgtgatctttagtcccggttgttaacaccaaccgggactaaaaattctaactttagtcccggttggtgttaccaaccgggagtaaagaccgtgatctttactcccggttggtaaagttaggatttttagtcccggttgttaaacaaccggtaaaacaaaacctctatccagtacacgcgcatgcaaagtc

SEQ ID NO: 29294 - DNA, 691 bp, Oryza sativa
cggaggcggaggaggaggcgcgacagggacgggtgggggaaccacaaccggagttgcagtcacacggcggcgagggtagtggcggcggccaccaaccctagccctgcctctgcgggatccccggagtgtcctcctcatcggtcggcgaagaagatggcggagccggcgtgcgcgctgatgtcgagggaggccaagaacggcatccatgattcaatgaaaggtaggcatcgtaccttctgtttttcctgttcgctttttctgtagatcaaaaagtgatgtttccttctttcacttcgcgatctccttcgcgagagcgaaaagtgctgataacgtattgtaaataagattgattgtagcgagagagattgagcgagagcgagagattaagggaatgaatgagcggatcctttattgataacagtgttacaatatataggagggagaaaggcggcaaccgaaggcgcgatggtttgggaaccatcgcgtccgttgctagaattgccgtgaggcgagaagaggtgtggggcacaaccaaccgtcgtgtccctgaattggttgctgctctatccaaatatatggatgagatcacccaaatatttcataacaggaggacgctccctcctggaaaaaaatagaaccctctaaaaaattgaaactgcattctttttaaacaaaaagatggttttctaca

SEQ ID NO: 29295 - DNA, 660 bp, Oryza sativa
gttcaacgtggggagcgttgatcagtgaaattcaatattcttaaattactcaactgtttactggtttgctcaataaaatgttttacaaccgcctttatgcaaataagcaccaacccgtccttgtgttccccttgcacgtctgcatcgttggtgtggcttgttgagtacggtggttgtactcagccttgtatttattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgttcggaactgtatattacttgtcgttttgtgtaccctggctggtcctggacagggatttaatacacaaaatagtctggaaatttgggctaaatttctgggcgtgacaaagtggtatcagagccaacttgactgtaggttgagccaaatggtcaaaccgtaaggacaagttttctgaaaatcctatttgcgaagtgtctcctctcgcccttcggcatttctttgcgaaacagtttattaaaatttttcctccctgtccctccaactcttttagt

SEQ ID NO: 29296 - DNA, 234 bp, Oryza sativa
gttcaacgtggggagcgttgatcagtgaaattcaatattcttaaattactcaactgtttactggtttgctcaataaaatgttttacaaccgcctttatgcaaataagcaccaacccgtccttgtgttccccttgcacgtctgcatcgttggtgtggcttgttgagtacggtggttgtactcagccttgtatttattcccccttttcagaagtgtagtgcttctgagctgaagat

SEQ ID NO: 29297 - DNA, 1501 bp, Oryza sativa
acaccacaagaacgaacgatacatttcagttagtcaactgaggactagcagcagcacaagtgcccatcaccacaacaagttgagcaagattccaacccaacccatgttctccaatcttcctttcagtctcgacgaaactcctggtcttcgctggctttttgtcgctgcgggtgattttccggatggaacaacctgttaggtaaatacatagatatcatgaaactgtgcagcaaaagtaacagttttcactagccacttatttcagtgcttacaacaaatgaaggtgattgatcctgttatgttgtctggtcatgaggtgtagcagtggaatttgtaggccgcctcctcctcttgcatggctctgaatcgacttcgacatcttcgtcaggaaaattctgatcagatacttctggacaagcaaaaaggaacacgaaacatgtgttaattccaggtttcatggctatgagaacttgagaaggatgacaattgatagtattaatcaatgaagtttgctgacacaagcaagaaacagtgcaacaccatacgcaattgcagtttactgatctgtttctgctgttccattatttgtaaagatccaaacacttgcttgtttgttagctagttttaggaaaataagtgttgaaaaaatctttttacaagttagatgtgattacacataaggtaataaatacgatgaatctatgaacaaagttgttctcgaaacagttaaaagtcaaaggcaaaagggaaaatttgtttggtgaaccatgatgcaacttgttgagtatatgcagaaaaaaacatggttacaaaatttgtgcattgatcaaacatgaattgaacacaatagctacttcaactcattaattttttttacatttgcagcaggggcaaataagatccatattatgtataacttttcatttaaaactgcaccatttcgagcatacttatttaccaactaaagagtctaactgcacagtcaagactgaataataaacatatcctaaactcgtatcaaaacagaagcaagacttgcactgaagaaagcgatttgcaaataagatgaccaaagtagtaacctgtgcttttatcagcaagaattcctccagcacaactcttcgcttctcttccatgcacccgaaccctctgtcggaccatgtcagtacccgactcatcgtcatccacagaaaaccccaccgcatcattcttgcggttcacaccggcatcgcgtggtctgaaacgccttatccatggattctcagggaagcagctcatgcctccatcatgagcgtgagcatcattcctctcagaccttaggttgtcgcacacaccctcccggtgcaccctgaacccaattgcgccacccgcatgactcctattcctgtcaagcccatggtggtcatgcctatagagttgttccatgaaggatgcctccatggagcttatgtacaagctgtgcctctcatttgtccatccatctgacatcaagtccaggaat

SEQ ID NO: 29298 - DNA, 1501 bp, Oryza sativa
ttcctggaggatgaaggctttggtgtctagctcgtgtctgccgtcaagcgcctgtggtcgtcgccctagtcttccactgtttctcgtttgtctttgtgtgtgctgggccttcgctgcccatgtaataaattaactatttacgcttccgcttgttaaactctgaattgtatcaacttttggtgtaccttgcctcctgggacaaggaataatacacgcacgtaaggaacgcccgttgggttatttccggtcgtgacaagttggtatcagagccacctttgaccctaggacgagccgtagatcccaagccttagcaatattttcaaaaataaaaaaaaatcctgtcttatttgtgaaaatcctctagtctctctctgtcctgttgcttcatttatcgccaaaatctgacctttaaaatgttgtttttctttttgtttttgtttgtagatggccggcagcatcagccgtcgtggtctggacctgactggtttcgtcttggagctgcggggcatgtgcgttgtcctggggtatccacatggagtggactaccagggcaggccgcttccggagcaggagggtgacgatgcagagccccacgctgcttgggaggttactgcagtgatcctcactggctctcccgagcggacttcgttggcagtcaccgcgggtggagattctttccccgccgcttgccagaacgccgctctcctcgccatcggcactcttcaccagcgctacccggacgagttgcagcactcgccctaccgctaccaccctcgccgcggaggagcccgcgacttcgccaccttccgggatgctagctcggaggatgacgctaccatcatgcacctggcgcgcatggtggaggcgtacgacgcggctcgtatcgacttccatcagatggtgcgccgtgggatggtcgagaacaacatgaagatcctggagctgcgtcaagagaatctgcagctgaagaaggaactagacgcagtggaggcgcagctgcatcagctcaagatcgcccagggagaggtctgtcgccccaagcgtcgccgcgtctgccgcagccagaagatcaccgcccgcaagagcacctccaggcccgagcttgttcgtcagtccctggcgtggacttgcttcgtcgagacccctcgtgccgagcccgcgcccgtggttcctcaggagggggaagcctccggcgttggtagcacggaggatgcgctgttgctcaccttccgtcctggcccgtcgcagcggtagacgagcagttagtaggcttgcgcgtgtattctttctcgtttgtcttcttgttggagtcgtgtggggcatggttatgccggtgtgtggtataactgtgtcggagcctgtctttattttatttgcttaagcaacttgaactttaatgaactaatttaatagcagtaataaattcaagaattatggtagtcgtgggtggttagctttaattgtcagctctctctgtttgctggtcctgtgtggggttttc

SEQ ID NO: 29299 - DNA, 1501 bp, Oryza sativa
agtgtagccccgattttgacattcttgtcggggttagcactagagagcggaacgatcttgacggcgccgttcggcttcggcgtcttgtttggctttctcactttcttgggtggctcagacgtggcgggtggagtgggcgtttgctcgaccatgtcgaggcttcgcttgtcgcactgcaccgccagttttgcgttcccttgaatagtgattgtccccttcggccccggcatcttgagtacttgatatgcgtagtgggatgcggccacgaacttcgcaagtgcagtcctcccgatgatggcgttgtaagctgtatcgaattcagcgacatcaaaggtgatttgctctgttcggaagttgttggcttggccaaaggttacaggcaacgtaatcttgcccaaaggtctggatgatgattggggagtaatcccatggaaaggttgatcagttggcgtcaactcactttgtggaattcccattgcctccagagtgctggcaaaaagaaggttgatcgagctgcccccgtcaatgaggacccgtgctaccttgatgttccgaatagtaggttcgaccacaatcggataccgtcctgggataaccgcggtcttgggatggtctgcttccgagaactccatcttctgctcggaccacttcatcttgggtgcagccccctgccatgtcgagcaaacttcgcgttccactttcttgtattctcgcttggaggagtacgtcgtggaaccgccaagatgtgcgaaacatggaggtcggagtctgggtacgcagagtccgattcgtgaggaggcgactcctcgttcttctcgacaacgcgtactcgcttgcctttctcaaacgccatgtgcttctcgagcgactttttgaaaacaaggcaatcctccagagaatgtctgtctgttttgtgtatggggcaccatgatttctttgtgtcgctgccttgtgggtccgggcgcctgggagggttcgcgtactctgctgcgagaacttccgcttgagctttccttttcccgtttttgcgatttttcttcttgctcgactcagatgtgtctgcggctgactttttctctcccccagtcttcggcttgtcgttcttgcgtcttagtgcgtcgtcgacgtgggcgcatctttcaacgatctggaataaccttcgagtagttgtgatatgccttgttgccaactcctgggtagtgtagcgatctctgacgccagacttgaaggcgcgaattacagaagcgtcggtgatttcggggatggtattcctgcattcgttaaagcgccgaacgtattccctcaaagattcacctgagttctgtgttaacgcgtgaagatcgtcctcgatcgcgtggcgcttgtatgttccttggaagttggcgacaaactgctgccacaggtctgcccacgaagaaattgagtagggggggagatgcatcagccacgaacgtgcagatcccttcaacgcggttggtaaatagtttgccaccgcgttgtc

SEQ ID NO: 29300 - DNA, 278 bp, Oryza sativa
aaaatctacatttggaagttccatataatttgagctaaaagtcgtatgattttgagttgaagttgaaagttttatatgagaatgctactaagaaggagaaaaatatgtacactgaaaatgtacgtgcgctaattagcgatcccctttggtccttttctgagagcggcgcctatgttgttactgctgatacattagtggtacacggaagatgatctttggcttactttcctttgtttttgagacactgacatatagacccgctggatagagggttcaca

SEQ ID NO: 29301 - DNA, 828 bp, Oryza sativa
ttcttgcggcggcttaaggtggagctgaagctgccggtgctggcattggtggactccaacccatatgggctggagatcttgtcagtgtacatgtgtggtccaagaacatgtcatatgacagggccaacctgacaacaccggatattaagtggctcggagtgcggccaagcgatctggacaagtatcgggtgccggaacagtgccggcttccgatgactgatcacgatatcaaggtggggaaagagctgcttgaggaggactttgtcaaacagaatgaaggatgggtgaaggagctggagacgatgttgcggacgaggcagaaggctgagatacaggctctcagttcatttggtttccagtatctcactgaggtctatctacctctcaagctgcagcaacaggactggatttgaggaccctttctatgctagatgaataggtgaattttcatgcatttatttgactactgcgctgtgcactagatttatttatttaaaataaggtatttttgagaatcagtattcccatgggccatggctagtcgaagtcaaaaggtagctccaaaatgttcagtcaaaatgcatggttaactaatttctatgttagattaggttctttatgttaggttctttaggaagtattgcacacccctgactgagagtttgtaggatcaaattgataagggtgaccaagattgcctcgtagtaccgtcagatgtggaaatcttcttctagcattatgtatttgaacagcagctgctgtgtgtattcactaatttttaagaacatggaaatgcttacttcagcatgtattcagagcaggtatagt

SEQ ID NO: 29302 - DNA, 518 bp, Oryza sativa
tgcaacgcgggctataggactgcttcgggatgcatggatgacaatttgctgaggagcaagcttctgattgcagggagttgcgtggactgacgtgccggcagctatgtttctcggttttgggcacttgtcggcgaaatgacccattccttgacaattgaagcaacagatgtcttcccggactcggcattttcttttctcatttcgattcctctgtcctggcactggagttaggctgaaacggtaatcttggcggggatttgtgttgccttgatgcttctctccgttggaactggcgggttggttggccatcttcttcgtcagcagaaaactgaattgacaatcttttggtacatgatcagttccttcacaaaagaaacaagtgatcctgctcgttggacacctgtcgggtggatggtcttcctcacaatgaacgcatgtagtggcacacgagctggcaacatgaccgacttctccacaacgagagcatgccttacgttccatttcatcttcatcatctg

SEQ ID NO: 29303 - DNA, 1395 bp, Oryza sativa
cccggtcgtcgtcgtcgtcgtcgtcctctcgtcgttcccggtcgtcgtggcgttcgtccctccgtcgagccgttctcgtccgtcgtccgcgttcgtcaagcgagccgctgcagccccgtcctcgcctccgtcctcggctccgcgtcgtcaagcctcgtgccggccgcgtctcgcctttgtccaaggatcgccgccgaagccgtcccctcgccgttcgtctccgttgtgcccgtctgtctccgccgcgcccgttcgtcgttggcgttcccacgcctcgtcgcgtggtggtaaggatccgtcctctcgcttccccgccctcgtcctttcggtgtcgccccgtacccgttgtgcggttgtcgacaccggtacccgtgtgccggtgtcggtagtcgttcgcttgtgcgtgtggtgtccgtgttagtgtgcccgctcggtagccgcgtggtttctacgtgtgcatcccgtgtggtgtctagtggagtccgtttgttggccactcgcctcggttgacacacggggtccgcttccgtcgacccgtggaccgtctctgtgtacccggtctaccgcggtcctttaggttgacatgtggggtccgcatgtcaacggcgcagccttcctgtcttttccaggctagcgcttacacatgttttatagttgcaaagcttaattataataatccgcaaatctccatataacagcattaaacttcggatgatcatatcttggtcatacgaactctgaatcgacccgttcaagtctcctaatgtttgttataacctaaagaaccctgtgctttctttttatgtattgttattgcttctttataggtttgtagctttgcttgtgtgcttcgcgtagcttctgtcgttccggaggttcccgaagcgtggttcgcggtcgtcgccgaaggttcggaagtccgttctctctgagcaaggcaagtcacatcatccttgagcatattgaatcccagtttataaaattattttgatttaaattattgcattaccgctttatttaaattcccgcgttatcactgttttatttagccatgcctatttacctttgttatgaccttattattgttattgttattattattaccttgttcaccctagattaaacaaaacctcaactagtggacactctactcatggttccactagtatgaacttaggtagatgcttcgctggttaattaggcaacattaggtggtttttataactttagactttgggaattctcatatcatatggacactatggaattgttggtttatggtggaattggacatacacctctcttcccctttcaaaacccctaaaacctgttttcggtggggtttgggtgcatgccagttgtgggaagtagcaccccggccactataaggattaa

SEQ ID NO: 29304 - DNA, 454 bp, Oryza sativa
gaacccaaccttcttatggttatggggcaacgcgatgaagcgtgcggccttgcacaagcgcttcaatgagtacccaatgtggcttacttttccattcagaaaaacatcgaatatcctgtttcagatattttttgtttggatggatgaattttccggttaaaaggacagataccgacagtggaaagagtaagtacggtttttttgttagggatgaacacaataataaaataagattcagtacatgccatcctgtcaaactaatttcacattaattaatgatcaaatttacttttggcgatcgtgtaaaattaattttgccatgaaagaatgaatgcagagagtagctctttctttttcttttttattaactatttttttttctcttccaaaatttgacatttcaattctagtatggcatctctctgaacatgcctatgtgtctgtctgttgtaga

SEQ ID NO: 29305 - DNA, 1501 bp, Oryza sativa
ttaattattctaggcataatttcaaggatgtattttagagtcgttttgggacgcgacattcgagcatatcggctttgcatcttctcggaggttgttgatgtggtctaacccctcgtttgataggtagctgatgttcaacaatcgatcggctgagtcctggcatctcataatactcccaagcaaagcaatatctgaattcctttaacagctctatcaacttggttctaaattctgaagataagttcttactgataaatctcggccttggtcgatcacctggaccaatgtcaatctcttccaaatcatcggccgacatgaaaccctgtccttgcttgtcatcgagatcatctactatgtccttggtgtagacgtttgaaccctccacgacgccctcaaaataatagcttgggctctccatcttcaattggctgtttatcacaatcggacacttttagaaaatctccatcccaaacttttctagataagcaatcgagaccatccatctcccaaagagctaaattggcactggcaacgttgactgacctgtcggctggcacgatttcaatcttgtcgccttgccactgaatcaagcattgatgcatggttgaaggaatacaacaattggcatgaatccaatccctaccaagcaacaagctgtaagaacccttcccaccgatgacaaagaatgttgtagggacagttttgctaccgactgtcagttccacattcaaaactcctttggtttctgatgtattgccaccaaaatctttgagcgctgttgtcgaaacaacaactgcatacgttgaaagacgtggttactcaacggtggttggaaagaaagtaaagtgtattgaattgagaatttttcttaggatccccctgttacatgaccctaggagactatttatagccttattacaggttcttgctactagggtttaggttatacaggggaatttacttggctgcccttatgaaagggacatttatgtgggtatacagtgtaattgaggtacatgggctcctaatgggccgtcaggcgattgttggctcaaaggccactgggccttcgtgaggccgaacttgctatggcgaagtcgtctcccttcgacatacactcttcgccttacatccttcgcccaagaggtctttggctctgcgaggcacccgcgctattctccgcccttcgcggtctttgctccatagtcttcaccatgggggcttcgccccaaccgatcttgacgtcttaggcttgaatccttactggtcgcatggtttcggcaggtttggtcgaagggcctcatgccataccgccaacaagcccctcacgggcaagggtgagataggagcttcggccgagaccgtgcagaccatgtggtatggtatgtggctccccctttcgaccgatgctcctgccgaaacctatcttattcgtgcaaagaaagtgtgttgtgttttttcggttggtattgttttgtagctttcgcctcttgcggatggt

SEQ ID NO: 29306 - DNA, 1501 bp, Oryza sativa
ggagggcacgatttggtatgggaggagcagcggcgactccatccggcggtggatccgccgcctcctagtcccagctctctctcccccgatcctcctcctccccttcctccaccgccaccacccacccctctccctctctcagatctggtgcgcggggagcggtggaggctacggcggcggcggcggcgagatcggtagcagtgatggtggagaggacggatccgatggcggtggttctcgtcaaccagttcaaggacgacgacagcagcggctgctgcaacgatggataggctctgggcggctcctccactctcctcccctctctcatatccagtggctcggggtggtggggcgtggccgacgcatccggcggcggagctcgggtatcgatccggcatgtttttttttctccaaaatcaatttttcttggtggtcgggaaacggattttcaattttctttttttcgctcgaatatctttttcgctggcggtcaacgtaacttaaccgcttgtgaaaacaagctttaaagtttcgctagtgaagattgttattttcacttgccatttgtttgcgggcggctgacagtgccaccagcgaaaaactcttttgctagtagtgattgctagatggtcagcagagaacttgtggagcatatgactatcaactaacagtacacttcagcagaaagaggatggttctagctctccgatggtttaatattgaaacgtacagcccacccaccaccaccccagtcgtccccagctaagcgctcccttgcttgcctcagtagacgagctgccaactagtagcactccagcaagcagcgggtcagcggagtccggagggcgcacgtgcgccgcagcgaggtatcagcatggccaggcggcggctggctggccggccgggttcggcaagcggctaagcaggtaattaagggactgcagatactgcttgtgatcatcccttaaaatttcgtctttcttgtcttgggccaggtttaattcctaattttttcttcaaactttcaacttttccatcacatcaaaacttttctacacacacaaactttcaacttaattttccgtcacatcgttccaatttcaatcaaacttctaattttagcgtgaactaaacacacccttggttgtgactctgggagtcgatacataggccttaatgctcgtagtttgtggattttggggttaaactggcgtggaactttacttggataccacctgggagttgatgtgattttagtgtttagtacagtttagagtttattacctaccggtttcttggtgcctggcgcacactgagcatgcaaatgcagtgagagccagtatcatctaagacggctggacctgaaatattttaccatgtatatatcaaactcgacttgatcaggtgtttagcggaggaaggatcgatgtccggcgccggacagagccgtggtcatcgccttggattacacattgattcggattggccagaggtcttgttg

SEQ ID NO: 29307 - DNA, 356 bp, Oryza sativa
taatgtcggttcacctgctccttgtccaactcatgatcctgcatgcttttgtcttgccgtacatatatactagtaggacacatgcatcgatcagtatttttaaatacgttctgtaacacaattaatcgtaatgcgtatatggatcagatggatctctaactaatgcaacaaatggctggcaaaactgtgcgaatttgctcaaatcagatcacctagctttcctgtaatctcctagcaagactaggatttgcattgcatcaaccatcacttatgaaagaaaatgcagggtgcagcctacatgttgccaagcttctcgacctgctgcttctactcgtataactaatggcttctctagc

SEQ ID NO: 29308 - DNA, 1501 bp, Oryza sativa
ggatccgtttggaatcgctcccgcaatcttcgccggcgtcttcaatggcggccgagatctccgcgcccgtttcctccctctccggccgcgctctccccctcccgacgctatataagcgttccccgtgctctcctcctccgtttccgccactcgccgcctctcctccccgtcggaatcgagcccgcaccgtcgcaccttctctccgccgtcgccaccgagctccggttcgccgccgtcgtcgctccggacctcctccccactcggcgtcacctccttcggcttcgccgcgtccccgtcgacctcggccacccctccgcttcgctcgccgaccgccggagcaccgtcgtcctcgccgtcccgaaccgcgccgccgccttcctccgcttcggccgccgttcccgtcgtcgccgtcgacccggggtgagccgaagaccgccctttcgcttccctctcctctccgctctctcgggcgccgctccgccgcgccggtggtcgccggcggtgaccatcggggcgcggtcgtgccgcctcccgtcggccgtgccggcgaggccgccttcgggcgcgccctcgcggctgccaagtgggcccggccgtcagccgcccgcgcccgcgggtgcggctgacgcgtgggacccacggcgccgaccgccgccagccgcgtgctcccggtccaccgtggaccgagaggctgacgcgtgggccccactcccgtggacccggtccgcgcgccctctctctcggctgacgcaataaatgagtttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggggtttagtagagtaaaagccttttcttttccgtcggtcgtgtagatgctgcagcttcggaagatccgctcttcgtggaagttgaagccggcgtttgggaaagcgagcaaggcaagtcacatcatccttgagcatattgaatcccagtttacaaaattatttttaatttaaattaatgcattatcgctttgtttaaattcccgcgttatcactgttttatttagccatgcctatttacctttgttatgaccatactattattgttattgatattattaccttgttcaccctagaataaacaaaaccccaactagtggaccctctatttatggttccactagtatgaatttaggtagatgcttcgctgattaataggacaacattaggtggttttataattttagactttgggtgtattcatatcatttggtcactatggaattgttggtttatggtggaattggacatacacctctcttcctctttcaaaacccctaaaacctgttttcggtggggtttgggtgcatgccagttgtgggaagtagcaccccggccactataaggattaa

SEQ ID NO: 29309 - DNA, 221 bp, Oryza sativa
ttgaaaaaactaacaagctttatttgtctttttctcttggatttgctttgcatgctctcatgttgttaatgagttgactttgacaaaagaacgttttgaaaaaaaatataaagttgctttttgtgcgtgttctttgttcaatgttttgagtgcataaaggattaaacaacacaaatatgttttggtttctccaaattgctcaaagtgttttttgaatgaaa

SEQ ID NO: 29310 - DNA, 1501 bp, Oryza sativa
aaaagaaaatcaagtgattaaccaaagagacatttgtttggactaagagtttcagacgtgtctttttcggatcaaaggcaatgacagtcagtatagcttttggcgaaacacttcaaggtttcactgaaaggtagcagaccaaagtaccacatcgtcaccagaagcatccacaactctcggagtgaagagtacttagtgacaaaggtcaaaagatgactgataggaggtatcgaaaaagatgtttattaccaggcaaagaagtaggtcgaaaggtgattgataagagaaatcgggaaagaacacatcaaggtcaaaggtgtaaaggaatacgttgaatgctaactgaggacaacatgaagtgaatagtggtaagttagaagtaaatgacaagcatgatattctcatgataacgagcatggtatcctagtaatgacaagctgatatcgacgcataacgtgaagtgggtaacttgtatgaggttgactccaaagatatgaactatgcaaagttctggaaccgaagccccatcttcaagtgccgcaacccagtcgaagtcagctaaaggttcaaccagggacaagtcaggtgaagagaagattccatctgcaacaggagatcgagccaagcagtccagagtggagaagttttgctaggcaagtttgttataaaagacgcgacggaagaagtcagacaagaagagaagaccgcccaacctatcttcttgctagcctcctcgaatctcggggacgagattcctgaaaggggggtggatttgtcacgtcctgataaatccattccaaattaaaatccattttctaaaaggaataatagaattaattaaaattcggaaagaaattggcaaacactaaaatacgtgcaagaaaaattcaaatgtggcccggagaatttttgttaaattctccttggtctaaaaaggagccctcaaattttacttgaattttcagagcaccggaaataattattaaacaacaaaaacaattatcaaagttcaataaaaagaaaacctaaaaatccctcctcttcctcctttgggccaagcccagtccgaagtcctcctctcctcccttttttctctccctcctcctcttgggcccccttcccctcggcccacctccctcttccctctccctcccgggctgcctctctcttcccctcccctcccggcctgcccggcccaggccgcctctccctcctctcttcctgggccggccgccggcccaagccgccccagcccccgagccgctcccctcccgcacgtgccgcgcgcgtgcgcgcgctgacgccgccgcccgaccgcgtggggcccgcgcgtcaggcgggcgtcgtcttcctcctcccgcccggctcctctcactcccgtggaaccctagctcgtttcctcctccaaatccgccccggatccaaccgttccttccaaattaattagggggaattaatcccctttccctcctcttcaattcccccttaatttccccttgaa

SEQ ID NO: 29311 - DNA, 709 bp, Oryza sativa
tgtcacactccgattttctttcatggattaaaatcaattaataattcatttctagaatatgtactattatattataaaatttgaacatgttttaatggtacgtcattcgtatttaagatggtttttatgttcgttctcttttggaaatacagatccatgtttgagtcggtttttaagttctttcgcttttaaaaatacagcaagatttgtataagaaatctctttaaaaaaactcgcatgctaacttaagacgataggacttctaattgcagctcctgattttgtaaaaaaaatatccaagcgaattctgacagtgaattttatcatagctaaaccgtataacaataataatattaaaatagccttcacccgctgtatcacacgagcgttttttcttatatattaaaatataaggatttatgaagtgaattaatgtgggaaataaagtttcctttaaaaaatcatggctaaggaatatttttataatattctccataccctaaaatactatctggaatgttcttgaatttctagagctcaatatctgattttaataatagaaagttcatttcatcaacaacttacatacaaaaaccaattcaaagtctactctttgtccttggaccgtttccaaaccaactgtggtttccctccccctcctttccacgtgcggtctcggcccgcttctccatttttctctctgtctagc

SEQ ID NO: 29312 - DNA, 1501 bp, Oryza sativa
aacttaccactattcacttcatgttgtcctcagttagcattcaacgtattcctttacacctttgaccttgatgtgttctttcccgatttctcttatcaatcacctttcgacctacttctttgcctggtaataaacatctttttcgatacctcctatcagtcatcttttgacctttgtcactaagtactcttcactccgagagttgtggatgcttctggtgacgatgtggtactttggtctgctacctttcagtgaaaccttgaagtgtttcgccaaaagctatactgactgtcattgcctttgatccgaaaaagacacgtctgaaactcttagtccaaacaaatgtctctttggttaatcacttgattttcttttccatcctcaggttggttattagctcgaggttagaacatggttcctctgaaatgagaccctaggtctcctttgacagtaaacaattatacacataatctcatatcgacatcttctgaaagagtcctcatagaacttgtttttattacacctttctcccatattacatgaatacgaggcactgccttaaacaaaaagggaaggtgcttaacatcggtacattgcatcctcaacatgaatcatccataaacatagcaagctcactgtttctagacatgaatatatttatttattacatgattgctgcaaactttcgattacagtgataagtagcgaactgaaaatcacaaacatggttactcattctgattctggagagatatagatggcattgtcctagttactgcatcatccttgattggttctgtgatgatgtgataggactgcatattgctatcattcacaggagaaaaattccttctgattgctggttgaagtggataatggtcttctgcttggtatcaccctcctgaggttgatttcccttcgctcggcctggagtaggtcggggagagaaacaacttcttccatcgacgacaattcattgctgaggctgtcagtgcagagaatggttggtgctgaaggtattattgctatgatttattgcagagtcaggtgcagcaggaggagcattggtgctgtggatgatatcgtcgaggttgctgttggagctgactagctgatgagacaatcgtagggttgttcgttggatttctgcggtcttggtcaacaacacactgagttggcaatccttgggcacatggtttgtaccttcgcatagaaaacatgtgaccttgcgggtgggacactcccctggtggatggtcttcttcacaatgagggcagagtgtgagacacatgctagcaatgtgtccaatttctccgcaacgggtgcatgcttttaattccatctcttcctcgccgagacgtcggggggactcatattcataatccgaggagacttgatctgacccttcactatcagatactctgccaccatggcttaggaggtgctgggtcaactgccgtgcacctcggaaggtatttcctctttgacgtctaggaatagt

SEQ ID NO: 29313 - DNA, 209 bp, Oryza sativa
aaatttgagggctcctttttagaccaaggagaatttaacaaaaattctccgggccacatttgaatttttcttgcacgtattttagtgtttgccaatttctttccgaattttaattaattctattattccttttagaaaatggattttaatttggaatggatttatcaggacgtgacaattaccacaaggtgtcaatgctcactttcagc

SEQ ID NO: 29314 - DNA, 310 bp, Oryza sativa
gcgctgtccgccagcaccgctgcaccggttccgaggccgcaccgtgcagagctgctccatcgagccgctcccaagaacggcgttccccatatcctgctgatgctctgcccaagggcggctggcatcttccctgttctctctactgcatcttcatcagctattttggttgtgcccaaagacctctcatctgcaagtgcaaactacgccaggttaggagcactctgttttttatgcacaccaggtgttcgatccttgacctgtatagacacacctctatctattacttgtttgtttcagtgcaaacgaaata

SEQ ID NO: 29315 - DNA, 1501 bp, Oryza sativa
acgggggtcgctggggagtccatgccttgtttataagggggtgattatgatccaggaaaggtgcgctgcggtggattgtgttgtgcgaggggtattgtcacagctcctttccgaggtaccgtggtggtattgaggcacatggagacatgatgtggggctgtgtcttgtgggtacagtggtacacctctggccagagtaaaactattcgaatagccgtgcccgcggttatgggcgggtctaacaatgtctttcatgattagtctcacacttctcaccttaataaaagatgctataactggtaataatttgattagctcctggtttggaatggtatattcctggtttggagatagaactgtacagccgggatggttgttcagaatggttgggcctatacaacagggtatgttgtatagcgttggattaatattgtttaattattacttaactgttttattaaattctgaaatgtttatcaaatgctgtttatgcaaatgaaaccctactatgccatcctttgttatcctgtgcacttgcatatttgctgcgtggcttgctgagtatatcatatactcaccttgcaatcactcatcagaggaagggttctacagtgatgctgatggtgtggaggattaggtgtagccctggtcaagctgcctgtggagtggagtcgtctgcgccgtttatcttatctttccgctgcttagatttttattgattgagcggaactatctacctctgtaatgacattttgttcgcttattaattagagtaataattgtactcaattatcaatttgttattgtgtgcctcggctgattcttggacgagggttcacacacatgtaagcgtttggaattttggatagaaattctgggcgtgacaagttggtatcagagcccccttgaccctaggttatgccaaacggttacccatagaagccctctaaaaatattggaaaagtagaactgttctcctccccttctcttttaattaaaccaaactaatagcacatgcaattcataatctcttttagtggttctcgttcaaaatttattccagcgttattagtactgtacatctattactgtactaatggctcatttaccagcaaaagttttacaatatggttttatttaatcttgctgcaataaaataaatttagcatgttgattttataactttcttttatttctttggaacctgttgttcaaaagtacaaaatttgtgaccttatttccaactgtttcaacttatcttgcaagcttggtttactttatttacttacctttttctttgattttctaactttattcaaattaatccaaaaacttgtgctattaattggataaatgtcttaactccctcctttcacttgtctttagatgccgtgctacaagcctgagtacttgtttggtgttgagggatttgtccaggagttgcgtacgatgtcctttgccataggatttgggactacccctttttatgcccagattcctca

SEQ ID NO: 29316 - DNA, 1501 bp, Oryza sativa
aatttgcccaagtggagcaagcttccctagtattcatcaccacgatttgatctcacgagtttaagtttagcattatgctgattttccactttggccttaaatttctcaagagatttagaacaaccattaatgggataaatatagccaaaacgggaataatcatttgtgaatgtaatgaatgagtcaaagccatccagaaatgtcattgggaacagtccacaaatattgatctgaattatttctagtggcccctttcttaattgtcttagtgaaatttcccttaatgcaatctacgtaatgatctacttcagaaaaatctgaaggaaggagtatttattctttaatgagacattcaattctttctctagaaatgtggcccaaacgatagtgccataattttgatgacatctcagctttatcattatatgcatttataacattcatcacaaaatcatccaaagagagcaaatagagtttgtctcgcacgaaggcaagacccacaactttattattaaacttaaacatgttccttttgtaaaatgacagtcataacctgtctctactaagactcttaaccgaaataagatttctcttaatagatggagcaaataagacattatttaaaattaaattacagccgctagggagtctatgtgtgaggtctccaacagccctcacttcaatctcggctctatcaactactctaggctatgaacttttcacctatttcacaaagttttgatgtgttttatgttgactatttgttacaccaaattgagaggcgttatataaacaaaagtgttttagattcttgataactggagtaatttaattttaaattatttggagctagaatatattatatgaaatttatgacttatagtttgtaatttagtagtacttactctacaatgttaaagtttagagatgatctttatattaaaggttccatattttattttaaaacgtgaaacaatacgcttctgtgaatctagcaggacttggttcactctattttgagctaagatgagtttcctatgaattttagaagttggattatgtgtgtgttgattattttgctattcatatttttagtgatgtttcaggtacagccgtacaggaggtgcaaaattttatcttactaaattaaagtccacatcttgctgaacctacagaaatttggttcatctcaaaacaatttatatttgattttatacggattttacaatttaacatattttctaattcaataggaaaacttgttaatatttccattttatttaaaagatttcaaactggcgactttgcatgaagaaccctagtttttatggaaaccaacacgcagtcctgtgactgttcaatggtgtgggatatttacagataggatcctagattttatctaatttccagagaaagtccctgtgttcctcccagagcagggcagcatggccgacggccatgcctggtctcggcggcggcgaacggtggggattcgagctac

SEQ ID NO: 29317 - DNA, 1501 bp, Oryza sativa
ctcatgtgatatttgtaaatttatttatttatatatttggaattaagttaagtgaagactatggtgagagtttaatataagggtgctaatatatacttattaacttttgtgaccatgacctatgttcagatgagagacaaaactaacttaatgaagtttgtcattggtaatgttgtaatattttggttgtaggaattttagggaatgcttcccattcttgacattaggtgttccttaacttagttattgctcctagatttgagtgatgcacatcagacctattatgaagtgcatttaaaattcaaaaacacaaaaaagactcaagtcacactaaaacattatgcacatgcaattatacactatgtttcatttttatttccggttagtaagggaaaagttttaaattgttacaaaattctcatatgtgcactagttaaattagccttgtctaggtgagtcaaaattttaagatttttatttatgaaaagaattttcaccaattttagatgcataatttggaattcaaatattttgggtatattacatatataaatgcatcattaggaaaatttgtatcattcacaagtagtccaaaacttatttggagatggacagaaagaatgtggacccaatttacttggagatgaagcattgccacattctatgtacgtatatatttttgttcttagggggacccttcccacgcagagtagtcaagagatacaacactcgttgggattttcatcgttagaacgcatagcgttctccggcggatagtacggcggctgcctctgcattgcttcttggatgaggtcactgaaggtcttgagaggctccgctgccaggtcgcacatacgggccgtaatgtcttcaaaccgatcggccaaatctgcatctgtgttgaccattctattatacacggtcgcacaaagggatgccaatgcttcctgcaatctcccgtcattgtcttgggtagctgcaaggcctgaacctgccggtgcagtataacttggcactctttgtatatgtgtttctgtcaatccccaaccaagtacttctcttagtacctgcgacattaactaagaagttagcaatacttttagacactctgtttggcataaaaaagatcagaagttgtatggtgtttgcattctaaaaatagtaaaaatccaactatatatccacaatgaaaggtacaatgtaaaatcaatagttatagtatatttcattatcataaaaaagatgtttattgatataggtagtaaatgtcagagattgcataccttgggcaacaaatcaatcatggcctccttcagattctgaaaatgttcatcatcgatggaatagttaccatataggtgtttcaggacatctgctgcaattttcctgtggatgctgttgtacaagcctgaatcagttttaccgatacaatcaatcatattaggaccatatttctccaatatgatggtggcacagcttccaaatccgaaagatagctgcg

SEQ ID NO: 29318 - DNA, 924 bp, Oryza sativa
cagactagtagtattatttagtactaaatttccttgttacagaatttcattgccctcttatttattagattaacaattgacttatgatcaaatatattggatatctcgattttatgaaaatttcctaattcactgttgcaatataattgtaataatgtttgctacaaaggagggaacagctttatacattgtccaatgtgtacttttggaagcagtgtgttatctttgatcagtcaccgggttgcatttcttcattcagttctatgacagtagactatatctgggtgtagcatggagtgtttgtatttgttgatggtttttatgcaaagctgtcaagtccttgtttttaataaagaaacattatctgtcatgatgagtgctgtatgcatgaacaatactcctatttcctcttgtgtgtagtacaaaaatgtgttcaagagctaatcgtcggaagcgggaggaagaggatgacgatatgattcttttccttttccctgctctgcatcttttactatgtgctaattcatgggattgggatgaattggatgcactactacttggaatgtgtaaaaatttcgatcaatctctgtaggtctagtcatagatagatcgatgtcatttcctgtacggagtaaatactcaggagcccccctcagcctctttgtgctttgccatgaactcagtataagcttgagcactgatcctattttgctaatgatgctatactgctaatgtgatctacttatatttatatatatttctatacaaatagttcccttctgacgtcgattgttcaaggaaatgctcttctactgatgtatatttcctccctgtaattctgctactttttatactatagttctattcatagcatggattaatgcctaatgcagagcactgacgataactcatttttcactcgca

SEQ ID NO: 29319 - DNA, 326 bp, Oryza sativa
gctcacctcatcacaggtatgctcccatacatcttttgcatttgtactaatatgttatgtttgagtatatatgttgcgttttagttttagttccatatattttagcacatctgtagcacacagcacatatgtgtagatccagagcatagaatataaagtatgaattgagacatagacagtagtgttaattgtaagatgtagtttagtttgatctggagaatgtaacgtacttttagaaatttagagaacaatattgtagagaatgtaacttagggcgtagtacagaaatgcgaggttaacgcagttattgttttcatcaggtacaa

SEQ ID NO: 29320 - DNA, 1501 bp, Oryza sativa
gaaactaatttggtattataaatattactttttccattccaaaatataaggcataaccacccttaatcaaaaaccaaaaaccaattattatcatatcctaattgtatcaccctagtaaatacaatgcatgcacctaataaaattagagatcttaagggtggaggattttaaaaaataataatttattggagaagcagtgctaattaattgcatgcatgcatgtacgccttatattatgggacatctgaaaaaagtagttgtaccttatgttatggaatggatggagtactatatttatctataaacttagtcaagcttgacgcattttgactttgaccaaagtcaaaacgtcttataatatgaaacagggggagtattattttagagaggaaaaccaatgcatatgcagaccataaataatgttctgaaccttaattgctttgctaatttgtttggttaatcttccattcattaggactagcaaaaagtatgtatgtactagtacatgagaggagtgatagagagaaggaagggagagaagaggtgaaagagagagatgatgtggatagtctgacatgtggggcccacgtggggctcacgctgactcagctgccacatcggacaaaaccgggtttaaaacctcctatggacctaaagtgaaccggttttgtgagatgagggatgacatatatctagttttgcggtttggggatgattttgtaatctgatgacaagatgagggaccttctatgtacttttcccttgcagttttggctgcatggatggttgaataggcccatatgtgcagttgtctaggcaggcccatgataggtccatggcgaacaccacctagatcccatgtcccatgtcatcaataatccgctgctatctttgggtcacatacaatacccatcatccactagtatttcccgagaacaagcctgaataaattttacatacgatggctgacaggatgataatttctgaagttttttgtgccattgctgatgttaaaaaccgtgaggaaaaaaaaaatctctttctggtggtgattatacccaagcaatgtgcatggcatccggtagcatgatcataaacttacaaatccaccacgcaccatataaaagtgatttcttgcatatgccacttaacttgatacacccgtattagtaccgcaaaaagtgtcttttttttctgcatttatttcttataagaaatatttagttaattaactaattaacaaatggcccaccaagatatttgttacagaaggcaatcaatatcttcaaaccttaaaaaatatatatccgagtagacatactatttcaatattatgaactagcaatttttgatcatacaattcaggtacaattttaaccggaaggatttcggtcgctcaggcaacaagatatttgcaaaccggggatggcgagatggttgtccctacggtgcttgactgggccatcagggaaatgggtcatgctcggggtcggtagctcct

SEQ ID NO: 29321 - DNA, 1501 bp, Oryza sativa
atcttgctcattgaacgaccacgatttggtactggccactctcaaggacagtaaaaatcctctttacattgatagagcactaaagagattacatgtctatagctctgggagattttagccaggaaacatgaaagggatgagaagtaaaagatattcacaccacgagtctacaagtaaagcaggaaagcgacatctctacaaggattttcacttggaaagtcgatcgggacatggttttcgaccgaagaaatccatcgagagggcaagaaagatcatgcaacaagggaaatgtggcacccgcaagtgttgcaattgctggcccgaacaggctggggttatgttcgtaatctttttcccctctcgtgtcgagaccgcttgccgaaaacagcagccaccgcgtcaacgcctcgtcatcggttggccatcaagtaggatcccgacattcggcgtgctccaatttcatccacgcagttggcttagagagggagagggtgagagagaaaaatggcccccttcttccctactttagcccgccaacgtggtcatcttgtggcggcaatgcgccgtcgccgcaagaggactagcatctgcatcaaagctcgccataggtctagaatgcccacctcacggggctaccatcaccgccaccttggccggactacctgcatcatccccgtctcgagtcgcgtcactagccctgttgcccttgctgccgctggatctcgactcggagcaccatccagtctcctacccatgccgtgtttgctcatcttgtcgacttgtcgttggtcgtggcttctcgttgtcctcgccaccccgctctagttgtatgtccgccgtcatcacgctggcatctggccatcgctgcttgcacaacgccgaccttcctgcttgtgccccaggcgcagtgtcacgcccggaatttctatccaaaattccaaacgcttacatgtgtgttaaaccctcgtctaggaatcaaccgaggcacacaatgacaatatcgataatagagtacaaataattaactatcgaatattcgcaaataataaaatattacagaggtagatagttcctctcaaagcaataacattctacgcagcggaaaacaaaactaaaacaaactacggaacagcgatggcaactccactccacaggcaacttaaccaagaacaagcctaatcctccaaatcatcaccttcactgaagtactcctcttctgatgaatgaatattgcaagaatgagcatataacatactcaacaagccacacagcaaatatgcaagtgcacaggataacaaaggatggcatattatagctcatttgcagaaaacagcatttaataaatatttaagagaatagtaaaaacagttgtataattaatcaatattaaataaacactatacaacacacccatgttgcataggcccaaccacatttgaacaaccaaccccagttgaacaaattaaacctccaaaccaggaattatccattccaaaccagg

SEQ ID NO: 29322 - DNA, 1501 bp, Oryza sativa
gggggtttgattcttttgtgttcttggtccaagaaccaaggggggaattagcgggtgaggatttcttggtttcttgtgggtggtgtgccgatcaattagatgtcaggttggatgattggagccgatcatggcgatgatcgcggtcctgatgatcgtctgttcggattggtgttctctgcttaaagatgatgttctcggttttggtgatcctttcatcagaatcggggcgattagcgtggatccttcgttgtttactcgaattggggtctttctttactggtaggatgttagtgggtgtgatcttttgccgccgatgatgcagttggaatcttgcttgtttgtgtgtgtactggttaactgtggatattgttgataattgttggataggataagaaaggtagacttttgtggggggtggagttgggaggaatatgctttgttttgtgagggggtggaagtggctctttgtcctttaccattttacatgttcctgttctgcatcaatcatttcttggtgcaagcctcacaaccgtctaatggtgttcttgactgggtttgggggcactgttttgagatttcagttgttttcttcctttgtttccttgatttttggaggttgttttgcatctgatttagtgtctgtttgccatccagaagaatatggcatctctatatgtttggtcagggtgatatgctctgttgattgcattgactttgggaatgctttcaattattgatatgctctgattgtttgtttacaagtgttggatggattctttctcatccacttttctgattcggatgaataatataacatattattgtttaattgtgttaaactaaggtgtgctgatgagcttgttagagaagttacttaacaattaatgattgtagttacatgtcttgattacattaatgcattgcacattacagaatggtcctgtacttaattcactctggacttctggagagccaggaacaccacaagtttgagataaaagcataaggcagtgcaagtcgcagccgtggcagatggacgccacgacgagcagtggagcttcctcctctctacccctccaccttatcatagatgatgctcttgccctgtttctccgttgcagcagtcgtttcagaggtcacagcgccattgctttggtggctctgctcctggagaattccccttggctgcaaacccatcaattgtcctccatgtcctcacatcatgcaatctggaacctgatgacctcgctcacttggaggcaagtagtgttttgttcttcctctccaatgtagaattgatattgccactgatgaaatttgtgcttgcgataggcaacatgctcgtttttccggaagcctgccaatttccctcccgattttcagttgtcaatgtcagaactcgcagcgttggatatgtgccagaaacgggcgatatttaaacctatgactcaacaagaaagagaaatgtttaagcaacgttgcggcgggagttggaagctgg

SEQ ID NO: 29323 - DNA, 865 bp, Oryza sativa
cgccaaggtaataatattcttggcggttcgaaatagccgccaaggtaattcctgccaaccgccaaatcaccgatccgcgcctaatgccacgtcatcgatccacgcctcctcccgcgatctcaatcttaaccgtccattccctccccatccaacagtagattcactaatgagttaaaatactcctatgagttaaattttaactcatgacagttaaataatattttgaagtagtaaatgatttcaactgaaaaagtcatcaacaataaagttgtataactcatcaagatctataacttatattttggtcagttctttatctgacaatgtgatagtaacattttcataaaatttacatatatctcttatagtttatagaactatataagagatatgtacattttatgaacaatgttacaaatcactttgttagatgaagaagtgaccaaaataaaagttatagattttgatgagttataccactttgttattgatgactttttcagttgaaatcatttattagttgaaaatgttgtttgaagtagtcatcatttgaaattcaaattcaaactgttgaaacaaagtcatatagtaaaatgaccaaaccaaaagttgtagatcttgatgcgttttacaactttgttgttgatagttttttcatttgaaaacatttactacccaaaaaattatttgaatttcatatattttaaaattcaaattttttatagtttaatcaaactcggatggaaaaatgaccaaaataaaaatggtagatctcaatgagttctacaactttatttttgacaactttttcacatgagttcatttattatgataaaattcgatttgaattttttcattggtaaaa

SEQ ID NO: 29324 - DNA, 1501 bp, Oryza sativa
catttactataaacgttaactaaaagatctgtagtttattaggtcaatcgtattaccatgaccattgatcaatcaaagaatttgtgttaaaaccaagattaattgtgcacttctgggatgctaaagatcttaccacagttgattaggtggttcgcattcctatgatattcgatctatatatatgaattcgtgtaaattaaaatatgtcacaaaaagtaacatgggctctttagttttatttttacaaaattaataattctgaaatcagacatcatagtgatcacagagtttcacctttcttgactcccaatttagaaatttgttaatttaattacattttttaaattcataattagtaagttgaaacttatgtgaactccaaaccatacaactaaaatatattatttactattttcataattattaaatcataaaagttacaattgggacttcaatcatgaacaatctataaccgtggctctagaccgagtacaatttcatattttatttacaaattttgaaattattaaatcataagtttctttacaattgaaagtataaagaatgtataattatgtacttttaaagactccaacttgaaaatgtataactttcaagaaaatttgatgaccaacatattcatcacaggattacatttttaatatttatattgttaataactatagcccatgcaacgcacgggttagcgaccagtattattaaggatgtgactaggtagtgcacggtagtgctttagtcctaaccagtgctacactcccgtggagaaccagtgctacaactcatccagctgctaatttttgccacctatagatgcccgtctatagatgaaccaccttcactttaaatcctagatacgccactaatttttgccatatttgaagaacattgtggtgctttagatatgggaaactgtgctaaatcctcaaaagcatccattctgttttggttgaatgcaattataataataagtggataaagtatatatgaatatatatcttatgcaaacccacaccgtcgagatgtccatgtcaatatgtgaagaatatgtatgactttaaactcagaatatgtatgactttaaactcgctgtctatgtcaatgtgcatctgatgggattataattttgaatatgaatatctatttgagtgtgggtacggcatggatatcagaaccgctaaatactccctccgtgtcaaaataaatcaacttctagattcaaattttgttccaaaataaatcaacttctaccttctcatccatccttggttcgcaaacattttattccttcaataccccttattacctgcttatccaccaatactaatatgctattaataagggatattttggccctttctccacctctttaattttgcattaggaagctaggagttgcttctttatgggatagagggagtatgtgtgaacatatttttttatcattgtgcaatgaagtgcattcagatttttttttctatcc

SEQ ID NO: 29325 - DNA, 516 bp, Oryza sativa
ttttcagctattagattagatcatattaaagtaattaatccttctttcctaatctcatgtgtacttgcaagagagaaaaataaatatatactatttgcccagaaaaaaatatacgtacatatatattcatgtacaagagactattatttgaaaaaaaaacatacatatgtacgtacatcagaaaagaactattaaccatgtcctcctaacccttaagtagaaagtttttacttgatcagtctacccctatgctgtactcctttctctccagtttatttcctagcgttgttgttgactaagctatatcgtatatctataatactcttatatataatacaataaaaaactattacattctatcatatgttatctatttttttaataaaaaagactgtatatttcttctgacataaaactaacgctataacaatcagatttcacaatacaattaaaaggagatcactaaggttccgaccaaatagaatgcagcacaatttattaatattgttgtcgaaa

SEQ ID NO: 29326 - DNA, 216 bp, Oryza sativa
gccgcatcatcctctcctcctccctctccgccgccatctccgctgccatctctgctgccatctccgccatctccgccgccgccggtcgtcctctccgccgctccgtccatcgacttccccgacctccccgaccccgacctccccgacgccgggatccccgaccaccgccgaccgcctcgaccccttcgccactgcctctccgccgccgccaccagg

SEQ ID NO: 29327 - DNA, 1501 bp, Oryza sativa
aattactgttatattccattaagcaataagcatctagccaatagccggctcgggacggcggcaggcacagcggcctcgatgagagggcggtgggctggatgcggcggcgcctggagcggcctcgatgcgccggcggccgcggcagcctcgttgtggcggcagccgcgccagggtcgatgcgatggcgccgcggcgagagaacaggcttgatacggaggcgccggggaagcttcaatgcaacagcgaggaacggatcattagcacgggcacctcattttcattagacggtcctacccctattaaaccgatggttagattagattggtacctcatacctcatggtacctctttaaggatgggaaagatgctccaatgtaaatgttgcactatcttgtgcagtttgtttaaaaaataaatgtaatctttttagggatgtgtaatgaatttttagggatgtaaatgtaaatgtaaatgtttagggatgaatttttaggggtgtaatgagtcttttaaaaaataaatgtaaatgttagggatgtgttatgaatttttttgtcctcttttaggatttgggccatggaacatgggccatgggccgtttgagcgagacaggtttcccatatggaaaaagtacaccgaaagcccctcaacttgtcatcgagttacaaaatcatctcccaaccgcaaaaccagatatatgacatccctcaactttaaaaaccgtttactttagatccttcggtggttttgatcccgattttatccgacgtggcggctaagttagcgtgggacccacatatcaggatgccacatcagcacactctctcttccccctcctctcccttctctctgtctctctagtctagtacttcatatgcttagtattgttaaaattgccagttcctgaaactgcacacaaatttattccacctacctattcagctatcccttacattttgagggtttctttggaacgcagggtaggatgtcacgtgtcctacgaagaaaaagttcacctgaaattacagaacatcttgtttgataaccccatatgaaaaacatagacactagcaagatctcatgttatttttcctccataattcctatgaaatggcaccttccatacgaattttaaggaatttcttacatatattcctttgtttcaaaagatcacatagacccccccccccccccccacttcaattcttcaaaattcttccaagtttcatttgttccaaaggagccatgaaaggttatatggtattttaggacatttagcttgcccaccccgcttgcattccttgcattcctactgctagttacagcggctcaaaaaagggcaaaggaatagcgaaagttaaggcggaagtaccaaacatcatgtttatcagaaaaacaccttatcacaaaagcatcgcatatgagcttctagacaatttaacagggcctgaatataaacggcacgctgacagtagcatatttccaaacgtacacaacaatg

SEQ ID NO: 29328 - DNA, 1501 bp, Oryza sativa
aaaagaaaaaggaacggcatggtatggctggcactgttcaggttttgtcggttagaacatagcactgtactgttgcattgtgattataatcaatgcaatgttatagcaatcatcaattatgaaaaaagattataaaagtgtcataaaaaatgtagtttataataattaatgaactcccaaaaaattcattatttacttatacgtaaaggtgcgttgcttggacgtccgtttctccaatgctacaatcattgggaccatgtgttagggacatcattcacattctgtacgtgtagagcggattaattatccaaacacaaatatgcatttgtgataactatgaaggtgcttcgataaatcgttaaggccaaatttcattcacctcaccaagtcaccattacccagtacaatgatatcacagtttatcacataagggttgagagagagagagagcgtgtttttattctgcgtgattatcattaacctaataaataatttatctatcttgaaacattactatatatatgttaactctagactttatagcatttaactgttcctttacccgtaacaaagcatgtgcatttttctagcataacaataatataattaaaatagccttcacccgttacaacatacgggtgtattattaaaaaatcagaccgggccaaaaaaaaactcagcaaaaaccatgtgtattattagaagaaaaaccagattggaccggaaaaaatgagcaacccagatcagaccagaggttgccgttgtcgtttctttctctatctatcagaacaatattgtcagtcgcatttctgctgttctggttttcttcgttgccaatgtccaccatcaatagatgagtccaattatgagatacatcctaccacagtcctcaccaccatttgatcatcggaccatccacgcccatcttgagtattatgagaatatgagtatatcaatatgtaatggtggttttatccattctaattatcattaaaatttctaattaatacttagtctaagaaataatttatccgtagcgaagcacgggcattttgctagtatatatatatgcacgtaagcaacgtaccagcctttctccgccacgaaggcgtagctacagggggcgccttggtcccacgcgacgttgggcaccaagctcgggtcggcccactccaaatttaggacgttaaggttgggcgggatggaaggcacatggcagcaacccagccccgtgcagccgtcaccgtcgttggcggctgtctccaagctcgcgcacgacgtgatgcagccggtcaagtagctcccgtcgtccttgccccatagcaacccaacccaatcgcaccgcagccgatggccgtgaactcgttcctctcctccgccaacaggaacggcgtgccggtggcgttgaaactcgcgtaaataccgctggattccgtggtgttaggcgagttgttgcagtagtcttgcagcacgagactgtagacgcgcatctcccccttct

SEQ ID NO: 29329 - DNA, 1501 bp, Oryza sativa
caaaaatgacttataatgtcataatgtgaaatggagggagtactactttggacaaatttggaggatatttccccctaaatcatggagtgcataggagaatgacctagaaatcactcgcatagttttcagtgtcttcacaccagtaaaaataaatctaagaaagaaagtgatgtttttttttaaaatttctaaatagtatttaaattgctcctaccatgcaatataataaaagtggatagaaaatactgtatgctaaaatcccgcatgcagacaattgtggatatacggcaaatctctactaagcgcacaaattccataatagttttatgatgattttatttcaaaggataatgcctattcttatatgttaactcttgacatagtttgattaccttatctctatttttgaacttgtaaaaacctatccctcaacttatcaaactattagaagtcatccctttgtcatgtttcttgtaatatcaatgtgtgattcaagtgggaagttagctcttcttgtcattaagagattttacatgcacggatctaatttgcggtggatgttgattgtcagaatttatacgagtctattgtgggcctgttcactttaatgccattttcaaccttaccaaattttggtaaagttgtcaaaaaaaagtggctacatttagtttgccgctaaatttttgtaactatataagaaatcatgccaaaattttggtaagttgccaaaattttgaaaactatgctaaaattttggcaatgccaaaatttagtaaggttgaaaatggcgtcaaagtaaacatgccctgtattttatgttcccctccataatacataggcactagtattatctactccaaatttttatacttgagaaatcaaccttttcacaactcaaaaaatagaagctaaaaatatgagtaacaagaaacaagcattttcctagagcaaataccaggctctcataaaataaaacatagaaaatggacaaaaattccacattacgactgtgctcaaagacgcaccacgtacggtgcgtgccgatagccatccaacattgacgcacatccaacttgaccccacaaaacacaagccaacgtttgtcgtctactgcaggagcgcgcacgccaagtcggcggaaacttgtggccaccgcagcagcagatagcctcccttccccctcccaccttctcttccagcggccacaccagcgccccaatggcttcccccctcgccgtcttccaccccgcctccgccaccgccgccgccgccgctcgccgtcaccaccccccgcgcccgccgcacctgcacctccacctcccgctccaccaccagccttcgtcgccccgccgcaggttcgctgccgaggtactcccgaacccctgtactcaaccctcgtatcctccgtgaaatggacgagcggctttccgagtgtgacgcgttccgttctaggaccccgcagttcgcggtcggcggtgctgacggtggcaccggcggcggc

SEQ ID NO: 29330 - DNA, 1080 bp, Oryza sativa
ccgccaataaaatcgtatggccgccaaggatattctgttttgcttggcggctagtttgaaccgctaagaaaatcttgtgactttagataagaaaatcaactggccaccaatataatcttggcggctgttttgtgaccgctaagaaaatcaactggccaccaagaatattccgctttcttgtagagactttagataagtggtaagattggaaaaagcagggcccaacagaaaaactacaaaactacagaagaagagtaattttatgatcctcgaggaggtaccacgaggtatcaaaaatttagtgtaaaatttggtacgtagtatttaggtaccaagaggtaccaaatcttctattatatactaaaagtccattaaacttcctaaaaacgctctcaaactgtcacgtagtttcctcaaaacgctcttatgtcatcacgtggcacatcgagggagttgagaactccctaggggcccgcacgtgcagcgcatgggttagttccataacgtgaactaacgaagattagttccatatataatcgtgtttggagacaagattcgaaattaagcaaaatctaatcacatatggcatgcaagattaggcacgtgcagcgcatggatttgtcatgaataaacgaagattagttccataattgtgtacacaaggcaatatttcaaatctatctcatagcaaaatttaaatcacatatgacaagattaatttcatgagtcaagattacatatacatacatatatacatatatacatatacacacaccggcttgcatacatatatgtacagctcgccagcaacaccttttaatcctccgcaacacacaattttggtggctacatcctcccatcctctacaacacgcaatttgaacacaggtgatctttgtaataagaggtctgcggcaccagcccagcagctgatgcccaatctaactaatcaagggaaatagagaggacatgaccagaagaggaagggatagagagagagagaccagggcggccacctgctgagctgggagataactcccaggaggatgttgaggtgaggacggaatataggagggggaca

SEQ ID NO: 29331 - DNA, 1501 bp, Oryza sativa
gaacctgattaccggattactagcacggctcatcatgttaaagatcaacagctatttcattatttcagtcaaaatcagtaatcggtaatttcttaaatagctaggttgaaacatgtacgttcaacggacaccgaacagttcattaaatagagaaatgatcccccagtaattcatcacttaaaagtccagacaaatcatataaaagatcgagaaaatcttaaatagatcactaaggagatcacacagtagaatagttcgaccatacctatgtgaattgggaaacggcggcagatgtgctcgatttttggatcggcgtctggaactcctgaaatttcttgggttggatgatgatgtttcagatgagtctgaatcaaaatcgatgaaaaatcactgtccaaaacataaattagagaaaaaacctataaattctgaaacaacaatctctatttaaatcgatggtctattattttactccttggataaaaaacataaaaagtatgcatcactactacataattaatttttctgaccaaaccctcctttagattgcaagaaggctataactactgtactctgcaaaaatcgcttccctgtgatcggttcatgggcctattaagtgacccacatgcgaaattagctacttgcgagtttctctctcccacactggcatctctccctcttttctccccactccatttttttctcccactacccactcaatcctcccactccctctccccctctacctactcctctcatcgcatcattaaagaatcatcatagcaaaattccacagaggagaagcaatcaagattcagatatcatcacttctttcttgcttgcttgtacgtggtagctaggagcgtgggagattagtgaccatgcatgtctttgtataaatataatactccacttttgattaatgattggccgggtgactcagcttaattatatctatattaatttaatcctcctagttgactgcactagctaggaacttcattatggagtatcttttaataggatcataatcctagctaattatatatacaacacgtgtgttctaatctatctatctatctattatctatctattattattatatactaaaaatccattaaactttctacaaacgctcctaagccgagcgccatgtctgggtgtgtgtgagtgtgatgcattggagacaatacagggttatttaactctcctttgtcctttctaccgtgcgttcccagaaactgggtcattcaacgtccaagtccaagacattgactattggtcaacattgtgtgactccgtgagcaagtgcagggaaagcacaacaagcaacttgatgatgcttgatcatgaaatgattgcttgtattggtatattggaaaaccttgactatcagtcaacctgaggcaaacaacagtgatccttatcaactctactgttcccattccaaaggggaaaaaagggagacttttggtgcataaagcactaacgatacgacgt

SEQ ID NO: 29332 - DNA, 311 bp, Oryza sativa
gtatatggttttaggttatgcctttgaaatttagggattgttaactgtcccctgatatatgtactattcttgtgagaaatgcttgttgaatttctttatttagtgataaatcgtatgctcatgaccttccacagttgggttgtggttagagttcataattatggatatggctgtggctgcataacgactatgtgaacttttcagcagtgctttgtttgtatcttgagttgttgactaaaagttgtatataggagctaattgtgtatgctagataatttgatcttcattatgcccttgtttagatccaaact

SEQ ID NO: 29333 - DNA, 1501 bp, Oryza sativa
aaatgcatccatctggctcaatcacttggacaatccaatgaaatctacgaacgacacagtaaagctattgtggtgaagaagcctcgatcccagtaaatctccatccaaaattactgccataaaaataaagagctcgccaagtgaggatatcaacgatataaggaaatcagtgataatggacagatagacagagaacaaccttcataacctcacctttaattagttaccatgttatcgacagttgttccttctatatctcttcggacccatgtctgaccatcatgtgcattgtcaaatagctccccaagattattgacatgatatggttcacattccacatcattccattcttcgcccagttcaaatacatctctgggtttcatcttccttacaatagaccaccctggatttaaatggtcttcaatgtaaaacacttggtcgacttgatttgcaaatacaaagggctcatgctcaatcttttcaccggtatgaattttatttgagaaattcacaagtatgcagccaaacttatctgttttcactctttttcctttagttacatcgacccattcacatttaaacaacacaactgagaaatttccatagtagtctaactcaattatatcaagtatctttccgtaatacatgatatcaccaaggacagggttggtatcactcgcagacgtgtagctcgatgtttttgcagtcacaacaactccactattttgagtcaccctgtcataacgctttgatctgaacctgtacccacgggtattgaatgctctatgtcgttttgctacctcaattggtccacgtgccaaccatctaatatcctcatcaatgctatcaatacctctttgattctccaactgcaaagatctacaccacaccaaaagatacattagttttactcatatttgaaaagaaaaatctaaattttgatacttacatgatctctgaaccaattaggaaattgttcattttgcatgttgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgaggcaccccgaccccttaaggaagtctgcgccacatatatgggataagtgagcacagctgtgctcacctaacagcatttattgcagtctggtcaaagcgtgtcacgctgcatgcaacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaagg

SEQ ID NO: 29334 - DNA, 1501 bp, Oryza sativa
ttcaagttcctccggctcctcctgtctggcaactataggttttttcctaacctcttccatgtgtgtagtggtcaaacgatccagttgatcccatatggcatcaaactttctttgttgattctgcttgcataacttcttgaacaggtccatcaatctcttactcctgaattgtctataaaaattagccccaaaatgtcgcatgcaccatctgctatataaatctggccatggcacggactgtgtgacatcttcttgaagcttctgtatcgctgatagcaaaccggcgtgtcggtcatgcagaacacacacatttggtctgttttcaacaacacacattttaatgtgccgcaaaaaccatagccagcttgatgtgttctcgctttcaacaaatgcaaaaacaacaggaacgacatggctatccgcgtcgactccgatcgcggttagaattgttcctctgtacttgcctgtcatgaaagtgccatcaacacagagcaaaggaatgcaatttctaaaggcctctatcatgcacccaaatgaccagaaagcccgacgaagaacattctccccatattcattcacctcatcgagaatagccatgtgtgtgcccgggtttcttgcctgcatcacctccaatagtgggggaagattgtgataagaatcctcataagttccaaacctcatctccaatgctttctgttttgccctctgtcacgccccgaactagtcccgaccggaactagcccgtgacgctccaaattaacctgttaatcgataccagtcccaggaaacagtgctggtatcacagggagatagaatatcacagcaacagaggtctctttattatagagtagaggtacagtcatgttgggctgcggacagatcccgagctcacaactgcattacaaaagggaaacggaagcaggacatggaccaaacaacacaggcgtgacttgggaactaggcagaaaccctaaaactcatcgtagccggcttgctcctgaaagaactccgcatcagcaggatccgcttcatcttcttcagcaactggggggagaattatttatatagagcaagggtgagtacgggagtactcagcaagccatgggaattaagtgtttaatgcaggcttcaaagaaaggctgatgtttttgcaattgattttatttgaactcttttctaaaaacaactaagtgagtgcttctcaaacgacacggatgagacagtgcgtctcgtccggtcggagtttgtgcaatgtatcagtctttaggattgaagcaaggttggcacccggccaacagcttttcaaacggccacccgggcctagctgatcccatcagctgcagatttttttcaaacatcgaaccccttttcacaacagcaatttcacaatcagtagtcaaacaaaactacgctaggaatcacctcacatccgcccatgaccgtgggcacggctgttcgaacaatttgttaacctctgcagagggggtacactttacccaca

SEQ ID NO: 29335 - DNA, 317 bp, Oryza sativa
cacaacatatcaataatatgtactaactaagaactaatttaaccgtaaaattacttaaatacctctaccaacatttagcaataacaaatatgtgctaaccatacatactaacatcgaacaatgcgaaacaattaacaactcttaaaccaattttttattaaactttcatatgcattgtacttagggattactaatgtataccttaactttactgctggagggcgtcgccaacccttttctcccgaccggcgcctcctcggcctcctctccggcctgctatcccctcccctcgctccctccggcgctcacggcgacga

SEQ ID NO: 29336 - DNA, 809 bp, Oryza sativa
tgccgtgttcacctaacccatacatgtgacgcaaaaaacccacaaggggtcggggcgcctcggccctcggggccggggcaggagtaacccgacccccctcggggaaatcaggaggagggcggacacctcaccctcgggcccgacgtccccgagggtgtcaggccacgtgggcgattgtgtctgcctcaagcctctggtcacgatactcccggtcccatatcaccgacagtagcccccggcgttgtgccagggcgattgcccttctcaagggaagcggtcgggcgtgacgccactcctaaagcctggtgacaggtgggaccggtctccatggttgggcagaaacccaacggtctcaaaccatgcacatcggcaatggtaacttggctgtcaataatgggcagtctcttcaagactgccacatcacctgagcagcgcacgaatcagggcgagccgatttgcttcgcctggagatatggtaacgtcgcttcggttggcgagcgtaattaacgcgcgcacgatacgatctatctcgactgccacaaccgcatatccacctcacgcgccgcaagcgggcgaatgggattagtggaagcatgggcacgagaaacgagggagcgagatagtgggcgcgagaaacgaggagccgggcacagcgatggcaagggtataaagataccgagggaaaaatttgctcccttcctttcgccattattccccttgccttcgccgcttgcgccctaactctttctctgctgcgccctaccttcgccacacgcgctcgttcccaatcatcccttcctccggcgtca

SEQ ID NO: 29337 - DNA, 872 bp, Oryza sativa
agaggacactaaacacagttctagatattgtcctccaggcatacactgcaaaatgctaactggataatccaaagcagcacaacaatatttaggtctcatcctgtaataccaaagttttggcttggtgataaggcaagcaactgtgcccaatatggaatctactttcgaaatttaagtgtgctaattacgaagtgtcttcccatacttctgctattactagacagttgtgcatgaaacctaacatcatagtttgaggtggaagatcatgtctaggaggtatcgtgtttgtagagatactgtgttgggcatggaaaatagctccgaaacaccactaacacctgtttgacgtatggtagtgctttcatgttcagatacagttaattttattgttgcaaattttaaggtggctttgtccctcttcgatgcaaggagttgaagagagatttttataagagaaagtaagaatcaaagagatgatacttaaaaaacaagcagtcaagcagtcatgtgtcgagccaaagtcatcgtattggttctgcttgattcagaatggttacaatgatctttttgaaactacggttctgtggtgcaccaatgaatgattacagttctgtaaaacattattattgaatttatttctaatatttcgtttatattccacatcaatgtcaatctttttggtaacgtgtacctcaacttactacctgtcaacattcatattagggatctataatctgttctgaagctaaaccatcaatattttgttgtataggcagcttgaacaaaatactcaaaaacaaactgtacgatactgaggtaaaaatattcagcatagatggaagccaggcattacattatcatcaataccatca

SEQ ID NO: 29338 - DNA, 350 bp, Oryza sativa
cctttagtagataaatttccttaaccgaatatagcaagaatccgacaactaacgacttgacaactctcatcggctaatctcaggacttcgaagccgatgctgactctaagccgatgactactccgggcttaccaaatttcactattaacacatgccctccacttttgaagtatgagaactcatgcttcaaaattatcttctttctctatcttgtaatcggctttcatgagccgatactgatgtactccaccatgctgaaactgatatgcttgccccccgagccaatattgttgttcctccattaaattcaccaccgtgaccatgatcttggaattgacttcttcttcaga

SEQ ID NO: 29339 - DNA, 1501 bp, Oryza sativa
cctatataactgaaattacatttgcaaattctaattttgataaaaatattgtggaattaaatatatatttgttattttctttaaaatataaaattacagtactatataactaaaattatatttgtaaattcagttgatatgacatgtaagtgcactgtaattttgataaaaataatgtgtaagtaaatatgtattagttatattcttgagtaaatttcacaaaactacacgttttgtggttcaagttgcagaaaaccacacacactttgacacttggcacttgagtacatatattttggttgtgtagtttcacaaaactacactatcgatgtatagattcacccgcaagatgatgtgactgtttcacctaggacgaggatatggcatcctataaccagccatcgcatgaaattaatatgatgccacgtcctcatcctagatggaataaccacgtcatctcaggggtgaatccatccatcgatagtgtggttttgtgaaactaaactaccaaaatatatgtacttaagtgacaagtgtcagaatgtgtgtgcttttctgcaacttgaaccatgaaacatgtagttttgtgaaatttactctatattcttttagggataattttgtttctgcccctactttgatatctaatattgattttacccctactttttagggtttttatttttaccctcacttttttaaactgaacgcttgttttgcccctactttggatagtgaagttaacggtgttaagtaattgacaaaataatatttataccctctcatatatgttcattaattgtgtttttgtccccattttatgcatatagctttagaactttattttttgagtatatttaaaattaaatgaagcacattgactaatatttaaagggaacagataattacattttacaaaatgttgtcaaaattttgtttaagttctatcaaaatgctgaaattttgtcaaaattccatcaaattcataatttgtccaaattgttatattagtcaatgtgtgtcatctaattttaaatatactcccaaaaataaagttccaaatctacatgtataaaatgggtaaaaaacatatttaatgtacatacataagagggtataaatatcattttatcaattacttaacaccgttaacttcaccatccaaagtaggggcaaaacaagcattcagttcaaaaaagtgagggtaaaaacgaaaaccctaaaaagtaggggtaaaatcaatattagacatcaaagtaaggatagaaacgaaatatccccattcttttatagtccgttggatataaatctaagggtataaaaaatttgggatcattcaacaaatggatagacagtcccaagaagcccatagctgtgccgcccgtaggccaaaaaaagcccaagccgaaacgcaactggcgagcaaacggtgggagccttgggagttgggaagtgaggcagcgtattgactgtgccgccgatggaagccaccgccggcgga

SEQ ID NO: 29340 - DNA, 268 bp, Oryza sativa
ccgtcctggttccggccggacggagtagttctccgcgactttaaaaaagataggttagcaattgagatatatatatatatatatatatatatatatatatatatatatattgcagtcttaagctgtgtaggtttgcaattctaagcctcggctaaggctccgcaagttgctccaaattccgagcctctctacggtaggctctgcgttcggagcccgtggtaggctgaattcggagccactcaaaaaaaaaaaaaactacgtacgctca

SEQ ID NO: 29341 - DNA, 1501 bp, Oryza sativa
aagaaaacattcttagctacattatacctttgccttgcgccatccatcttggggtcaagcttgagtcgagatcaacacttgtgaccatttgattcaaccatgtttataccaaggtatttaccatcatttgtcaagactttcttctcatcacaagcttgatttcattcttgtcgacacggcgatgcccttggcttggtgaccatcaacccatggtgtcatccattagcttcatcacaattagacctattcctttgcacatctcaaagaagaacattagtaccaacaaatcggttgtcatcctccacttggtgaccaaccggttgcatatgaaagatgtggatatgtttgttgagtattcattaacatcgcaagtgtcatatacttgtatgcaagctcaaatgcaaagatccaatataaataataggtgaacaacgtggatctaaaacatgcacaataaatgtataggatttgctccccctaaaaatatgcatacaaataaatatacaagagaggcaagtgtatgcataagttatgaagaactaatgggtttatcctatacacatggagaaggcatgtagcaatgacaaagataaaccaaaaaaacacataccttcatgatctccatattctcaatgtaaaggagactaaataagataaggctcaagtaaacattagtcccacacttatataacaataacatggaaatcatatatatgaacctatcaaaaagtaggagataagaagtgatacatatcactttatctccatgaatttcatccttgtcatgattaaggtccatcaccaaagaatgcatatctaccacatctcattatcgggaaataaccttgttgaaaacttatgtaaaagagaggttaatcccataaacatcggtttatcatctatcaccaaagcaacaattacacaaattgtttaatccaagatctttcaatcttttcactcttttgtgatagataataatccgatataaacaatatagagagatgagatgaaagatgatttcaaatcaagatagaaatcttataataaacaaaatatagaataagctccccctcaagatgtgcatacatatggatataaaggaacacatatgcacataatcaatcaagatcaatgagggagctcacactatattttggatccacaagagagaccaagttagaatatgtgaagtttaatacatacctctaatcatttttactttcatatccaaatgagactagtcaaagaaaagctcataaaaatgttagtctcatataactagatttgtcattaatcaccaaaaccaaattaaggcacatgaacttataacccacaagacacggccccacaacacgttttcgtgctccgacatgcaccacgacataccggaaagagcccgtgacaggacccttcgcataaccccctctaacagatcgcaccacacctcagggttcacccccgtccccagcaggcaacgggcggcccccctctcgtaccatgg

SEQ ID NO: 29342 - DNA, 1228 bp, Oryza sativa
tttatgtgtatctcgggtttgtttctcaacttgtgcatcaaggaaataccctgggacttagtcggttacgactgtattttatctgtatctgcatattccgttagggatatagattatcttttgtaacacggactcctccccatatataaggggggtccgggtgcctctaggggcatatgttgatttttcccaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacactctctctctgctagtctgattcatccttgttagtgtaagagcagttagtgagaatatgtatgctacccgtgcaagcacattgagatgacagtgttacttgcaagttgcaacaccatatgcgatgacagcaatggaagagtctctgagtgcaagcatagggggacaaagcttttatactctatgcagccctgatacaaaaacaaaatggggtgccattcttccaccatcaggatttgatcttacttgtcaacaagcaattatcccacagcgtgtacagatcgagagctagcaacaaaacctggagaaatattggggcaggttggggatggcaactagcagtgagtgcgggctctggtctccggatggagacacaacaacaccaaaatgaagcagaccaaggccagctttcagagtccagatgaacatatggcaacttgagatgaacgacgtgcggcagttggatggaggcggtggcggcgggggaagtggtggtagggggagcgggagagcgggtagagaagggagcggcggccgacggcggtgaaggaaccgtcgacacgggagggggttcacaagatttaaaagttttaattgttgtttatttttactgaaacatttgatcgtccgattcgtttggaggaattgggcgcttgatttggaatctcctctgcaactaagagatgctcctaactttacccatccacatcctactaacattgcaacctcatcatatctgcaacgtcagagccaaaacaattagtgatagaacatcacagccggcaattaaattttaaagtatacattatttttctctattttgtatatatacatgcatttacagaaatatacattttccgcggtacagg

SEQ ID NO: 29343 - DNA, 1005 bp, Oryza sativa
ctttgcagtcaaccatcatagcctgctcaaagataataatccgagtgcttcaaacttttcatgccaaggcctgccgagtagtgaagacgaagactgtaaagggcgaaaagataaagaatatggtgcatcgaatagatgcacctaattaggtatagcccccaactatgtgattagtcaacaaactaaacatatagttgagaacaaaataatagcataattatgcatcatatgacaaaagcatacgcggcgcctaaagaggcattccagccgactgcttttcagccataataaaagaaatccgagtggttaacactctaaaaagttcacgaatgaacacacttgacaggcatccgaatataagactctaaagattacccaccaaatattataaaaatcatggtaatgaataagtctaatagcctaggctatgactatttaccataatgaaaacaggcatataacataccgaggaaatgactatgataaaaacaagtcattccaagttaacccagacagcttttgtagcctaaaaaagcgtacaaaaacagcataacgcctttctgtcgggcaccttttaatttgcatcgcaataattccaaagaattatatgaccgcgtaaaaaggattttatcagcattgggcaacactattgtgtacataaattgccaaagcaaagaatgcctaagtccctaaggaacacaatgggccacgctgttaaaagtattgggctgaggtactgttcaggcctaggcccattcgcacctccgatacccttaacaagaaaacccgagatccaaacgacgcttcgtcttccccgccggaactctcgccattttccccactccttgctacagtacagagctgggccggcaaactagggttcaccattccactcaaatccaccttcaaaaagtgatcaaaatccttcccgtgatccaccgcctcaattcctcacctctcccaagccatccctcgaatcaaatcagcgcattcggggaaaatcga

SEQ ID NO: 29344 - DNA, 1501 bp, Oryza sativa
atctccgtaggaactacctcattggcttgataccaaacaatctattcaacaatacacatttgctaacttatctcaacattggtaacaacagcctgtccggaccaatacctggttgcattggctccttgccaatactacagactctcgtcctgcaagtcaataatctcacaggcccagttccaccagccatctttaacatgtctacgctgcgtgctttagctcttggcttgaacggcttaactggtcctctccctggcaacgcaagtttcaacctcccagctctgcaatggttctccatcactagaaatgatttcactggtccaattccagtagggcttgcagcatgccagtacctccaagttcttggcctgcctaataatttattccaaggtgctttcccaccatggctgggcaaactgacgaatctcaatatcgtctccttgggagggaataaacttgatgctggtccgatccctgctgcacttggcaacctcaccatgctgagtgtcctagatctcgcatcatgcaacctaacaggacccataccgttggacattcgacacctaggccaactttcagagttgcatctttcaatgaatcaactaacaggacccattcctgcttctattggcaacctttctgcattatcatacctgctattgatgggaaacatgttggatggattagtaccagcaacagttggtaacatgaactcgctaaggggattaaatattgcggaaaaccacctacagggggatcttgaattcctttctactgtttccaactgtagaaagctctctttccttcgagttgactctaattatttcactggaaacctcccagactatgtaggtaacctgtcaagcacactgcagtcatttgttgtagctggaaacaagttaggtggtgaaattccgtctaccatttcgaatttaactggcctcatggtgctagcactttcggataatcaattccacagtacaataccagaatcaatcatggaaatggtgaatctccggtggcttgatctcagtggaaatagcctggctggctctgtcccatcaaatgccggaatgctaaagaatgctgaaaagctattccttcaaagcaacaaattatctggctccataccaaaggacatgggcaacctcaccaagttagagcacctagtactatcaaataaccaattatcatcaactgtaccaccgagcatatttcatctttctagccttatccagttagacctatctcataactttttcagtgatgtgttgccggttgatataggcaatatgaagcaaattaacaacatagatctctctaccaatcgctttactggtagcatcccaaattcgattgggcaacttcaaatgatatcctacttgaacctatctgttaattcattcgatgattcaattccagattcttttggtgagctaactagcttgcagactttggatctattccataataatatttctggtaccatccccaagtatct

SEQ ID NO: 29345 - DNA, 707 bp, Oryza sativa
tcaattggacttagcatgaattttctataaatttttaaagtttagatatttttaagaaaaaaggggaaaatgtttttacaaggtggattctcaacaaaactagcctcaaataaaaaccacccttataaataggagcaccactaaaatatgaaaaaaaatagaactcattcatatgaagtaggatcatgataaactttctaaaaaattgtagttctcgactagatctacaactttatagttgaatgcttttttcatttaagtttgattagggtggccaaatatttattgcacactcttagttctattttgataaaatattttttgaggtttgcaattgagttcggatggagagatgctctatatcaaagttgtaatgctcaacgcaatctacaagtagttagttgatgacatttttattggtgttgtttagagcacaaaatatttgttacaactttatgagaggtgaagtcaaaagaatagcatccatcatatcttcacgaactgcttgataggtgagatactaaggagactacgtgttcaattcggctctgataccaacttgtcacgcccagaaattcacgaaccagaatttctaagctgaatgtgcattaaacccctgtccagcaccagccagggtacacaaacgacaattgtcgacatacagatccacgtcttacaaaaatataaaagattacaaatgcagcgga

SEQ ID NO: 29346 - DNA, 1501 bp, Oryza sativa
ctctctacctcggattcgtccggatttgctcccgcaatcctcgccggcgcatcaatggcggccgagatttccgcggccgattccttcccctccggccgctctctccccctcccgacgctatataatcgctccccgtgcctctctcctccgtttccgccactcgccgcactctctccccgtcggattcgagctcgcgccgttgtcctccctctccgccgtcgccgccgagctccggttcgccgccgtcgtcgccccggacctcctcccgcttcggcatcgcctccttcggcttcgccgcgttctcgtcgacctcgtccgctcctccgtttcgcccgccgaccgccggagcatcgccgtcctcgtcgacccgagccgcgccgccgcctctctccgcttcggtcgccgttcccgtcgtcgccgtcgacccggggtgagccgaggaccgccgcttcgcttccctcttctctcctttctctcggccgccgctccgccgtgcctatggccgccgccggcgaccataggggcgcgggcgcgccgcctcccgtcggccgtgccggcaaggccgccttcgggcgcgccccgcggttgccaggtggggcccggccgtcagccgcccgcgcccgcgggtgcggctgacgcgtgggacccacggcgccggccggcgtcagccgcgtgcgcccggtccaccgtgtaccgtgaggctgacgcgtggcccccactcccgtggacccggtccgcgtgccctctccctcggctgacgcaataaatccgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttcttctgttatatggagtttattagagtaaaagccttttcttttccgttggtcgtgtagatgctgcagcttcggaagatctgctcttcgtggaggttgaagccgatgtttgggaaagcgagcaaggcaagtcacatcatctttgaacatattgaatcccagtttataaaattatgttgctttaaattattgcattatcgctttatttaaattcccgcgttatcactgttttatctagccatgcctatttacctttgttatgaccttattattgttattgttattatttccttgttcaccctagaataaacaaaaccccactagtggacactctactcatggtaccactagtatgattttaggtagatgcttcgctatttaattagttaacattaggtggttttacaactctagactttgggatattcatatcacctggacactttggaattgttggattattgtgaaattggattcacaccgccccctctattcaaaatccccaaaatggttttaggctgggctcggggtgcatggttttgatagtagcacctcggccatataaggaccggt

SEQ ID NO: 29347 - DNA, 1501 bp, Oryza sativa
gaaaagatttataatgcatgaatcaaacaagcaagcctagcacattcatacttgttttattttggagaaatatgcagaacctcaattcagttttgtagaggctagaagattcaatcctggatataagaaacaatgcatattatgaaatttaaactgaaaggcgaagttagaaagtagcataaaaaaattaaagggaacatttgagatgtaaacagaaatctcacattattgtccttttatctcaacataaccactttacagatacccaagctgtaatctttgttatactcatgaaacttgagtacttcaggcaatcagtaatttcatcaacaatgggcaccaccagaaacttggcaagtccataacgggcgatggctgcgaatcatgggtggcaggttacatcttcaaatttcgtcaaggaacctgtcaaagttcatccataagcttgttagttgttacagttcttaaaaatgatatttttgtctagaacatgtaacagttttcctgttgcaaaaaacagatagaaaacttgcaaataccaagttgtgttttcattaaaaaaacaagttcggtgattgggagtagagaagaaaaccaaagcttaaaatgtgaatgtaattgcagagaatgaaattgtagtgtaagcattgaaactgcaagcaaaacactaattaactcgagtgttacctgtgttctaattccattactaattgtatccccttcactgaccaaaactcatagtcaaccttgagcaggatgagctgctacagacccatggaagatgtgctgcaatatgaaggaccatcataagcaaggtagagctacttgttttttcttcaatttagtgagtcctacttataagtgtttaggaaatactgcctcccacaccatgtaaataaatttaaggaaaaaaggaggcaggacaagatgaagcgtttataatgcaaactattgaaaatcacaattcgtggatatgtgccatcaaatttgcttggaaactctctctctctctgtggagattatggatatcccatatctacacggcgatgatatttgggctgaatataggataccgaatatagatagaatattttatgtgtatctcgggtttgtttctcaacttgtgcatcaaggaaataccctgggacttagtcggttacgactgtattttatctgtatctgcatattccgttagggatatagattatcttttgtaacacggactcctccccatatataaggggggtccgggtgcctctaggggcatatgttgattttcccaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacagttggcgcgccaggtaggggtagcgtcaagcttttcgccgatcagtgcaa

SEQ ID NO: 29348 - DNA, 870 bp, Oryza sativa
ctatcaatgaaaggattcacccgcgagatgacgtggctgtttcacaaaggacgagggcgtggcatcctattaccagccatcgcacgaaattaatatgatatgccacatcatcatcctagatggaataactacgtcatcacacgggtgaatccattcatcgatagtgtggttttgtgaaactaaactaccaaaatatatgtacttaagtgccaagtgtcaaaatatgtgtggttttctgtaacttgaaccatgaaacatgtagttttgtgaaatttactcttttttaaaaaatatttgctatgcaaatatgatgttacataagaatatttttttcctgcagtgggatttaccaccagcattactctcttaaacatagataatttattccatagattgtgttttatgatgtactgttgagaattaacaattggacttatatgattgtgttttataaataattgttgaccgttgagacctgagaattggatttatcagtttgaggggttgttgtattccgataaattttcgttaccgtattcacgccggttcgttttcactccgttttcggtttcgataatattcaattccgttttcgtatcggggtttccgattccgaaaaaaatatgaaaacgaaaacgataaaagtggcagaatttcagaaaggaccattttgcaaatattacatccatatcaggtgttgtttcgtaaatttcagtgccgaaaatttaatgtcggttaaagaaagggatttttatgaaaaaacgtcaggaggaggaggagagttgggtaccaatctgagccgttggttcttgtcgccggagaccgccgcctctctctgacgccggcggcggcctccccgtcctacccagg

SEQ ID NO: 29349 - DNA, 984 bp, Oryza sativa
caggttactagacctaaagaagtaacaccttattaccgaaaatgtagtgtttgtcatgccaccaggcgtcgcaagacctagggagccaaggatatcccgaacactctgcagataacaggtgggaggaaatcacatcaataaacatataaaggttctggtccccatttagacaggtacatataacactagaacaaagcatataccctagccaggtcatctatcatcccctcagaatgcatagcctctataatttcctagaagagagttaatgaaaaagaattcaaagaaaattaaagttaacctgtagttgttgctaagagttaagcagattggaaattttaagtatacgagacaaagcgatgttagaagcataccctggagatatctcctaacagtccatttccagcaacattaactgcacgtaaaaagattatcagacccatacccagcatattgctgtaatatacctaaaatcaggtacagaggaaatacactctggtaccacaaaaggtagtgccagtcaatataacccaagttgatttgttatgctctatctatatattgtaataactagaaacacagtaatgcttacataaatacagttaaataatggtgtttttagttcacaaattaaatgaaaaataaagcgaaggactgttcaagccttcatctacttagcctgaaatgcttacctagctattttttacaataactagcaataactatttttctgcccttcaaagggcaataatattttatccagtatgagcttgacacaattaatatatagaacagacacatggaaacatggtattgaagagtgaaaacgcacataaattgtttacgatactacgaaaacttgtgcagcacatggctctgaggactaataggtcataggcatatcaggtgcgttctatattgatagtatactcttcaaagcaacccccaacttaacttaccattagcatgggtgttttcatcaga

SEQ ID NO: 29350 - DNA, 392 bp, Oryza sativa
aaattatgtgtttctgtagtaacaggattctaatataattggtgacaaagtaatttcagttatttctagtatactcaccatattgcgtgcttggtgagctcggcgtcaccacggacatttccatgcctacttaatttcattgacgctgcttcggtgtaacactaatctatctgctcatccatgttgctcagaagtgcatttgaaatccccccacaaatttttgatgcaaaatttgtgtattcaagcctagagctgggacatgggctgtgcattctggggccgaggcaggcccagggaaggcagcccggcacaacgaaaaacactatagcctcaggccgatttgaacctagccgggcagttgggccgtgcctgtgcctgaaaatttggcacga

SEQ ID NO: 29351 - DNA, 1501 bp, Oryza sativa
gcatcttttgatgatcatttataatatgtctcgtagatctgagtgcttatttgattcatatggtttctaaatcataggaacacgaaaagtaagaattaggattagggtgttacgtactctaatccttaggaattttttcaagagctctcatctcatgtcaaaaatcaaatggtactagattgtaagaatataatctttaagaattagatgtgatctatttctataaaacaaatgatgcatgtaaaaaaatttgaaaggccttatcttttcgcttatgctaatacttatcaaccaaaatataaattcgtaactttaaatttggagctaattttaaggtttttttcattaaacaaaaaacaaagtaattataatcagcctttgagccttctcccgtgagtggcatttggctgctcctattggatcgagtgataagcaaggcaaagcatccccaagaacgaaaccgccgtggaactttccggaacagcccggacatgtgccccactgccccctccctcctcacctcctccccctcttcttcttcttcttcttcttctttcactgcggcgccctcctcttctcagttctcacttctcacacaactcgcaaccctaataaagcgcaaaaaaggaaaaagaaaaatcgccacggaaaaatcctcgctgccccccatcgggcaggagcaaccgccgcatcggcccccgatccggtcgccgccgcctctcgcccggttcatccgccgcttgccaacccctccgctcccagcaaccctagtcccccaccccaacgccgccgccagctcagctcgcctcgcgcggggcgcagccgactctctacttgtggcctcggcggctcgggccctctccggattccacgtatggctcgatcttctgcttttctttttcttctttttttttttttaattattcgggaattgaagcctcatcctattgggggcatacgcgacttggcggagaggacaatggcgacgcatttcagagctaaggggggaagggatatgattttgaggctgtaattgcttgcgaagttctccttttggaagggatcggtcctagccattctgagctgctaaaaattttatttgcggtacggagcgtcttctgataagaggacagaacgattagggtctcccgtaatctgcttttaaatgcttgatggagtcctagaacctaaaattatggaattttctctaatgttaagctaggaatgagggtactggtttcttcgtagatggaaggcgctctacttgttgctgccggaactctgttgagatcttgtgcttaaatgcaggggtttaactggctgtgtaatcttaggcgtggagtgagttgactatgaagaattctgaacatgtctaggaatcataatttcgaattttgtagcttgtggtttatgcagcatctgatactattcagttcctcgttctgtaggatgtctgaagatgcgtctgtcggggccagcagttcaacagtaaaagctggcg

SEQ ID NO: 29352 - DNA, 1501 bp, Oryza sativa
ctttttcaaacatgagcttgactgtcctgggaggcttacgcccgaatttgccaaccaattcttcgtggcgaatccctttggtgaatgcggcgatgatgacgtcgtcggtgatgtcggagatcttgttacgctgttcagaaaatcgccggatgtaatctcgaagggattctccggacttctgaatgacgttgtagaggtcgtattgtgtgccgggacgctcgaaggtgccttgaaagttggcgatgaagtggtcacgtaactcggcccaagatccgattgtaccacggggcaatccatggagccaagatcgggcggaatccgctaaagccactggtaaatagttcgccatggccttgctgtctcctcctgctgcgcggattgcgagaccgtagacggtaagccacgattctgggttagtggtaccatcatacttctctattccagtcggcttgaagccggctggccaatccactcgacgcaggtcgtcggtgaaggctgctactccgtcaaggtcgtcgtcgtggcggtccggcgagtgatgatagcctcgagctgctcggcgctgtatgattgtgtcgcgaagatcgacggggcggcgacgaggtggtgagcgaggccgttccactcggcgctccctatggtgatcgggaggtgagtgaacagaccgctcgtcgtggcccctgctcctgcgattggatcctgcgccggtgatgctgaggcttggatgacggtagtcatgagatcggaagtgggggactcggctgccagtcggcgtatggacgctttcggagttaactgggaccgaagccgcaatcatagtcttcgtctggttcaagatgttgacgacgtgatcggattgattgagctcgttttccctgagtagggtgtcgaggagggtgatcgcggcaaccgcattctgttgaggggtgcgaaaaaccggcgtcccttcaacatcttgctggccgatgagatcacgcgcccggcgccctgcttccaaagctcgctgccgtcgatcctcagcctccttcgcggtccgctcacgctcctgctgctcatgccgtaaccgttcttgttcttgtgcttgatgctcctcttccagtcggcggcgctcagtctcgcgacgcgcttcggtctcccgggcttggcgttgctcctccgtctcgttattggccatgaagacgccaaagtagagaggggtgtagttgtcatctaggcttccgtcgaagtcgtcgagatccgggtcgtggtagcgagagctaaactcgtcgtactccacgatgtcggtggggcgcgagtcgacggtgggagagctgtagtcgccatctagctgatccgtctaaaccgtgccgagtggttggaggatgacgccaacttccctgaagctaggcgaaatcggtattgaagccgacttccgcctaggcctacgggaaagagacgctgtcgtgatggagacggccgtcaaatcgtcggggagcttcatcaggatcggtgggtaagcccc

SEQ ID NO: 29353 - DNA, 1501 bp, Oryza sativa
atctagctgatccgtctaaaccgtgccgagtggttggaggatgacgccaacttccctgaagctaggcgaaatcggtattgaagccgacttccgcctaggcctacgggaaagagacgctgtcgtgatggagacggccgtcaaatcgtcggggagcttcatcaggatcggtgggtaagccccatcatcttgatctggtgacgttggtgaaggtgcgatctcgcccgagtggtttgaagccgactcggtcgagatggtcttgaagtaactttcagccgcgtttgggagtccaaacggggccgaaatctggttctctcccgactggtccgactccgagtcaaggagagagatcttgccgaagttgctggtgacgaagtcgaggctgccgaaccgaaacgtctgcccgggtgggaagacgaggtcgtcgatgccggagatggaacccattgcactgatcggcgaaaagcttgacgctacccctacctggcgcgccaactgtcgaaactagatttcggcaataataaaagggggtggctatcaagctggaaaagtgtatgggtttggagacaaaggatttatacaggttcaggccttcttataaaagaagtaataccctactcctgtccggggatgaatccgccgagtgtattattgattgtatgatttgggaaaatcaacatatgcccctagaggcacccggaccccccttatatatggggaggagtccgtgttacaaaagataatctatatccctaacggaatatgcagatacagataaaatacagtcgtaaccgactaagtcccagggtatttccttgatgcacaagttgagaaacaaacccgagatacacataaaatattctatctatattcggtatcctatattcagcccaaatatcatcgccgtgtagatatgggatatccataatctccacagagagagagagagtttccaagcaaatttgatggcacatatccacgaattgtgattttcaatagtttgcattataaacgcttcatcttgtcctgcctccttttttccttaaatttatttacatggtgtgggaggcagtatttcctaaacacttataagtaggactcactaaattgaagaaaaaacaagtagctctaccttgcttatgatggtccttcatattgcagcacatcttccatgggtctgtagcagctcatcctgctcaaggttgactatgagttttggtcagtgaaggggatacaattagtaatggaattagaacacaggtaacactcgagttaattagtgttttgcttgcagtttcaatgcttacactacaatttcattctctgcaattacattcacattttaagctttggttttcttctctactcccaatcaccgaacttgtttttttaatgaaaacacaacttggtatttgcaagttttctatctgttttttgcaacaggaaaactgttacatgttctagacaaaaatatcatttttaagaactgtaacaactaacaagc

SEQ ID NO: 29354 - DNA, 277 bp, Oryza sativa
aaagatttttctatgttatgttaataataaataaagaagtatttattggtaaaacttgttaatattgttataaaaatgtattgaagttggttgtttcgcaatttcatatgttaagtgaggtattattttgtaccttattcgacgtatcagtactcggataattaatataggcctatcgcagtctcggtcgtagaaacattatatggacttaaacaaggagaattatgtaacatgaagaaatagtagtacaatttgaacatgatacaactatttccat

SEQ ID NO: 29355 - DNA, 159 bp, Oryza sativa
catttgtaaaattagttttgcaaagggtcaaattgtcaaaaatttgtgttatccaaccggtccatccatcatgtgcacggccgcatcctttgctgcgctagcttgagcctgtgtcaccaaccggctaattgatcctaactactacggctacctatcagg

SEQ ID NO: 29356 - DNA, 297 bp, Oryza sativa
cccatcgcgaggccgagccactaccgccacacaccgccttcagccggccgttgccgccgcgttagtcgtcgctgcacctcgccgcttgcgccgtcggcaacgccgtgccaagctctaccccggcctccgctccgttttcccaaatcgccaccgtaaccacccctcccccgtcaacccgagccaccaccaccactggccgactccagccgcgtcgcaccgctgctacagtcattgcagacccacgccgttgcctccctcggctccacaaggacgaggagaacctcggccatctcttcc

SEQ ID NO: 29357 - DNA, 1501 bp, Oryza sativa
cttccacttcgactccgttgcagcagcctcctctctcacgccgccgcagtcgctgcctacagctgttgctgcttccacgatgccaccgccgccatctccgcaacctactctccttccctccctcgtcgtcgccgccaccctctcataccaccgcagccctcacggcctctgttgttgctggaatgtgtgtgtgagagagaggataaatgaagattaattaaagggaagagagatgggaggtgaaaaaaatggtgatatgaggtggaagtcgctgacatgtgggtcccactcccacctgccaactcagtcagtcaaccgtggtctagcagccatgtcagcagcaatcgcttgccaaatgctgaaggagtaagttgcactagtttttgaggatgagggatgcgtatacccagttttgtgggtgagggaggtgattcaatcgaaagaagagatgagggaggtaaaatagacttattctagcaaaataggactggaaattttgaaactttcagtcctgggcctgttacatgatccaataatccattacaaaatgtaactgatttttttttcttgcataattacatgcatgtctcctatattgattgcattagaatctaatggattttctttttcctcttctgttttaaaatagacactaaacaatgcagtcaataatttgcattttttcttatatccacctatgaaatacacaaaatacatgcaaaatcatcatacttgctgaccatcaatgaatcgattggattaaccaaccaaagttggtcttactcattatgcccttaaacatgccgggctttgttgttggccacaatttttttaatctaactgggccccaaatatgctgcattttctcacttgcaatctactaaaaataaagataaaacctcaagaagacttgtcaccagccaagatttaagggtagtgatcttggctgggtttgcttggctgcatgcaagaattatagcagtctctgaatgacccagaaacatttaccgttgtggagattatggataccccatacctacacggcatgtatagtctgactgggtatggggtgccatgtatagatataatatccttaaaaggactcgggttaaattccaaacttgtacgtcaaaggaaatacctgggatcctagtcggttacgattgtatctcatctgtaactacctattccgttagggatatggattatgctttgtaatgcggacccattcccctatataaggaggggtccgggtgcctctagaggcacgattttcacccaaatcatatgatcaataatacactcggcggatcaatccccggacaggagtagggtattacttcttgattaagaaggcctgaacctgtataaaattccttgtctttcaacccatccatttttccagcttgatagccacccccttttagtattgccgaaatcttgtttcgacagttggcgcgccaggtaggggaagcgtcaagttcttcgccgactactgcga

SEQ ID NO: 29358 - DNA, 1161 bp, Oryza sativa
  unsure (1)..(1161): unsure at all n locations
ttcttataataatgacagtcatacaataattataagatatctttattcatacaaaaatcataaaataatacaccaaataattcttaaaaactatttgtaaagttttaaactaatttaatgtgttttacttcttttaattttcattttagtttgttttctattatttaagattaactttcactagagttttccttctcaactattttataaaaacttgtttagcaaatgaactaaatttctatatattctttcttccccacacacattttctctctcatcaacttacaactaaattttggagacaaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatntattttggtgattacatacaaatcggaggtgcctaaaaggtttgcaacttcatcctccaatgtttttttttgtcatactacatttgcacctatgttttgcacacttttttttgtctccaaaatttagttgtaagttgatgagagagaaaatgtgtgtggggaagaaagaatatatagaaatttagttcatttgctaaacaagtttttataanatagttgagaaggaaaactctagtgaaagttaatcttaaataatagaaaacaaactaaaatgaaaattaaaagaagtaaaacacattaaaattagtttaaaactttacaaatagtttttaagaattatttggtgtattattttatgatttttgtatgaataaagatatcttataattattgtatgactgtcattattataagaagaataattatttgtgtacggtttttttgactcatgtaga

SEQ ID NO: 29359 - DNA, 280 bp, Oryza sativa
ccacccttcctcttcgcttcgttttcttctcctcgacccgccgaacagcagcccgctcttttgatcttttcctccctctcttcttctccctccgaaccacgagtcgccgccaatggcctcctgacaaggcctcgtctcggttctctgctcgtggttgggggcttcttggcgttcttgattttttggtttgggtgccttggtgctcgttcttgaggcgttcgttttcccttggtttgatgcggcggcggtggtgagggtgggagcagccgcaggtcgggaa

SEQ ID NO: 29360 - DNA, 1501 bp, Oryza sativa
aagacggacagtcaaacgttgacacaggaacccacggtttgtctttttttgggacggagggagtacttgtcaaatacagtaaaaaaagtattgtttggatcctatatatcaataaagtttatcctcactaagtatagttaatactaattctctcatctcttatgaaaccacatcacttcaattgtttttaacctttagatcattcataaggtacaaaatgcatccctcctccccaatagccacaccatacaacccaatcatttataacctttggataattgataaaggtacaaaatatataataagcatgtggaagaaaattgtataataagtaacaaagaaaattttacaactcatgtgtactattttatcacataactctcccacagcaacgtgcgaaatagcttaggattcacctcgggtgttgtgtagcggccccgggctctatttcatttgattaattaggagataaaacataggattgtggttctttaccttatcttggtacagtggatattccttctttccaggtaagtagcctgtagctagctttgattcaaaaggatatcctataatgcagaagaaaatgagggctttatactatatatatgctaattgtggctacacggtttagggatttagggttagttttcttcacaactgtgcctagatcaggagtcaagggtttagggtccatccataaatccaattaaaattttctttcgcgaggatcaagattccaattgatgactttgcaagaaatgccatgttacaaaagcttcctatgactgagtactgttacgtccatttgccagaacaattaattgatagtctagttctatatctacaggccataataaatgtgaaatgctccagctagattaggacatgccgggtgtcgcattatattagcccagtaaaactaatcaagagatcatgaatgatgcaacactttctatttcccaaatcttcacatactttgtaactaagaatgccattcatgttgtaatcttgactacgtcatcctttggtaaaaaatgggtctgaatgaagtatcaactgggctaaccaatttttatctaaaaagatttgcttgccactgctctagaaaaaaataaaaaaaaactatatatgttcaaccaagtatattaactttcaaggacagaggattttatgaactgactcaaaggcgatcaaggcaacctctctccccgtccccttgctctttgttccgttttccgtactagtaaaactttcgcattttggcccgcatcatatcaatggcggagttttccgtagtagtaaaactttctccttttggcccgcgtcatatcaatggcggagtttggttatagaccgactagccaaatgtccatacgttgcaaagtattagtgaaattagtaaaattaagtcctcgtttaaaaaatcattttcagccaatgaactttagccaatgcaaagcccataatttacgctccctcgtgtaaaaaatatatacgt

SEQ ID NO: 29361 - DNA, 1501 bp, Oryza sativa
tgtatttgttagctatatcttcacataatctaaataaaaaaatgaactgtttggggagctttggattttgggagaaacttattaaccatggatttgaagtttgtattttaaattttagtggtttaaagttttatattttatttaaaataggaaaaaaatgattcatccaaatgttatcaatgcaatcgtatattcagatttatagatttgtgaagctaggcatacatagctttaagaaatattgaatccaaagctgtaccaaacagaggcttaactttgttggtataaactggctggaatgatttggacgctagatgggggccatggtggttttgtactgatcaccctacttagcagcaaaaaggatgtgggggctcatcatctggccgcctgatgcagctacatatgtgattgtcaagatgctgtactctctatgccccacgatgtagtaagttcactgtagtgaattcgacaagatgtgatctttgtccaggttcgttactttgggtagatttaatttaaattcaagatgagcatccggaaggttgtgatgagggaatagtgtactctgtcccacaatgtaagagtggacttaaaatgattttcacatggatttcgcagcttttgtatatctctggagggtatttgctacatttcaactgccctttttttgttttcttcaatcacctgaaattacaccattattaagtcttaagattacgttgttatgtgcggaaatttagtttattttactgccttttgttaatttatgtagttttacttatttttttaatgtaagttgtatactttatatttcaactttcagttgtgcattaaatttattcttattcaactttccatataagaaaaaatggattgcgtttaaatagagtaagggtgcgacggaagtagggtgtgttcatgctaaaattgaaagtttggttgaaattgtaacgatgtgacggaaaagttaaaagtttgtgtgtgtgggaaagttttgctgtgatggaaaagttataagtttgaagaaaaagtttggaactaaactcgacagtagtttttttagggaaaaagtagttgtgtttttatttaagggatgagtggagtgtttgaaatttttaaagattaattcatcaaccttaaagctagacaatctctttctcaagatagatgcaactttcattttatctcaccaataagttaaaggtgatactaaaagggggagtcattgaaagtacagcagggtggaatatcgacaagccggatggaagaaaaatggttatgacaatgagaagaattgaagaaagatgtaatagtaatgtatgcacatacgcatggtgaaacagctgtttaaaaatattttcgcgaacgcgaaacaaccgtttaaaataagtttgatatatgtgaggaaaatgactcaacgtgatcgaggatagatcttgtcttacacaatctatatgcctgatgaagcaacttttatatatatatatatatatatata

SEQ ID NO: 29362 - DNA, 998 bp, Oryza sativa
tttatattggtggcaactgattatttcaccaagtgggtagaggcgattcctttgaagaaggttgattctggggatgctattcaatttgttcaggaacacataatctatcgatttggtcttcctcagactattactacggatcaaggttcaatcttcgtgtccgacgagtttgttcagtttgccgatagcgtgggtatcaagttgttgaattcttcaccttattatgcacaagctaatgggcaagccgaggcatctaataaaagtttgatcaaattggttaagcaaaaaatttctgattatcctcggcaatggcatactcggttggccgaagcattgtggtcttataggatggcctgtcatggatcgattcaagttccatataatcgaggctgttttgccatgggaagttagaatcggctctcgacgaacggagctgcaaaacgatttaacagccgatgagtattacaatcttatggctaatgagagggaggatttggttcagtcacgattgcgagcccttgcgaaggttactaaggataaggaacgtgttgctcggcattataataagaaagttatatctaaagattttttggaaggagaacttgtatggaagctgattttgccgattggtactcgtgatagtaaattcggcaagtggtcgccgaattgggagggaccgttccaaattcataaggttgtgtctaagggagcatatatgttgcaagggctcgacggttaagtttatgtgcgagcgctcaatggcaaatatttgaagaaatattaccacagtgtttgggttaacgcatgattggctactattgccgatacatgacagccgatgagtttacatcgccttgagatggccgatattgttatatcgcccttagttgtttttataatgtgatcggttgtgttttgccaatgtacaatggccgatattattatcgcccttagttgtttcataattttatcaatgctctcgacattgtataactagg

SEQ ID NO: 29363 - DNA, 1501 bp, Oryza sativa
ataatactccctgatctgtttacacattcttgacactaggcactattctaatgtaaactttaagtactttagatcctaataaatataatcatgaaactttcgtttattattagtggtaagaaaaaacagtgaaagaaaaagggagctaagtagttgtttttagtcgtgtcacaatagtttagggtgaaacggactagctcttctaacaaagataggtttagaaagaagtgttgaaaataaatgtagaggtgagctcaattcgttagggtttttttttgttaaaacctatcaacctggatttaattcatatatttgacacatatatatgctcgtatttatggctaattattcttttagtggtagacgacatacccgttgatcacgagtagtctgatgtgagatgtttatatgagtgtgtgcgcttgtattgaaattaaaaaaaaagatgtacccgttgatcgcgagttgcgtctgcagtgagatgtttatacaagcgtgtgcgtctgtattgtgttttgaaaaaaaaacaaatttataatacagtcagaattgggagctggtcgatctgcaatagtgatttatcagagatagcatacacatgatttaggacccatatgcatgaagctttgtagatatggacttatggagatacttataagaaaatgctaagaagcacctaccaaagcatagtgtggacacacgcgcacttcctcttttaaatatatatatgtatctgcatgtgtgtggcataatggcatgcttaatcaagcatatgcagctttgaccactaatcatatatacttgtaaagttgatctaaagtctatggcctcgctaaggcacttcatatataagaaaaatcctgaccgttcaacatgattaaaatagagaaagtcatgggcatcaagttttgcttaaaagctacattttggaattttaatgtgatagttttttagatcatttggtcattctttcagcaacacaatcttctgcctaacttgcatgcatgtatgcaataataatttcaggctctttttgaaacaaacgaaaaacatagaagttataaattatttgtgtcctatagaaaataatcctatggagttcttctaaaagaatggattgaatcctataatttcctttgaaatttctatgtaagaacaatcctatagagatttttgaaaaaaataaaaagcttcaacatacctcttgaatttttttaagtctatctcacatatctaattactgtgtttttcatatggtctattcaaatgatcattcctatatttttttcatgtatattctaattctctattttgcatttacattcctatttaaatcatatgttttttctattcttccattttttttcaattaaacgatttaaaggagctctcaaaggttggccacccgaaaatgatatataaattaatctttgtgaaaaagtatttaggatactatcaaaatttagcaatagtatgttaattaggtaaaccatcgatttaa

SEQ ID NO: 29364 - DNA, 236 bp, Oryza sativa
tcagattccttcaatttatagtagaacaagttcatgactttattctgttaagttatgacttaaatttatcagcattgattaaaattttgcttataatggtaattggtccatcacacataactagggaactgttttctgtaactttggcaatccatcgcttccaaatagctttctttaaacatttttggtatttagtgaacaagtgaccatcttaattctacttagttgttttaagg

SEQ ID NO: 29365 - DNA, 1253 bp, Oryza sativa
ttaattttggtttcccgatcattcaaatccaaaaaatagttgagtataaactgttcccacttgctgcatcttagacatattcaagtacacacgtcaaaaccatgagtggtcgtacgtagcagtgtgtgccaatgtcaggaaaatgtggggatatactcatatacagtacagaaaaaactaaagtttcctgtacaaaatatgtttttgacgtcatgaaaaagatatagaatctggcagtactaccgaaacaaagtctgcactattttaaatagaagcaaaaaaaaacatgtatgtatataaatgtacttgtattattcgaatttattcaattattgctcctgaaatcgagtggcatagacaacaggagacgagcaggggcttggcctccataataatttaatgtgcatttacggtacatcaacttagcaagttgatgcgatatagctggattttttttacaatttgctatttttgaaaaaaacttatttcgcaaatagactaaaaaaaacttatcccgaaaatagtccattttaggcgtcgtccaacgggacggcgccacagagtcgctggcgccgtcgttcaacgggacgacgcgctcccctgccacctcagcgccgacctgccacggttgctggaggacggcgccagagaggcagcgactctggcgccctaaaaaagaccattttcgtgataagattttcagcggtctatttgcgaaataaatttttcaaaaggaccgaattgtgaaaaatccagtgcaatttagtgtaggaacttgagaaatgagcatgctaggacaacaacttgccaagtgggtgcaacctaataaacaaaacttaataaataagcttatgggtacaactacttgaaaggtgggtgtgattttgatacaataacttgagaagtggtgtaaaaacttaattattttgagtattttttggctatatgtgctcagttattaatatacttatgtagatttgcacaagaatattcttttttgtcactctagtaattaaaagtcaaataaattttactgtgtagaaattttctagttggtatttgagtatggtgaaaaatatctaaatcgatggtgtaaattaggtgagcaatatattcttacagattacatcaaacattgattatatctacgggattgctatgtggatattaacatcatgaacttgcatagctctcattaaccaaaatagcacatatctagccaagttattgcaccaaaatactaaattatcaaa

SEQ ID NO: 29366 - DNA, 1501 bp, Oryza sativa
gtatacaacttacattaaaaaaataagtaaaactacataaattaacaaaaggcagtaaaataaactaaatttccgcacataacaacgtaatcttaagacttaataatggtgtaatttcaggtgattgaagaaaacaaaaaaagggcagttgaaatgtagcaaataccctccagagatatacaaaagctgcgaaatccatgtgaaaatcattttaagtccactcttacattgtgggacagagtacactattccctcatcacaaccttccggatgctcatcttgaatttaaattaaatctacccaaagtaacgaacctggacaaagatcacatcttgtcgaattcactacagtgaacttactacatcgtggggcatagagagtacagcatcttgacaatcacatatgtagctgcatcaggcggccagatgatgagcccccacatcctttttgctgctaagtagggtgatcagtacaaaaccaccatggcccccatctagcgtccaaatcattccagccagtttataccaacaaagttaagcctctgtttggtacagctttggattcaatatttcttaaagctatgtatgcctagcttcacaaatctataaatctgaatatacgattgcattgataacatttggatgaatcatttttttcctattttaaataaaatataaaactttaaaccactaaaatttaaaatacaaacttcaaatccatggttaataagtttctcccaaaatccaaagctccccaaacagttcatttttttatttagattatgtgaagatatagctaacaaatacaaaagatgaacggaaaatcagaagtttgatttattttttttcatttttttctatatttttaaaaactggctaagtggttatcaaccagatgcttcttaaaatctcaaaatatctccaaacatgcccataagatagccatagcagattcgtttcgttctaaaaaactgtgaagatgtagctaccaaatacaaaagatgaacgaaaagttagaagttgtatttattttaatcttttctagatttttaaaaaattggctatcaacaggcttgttagaatcttaaaaatcttcaaacatgcccataagatagccatggcggattcgtttcgttctcaacctatcacccataaaagggacaccaaccactctctttcccacgaactcctctctccctccctcagtccttcctcctctcgtctactcactcccctcaactgccaattcccctctctctcctctgcttcttcttcttcttgagctgatccattccatttcccgagctgctcaccaactccttctagaggccgacgcggccggcgccattgattgcccatgcactgacacgaccacagatgcctccttaactcctccactcccccacgtactgcgcgggaaccgatgcgcccatgcactccacgtagctagctaagacgcgccggagtggtggcgccggcgatgatggcgcggcggcgattct

SEQ ID NO: 29367 - DNA, 535 bp, Oryza sativa
ttaattttggtttcccgatcattcaaatccaaaaaatagttgagtataaactgttcccacttgctgcatcttagacatattcaagtacacacgtcaaaaccatgagtggtcgtacgtagcagtgtgtgccaatgtcaggaaaatgtggggatatactcatatacagtacagaaaaaactaaagtttcctgtacaaaatatgtttttgacgtcatgaaaaagatatagaatctggcagtactaccgaaacaaagtctgcactattttaaatagaagcaaaaaaaaacatgtatgtatataaatgtacttgtattattcgaatttattcaattattgctcctgaaatcgagtggcatagacaacaggagacgagcaggggcttggcctccataataatttaatgtgcatttacggtacatcaacttagcaagttgatgcgatatagctggattttttttacaatttgctatttttgaaaaaaacttatttcgcaaatagactaaaaaaaacttatcccgaaaatagtccattttagg

SEQ ID NO: 29368 - DNA, 413 bp, Oryza sativa
tccactagtatgaatttaggtagattcttcgctgattaattatgcaacattaggtggttttataacttagactttgggaattctcatatcatttggacactatggaatggttggattatgatggaattggacatacacctctctttctctttcaaaacccctaaaacctattttccggtggggtttgggtgcatgccagttgtgggaagtagcacccggccaatataaggattaagctcaggcctctattgcaaagcactaccgtacttccacatgtctagtgggtaaggcttagtttgtggctcagtctggttataaacaaaggtacacggatggagatggacgaagtcggggcccgatggacatctctaggacaaatgaaggctacatgagctgcggcccggtagtcgaga

SEQ ID NO: 29369 - DNA, 341 bp, Oryza sativa
tgtccaccaaaatgccattttcgttccatttggtgaatagaaatgtttttgctcaattttattttttcccagatcaaaatacccctaacgaaggccccacttgtaatactctttgatctctcggtttcccctctccctctctctcaacgacaccgtcgggagcggagcgtggcggtagaggccggcagacggtggcgggcgtggcagagcagggcccgcagaggagtggctcgaccagccgcctcgacgctggggtgccggagtttgcgccgcggatcgccgccccctgctgccgctgccagtaatctgcgcattcgccgcggcgcctcctccgccacagg

SEQ ID NO: 29370 - DNA, 1501 bp, Oryza sativa
ctaaatgttataggtattttggtcgtgactatatcgatcgatagtggtagctggttaaacagctactccttcatttataaaagacactatccatctatactttaaatacaattttctcttaaattacttatccgacttacgatccgattacaccgttgtgttcgtagcaattaaatctttataacaagatctcacatgattatatttttataaaaaataataaattacttttataatatatctaaattacttcttagacatataaaagtaattcaataaaacctaaaagtaatttacatatattatagaagtaacttataacaaaaagaaagtaactttaattaatatatttttctcattggacgtgactacacagctagtggtagctagtttgtactccatctaatatctccttttaacttgaaccatgcaaaagttactttcaattaacattcaagttacttttaaaaattgttaaacttatgtgtgttgatctatgctgattaaatttaatttctagtcatatttttatccctacaacgaatttacttctaatgtcgtgacaaagttacttacattttgttttaaattacttttataatatatgtaaattactttcagactttattgaatttacttttatatgtctaagaagtaatttagtgaaatctaaaagtaacttatatatatgataaaagtaacttatgtatataataaaagtaatttacaaacataaatattttttatcgtaatataatcatgtaagatcttgttgtgaagatttaattgtaacgaacacaatggtgtaatcggattgtagatcggataagtactttgagataaaactttgtttgaagaaaaaaatgacatgggggagaaactgtagccttcttctctgtgactctctctgaagcaggacccgcgtgtgcgtgtggttggagatcggacggctttgccaacgtcgcgcgatagcgctaaaacgagagggatctcgaattagattttacgtaaaaaatatggtatgaaaaaaatccggtctaactgtgtccgatatagtggcatgattcaaattttataaaataccaatggcatataaccgatatcataaatagtagcggtatttttttaatttgccgaagttgtaatggaatggatccaattaaaaaaagggtaagtccattttacaccctccaactcttcgttttgtctaaaatacacccaaaactctaaaaccgaatatttcacaccctccaacttccaataccgttcactttacaccctcgagtggtttttcagctggttttcgcctacgtggcattaatgtggaagtccagtcagcaaataaaaataaaaattaggaccttatgtcagtccataaccacggtggagccacctcttcttcttccctcatctcctcttcactttctctctctatccttcttcgtcccagagcaggagagaagcggcggtggcattcttgagctcatggagcaggagatcg

SEQ ID NO: 29371 - DNA, 301 bp, Oryza sativa
caaatatgacatcggcttagagataaatgatatgtcatcggcaattagccgatcggctatcatttatggatttaacgatggtttctttttctttatttttgttggttgcaggatcaaatcaactggcacgctcacgaacctaaaggcaagattttttggacctgcactgaagttaagcagatcttccaggcctcgtgttttcgcatcaacagctaggccaaacaccgacggactgatcgaggccataggaagtcacaagctgtcgagggtcaatctctgttgacgaagatcaagatcaaga

SEQ ID NO: 29372 - DNA, 1501 bp, Oryza sativa
tgaagttgggttagtgtcggatgctcaaatttcttacatttccacaccccgttcatatgttaatgaggcatatttggtgcaaggccatacactcaaacatggcccggatgatttgcttgtatttttcttcctcggctatacgaatgaaatcacgttacctaactggggttctatttgtataattgtcgagtgctactattcctctccaattgatagaggaatcttgtacaaatgatttccacgcaaggtgacgtgaagcatggcaagagtgacaccttaagaggtgtcatcctcttcaccggcagtgcagatgtatgaggccgattgagccccaactaaggatgcccccggttggacacaaggtcctcaacatgaggccggaggttcgtcttggcaaagcgcttctccagttcaagtggcctacctccctccacccgattgcgttgctctgtctcctctcgagggtatttatgtgaactcacttggaggatatgcaatcttgagctgcaggccagagatatccagcacacgctcaaggaacatgtcatgcagacacatgagtggcaacaaaatgttgatgcacagctctccaacttcaacaacacgatgcagcaacaataggccgactggcaggcccactttcgccaccaggggttcagcccctaccttggaccatgagcaagaaacaagcttggggggagatgcctttcccccactgaggtgacttgtattattacccttccatattgcattttccccttcatgttgcatttataaacttgaaaacaaaacaaaaatttgcaaaatataagaagaacaaaaatataggttagatttttatatgctatgtaagtgccctttggtatcaagaaaatataaattcataaagtatattgatggagtgtataaatttattatatgtgactattatatttatgagtttattctatgagatattatttagcaaaaatattttttatcgcacaataaaaataaattatcataaataatatcttgcgtaacaaagtcataaataatatttatgataatttatttttaggtatgacataaaaataaaatttatttattagttattaaaaattatttatttagcatgtaaatatatttatcttacaaaaatgtcgtactattataacaaaatatgttatatatacagtttttaatggtaaaaaatattattttttattatatctaaaaataaatgttgtcatagataaaaaatatttttgttttgccttcgcggaggtgaaactaaaatattatttttgttaaataatatctcacaaaataaactcataaatataatagtagcatacaataaatttatacactccatcaatatacttcataaatttattttttcttgataccaaagggcaaaatagactttatgataggaatttaacggtcaactaatgtaaggggtatagaagggatccaaacttaaatttaggggtatggaagggaatgagcaaatctc

SEQ ID NO: 29373 - DNA, 1501 bp, Oryza sativa
gagaggagagctgccaggacgaggcacggcgcgcgtggccaggcaaagcgaggtatcaggtacgggagagattattagtgtggacggattagcgagttgctcgccagtccggcaaggctgcaacaaactgaggacgaagagatgaggggattagagacctgacctgcgccgaggatcgatatcggtggaagaatatgcacatcttttttcagaggagggtactttttttacccggcctttatatccaaccggatatatacagctttttttaagtaggaacttagtctatcgaatagggaacttagccttcaaataacccaatctaaatatgcacatatctagataccactctcttaaattttcattttaatttatccgcctaaatttttaatttatccgccggttccacgtatcagcctcctctcctctgtcacctagttgcagatatcctgttgttgtttcttttttttcatctaaaccatcgtgacacagttggattcgaaccgataaatcctatactattatgttgatttaatgataatctacttataaaataagcttttctaaaatggccaatatgtcaaaaatccaggcagcaatattgtatcggagggattcgtgaagagtatggagcaggatttgaaaaggctggtggttgagaaatatggcgggcccaatcagccggagcagcggctgccaaccatctacagagtccctggtgagatgaaaaggagggacgaggagggtaacagctatagctacctcccagttgccgtccagatcggcttgctaagctatccaaggcagcagagccgcgaggaggactacagggtcctcgaactgtacaaatggcgctgcgtcggtagcctcatcgggaggcaccaccttctccaagagccaacccggacaccggagcttctgcgccggtgcctgagcgccatcaacggcttcctgccacgtatcctggcgtcctacaattttgacgcggaggcgctcgacgtcggccagagacatgtagtcctgggcatcatgctgctggacgggtgcttcatcctccgccgcctgctcaagttcgcgcgcattgccagtgaagaacaatcaggagctaaagcttcctcctctagttctcgttccggcaccggcgggcaagatgacgacgaggaccgggccgtgctgtttgggaggtgctgggtgtggtcgttcgtcacgtgcgacctgctgcttctggagaaccagatcccgttctgtgtcgtccagaagctgttccatcagctccggacggacgccgacgacaccagcgacgtcctcgtcgctggtgccctgcggctattcggctccctccgaccacgcaagctctactcctcgcccatctcctgccgcgatgtgcatgtgcaccacctcctgcacctcttctacctctccgtcggcttcccaccaccaccggacgccgccgcggcgccggacgacgaccctagcgagcacttggtgccgccgtctgagc

SEQ ID NO: 29374 - DNA, 1501 bp, Oryza sativa
ggctattagattggctatagataaattggagtaagtagtgggccatactattaaacttgctctaacaatctttattcagttgagtgcagctatctataattcctagggcaaagggcttgattgtaggctggcaaaggtataaattcatgaatcatgtgcccaatcatagtttactcaatgcttatcacaagttcagaaacacaattacttttcatggatcctgcagctacctttgtggggctgtgtactgtatagtactacagtgcatgtgatgtgcaggctaccccaaactggaagaatagtggttgctactatttgctataccacaatcaatctccactcttcatttcaaattatttgtcgttccggttttattctaaattaaatatttatatatttgataatcgctttctaaaaaattatatggattaattctattagatttacatttatggatttatcgtgagaagtgctttcataatatatatatatatatatgtatatatatatgtatatatgtatatatatatgtatatatgtatatatatagttcacatgttgcttaactatacaaatttctaaaaactaatagtagaatataaatatttgatttaaaacaaagcttgaataataagtaatttggaacaaatggagtaagttatatggaaggccctgtttagatcccacccaaaaattttcaccctgacacatcgaatgtttgaacacttatatgaagtattaaatataggctaaaaaaataactaattgcacagattgcgactaatttgcgagacgaatcttttaagcctaattgctccacgatttgataatgtggtgctacagtaaacatttgctaatggtggattaattaggcttaataaattcgtctcgtggtttactgacatattatgtaattagtttttttattagtaccgaacaccccatgtgataccctatataatatcctatgtgacacgccaaattaaactttacacccctggatctaaacacccccgaagttaagagacctcatgtagctactccctccatcccaaaatataagcatttttaactatgaatctggataactgtgttttcaaatttatagccaaaagttgttatattctcggagggaggtagtagctagctagctaggagcctaggagggtcctgatcttgttgtgttgtgtgatggttgatctgaatctgatgggaccagaccggacatgttgctagctacagatctttttcagttaattgttcaaagatttgatgagagcacgatgctggaattgaggggagctggttgtttggtcttgtgcatcaccatcaccaaactttgtttagctcaccaaacaaacacacatgcatatggatcactgtggagaaattaattaatactatcctaaatcttccattaaggtcaacttgaacccaatgagagctatagctagctagccaagtttaagcactggcaataatgctgctttagttattaata

SEQ ID NO: 29375 - DNA, 227 bp, Oryza sativa
atagaggggaaatgatcctcgggatcccctcttccttttctcttttggaatcttcggctaatttcgtttgaaatcgttggattcgagctcgattcggattcgttttttcctcctaaccctagaccttccatcgccgttgttggccgccgtgggcctacatcgccgctcctagcccctatataaggacactcgggacctcctcttttcgtcgccaccctcgcctcagc

SEQ ID NO: 29376 - DNA, 377 bp, Oryza sativa
agcataaaagagcaaaatcaccaaaacagcacataaacaatcatgaatagtacatttggatatttttaacatgtagatctcaattttagaaaaaattagagacttaaaccaactaaatccgagttaagatgaattagttatgaatttttaaagattaaatcggattaaatcatttatttagattttaattgaactatgacgcaataaagaattatttttgaaaaggaaaaaatgatttattgcgtcagcaggctcgggttaacggtggaccgggtgcacggggacggtgtacggaacgaacggccgagatctaatctagacaaaacgaacggccgagatcgatctaatccaccacgggtctacggatgacacggcgc

SEQ ID NO: 29377 - DNA, 1501 bp, Oryza sativa
tgtcggtcaagaagattttcgggacaactgtaatttgccaagtttccatgcgtgaatgatatatctgcaaaatattattgccttcatatatatgaatactatccatgacatgtataaaaacaataaattataatatatgtaattagtactaggagcttcccaagacaacacgaaattttggaatatgttgttaggtttaaaaatttagcttgaaattttcattcaaaagttttggaatttggttatcctcttctgcacctaccacccagccccccaaaaaatggtagtctagggtgcatgatgtgaaaatatgaaggcgatggagatagagacggcacaggccaaatggttccacaaaatgtgcgcgcgccgacgctccatgttgtggcagggttttgaaaatagaagcaagtagctaagcttagtagttggggaggttgctttctagtttgacatcaccagtgaggtgtgcatttgtttttgtgattcctacgtaatgtgagatactacctccatcacaaaatgtttgacgccgttgactttttaaaaatgtttgaccgttcgtcttattaaaaaaattaagtaattgttaattctttttctattatttgatttattgttaaatatacttttatgtatacatatagttttacacatatcacaaaaatttttgaataaaatgaacggtcaaatatatttaaaaaagtcaatagtgtcaaacatttagagaaggagggagtactatgcaggcagttaggggttgtggtgtttgtgctaatcttgttttatctggcgactcctccggtaatcgtcatcgccatgtttgaattcggatcacgtaactaattaaacatgtgaatgatttcatgggaaaatgatctcattgaaggatcgggatccagaccggccttgtgccggattacatttttatgaatggttccgctaaaactgtcgccacttttccggaatatataaatctcagtgatattttttgaccgtacttgcttagtataggtaggaaatgttgtgcccataatcatgtttttcatgatgaactttaagcttctctctctctctctctctctctctttatctctcttgttttttttcgtttctcttatgtgctaatttgtaccataatacattttgttcttaagtaggtcatcaatcatttagagtcttagttctcatacattgagttttacaacaaaaaattgcattgttaaatttgaaattcacaggggcggtggccgcaacgtcaccaagctcatggcggaagcattgagggcgacaatggggaaggtaggagctaaaggtgatatataggggtgtggggaggacggtggaggtggaggtggaggtggagacgcattagaggaggaggtgggagatagactgaggtcatcggagttggagtcggagggggttaggagatggatggatggccaacgattggagatctggagaactggggctcaaccggcagtgggtggaggagagg

SEQ ID NO: 29378 - DNA, 1501 bp, Oryza sativa
tgtcataggcacatgagggtccttatgtcattgacatataggtgacaattaactattctctcccttttcttctagggctgctaacaacctactatgaggcagatctgataatcacccctcccctaataaggctaattttgaaatgagattggatattgctactctatcatttactgtgagcatgcttcccaaacgacgtgtttttgcaagtaaaatatataagtttcttttttaaaaaataaactcaagtttttaataataactataattattgtttcaattaattatatactaatggctaacttctcttttaaactcagcctaagtcgatttgatgaactggagctcctatttcccctaagtctcaacattgagcttttagtggcgttctttacaagctaatacagaagaggagtggtaatggtggtagggcgatggggccgccaaggggatgactagcaataaggaagacaattaaggtaaacagagataatagagcaattttaaccaggaaaagtcaatatagagcctatgtaataatgtggatctaacgacttaggacattcacaatgtgaacatagtaagagacataaaggtagctaatagccttatatattgtgaaagttggcaataagccatttgatgctaaagttcaccataagcttatggcttggacattaagacaaaagaagaataaaactattacacaaaggagagggaggtagttcattcttggggtgaaagatttcaaatgaagcaatatttccttaattcctaaccattgtgaagtttgtcataattagtgcttcctgcacaggacctcatcattattgcttatcgatatatacacatagaggatgcccttaggttacaatacctacatcctggttacaaccacaccctctgttataaaatattatgtttctagcttttttaaatagggattaaggaagagggaaaaagactttggtgtcccttaaaaaaacaagaaagagttagggtgggagggtggtatggaaagaagtttgaatggaaagtgattgatgtgataagtagtagtgtgaagtgatgaaaatccttatattttaaaacaagatatgcatctaaaaatcattatattttagaatggaaagtaacaaatgaccaaaccattagagcttgttgccatgttatagctaaaaaacagctcaataggaagtacatcccttgtgtggccacaacttgtaatttgatgcctcaaagggcctcatcttttcaattatgcttatgcttatcagccaaaatttaaattttcaacgaataaatttgaagctgattttgaggtttttttttatcgaagtttattttttagcctttgattttagatcgctaaaaacacgtgtataaaagttttattcacaaattactttttgtttataaatatgttgttaggcttattccacgaataagccaaacgatgggaccgaaagttttcatcccttatgtgacaaacaatttaagg

SEQ ID NO: 29379 - DNA, 363 bp, Oryza sativa
actagtggatccccttaattattagttgagttctctctacatgatcttcccacgggataaaataaatacgatacccttggaatactctcgggtgaaatgctacaatggtatatccgtgcgcttgcgcataaactctgtaaacataatataccagaagtatttctgcgccattgctgaaaattatatttctagtaatgtcgttaagaaataccaacagggatccccacagccttggacctatacaggagctaagcagatctcccaggccgccgtgttttccgtcaacaaacctattgttgtattcttcatcacagaagtatcagaagcatgtgaagaagcaaacattttaacatgacaacacga

SEQ ID NO: 29380 - DNA, 1501 bp, Oryza sativa
gaaaaggtatttttccgggcgcgacaagctggtatcagagatatctcgactgtaggataagccaactggataaaacgtaaggacatattttataaatgaaactatttgcgaaagttcctttttcctcctttccctaatgctatttgcaaaaggtttacttccttcttccttcttcgaatttcaactagtactagatggtcagctttgtgaagaagaagagatcgtcaatcgtttgccgaagctccagaagactgttggatccgctagcgaagcgaaggaagcaatgaagccagctgtgaagcaggggtgaagatcttggagaacctgttgcagaacctaagccaccctctagggtagagtcgttagtcgtgtgtttccttgcttgtgtgtgtagcgcgtggtttgcatcagtggggtgtgatgtaaccatgctagattgtttgcttaatcaacttgcagaataaacctaacatacatcataacagaaaaaaaatagatctgttaaggtcctatccttagtttctaatctgtctctccccttttgttttccctctctccctctccaaacctagtaacagatggctgacaataaaaaaggcagtatggtcagaaatcaggacgtgggtacctcaagctcccgagtgaatgaagcaccagacaccagttgtatggcagtggtccaacacctgattaaccagaacaaattgcttatagagatactacagcagcatcagacgccaattctgaacccgagtcagatgcaacctcaagtgcagttggaggcagtccaagcactcacaccacaagtcagcgctccgccagcatcccaacaggcccatcgtgccatgccacttgtggactcaaaagaagcaagaatcatttgttttatctgtgttgaacaagggcactatgcaaggaaccgtcctcagcagaaaagaaaagcaccaatgcgaaccgaagatgaggtccgtaagatgaccattaccggcacagaatggcctccaccaggaatgacaaaacgtcagagaagaaatttcttccgaggtgcaccacagttgacagaacatcttttggctaatggaggtagagtgtctgatagcgaagattcagatcaagtctcctcacgggatgaagatgagaagtctctccaaggtttcaatcagaataaaaaggaacataaggcatgctctcgttgtggagaaatcggtcactttgccagctcatgtgtcaccacttgcgttccttgtgaggaagaccatccacccgacgagtgtccaacgagcaggatcacttgtttcttgtgtgaaggaactaatcatgtaccaaaagattgtcaattcagttttctgctgacgaagaagatggccaaccaacccgccagttacaatggagagaagcatcaaggcaacccaaatcctcgacaagactacagtttcagcctaactccagtgccaagacagaggaatcaaaatgggaaaagaaaatgccaagtctggaaaga

SEQ ID NO: 29381 - DNA, 290 bp, Oryza sativa
ataatcagaccattcaatgactaatttaatatttaaataattgctaaaatgctatttgtattattaaaattaggagttgagctccgaaaaatccgagaaaattccagagagtataattaatcatggagaatttaataaaaattaaatccagccatgctttatatttaaaaaattttatttcccacatttaacttcacttgtaaattaattaatatttaatataaattctaagaataatttattaaataatttataaatcctgaaacgaaattcaggatgtgacacactgg

SEQ ID NO: 29382 - DNA, 163 bp, Oryza sativa
atttctcactgtattgtggtaaaagaatgaattggtactcaattttgtggcattttagtaaaggcttcaaacttttgttcaaaatgagagttttcgcatccaactttgtggcataagagcattattctctttgtataatggaataccgttaacttgtctcagg

SEQ ID NO: 29383 - DNA, 478 bp, Oryza sativa
ccatactcttatttgccacatgatttgttggctttgtaaaaatgccacaaagttcagttgtatactcgtttatctgccacactttaccattttaacccaccaaatgtgcaattttcccttcttctgcaccctctttctctcttctatgagtttgtgaatggagcttggccgcacgggctggtgcccactgtgtttggcccaacagaaaattatatcttaaaaatgtatgtctctctatgggcttttacacccaggcctaggacctaggtccgccactgcggccgggagcagggcgcgtggaactggctttcaggaggaaagccgtgcgcggagtaggtgggctgcacagagccagttgctgagggcaggacgcatattgttgtgctgctggcggccagaggcggaggtaatgctaaggttgaagctggctactggagctagggtgtcatagctcatgccgagctcaggtgcacggaga

SEQ ID NO: 29384 - DNA, 1501 bp, Oryza sativa
cgtgggcacgacggcgttcccgtcgatccgctgcacgatagaggatgaaattaaaaggataaatcatcggcatggtgagaagagtatggaacgcgaaagagatggggattaccctggcttatttacaagtacgatagtcgtcttcttcgcggccggcagcaaggatgagggcgacggagaagttgagagcctcctccctcggtttcttcggcttagaggtggagaatgatgtgtggagatgcagctgggaggaggagaaggctagaataggagtttgatggcgtcgacacattgtggccacgcgtcgtacacagccggcgccaatctctctctctctctcggctgtctctggtcggctggaagatttgcacaaggtgaggacgagccagagtggctgccaagtgggtccaggtcgtggcaaactaagctagggtgagagggttgggcagaaacgtgggtgaacaaaagttttgaatgattttcaggattatttctctctcccactttagtaatttaaacagagaagataaattctggaaaaattatttttattcatgataaatgacctagtatttgaataaattattttacttatacacttttatgcagttaaatgcacttttagataaagtatggttttagccgattaagaactacggttaatctagtttttattagtttgactgatttatttgaggtaccaaatttagttattaaattataccaaaattacagtgagttgtatgagttgagtagagcctacaggaattttcccatgattttatcttgcacgaattattttagataattcgcaagacttatgtcttatatgtgtttccctttcctaaatgcatgtaaatgtttataaaagttatatttggactctcattaacctgaggtgatattgatatgatagaattacagtttaccttacacatgtcataagctccttacttatttatgcataagtttactttagtattaaattaagagaatgcttagagatgattaagatagaatataccctatatgatataatttatttgttcactttcatgttcatgacatgtcttcagatggatgtccaaattagttttgtgaggcttgacattagccatgttgatatattttaaggtgtatggtttctattttaacttcctctagctagcactaggccataatggtttagttgtttatctagatcttagttaatattcatcagacctattatgaaatgcaaatcaaatattcaaatgcacatgaaggactcaagtcaaaacatgttttatgcaagtatgcatgcttttactcgtgtttgcatttatgtcctaggttataaatgaaaaagttttaatttgttctcaaattttacttaggttcaagttagattgaccacacctaggttaaaaatggaaatttttagctctcaaaaatggaaaagttagcttccaactattttgataggaaatttttaaggtctagaatttgggtatgttacaga

SEQ ID NO: 29385 - DNA, 1069 bp, Oryza sativa
attatggttgtgaaggccaacttttggctgaaaccccgtccttcacaaaatcaaacaagggaaccggctcccgtgccccacattgccaaaggtgcaggcggtggtgaacaccatcccgccggggaactccctgattttcatcaaactcaacatccggtgttcactcgctccaataacccacttgattgtcgcgcccggaaaaataccttttccagaacgctagtgtattaatccccgtcccaggaaaagctggggtacaccacacaaacatgatataaaagacacatctttattatatcgataatatttacattattacaaaggcacttcaggcctatggctccatcttcacaggcgctcaactggggtataagccatggctccacctaaacttcttctccaaagctttactgaagggggtgaaagatagagcaagaatgagtacaaccacagtactcagcaagtcacaccgggagatgcatgattaatgcaagggagtacaaagggtgataatataggggttaagttttgcaataaacagcatttaagagtcacttagttgcccaaagctattttataaagacaatcctagagctacacagtattattaatcaaggccctgaacccacacgaacctggcttaacccaaggcctatgatgattcagaccaaactggcaacccgacctaggtcccagctcgtcccaagccaacctaggccaaccattccacattttagttgttaagcaagttttaagaattaaaccactaacttgggtacattgctaggcttgcccataaccgagggcgcggctattcgaatagattatactctgatcagaggtgtacatctttacccacaagacacatctttactctgcattccacggccgtggaacccgtggtaaaggatgtgacataacccctttacccatcctagccgtgacaaaagcaccgacccaacctcgcctacggccggaatcccgagacaggtaggtaagattgagcccctagcagcaggacaccggccctgtgccatgacatcttgaataccgagccgcagcccgtgta

SEQ ID NO: 29386 - DNA, 390 bp, Oryza sativa
tcattaatccattatatttagggatggatggagtaactacggacttaaaaaataaactaaaaaattattaaaaaagaaaataaactagaagtcacatgcgggttcttaagctggattctcagaagctaatgactgacaagctgcctcttaagctttttaaattaacaggggtctaattaagacgaagctgtggatttgataagggcgaaagaagctgggggaggaaggaaaaaggggcgcaatagtgcatgcacctggacaggactggacgacctcaccacccacaccaccacacccagcagcagcaggccgttgcatgtcgtatcgcattttatttttctttttcccgtttcatctctcttctttctctgtttctttctttccgttagt

SEQ ID NO: 29387 - DNA, 1501 bp, Oryza sativa
taaaaggggtgggctattttcgcgtgcgggtgaaaatatgcttattttcgtatgcggttggcttaagccgcccgcacgggataatgcgttttcccgtgggagagacagctcggcaccggtccccctattttcccttgcggttccacttacggaccgcatggcaacataagggggcggcatccaggaaaatctatcatgttgtagtgaaccctccaccattcaatttttccacttacctttatttcttgtccaatcacaatctcatttaattctacatattttcttaataactatattaaccctaaaaattcttatactctccaccaacattctctttttaaccaatcataatcctctaccattcaattttttcacctatctccactgctcattcaatcataatctttctctatttaattctacctactttctaccataaaaaattctacacactttcttaataatcgtgtacacccctaaatatccttatattttaggacagatgtggtaataatttttacttgcatgtcatatccaacacatgtgtgaaaatggactgggaaaaaataaaatagtttggactgtttggtagggcttcagcacctaaatttagagcctgtttgatacggctccatctccagctccacttctcctagagctaaagctcaaaatagttttagctccacctaaaataagagtggagctaggtagagcattctcacaaaatgaaaaagagaggtggacctgggtttaggtggctccacaactctactccagacccaactcctgtagttaaatttaaaaattggagctctaccaaacaagcacttaactctaggaactgggtttaaagtggagttatggagctgcctaaacccaggcccacctttctagtttattttgtaagagaactccagtcggctccactccctttttgggtggagctgaaatcgtttggttggcctccagctccagaaaaggtagagctagagttagagctgtgccaaacaaaccctttatgtaccacatttcattcataatttggttacttcattttagaaggagacaatatgacttattcttgtttatttagagagaagacacactaaatttgaagatactttctgagaaaatttcctatgtacccctaaaagttcacctaacctcttttatactcctgagatttgctcattcccttccatacccctaaatttaagtttggatcccttctataccccttacattagttgaccgttaaattcctatcataaagtctattttgccctttggtatcaagaaaaaataaatttatgaagtatattgatggagtgtataaatttattgtatgctactattatatttatgagtttattttgtgagatattatttaacaaaaataatattttagtttcacctccgcgaaggcaaaacaaaaatattttttatctatgacaacatttatttttagatataataaaaaataatattttttaccattaaa

SEQ ID NO: 29388 - DNA, 1501 bp, Oryza sativa
gatctccaggatggtggtgtgtactgttcttagtttatatatgaaattctgaatcacagatccacactcagatgagtatacactatttcttattcttcttccttttaatctctgtacgtacacgtagataaaaattaatcctagagttcagaatgaaaaatactgtgatttggatgagaaaaaatgtcatcaacagatggtagattaattgtcctttgcatgcgtgaatgttgttccaggatagtggtttgtgatggatttctttagttccttgaaatttgaatgaataagcccctaatctttttgttgcttgcaggtggtgtccggccgcgccggccgtctgcagaacatgtcgactcaacgccacaatccaacggcaccagcggagagaatatacacgcaaggggaaggatccttgtttgacaaactgtgatttggatgtacattattacttttcaatctgcgattcagcatgttcaatttgtgttcttgatcatgttttctcgtctgtgaggctagttcttttggaactacatatatctttgagaatatactaaaacttttggatcataatacgtgcatgcagcacgaacactgagttctgcgacagggtaaaagcaagtaataaaaatagcatatatactgctactatcttaaaaaatagcatatactgctactgctaaaaatggtatatactgcaattatcttaacaaaagtataaacctgcaccttaaaaaggtatatgttactaccaccttaaaaagaagtatatatgtatattgctaccacctaggaaacagtatatatactagtcttaactgaagcacagtacttaaactactttggtgaagcacagtactaagtaaaaaaaagaagtatatactattaaaaaaaataagtatatactgtcataaaaaacacgtatgtgggatatttatctgtatatatttctctacatcaaaatgaagtatatggcagctgcctataaactgctgcctactacaaataaaaaaaaacagtatataccgttgcttactaaaaacaaaaacagtatatactttcatgcagaaatggcagcatatacatagctaggaaatatactgcacgaaaaaagagtataaactgttacctactactaataataaaaaacagtttactaaaaacagtatataccctatatgggctcttctggccccagcttcctccaggagacttccatgtgggcccctaaatcagtgacatacattctaggcccatttgtgattgttaaattggacttttgggccttctcatgcaattgcagatcaccagcagactttcgactgattgattgatatatttccacatccttctcttcatttatgagtgcttctcctgcatacatgttagtagcatagcatatagtggaagtaattattttatttgggaattatgcattgcaaccataggtagtcttcatatattggataatattgacggtcgaaactggtcgacaacgacc

SEQ ID NO: 29389 - DNA, 422 bp, Oryza sativa
tgccgccggtgtccgagctagaattctactagtacacgtcaaggcgtcaagatgggattagattcagaaaaccggctgctaaacaagctaggagaacttgttaaaaaaaaagaaacagggattgtggtttaagctataaacttttgaaagacgactattaccacgtctgtgtggagaactattaatctaatttttttaggaaaaagaagtgtttttgtttgtctaatatatatgaactttaaatcttgatctcctacttaatagcagtaatttcttcatatatacatgcatggctagctttcttatgtgcatagctagctactgcaaattaaaaagaagccaaccagagagcaatcaaacaacgattatatgataaacttaacacaagtcgcagctaggatgaatatatagatagctcaaga

SEQ ID NO: 29390 - DNA, 1501 bp, Oryza sativa
attcttatgagcacctttaaacatattttttttcatataaatatggatagttctttttttttcttttccctggtttcaaccccagatagagtttctctgatccttcattttatcttacatctttgctctaccactcatggtagaatacatattggttttgcttccaagaaaaaatggcactgaatctctagcaccggcaacataataaacaaaatacaaaagcaaatctgcactgactggattttatttcatgatccttattacgtcgtcgaaggccccggcatccacaactgttcacagttgttttacacacagcttgactgaaaccagaatattatccactggactgaagtgcactggaatctcaggaatcatttccaggatcccaggcaagcaggcagcgtgcgactgaaactctgaacatgcactccacagtccgctaccaacaaacacaagaaagaagacgcatctgtttcttgctagtgcaaagcttgccatttatacttaattattaataactaaagcagcattattgccagtgcttaaacttggctagctagctatagctctcattgggttcaagttgaccttaatggaagatttaggatagtattaattaatttctccacagtgatccatatgcatgtgtgtttgtttggtgagctaaacaaagtttggtgatggtgatgcacaagaccaaacaaccagctcccctcaattccagcatcgtgctctcatcaaatctttgaacaattaactgaaaaagatctgtagctagcaacatgtccggtctggtcccatcagattcagatcaaccatcacacaacacaacaagatcaggaccctcctaggctcctagctagctagctactacctccctccgagaatataacaacttttggctataaatttgaaaacacagttatccagattcatagttaaaaatgcttatattttgggatggagggagtagctacatgaggtctcttaacttcgggggtgtttagatccaggggtgtaaagtttaatttggcgtgtcacataggatattatatagggtatcacatggggtgttcggtactaataaaaaaactaattacataatatgtcagtaaaccacgagacgaatttattaagcctaattaatccaccattagcaaatgtttactgtagcaccacattatcaaatcgtggagcaattaggcttaaaagattcgtctcgcaaattagtcgcaatctgtgcaattagttatttttttagcctatatttaatacttcatataagtgttcaaacattcgatgtgtcagggtgaaaatttttgggtgggatctaaacagggccttccatataacttactccatttgttccaaattacttattattcaagctttgttttaaatcaaatatttatattctactattagtttttagaaatttgtatagttaagcaacatgtgaactatatatatacatatatacatatatatatacatatataca

SEQ ID NO: 29391 - DNA, 1501 bp, Oryza sativa
ggcgcctaagtgaatggatatgaaacaaaaagcgagcaggctgtctatatatgggcaattagttgcattaatatagtagtttataattgcaagcatggcactacatcacaacaccaaaaagacatgccgtgatgctagaacagccattgaataaattagaaagaaaggttgtggttaattagttaacgaccaatcgagcctactagtataaattgtacctcgttgttatgaagtaattcatcctgtagtaacgaaacaagcagagagagagagagagagagagagggagagagataaataatatacagaaatgagcaggtcgagctcgagcatggccaccgtcctcgtggtgttgatggtcgtcagcgccggcggcttatccccaccatgtgcggccgctgcgaaggaggagaagccagtggtggtgctgccacctgcggcggcgccaggggaggcgccctccgcggacgcggcagcgttcgtccgctcctgctgcgacaccgccctgcaggccgaccgcgacggctccagcttctgctatgaccatctcctcccctacgctgccttcttcgagggcaaccaggtgaaggtcgccgaggtggccgccaccatcctaagcaccaacctctgggtctacgcatgctctctagctacctactaagtggaagtacattattttatttattatacttgttgttaattcccatgatcgattagtggtgttgtccacgatttttggtaacattgtttttctcaattttctatttcatatattcccaactctcaattctacattatatatcattttttcattcaacttcatacatacaattcctcagttctttcttatatataggccttacgctaaatttcttttggatacacaccaccgtcgattatatcgtgcatacttttgtatttcaattaattaattgtgatacttgcttcccacacattgatcgcatgcacgccacatttgtaacattgttatcaaatttcggaaataaatttatctatcgtgtgaattatttcagcttgcatgaatctttctttttattttaagcaacctttttctggtcaaaacaaactacacaaaaagatgacaaccaaaatatgttgatatattattaggagtatcctgattcacaccaatgctaaaacaaaaacataaaattacaatagaaaaatgtaagtaaacatcaaggctagagctaggcatttaatgctaaaaataaatgtcaatgtgtagctgtgtgaaccaaaatagaaaagagaaaacagatagttagttattgatcgtccttgttcctgtagagaaacttgtggagagtatgcgtaccgggtaccgacacggcctccatattcgactagagataggagtgggccggatccatctattatgtactagagtgggctgtctggcttgttttctactttgtaaccctgccccccaacctatataaggcgggcaatgagcccctacaagggcatcagcacggat

SEQ ID NO: 29392 - DNA, 1501 bp, Oryza sativa
actcccttcgtccctaaataaaagagattttagttgaatgtgatgtattctatatccagatttattttactatgatgtgtcacgtctagctaaaatcacatatatttaaggatggatggagtagtatactaggaaggtgcactaaaaaaatattattaaaggagacatttacgtctcttttttccagcttctagtgtgctgaattggcgttttgggctacgcagttggtgaaccgtttgtcttttaagccacaagtttacaatgacagtcaaggctccaatagtaaaatcagacaaaaaaaacttgtagctgtagaatagctgtagaatgacagatggttttgaacaaaaattttcctcatgcatttcgttttggacgtgacaaactgaagtcgatttttggtaaagtcacgggagtggaaattcgcgtgacaccttttatagtagttgatcaattatttttgaaaaaaaaaaactaaacgcacgcactcgtataaacatgtgcatatatattctaattagcgcacatgcacacacaccttatatgattatctttgaaaactgaattaacgaaatcaccataaatgtctcgttgtcaaagctacatcttatctggaaagagtttcttgcactttcacttgactcccacgcttgagaaattgcgaatgaaacaatccaaaggtaattaatgaatccaaattaatcgctctgaccagttgcaaatacagtcataaaatagaatagaggcagcaaatgcgaacgaatcctttccattcgaaactcaaaaaactgttcaaatccagccccaaaattgattgaagtttgcgaacggtggaagaagagagcaaaaacaacggaggggggaatcaagacggagtggagccaaaaaaaaaaaagttcttcccctttgctttgctcgtgctctgctcacatttgtttctctctcctcctcggttgcaagctgcttctgccttctgctgggctgctgctgctgtcccaatctcttttctctctctagattccaaatactttccccctattcctgggcaaccccatcatgagatgagagaggaggaggaggagggtggtctactctagcctggctctagagagagaagaggtccatcctagttgttgtactagtagcaatagcacaactctagagagagaggcaacaaggggagaagaagaagaagaagccaagaagaggcaaggaggaggaggaagcaaggagcaagaaaggtaggaaggattggggaggcatttcttggattcttggcttgcggggggtagcattgcgcctcaattctttgcttgcgctgctgttgcagatcagcggggaggtggggggaggaggaggaggcgtttcttggattgattcgccggaggaggagggatggccggtgtggacgcggcgaggtacgcgcacagcgaggcgcaccacgcggtggcgacgagggaccacgcggcgctgcggcgggtgctggacgcgctgccgaggg

SEQ ID NO: 29393 - DNA, 1501 bp, Oryza sativa
ccaattcttaatcagagccatatactaaacaatggtaaggattaggtgtttagttcgttgcaccaattcaatattcgtgtaagtaggacgatccaccatcaaatttcaaacatattattgtatcactgcaacaattatgattatatagaccaatcctataatgagttttactcccatccggcagcctgtaccgaccggtaatctggccgtccaccttgaaaggatacaattgggaaacagaaaagaggcggaacgattccggagtcacgccgccgctttcctccctcactacgctctttctttcctctctccccgcatcggttctttctcatctattcctccatccgagcgcagcaacggagtagttgcgccgcatccacgcctccgccggtgccgattttttccccatccatctgctgtccgcggcagcaaagccaccggcgcgctccgtcaccaacaacgccgccgcattcacgagcgaagatgtcgtggtattctgtgtcccctatcccccccccctcgacggctcaagcaagtacctaatctcccccgctgccattggcacagcctaagcccccattacggctcaaaaactactccactatatggtctagttattttgtaatgaacaattcaatctgccatgtttcttgtaatgaatttataagaaaagcacaagcttttgctggagactttaatctttgaatggaaaattttaagctcatctgtcgtctgtttttttatgctgtttacagggcatgatctatcgttgaatggagcttttgacttaatttttgtctgctatgaacagagcatggtatatatgtcgtattgagagccattaatattttgtctgctgtttttgctcgatctcctgtaaaatacatgtcattatgtggagtgattagcagcacaacaatggttacaaacaagtgttttcaatgaacagcaatccagctagagatgtaaaagttgaggaatcactggagtagagtgctagacacaggggcaataattactgaaaaaaagtataatttacatgattctgaaagactaaaacaaatatagagtaattcagagtttcagacagtgggagaggttaggtgctctcccaaacagaatagacagttaaaacaaacatagagtaattcagagtttcagatagtgggagagactaaaataaacagaattctgcaaattttcagccaaacagaacgaactagaacttagcaagaatctaaaactgaaggataagttagacaacccatctgaagaagctgtaatttagagtttcagatagtgggagatagataaacaggagaaatgcccaggggtcttccggctagctccacaaggtggtgggctagacgacctgggttcaaagcctcacccctcctaattatttgatattaggtccttccctaatattctagtttttgggagatagataaacagaattcacatggattggttgctaagacatcaacatgctgagtgatcc

SEQ ID NO: 29394 - DNA, 1501 bp, Oryza sativa
atgtacctggaggtaccgcataatttccaccattcgatcgagctaaataaatagctgagatttggtaccgggctggtaccgtggtacctgcaggatgggagcaagctggtgcgggctgcggctgggaacggcaccggcaccgctcggcaagcaaccaagcagggagagagcagcgtttagcacttgctgcacttcagcgtttacttgtattcccaaaataaaaaatactttattactttaagtattcttcaatgcatactcttttatttatacttatttgcaaatggacaatagattacgatcaatggttgctgccatgcttaacataggcttattgacgtaatattttgccgtacgataccgtgcaattgagattgtttatttccttattcttgttgggttttcactctcgcgctagtccatatgagccacaccttgtttttttccgtcctccgccactggccttaattatcatgtatttcaattaatgtgaatatgtggtgggatatattttttacactagctagtacggtagcacccctcaatttaaattctgaattcgccactgtgtacactgtagttgcaatgcatatacacaagtacgcaagtgaatccttagaaatctgagccaaaccaaagcggtagttatcctcaccacccaaacttaatctaatcatgtttgttttttcattttaaatggaaggagggcgccaacatatacattagttagatgtatatatgtgctagcgcgtatacacacgctagagaagcagtgatacagtgaacaaaaaattaaacttttttgagtgatacagtgggtcaaaaccacacttgcatggccaaattaaacttttgagttttgtggttagtagtagtaactaatgaataaaaaaatgtacttgtacacaaacaatggtcttttctttcgtacgatgtgtgaacaaatcacgcacagccagagaagatcatggagttctaggtgatgtgtctttttacataggttggatcttctgcagtactgttggtgtcctactactactcgtgtagtaatgttgtacataacacatgtagtaatgtcgtagagaatcccaattgcttttacacatttttcctataaacatttttaagagaaataaatattccctccgtttcaggttataagatgttttgactttgatcaaagacgaactgcttcaaatttgaccaagtttatagaaaaaaatagtaatattttcaaccaaagataaatttattataaaaaattatataattattaatttaataaatctaatttggtaatgtaaatattaatatatttgcctataaacttagtcaaacttaaaacagtttgactttaaccaaagtcaaaacatcttataacttaaaacggagatagtaacaacttcatctgcacaattctgaaggaatggaaaagaaattgtgtacctagaatggtagcttctctcatcatccaaacatgaacttttggtcacgatatttt

SEQ ID NO: 29395 - DNA, 445 bp, Oryza sativa
agctttttagcagacctgccccttggcttccctatgcccattcttggatccatctgcaagtctttggtcaccttgtcctacagcaacctatagctttgtcttctgtatgggcgggcatcttaagtgatacacctgggaaaaaccatctctattccaactccttttatattctccactcccatctctctctttctcccactcctacctaccctggccactccccctctctcccccactcctcactccggccacctcctctccctacctcccgcaacagggcatcttaagtgatacacctggaaaaaaccatctctattccaactccttttatattctccactcccatctctctctttctcccactcctacctaccctggccactccccctctctcccccactcctcactccggccacctcctctccctacctcccgcaacaacagg

SEQ ID NO: 29396 - DNA, 605 bp, Oryza sativa
gctgcccctgtcggggcactaggtcggccgtctttgtccatcctcagttatgatgtgctgaccctctatcttcttcgcggcacctcgttgtccgcgtgccctcttctgtccagcagagggatgacttccactagcctcctcctcatcgttcccctcctcgttcccctccgcatccctctccacgttcccctcctcgttcaagtactggtttggatcctcgttcccctctccttcgttccagtactggctgcttccctctacgattgtatcgtatagtatctgttcctcatcgcgatcagccatctgtgcatacaaaaaatatttgttaggtatataggatgtatttgcgtaccgtaatattaaaactctgctaatcttatattaaatctctaataatcttatattaaatggctactaatctcatattaaaattgtaataatcatatatatatgctaagtctaacaatcttatattaaatctctaacaaacttatatttaatctataataatcttatattaaaattgtaataataatatatgtatgctaagtataacaatcttatattaaatcgctactaatcttatattaaaattgtaataatca

SEQ ID NO: 29397 - DNA, 461 bp, Oryza sativa
taattcagtcttcccactaccaatcagagaactgatgacactagttatggaagtacctttttgtgaccttttaaagtcaacaagaagaacctttaaccactaatttaattgctatataccggaaagttacgaagtgtaatatactaatatgattttttgtcttatcaagaacttactctttacatttttgtataaccatgctagacattcaaaacaataacttcggtgaaaacaaatatggtttgattgcatgcattcttgatagtgattatttgctggctggatggagtactatcagttacagtctacagcaaaggtcccatgtaaattagctatgttctttgttcaggtaggggcatgtgctttctattcttttgcatgtccccatataatgcataattatagacatgcatcttcattatgattttattcaagtgtattccttaattcctgcttacgtg

SEQ ID NO: 29398 - DNA, 425 bp, Oryza sativa
catccatatccaccgcccatcactgcatctagcgtcgccgcccgtcgtgccactggatcgaacgccggcaacctcggtgcggagaggaaccctggtggagacctcggcgcagagagggaccccaccgatgacctccacatcgctcctccgtcggtgacacaaattggcaacgacagtgggaccggggagagtgagttcatcttgcttgtgtagttcttgatcttgtgttgttgttgatctgtgatatgtgaaagatggggtgaggatttttgttgttgatctgtgatggatgggaatgagaattgtttgttgatttgtgatttgtgaaggatgggattaggggttgcttgaaggggcggctccaaagcatctcctcatcaagccgagccgatggttggagccagcttctccttttttctttgaaa

SEQ ID NO: 29399 - DNA, 932 bp, Oryza sativa
gggtggggggtcgtcgccgtgcaccgccctcgtcgccccggtgccggcgccgccctcgccgccacgctctgccgatgggaaggaggagaggagagggagaacaggggaaaggagaagaggagagagagggagataaaaaaataaaaaagatgctacatgcattgtggagtatgtagcctataaagttctttgtctagttggcatgggaggaacaccaaaattgcagggcgctctgtgaatggccttagttgattagccagcagcttttacagaacatcactagatcagtcagccacatgattggcacatatgcttgtagtttctgaaatttttactgcatgtcctgaatctgaagttttggatagatgaaaactcaaataactcgattggatagcaacatttccaaaattttgttgttcaaaggagcacatcgattgattttttttctgaacttctgacgatatgtttcttgttgaaaaaggagatggattggattgtgtttctgaactgctcactacgtacatatatatggtctcgttgaacatgctatttttagcagtattatgactacaaaatagtagtagtttttttttgtggatatgaaatatggataaggatcatgcataggtaggcctgctgctagagttttgtttttgtgatgctttaagcatctccatttcctgctcttatctaaattttcatgtgtgcattattgaatttgcatgtgcaatacgtgcagagcactgcttccatctgaattttcatttgttcggtcattatttcgtcaatgcaatgttttggaaaaatggcaatagcatcttcagggtggacagcaacattgattttcattcatttcaaccccatgcatgaatcttttttttctcatttagatgtattgcacaatgttatcgattgcaggtcaggactaaggc

SEQ ID NO: 29400 - DNA, 1501 bp, Oryza sativa
ttaagggactaatgagttcattgagtatcttttaggtgcattagttcaaggtgtggaagatggatgcttggagaccccccaaaagtataaaatcaaagcggaccggaactcgagaagtgcataggatagtttattttttgcaatcgagtttttaggaaaaaccgtactattaagtggggttctaggtgatgctctgagatatctcaagtgctcttagtgtgaaccaagtgtcaagtttccctaggagtcatttttgcaaatgctccattggtccaaaaatgcaagtccggaacttcctgtttccaggtccggaagttccagtatgatgaaagaaattttcctaagtattatccggaagttcctgtcttctaggtccggaacttcctgtctagttttcagttcaaatttgtgagtaacggctagatgacgtcacatatacagctcgtttccagcttgttcattggccattccactttcactttttgaacctagagctgttgctagcctctcccaagtgtttcttgccttctccactcaatctagagcctaattcttatgagaaagagagattgagaggaagagaagaagatttggagatgtgtgaagactaggatcttgggtgagcacttggaatatcttgtgggctgtcatctcggtgcttattactcttggagatgatctcctagatggttaggtgtcgcccgcgagaatccgttgcatattgtggatgtcccgggtaagtttgtgaaggatctcctctcctccaaaagggaacgaggtaagttaattaagttcttgtgctgagattctagaggttttccaagtagagcaacgtatacttgtggcgaatttctagaagtagtttgagttggatcttggtggtcactcaattctagaaacttgcctaggggtgtttgtagttgaaggctgtggatttcctctggagtttttgcacaagtcaggcaaaggggttaatcgagacccagctctttggagctcctcaacggagagtaggatcgcaagatccgaacatcaggaaaaaaatgctcttgtctctttctgtgatgtttctgtggatgtttctgtgatctatctcctacttagaatacctgtgcatcatcttgtgaagattggcttagtctcctgattcgaaatttgaatttcatccttgttctgtaacccggaagttcctgtcctaagaacaccggtagttccgggcctggcaggccagaagttctggagttccttaccaggaagttccgggtctgtttgaattttaccgctgcgatttgtttttaagttttcagggacagcctattcacccccctctaggcttcatcagcacgttcaattggtattagagcaaggtgctcttgattcaagcttcactgctttgagtgatccacaatgtcggacttagggggaaagaacggggaaaatggaaatgaagatggagcgagcagcaagggaactccatcacccaagggagctactatacctt

SEQ ID NO: 29401 - DNA, 1501 bp, Oryza sativa
ggttcaaaaagtgaaagtggaatggccaatgaacaagctggaaacgagctgtatatgtgacgtcatctagccgttactcacaaatttgaactgaaaactagacaggaagttccggacctagaagacaggaacttccggataatacttaggaaaatttctttcatcatactggaacttccggacctggaaacaggaagttccggacttgcatttttggaccaatggagcatttgcaaaaatgactcctagggaaacttgacacttggttcacactaagagcacttgagatatctcagagcatcacctagaaccccacttaatagtacggtttttcctaaaaactcgattgcaaaaaataaactatcctatgcacttctcgagttccggtccgctttgattttatacttttggggggtctccaagcatccatcttccacaccttgaactaatgcacctaaaagatactcaatgaactcattagtcccttaaccacatttgtcattaatcaccaaaacccactagggggattaatgcactttcagttgtgctggaacatccaaaggtacaacgcggatactggcctctatcttgtcaactggtggctggggctgaaattgagcattgacaccttgtggtagtgcactcattggagtgggagctattgcatcttgggctatacgactgcttcaggacgcatggatgacaattcgctgaggagcaagcttctgattgaggggagttgcatggactgatgtgctggcaaatatgtttctcggtttcgggcacatgtcggcgaaatgacccacttcttgacaattgaagcaacatatatctttccagacttggcattttcttttcccattttgattcctctgtcttggcactggagttaggctgaaactgtagtcttgtcgaggatttgggttgccttgatgcttctctccattgtaactggcgggttggttggccatcttcttcgtcagcagaaaactgaattgacaatcttttggtacatgattagttccttcacacaagaaacaagtgatcctgctcgttggacactcgtcgggtggatggtcttcctcacaaggaacgcaagtggtgacacatgagctggcaaagtgaccgatttctccacaacgagagcatgccttatgttcctttttattctgattgaaaccttggagagacttctcatcttcatcccgtgaggagacttgatctgaatcttcgctatcagacactctacctccattagccaaaagatgttctgtcaactgtggtgcacctcggaagaaatttcttctctgacgttttgtcattcctggtggaggccattctgtgccggtaatggtcatcttacggacctcatcttcggttcgcattggtgcttttcttttctgctgaggacggttccttgcatagtgcccttgttcaacacagataaaacaaatgattcttgcttcttttgagtccacaagtggcatggcacgatgggcct

SEQ ID NO: 29402 - DNA, 224 bp, Oryza sativa
atttgtccagtgtactagaatttgtccagtggagactttacaaaattttccatatgcttgatagactcattaaagcttaatcattatgcccacactttggttgcatttaatatttatgcatttatagtcttatgttttgaccagcaaaggtgaccaaaaagtaaggaagtgaaagcggagcagtggaggccaccatcccttctctgcaacacatcaacttggca

SEQ ID NO: 29403 - DNA, 325 bp, Oryza sativa
ctaattacacaattttttaagtgttctgtagcaaattttgcaaaaaaaaaggaatatttcaatgtgcatatgtccctctcttgacattgcagtcgtgtcgtgtgtacgtagaaatagaaatagttgctcctagttgatatcggattgtgttcaccctgatttctgattcttattctgagatcgaatcggatttgctttgatctccgatttccttcctacatgttgtgcagattgctatacatgtgtgtatatatacaaaggcatagcacctggccgatcggttgaggtgtgctgcaacctgcaaaccggagggagacaaagaaca

SEQ ID NO: 29404 - DNA, 384 bp, Oryza sativa
tgtatttagtagatcaatgaatgatttgatctaaaagaagtataactgtgtaccaattagcacactctccatttttttttctgctgatctatgcattatgtttatggaactaaataattaatagaaattttagcacaactctcaaaccccaaatttttgaacaacgggattttattataagctataaaatctctggcagaggtaagatggagaactgtgattacataccgtcaaataaaagagtttacactatcaaactatatggggagagtttttttttttaccgcccatcaaaactttggtacctcgcaggagcagacaagtggccagcatcgtatcaagaatttgttcgcaggcagggctagctagagattacggtgtcga

SEQ ID NO: 29405 - DNA, 1058 bp, Oryza sativa
gattacgaaacgtgaacgaacgtgcacgaaacgcttacgaacgtgaatgcacttgtactaaaagtgtgagaatgaacgcgtttatactaatacgatttactggtaatacatatatgattatatatgtaacttggcccgtttagactaatacattttcctggtaatgttgcagagaagacgtcgtcgtcgtccctcaagccgaagtggtagctagccatcgaaggaattcgcgcaggcaagtgatgtaaagaagtgattgttagatatttaatattagattgttagacttagcatatatgattattacaattttaatataagattgttatcgatttaatataagattagtagcgatttaatataagattgttatacttagcatatatgactattacaattttaatataagattattagagattaaatataagattgttagatatttaatataagattgttagacttagcatatatatgtatgattattacaattttaatatgagattagtagccatttaatataagattattagacttagcatatatgactattacaattttaatataagattattagagattaaatataagattgttagagatttaatataagattgttagatttagcatatatatatatatgattattacaattttaatatgagattagtagccatttaatataagattattagacttagcatatatatatatatatatatatatatatatatatatatatatatatatatatatgattattacaattttaatataagattagtagcgatttaatataagattgttatacttagcatacatatattattattacaattttaatataagattattatagattaaatataagtttgttagagatttaatataagattgttagacttagcatatatatatgattattacaattttaatatgagattagtagccatttaatataagattattagagatttaatataagattagcagagttttaatattacggtacgcaaatacatcctatatacctaacaaatattttttgtatgcacaga

SEQ ID NO: 29406 - DNA, 1454 bp, Oryza sativa
ctaattacacaattttttaagtgttctgtagcaaattttgcaaaaaaaaaggaatatttcaatgtgcatatgtccctctcttgacattgcagtcgtgtcgtgtgtacgtagaaatagaaatagttgctcctagttgatatcggattgtgttcaccctgatttctgattcttattctgagatcgaatcggatttgctttgatctccgatttccttcctacatgttgtgcagattgctatacatgtgtgtatatatacaaaggcatagcacctggccgatcggttgaggtgtgctgcaacctgcaaaccggagggagacaaagaacatggcgattacggaggaggatgtgccggcggcgaagaagatgaagacgacgacagaggatgatcatgaggaggtgttgctggcgtatcccccgcgcaagaaggaggatgggaagaagatgaagaaggtggtgaagaggctggggaaggaggaggtggagaggctgctgtcggtgacggtgaccgtgccgaccctcagcaaggaggcgatggaggaggacgatgaggaggatgtgcgggagagggagatgctgctccgagccgcatgcgcaaggaccaggtcctcatccgctcccagttcgaggccaagggctacgtcgacgtcctggacgaggtctccgacgacgacgacgacatggagatggagccgttgtaacataacctcacctgtaatctgaaatatactggaataaaacacataccgaccggcaatttcttttgattacggatttattttttaagtagttaagatcttgattaactagacccgtcacatcagcgtcacctctaaaacctacagcatcgagcttcacaatgcaggttggaaacatctgaatatctgccagtctcttgcccttgagcttcacaatgcaagtatgtatcccccggaaaaaaaaatatggagtatgtacggtagcacagttgttggaatataaagctgtgatcattgtttcctagaactgtcgcttcaagcattgttgtcattccttttgcctccgtccagatttgtttctgacagtgtacgtatccattactcagataagagcctgatgtggtgcagcaagcaatggtatttgctatgccttctgaatgttaatacatcccgtgttttttaactgatgcttccaacaacgggagtggattctaatcgctcgaggggatatcccctcgtatacttttttcttctaaatttgatgcaaatagttgtgaaaaagtctgaaaaaaattgacaatatagagtataatggtacctgctagctagtacaccaaaattcaagttcaaattcgatctacacatcgagaaaaaaaaaacaaatttagatataaatagtgcgctagtattcatatgctgattttttcttttttatatctcgacgtgtgagttgggtttggacttaagatttcgtggagt

SEQ ID NO: 29407 - DNA, 1501 bp, Oryza sativa
gtaagtcttctaaaagttttttataactatttaaatgatacgtaataaatgggagtaaatgttcagaaacttttcgccaatgggatctaatcaagtttccggtagcgatctcctttgaagaaaaaagagtttccataagtatagtcctataaattacgaagtattcagagaaaatattggttttgctctacattgtttgctgaaataaaattgttggtttatcgtcgtggaaagaaggaagcatgatgttcttgattttaagagtaaatttcaaaaaaccccatattctattatcaaaaaaatcataagtattatcacttgtaaatctgtggttatgtgacacacatcataataacttaaaatttaaatacacggttgtaagttattccagcttgtgcaattgtgaaataaaattgcttaaagctagcatatactaacatttctttaattgaggtttatatgcatatggcaggtttgtatacactattggggctatttgtggattttagttgatggcaaatgcctcatccattctattttacaaattaacgatactctcgtgagtttagaagcctattttcgtttctatattcgtgtcggatcattttcaaaaatacaagataattcgtatttacttttaaacgagctattcatatttactttcataaaataaactaaaagacgaatatgatacaaacattgttatctgtccatatacactttgtttttctccatacctgtaacaaccatatgtgtactgcgtaatatgaactttgtcaatgaccctcaccttccaccaaacaaatgggtatgtttggggagcttctaacttctgcagcttctcccagaatcaaaaggtccccaatcagtttagcttttggtttagattatgagaaatagtagatgtacaatccagaaaacgaagtagaagccaaaagccgaaaaacctagcttttctagaacgaagaagctaactatcaatcgactgcttcttataatcttagggcctattggaggagcttctagctactgtaacttctcccagaatcagaagctcccccaaatagtctagcttttggtccaaattctaagaagctgtagttgtaaaatccagaaaataaattagaattcagaaaccgaaaaacccaacttttcaagattctcatagaccggctactaacaaattgcttttcagaattttacgctccctagacaggccggaaaatatctcccatgttcggatgagttgccaaaagtacacatgtcacgcaagcacgcgactcacttgatctgcgccaagtcaaattatatcgcaaatcaaaagaaaatgctagtactcgcgatctccacttatggcagcgaatccatcccatggccgccaggttatccacatcatccgcaccggcggataaggtgcgccacgcggcgcctccccactggccgaaatccaacccgcgccagcctccgctgcagataatctccccgcgccattttacgcctc

SEQ ID NO: 29408 - DNA, 1501 bp, Oryza sativa
ccatgaagttaagcatgaaacgaccctcgtacaaccgcacttctcgtatgggtatagacctagcggaatagatagctgagcggaggcattatccatgcatagtggtttcttgatgtgtgaggcaggggctctacggtggggcagccattggtagaaccgcgaggcgggtgtctacagtggtgtcgccatcggtaggactgccatgagagaatttaaacataattataacttaatgtatgtgtgagtctttctttcccgggtgcgccagaactcctctcactgctagaaaccgtgtacgcctagagtgcaagaggatgtaaagttcatggagcgggtactgccaatgcgaggttatcaaaaagctttgtcgtgatgcgtctcatgtgttgggacgaggctcatgtgttgggcagtcacggagtgcgggtaaagtgtacatccactgcaatgtgagtaaaccaaatctattcgaatagccgtgctcgcggttattgagcaccgggacatgtattacacttggctagtctctaagttattaacttgtgtgggatgggtagttgcatgatgaatttatatgctgttggagccacttcctgagaagggggaaagtgggcgtcctcagaaaaccataacgattcaatggcgggaagctatccttgggatcacaatggatggtggacagaaccgtcattgtttgaatacaaacactggtactaaaatttgatcagtcaatgctaggtctgaggcttgtgaaaagaattacaaaactggctttacgcaaaagagccatagccatcctttgaaatacccctttcatatgcattgttgctgtggtggcttgctgagtacggttggtactcacccttgcaattataaaattaatcagaagcgggaaatgaagcttcggaggatccctatgcctactaccaggagggagatgaagacgatggcgctcagtaggtcttagtacggtcgttgcctgtggcaatggcatgccgctgcctaaattctgctgccttatctatttctgcttttggatgtattccggaccgctcggtccgatgatttaagacaatgtctaaggtcttatggtgtaataattagcactagactctcgtgtatgtgcatttggtatttcagttatgaactcgtgtgtaccagactacttgatccagggaaatggtactgtttacatgaatgattcctgttataaaaacgggggtctacacattcatcctgcaatggtcagcccatcaggcaatcatagcagctgcgcctcaatggggcaggtcggatcacagagcatggacgccatgcaaacccagggcgaaaccacctgccccgttgatgagatcacgcagcggacaccatgtgagctgcatattcccttcaagaacttatcaatcaaggtatgctcgtagtttgatgatttttgacttgtacattccgcaagttgctgcttaggttgattactaatagataacctctcatcacgtgaagg

SEQ ID NO: 29409 - DNA, 1501 bp, Oryza sativa
ccacgccgcgtcttgcccatagagccgggcgccggcggccacaccgcctgacatcacatgcgccattagaaagaagaaatcgaagaaaaagaaaaaaaataaaaaaaggagaaggcgacaccggccgcgccatcgaggccgtgatggggccgctgtgacccgcgctgccgccgcacggaaatatggtcaccgccggccatgctcgcgccgagccgccgcccggccgagtgccgctggctgagctggagccggagccactgcgcccgccgaggccaccgcgccagcggcagcacgcgcgccgtgatgcgtgtcgccgtcgcccagtcgcccgtcccgtgtctcggcctccacgccgccatgcaacacccatcgtgcgagtcgcgccagcctccccgcccgccacatttgtcaggactcaggagcaccatcgggggaggggggaggagaaaagaaaaaaggaaagaaaacaaagggaaaaaagaaaaagaaaatgattgaatcttgtgattttgcaaataaaccctcatcttttgggaaatcgcatgtttgtctgaattggaaatttcatgttttaaaccctgaaattttttaaaaatacacaaataaccctttgcattgggatatttgtttgaacggtattcggaatttgcaaaaccactaaaaaatcatattctcgcataaaagagcccctggatttttgaattttgatcccgattttgcatttcaggaacttttgttgttgatatttataattatgaattttatttattgcatttatgattagtggttatttgtaatgcttttattacccttaattgatatctttgctgtaaaatgtatagaattgcatagaatatattggaattatttgcggaaattttgtgtaccattatattgcaacatttgtgcattttacctaaatgtaatttgcgtgtattttttaataacgaaagatgactggcatcacgaacaagaagttcatcgaatctagaatatccctgacatatgcaaccgaagtcgacggtgcaagaagctttgagcaccatcaactcaagtacactctatttattagcttgatgagattgatcaagcatcttcagtctctcattggtgtctctatgttactttcatgaatgagtacactagatgaacgagtgcgttgacactctgttgactacacgaaagaagtggtttgaaagattatgatgcacacccacctctcatagagcaagaatgggttttttttttactatgattcattgagaatatgactcggaggctattcggtgcaccgaatttacaccaaatactatggaaactctcaatgattctacccgaacacgatgaaagtcgcacgtaagcatcactagtgcacatacaagaagtatgcctaattagttgataatagaattgcgcaacgttcagtatcgatttcgaccgccaactagcacaactaataaagagaaaattagcattttgtacaaatataccaataataaat

SEQ ID NO: 29410 - DNA, 196 bp, Oryza sativa
tgcaattatcgtaagagcataaattacacttaatttttgagggaatctatcctaccatgtcatatcctgaaaaggtcacggggtacacagatctcatctatgattcgccatatgaaaaccttaacggtgtaatcaaattgtgccgaaactgagtcaatctcattgtctcgtttttctcaatgcgtgcggttccagt

SEQ ID NO: 29411 - DNA, 1501 bp, Oryza sativa
ccaaacgagatgaaacaccaaacaaaccgctcgaattaagtttttctttcttttcttttttttttttaaaaaaaaggtattttcccctttgggagaacaagaaatttaaggctctccagttaattccttattcttaatcatcaaacggcaagagctgcgcgcaactcgcacgaattaaccagtggtgcgcattgctgtcgaggtatattcggaaattctccatccgccctcgtcgatgcgcggctgctcaccatttggcaaacagcaaagcagcagcggagagcacccaaataaaaaaaagtgtaaaaagaatcgcccggatcaaagcaaaggggggagtgcgaggagtttgatttggactcgtgcactggcgggggcggatgtggagggtagcgggaaaggagaagcgggggaattacctggtggagcatgcggtggttgaggatggtgtccttgtcgagcaccttcatggcgacggcggcgccggtgtcggcgtccacggcgaacttgaccttggcgaacgtcccctgcccgatggtccgcccaacctcgtacctccccacccgcttcttcctccccgccgccattccctcctcccctcccatccgccgcgcggccacgaatccaactcggggggaagaggaggaagacgacgacgccgccgcgcgcgagctcggctttgggggggcttcgctgcctgaataccgaccatctggttgactgcttgcctatttatgggcttccaccccctccgttctataatactccctccgattttattttaattaatattttgataatcacacgatctaaaaaacatatatttgaccttatttttctattataatatatgtaataaataaatgaatgtttagtgttttgaaagacaaatctatatatgttattcttgttcttttaaactaaatacttttatatatgttgttcttgttttttaaactaaatacttttaaagttatggatagtcaaagttataaaagtttgacttcaatcttatctaaaacatcaattattatagaaccagagggagtaatcgacatttaacataataaatggtttcgatatatggttttgattagcatatattaagatttgagattacgatacccctcattaaatggtgtataggtaagaatagaaggacaattaagggtaaaatagaaataaatttaaatgagaagtgattatgagacaattagtactctattatgataattattttgtgacacatgtaaatcttagaaatacaattattatgggacggagatagtacagaataaaacgtcatatcataaaattaagattatttttttcacaaaacatttaatgcggagtatcatagaattatgtgctattacaaaactacagatttcaaagttgaaactcttagcactaattttatctccaaattataaaatgttgtagttttataataattttgttactaaatctgcaattttgttataatttatttttttgagaa

SEQ ID NO: 29412 - DNA, 472 bp, Oryza sativa
atactctctgaaattttctcggattttttagagctcaattactaattttaataatacaaagaacattttaggaattatttaaatattaaattagtcattaaatgatcttatcttaagtttgttaaatactctaagtgtccaagtagttgcgagatttttcttgaacatatttcagtatttgaagtatttttaacaattcaaatatcatttcagtgattaatttagttggaaaagtaattaaaatcctttcgaaagctcaggtcttaatctggcccatctctccccttcagcccagccgatccagcagcctctttctctctgtcgaagtctgctttggggctatttgggggagctttagattctgagaagcagctgtttggtagccagcttctgagaatgtggaaaagctctgaaacccatcttctccagcttttggcttcttagttcatttttcagaatctgtaactacaga

SEQ ID NO: 29413 - DNA, 1186 bp, Oryza sativa
atttagcatacctcgtttagtctaactatattggggtgtcttacaatcttcattattgatatctcccttttgatctgtcaagtaacatgagaagtgagttcgtaatctaatgccgaattagaatggtttagtccttttttttgttatcatgattagcgatattgcataaacaacacaaagaaagtacatctcgcataaactggaaatctgaaatgggtgctcacagcaaaatcaggtaaaactggtggtcatcattgatttgcagaacagttaaactaaacaaaccaaatttatacacatgaaattgcaaacacaattggggagaaactaagcttcatggcaaagcagtaggcttaggattgtagaacagttatattaaacaaaccaaatatatacttgcaattgcaaacacaattggagagaaaccaagcttcatggcatagcagtaggcttaggattatagaacagttatattaaacaaaccaaatatatacttgcaattgcaaacacaattggagagaaaccaagttccatagcaactagcaaatcaggaagcttaggaaaagatttacaccactataattagagaacttgagcactttgcaacaagatgcatcctcaaaagatgtcgttggataaccatatgaaccaactatttgtagcatttctgcaaacaccgcaaatcgaattaagctacaacagaccaaattttggtaaaatcactttcaacacccaaccatttcaattctgcaactgagcttctgtcagcccaaacgagatgaaacaccaaacaaaccgctcgaattaagtttttctttcttttcttttttttttttaaaaaaaaggtattttcccctttgggagaacaagaaatttaaggctctccagttaattccttattcttaatcatcaaacggcaagagctgcgcgcaactcgcacgaattaaccagtggtgcgcattgctgtcgaggtatattcggaaattctccatccgccctcgtcgatgcgcggctgctcaccatttggcaaacagcaaagcagcagcggagagcacccaaataaaaaaaagtgtaaaaagaatcgcccggatcaaagcaaaggggggagtgcgaggagtttgatttggactcgtgcactggcgggggcggatgtggagggtagcgggaaaggagaagcgggggaatt

SEQ ID NO: 29414 - DNA, 542 bp, Oryza sativa
tccccctatcacctgagctcaacgacagcaatgaatatcttcacgattcgctcgcataccaggccagaactgtctctgttcatcagtcatcaactacaaatgcaccaagtacacatactctgcctacatactgctgtgtgttcattcattgaacaatactgctcgtgattgtacagtctgcatcacctacaaatgccatcactaacaacacagcaagcacgagtaaatgggcttgctctctgcttctgttcagccttttatttaagaaagttgcaggctttaacaataacagtgtactacagtatagcagccggtttaattggctagctagacaagctaatacactaaggagtagtagcatgatcaatcgcagttcagtagccattgactgtactaagactaccaacaatggtcaattcacacactgatgactaatgcatgcatagttgcatactttttcattcagttttctagttagtacagtactagtataacaatactccctccctggtaccatgagcatgtggcacattctagtacta

SEQ ID NO: 29415 - DNA, 1501 bp, Oryza sativa
catgtcgtgatttgagattctcatggcgtacaagggaggtgtttgttgatggcactttgggaagtgggcgtttgtcgatggtacatataaagaagagtagatttcacaaaactcttttagtttattatgccaaaccatggtgatgtatgattaatgacatctatatactctaaactattcttccctgctaatttcaattaatactaattttcttgtcgtgttgagccacatcatcctgaatcattatggttattggatagttgttctgtgtctgagatttgcaaccagatcagaccagccgctccattcacatatcgagctcttatgtgttacttgccttatgtgcttgttgatgttgtttcagtattgctcactattatattatagaacatcctaaataacattcttaaattaagagttgtgcattaagctcaccattctacttggcatttgcacagtttcattgttttgcagacttaggggctattcaagcatcatttggtttccttcccaaccaaaacctgttctttcatggacctaatctgttgttttgtcttattctaacttgataccccaaaccacaaccaacatctcctctgatttaatcaatctgctgtctttgtaggaatgtattactgcaggcaaaggaaggcttcttctgaggtcaatgccaatgtgtttgtgcctgggggtcagaatggtatttcatttcctgcatcaaatagggctcatgattggggatatggcggtgttcgcgaagaatgggaagctagttatgctcgcaaactccagttgatcaattttctttcttcactgcatcaacgcactgcaaattctttgataaccactagaatggatgctaacatggacactcctttggagcaaaaacaaaaggacagctcagcaataatagttcttgattccgatgatgaggacgaagcagaaagatgtgaacagctcgcatctgagaacaataaacaacaggcaccatctggacccactagtccttgcacaacatggattgtatccagtgcgaaagaccaagtaaatggaaccttgcatgttgatggagtccaaagcactcaaattgttccatatggtcaaaatgcacctttaataaatcagtcccctttgcaaaccagctggcaaccatctatccaatatgaaagggttatattgcagagaagacctgaggagcaacgcgttcaagatcttgtggtatgtatctttcacttgaaatttttcaatggactatccacttctacatattggtacttttactccttccacatacctgcactgataaaccaatttattgcatcatgtcttgtgattgtactttgataaatctgaagagcgttatgatatttcttgtctggaatgtgagaatagaaatgtttggtgtttgttgaatctatactcttttgaagcttaaatatctcatatttgaactttaactcttgttgctcactgtaggcagcaagccatgcagagaagatag

SEQ ID NO: 29416 - DNA, 265 bp, Oryza sativa
atatatatatatatatatatatatatatgtatatatatatatataaccaaccatgcagcaaacagggccatgcaaaaaaaaaatggtgcaccgatctttagtcccggttggtaatataaaccgggactaaagatggatctttagtcccagttatttcacccgggactaaagatagctatctttagtcctaaattcgtagtcctggttggataaccgggactaaagggggttaccaaccgggactacagacggtttctccaccagt

SEQ ID NO: 29417 - DNA, 226 bp, Oryza sativa
tggggtagggtttggttttttccttcttatatatgctgattcccatgggctttttgggtctgcattcttgtaatgggctacatatcaagtatattatattaccctcggggccccacgggttacccgcgggtggaacttgtgccccatcccctcacccgcaaaatgcggggccctggccccaacagacccgtggggtagaaatgtcacccgtccctgcccccgtagg

SEQ ID NO: 29418 - DNA, 1248 bp, Oryza sativa
tgttggtatttcttagtaacactactggaaatataattcccagcaatagcattagaaataatcctggtatattatggttacaaatatgatccgcaaacgcacggatataccattgtagcatttcacccgggagtattcgaagatatcgtatttattttatcccaaggaaatatatgataaaagagtactatgctaatagtttatgtattacctgtatacattaaggtctatgcaggggtaagttaagcttaagggtagagtgacacacagccaaggattccgctaactcctccttatcctaaatatgaataagtggaaatagaatagaaatgtctcactcatgtacttctagtatacaacatcctagtctattctagctagtatactctatgtagtatattccctttaacaatgcagcatagctaagccggaactcagctattgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagataaaagcgagctaagcctgaagacttgactcctgcagcgggcgactccattccacaggcaatccttgacggcagcgacgaaaccaacctcttcgagacatcttcaactgggaaggacttcaactctggtgtgggggaaaagagagcaagactgagtactacccactgtactcagcaagtcacaccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacaccacgttgcaacaggcccaaaccaccacctgaactaaccagttccaaaagctaactagggtgaaactaatcacggtgaatctggtcgaccgcccataaccgcgggcacggctattcgaatagttttactctgatcagaagtgtacaactgtacccacaagacacagccccacgacacgttcccgtgcgccgacatgccaccacgacataccggaaagaggccgtgacaggacccttcgcataaccctctctaaccgatcgcaccacaccttagggttcgcccccgtccccagcaggcaacgggcagcccccctttcgtgccgcgg

SEQ ID NO: 29419 - DNA, 1501 bp, Oryza sativa
acggtattaaatatatagttttatgtatttttatgatacggtattaaatatatagttttatgataaatttaatgttaaatatataattttgcgatatatcattttcaatctatagtttctgatagtttaaatggagttcactaaaatttattaaaaaccatgagtaaattttataaaactacatatattttaaattttaaatttgtagattttaaattttaaaagtatactgtaaaatttattataaaccatgagtaaattttataaaactacaaacctacatatttaataacaaatttcgcaaaacaatagaattaaaataaagtataacaaaattcccttgtggtgaaaccagtctatccgggtttaagttttagacttaacatgggtgctcgtatttacagctaattatttttttagtggtaagtgatgtactcatcgacagcaagatgtctatggacttcatcaatctcaagatatactggtccagtcctccgaagatgcttatagaggtagggtatgtgtgtatgtgtttatagacgtgagtgtgtgtgcgttatgggcacctggatttatactacgcttctcaaaaaaataaattataacaaaattgcagatttagtaacaaaattattataaaactacaacattttataatttggagataaaattagtgctaagagtttcaactttgaaatctgtagttttgtaatagcacataattctatgatactccgcattaaatgttttgtgaaaaaaataatcttaattttatgatatgacgttttattctgtactatctccgtcccataataattgtatttctaagatttacatgtgtcacaaaataattatcataatagagtactaattgtctcataatcacttctcatttaaatttatttctattttacccttaattgtccttctattcttacctatacaccatttaatgaggggtatcgtaatctcaaatcttaatatatgctaatcaaaaccatatatcgaaaccatttattatgttaaatgtcgattactccctctggttctataataattgatgttttagataagattgaagtcaaacttttataactttgactatccataactttaaaagtatttagtttaaaaaacaagaacaacatatataaaagtatttagtttaaaagaacaagaataacatatatagatttgtctttcaaaacactaaacattcatttatttattacatatattataatagaaaaataaggtcaaatatatgttttttagatcgtgtgattatcaaaatattaattaaaataaaatcggagggagtattatagaacggagggggtggaagcccataaataggcaagcagtcaaccagatggtcggtattcaggcagcgaagcccccccaaagccgagctcgcgcgcggcggcgtcgtcgtcttcctcctcttccccccgagttggattcgtggccgcgcggcggatgggaggggaggagggaatgg

SEQ ID NO: 29420 - DNA, 858 bp, Oryza sativa
aatcaaacgttcataaaccaaagtaagcaaggctcgaatttagatgtcatatgtgccattgttgtattcttttcttaagggttcaaatttggaaacacgtacgttcaatgcatatgcgttgtttcgattttagttcaaattgcaggggaacaaaatgtgtgccaactgtcttcttggttgattatgttatgccactcttttcttggttgtgcatgaacaactaagcaattacttaaatcaaactatatgtgtcatgcttttgttgttatgtaattaatgagcaaatatattattttaattattcaattccaagcatcaaacctataaatgtccattcttaattcaaaatccagactcataaataatgatggaagacactattactttaacgagtagaatgcactgctctatgtagaaaccttaggtgtaatcaataaatcactaaacaatactaacacattgttttttttacacacaactaaactcccaattcatgttgaatagtccactaactttgtgtagaaaagtctaaaaatatagggaaataacaaaagtcaaatcccacatgaaagtaacgcacagagcaataaaactaaaacttgggtcaagcattgaagaatgagccaaaaaaaaggggaaaccgcccactttccctcttcccaaagccaagcgaaccatgctatttaatccactacactatttgtgagccttttacaactgtgctcccactccgctccactccactagttttttccattccctgtgtccccttttcagatctccctttccctctccaagaaaagaaaccatcaaagaatacgcaacgagataggggggagtggctactatcaatctcca

SEQ ID NO: 29421 - DNA, 357 bp, Oryza sativa
aaaaaacggaaggaaaaaaccgaagaaataccgaaaagatacaaagaaaaccgaaaaaaatcccacgcgcggcgcggcttctgccgccctcctcatccgcgcggacgtcggcgaattagcaatttcgggtatttttgctagtaattaataataggtatactatatatatataatctcctagggcttagggttttaccttaatttccttctccaactcgatcgatatatatatatatacacaccctaagccccggcctgcaacaaactacaccgatcgaccaggcgggcagcgagagatgatgcgcccctccggcctcctcatcagcggcggctccgtagtcgtgcggccggcaacca

SEQ ID NO: 29422 - DNA, 336 bp, Oryza sativa
cactactcgcggccatgacgcaatctcacgtggcaatgtcacggaagaattctgagagaaattgaatcgacgaacggtgtacatgcatgtacaagttgtacagatgtgtgctgcttgctaccggtgtgacggggtagttttacaggagcagcagcaaagccagaagaatcaggtggcgtcttgagcggcgggcgcgacggccggggaagggaaatcgttggcgcggctgtgtggctccgattgacggcgacgacggtcgatgggccgacgtggatgggcggcgacctcgtcgccgtagcgcaccacctcccatgccctcctcggcactgcccacca

SEQ ID NO: 29423 - DNA, 1501 bp, Oryza sativa
caccatttgactctttgattctctcctcctcttgcacacaattagcgatgagcttttcaaagttccatttctctggacttatgttgtagttgacaataaaattgtcaaactgctttggcaatgaggccataaccaaatggaccaagaagtcatctgttaagcccaaatccattggcttcaacttggaagccatattgctcatcctaagaatgtggtctctaacaccacctccatggtacctctctgtcacaagctgctttatcagctatgtagcataagtctttgaagagccagtaaactgactctttattcttttgaggtactctgagacagcgtcacactctgggattgagcccaatatggttggctcaatcgtgttctttaccacagccaaacatttcttgttggctaagaaccatttcttatgttcaatgtcatacgacatgatgagaagagcattgtccctctgtctcttttcccagtcagcatctgactcattttcacctctgacaagtgcagcaggttctataggacatgggatagtcaacacccagtccacctctcccaagataaaagcaaggtcgagtttttcttttctattctgcgtagttatctcctttcagggtcggaatatctttaatgcaacccatcaaggagtagccacctgaaataatcatgtactatgagaacaaaattaacattaaagtagtatgcattaagcctacatcaccgttgggcagaattagacatcacacatagccataactataacattgcaattatcaacgttggtcagaaaattacaacatcatagcacataattaatgttcctaaaattaaattctcccgttggttcgaaatttaattttagaaacactaattttcatcaatttcatctatttgcagtggaaaaactatataaaattcatatgaacagtagcaaaagtatgttatttattctctgtaaaagttctcccgttggttcaaatttaaacagaggtaaaacatgcaaaaatctattcaaaattctattgaaatttgcatgaaaaattgacaaaataaaaaaaattgctattgtcctcttttcatcattttcggcccccgagggacctaatttgaacttttgccggcgcgcccccctccccttccccaaggccgcaacctgggcttggacctggaaagccgcctcccgcgcgcgccctcttgggccatattcggcccggccgccgccggccgtccgatcggctagggtttaggtcggacggccgggcgccgagatcggagggacaaaacttcgaccccagccgccggccggccgaaccctagctagcctctcttctcttctctctcgcacgaccacacagagcggcgtcgtcgtcgccggcaaccttcgcgccgccgcgccatggccggcgtgcttttctcttctcttctcttctccccccaccgtctctcgccctccacccgcgtgaagtgagagagagaacggcgacaacggaga

SEQ ID NO: 29424 - DNA, 1490 bp, Oryza sativa
tcatgttagatggatctccctccgcttgagcccaacggctcaagggggccttgacccgcgccctgatcgggggtgcccaacccaatagctggtgggcccccgtcacactgtgccatataaaaggggtggaggccgaggcggcacatggtacgaggtttgtcaccaccgccactctaccgcacaaaccctaaccgatcgagagggggcgtagccagtgacgagaaacgtcgccgccgtccacgtcaagcccgcgaccgacaacgacgatggccggcgcttcttcatcctccgacacctcaacttgtcgattcctctaaacccttctcccttatgttctattgttcaaacacccaaatagagccaacccgactagatctaacctaggttatcctagagcaaagtctaacaatggtattagagcaacctagccaattagatcggttcggggaaagaaatccaaagaaagaaaagcacaagatccgcacggatcaaaagaaccgaaaaccctaaccctaattcttacctcatcgtcgttcgtcgtcgacgccagcaacggaggggggaggggcacagggcaccgtcgaggagcccctccacggtcgtgcacgcgcgtgccggcgagggggcccgcggcggcgccgccatctccgttgtcgccgttctctctctcacttcacgcgggtggagggcgagagacggtggggggagaagagaagagaagagaaaagcacgccggccatggcgcggcggcgcgaaggttgccggcgacgacgacgccgctctgtgtggtcgtgcgagagagaagagaagagaggctagctagggttcggccggccggcggctggggtcgaagttttgtccctccgatctcggcgcccggccgtccgacctaaaccctagccgatcggacggccggcggcggccgggccgaatatggcccaagagggcgcgcgcgggaggcggctttccaggtccaagcccaggttgcggccttggggaaggggaggggggcgcgccggcaaaagttcaaattaggtccctcgggggccgaaaatgatgaaaagaggacaatagcaattttttttattttgtcaatttttcatgcaaatttcaatagaattttgaatagatttttgcatgttttacctctgtttaaatttgaaccaacgggagaacttttacagagaataaataacatacttttgctactgttcatatgaattttatatagtttttccactgcaaatagatgaaattgatgaaaattagtgtttctaaaattaaatttcgaaccaacgggagaatttaattttaggaacattaattatgtgctatgatgttgtaattttctgaccaacgttgataattgcaatgttatagttatggctatgtgtgatgtctaattctgcccaacggtgatgtaggcttaatgcatactactttaatgttaattttgttctcatagtacatgattatttcaggtggctact

SEQ ID NO: 29425 - DNA, 164 bp, Oryza sativa
ctgtgggtgcatggttttgctggtcgcacccatggcagttaaggaccggttcgcgggatgccctggaagaacttatcgtacttaccacaagccagcgtgggcaacggctgggcttgtagcgtagcttttctctagccgacgcatccaggcaagggtgggcgtga

SEQ ID NO: 29426 - DNA, 1501 bp, Oryza sativa
cggcgcacggaaacgtgtcgtggggctgtgtcttgtgggtacagttgtacacctctgatcagagtaaaactattcgaatagccgtgaccgcggttatgggcggtcgaccagattcaccgtgattagtctcaccctagtgtaatcttttgaatttggatagtttaggtggatggttgggcctgttgcaacgtgggatagcgttggacagtggatagttaatactaattaattattacaactgtttaatctttcaacttctgtttataaatgctcgctttatgcaaatgaaccactttagctcttctttgatgattccctgcatcatgcctctattccggtatgacttgctgagtacagtgggtagtactcagtcttgctctatttttcccaaccctagagtacgagtatgtgtcagatgaaggtttctccgaggagtaagcttagtccgtgccgtcgaggatgcctgtggagtggtgttcccgctgtagttctagtcaaggcttagctcctgttgtctctctttctttccgctgcatttatgtaagacttttatgatgtttgtaagacgtggatctgaatgtcgacattgtcgtttgtgtaccccggccggtcctggacggggatttcaatgcacattctgcttggaattctattcgggaaattctgggcgtgacagccggtgtgagcccgggtgcacccggtccaccgtggaccgtgaggctgccgcgtgggccctactcccgtggacccggtccgcgcgccccctcccctcggctgacacaataaacccttttaaaattaaaatttaaatgaagaaattcgcaaatattcatttaaagagcatataaactttaaatgaccataagttggccatttgaactcggaattggaccgttcaagtctctaatttttccttaagaagtcaagaacccatttttgtgctttgttccagcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcctagtttataaaattattttgatttaacttattgcattatcgctttatttaaattcccgcgttatcattgttttatctagccatgcttatgtacctttgttatgaccttattattgttattgttattatttccttgttcaccctagaataaacaaaaccccaactagtggacactctactcatggtaccactagtataattttagttagatgcttcgctggttaattaggtaacattaggtggtttacaactctagactttgggaatactcttatcacctggacactatggaattgttggactattgtggaattggattcacacctcctcctctattcaaaatcctcaaaatggttttaggctgggctcggggtgcatggttttgatagtagcac

SEQ ID NO: 29427 - DNA, 1501 bp, Oryza sativa
aggttttgttgaagacacgataggcatgtgcatttgattcatagccaagtaagaatccctcatccaccttaggtgagaacttagatgagcgaggcctcttacttaaaataaaacatttgctcccaatgacacgaaaatatgaaacattaggcttcttaccactcaagagctcatatgaagttttttttaggatcttgtggaggtacaagcggttgatggcatgacatgtggtacttacggcctccgcccaaaagacatccgaagtcttgtactcatcaagcattgcccttgcggcttcaataagggttcggttcttcctctcaacaatgccgttttggggaggatcatagggggcggagaactcgtgcttgattccttcttcatcaagaaattcctccacttgagtgttcttgaattctcctccattgtcacttcgcaccctcttgatagtgagatcatagaggttttgggcttgctttgcgaagcgcttgaagacatcttgagcttctcttttgtcatggagaaagtacacccaagtgaagcgtgaaaaatcatcaacaatgacgaaaccatacttgttacctccaatgcttatgtaggccacgggcccaaataaatccacatgaagaagctcgagtggtcttgttgtagtcatgatgttttttataggatgtggactgccaacttgcttcccggcttggcaagcactacacacacgatcgagacccattacctttcctttaccatcatgtccaaagacaatattttcacgacttccaccctcctcattaagacttgtaaacatactcctctctcccatcatatgattggtgcagccactgtccacaacccaacttgagccactggaggagtatgcctacaaaagaaatcaagcttgggatttaggaacccaaacttgtctaagtttgggtcccttgatgttagtcaccaaagcctttggcacccacacacaagtacggtactcatcattgtaattcccattgaaataagcaaccactttgccctctgaatttttgaaaattacatatgaatcatagtaaagaccctctagccagaacttcctgccattatacccggaacttccggttagtccgttcggcctatcagaagcccggaacttcctgacaaaatgtccggaacttcctgtcttacagggcaggaacttccggtcattttgctcggaacttccgggtgtctgaccagtgaggggacaagtcacctcacttgcttgtggagcttttccttctctcacaaacatcaagcattctttcccatttaccatcacacgcttagacacatgacttccaccagaaaacccgagcccatgtccatccttgttaggatgagcggtgatggtcttgtaaagggcatcttttgaatgatatgtcttcacgcatccatatttcaccaatgtgcccaattgtcacgaccggaaataacccaacgggcgttccttacgtgcgtgcattatttcttgtcc

SEQ ID NO: 29428 - DNA, 1501 bp, Oryza sativa
cggcccggtagtcgagatgtcatggcacagggctggtgtcctgctgctaggggctcaatcctgcctacctgtctcggaggttccggccgtaggtggggttgggtcggtactcttgtctatggctaggatgggttggaaactatgtcatgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaataactaaaatgtggaatggttggcctgggttggcttgggacgagctgggacccagggttgggttgccagttcggtctggatcatcgtaggccttgggttaaggcaggttcgtgagggttcacggccttgattaataatactgtgtagctctaggatcgtctttataaaatggctttgggcaactaagtgacttttaaatgctgttttctgcataacttaacccctatatcattaccccttgtacccccttgcattagtcgtgcatctgccggtgtggcttgctgagtactgtggttgtactcattcttgctctatctttctccccccttcagtaagagatgctttggagaagaagtcttaggtggagtcttggcttataccccagttgagcgcctgtgaagatggagccgtaggcccgctagtccgctgctttttatttttgattgtcaggccttaagtgcctttgtaataatgtaaatattatcgatataataaagatgtgtcttttatatcatgtttgtatggtgtaccctggcttttcctgggacggggattaatacactagcgttcgggaaaatgcaattttctcggtcgcgacaagctggtatcagagccatctcgactgtaggataagccaagtggataaaacctaaggacatattttataaataaaactatttgcgaaagttcctctttttcttcttcccctaatgctatttgcaaaaggtttacccttttcttccttcttcaaatttcaactagtactagatggtcaggtcagtgaagaagaagacatcgtcagttgttcgccgaagctccggaagactgcaggatccgctagcgaagtggaggaagcagtgaagccagctgtgaaggagtgaagatcttggagaacccgtcgcagaacctaagccaccctatagggtagtgttgttagtcgtgtgttccttgcttgtgtgtgtagcgcgtggtttgcatcggtgggttgtgatgtaaccatgctaggttgtttgcttaatcaacttgcagaataagtgaaacaaacaacatatcaacaagaagagttagttcctttaaggtcttgtccctagttctggtccattctttccttgtctgcttcccctctcaacctctaccttgtgacagatggataacactggtaacaaaggct

SEQ ID NO: 29429 - DNA, 1501 bp, Oryza sativa
ttcatcctcgccggctcgccgtctcgcggcgccgcctccgtcgtcggcatcgcagcggtgtgttccacgccatcctcgcctccgtgcagccgctgccggctgccctcgtcgtctcctcgctggccccggtcgtcgtcgtcgtcgtcctctcgtcgttcccggtcgttgtggcgttcgtccctccgtcaagccgttctcgtctgccgcccgcgtttcgtcaagtgtgcagcagccccgtcgtcgtcttcgtcctcgcctccgcgtcgtcaagcctcgtgccggccgtgtctcgccttcgtcccaggatcgctgccgaagtcgttccctcgccgtccgccgcgcccgttcgtcgttgtcgttcccacgcctcgtcgcgtggtggtaaggatccgtcctctcgctgccccgtcctcgtccttttggtgtcgccccgtacccgttgtgcggtcgtcgaccccggtacccgtgtaccggtgtcggtagtcgttcacgtgtgcgggtggtgaccgtgtagtgtccgtgttagtgtgttcgctcggtagccgcgtggtttccacgtgtgcagcccgcgtggtgtctagtggagtccgtttgtcggctactcgcctcggttgacacacggggtccgcttccgtcgacccgtggaccgtctctgtgtacctggtctaccgcggtcctttaggttgacatgtcgggtccgcatgtcaacagcgcagccttcctgtcttttccaggctagcgcttccacatgttttattgttgcaaagcttaattataataatccgcaaatctccatataacagcactaaacttcggatgatcatatcttggtcatacgaactccgaatcgacccgttcaagtctcttaatgtttgttataacctaaagaaccctgtgctttctttttatgtattgttattgcttctttataggcttgtagctttgcttgtgtgcttcgcgtagtcttcgtcgttccggaggttcccgaagcgtggttttcggtcgtcgccgaaggttcggaaggccgttctctctgagcaaggcaagtcacatcatccttgaacatattgaatcccaatttataaaattattttgatttaaattattgcattatcgctttatttaaattcccgcgttatcactgttttatttagccatgcctatttacctttgttatgaccttattattattgctattgttattattaccttgttcaccctaggaaaacaaaaccccaactagtgggtactctattcatggttccactagtatgaatttaggtagatgcttcgctgattaaataggacaacattaggtggtttttataactttagactttgggaattctcatatcatttggatactatggaatggttggcttatggtggaattggacatacacctctcttcctctttcaaaacccctaaaacctgttttccggtggggtttgggtgcatgccagttgtgggaagtagcaccctggccactataaggattaa

SEQ ID NO: 29430 - DNA, 312 bp, Oryza sativa
agatagaatcatcgtgtttcacgctgggcaccaaagaacagttcgtctaatcaatcaaaagcaataaagctagcgcactaggattacacatgtggattcacagtgaaactttgcagcatgcatggtcccgtgtaaaagttgattgattattgtactatgctaatgggtggacactgtgattagggactgaattatgcagagtaaactccacgttagtaatccattaattccccctctccctttaaaacctgccccttgcattctgttgatgagcacctgcgcctcaccttgtctagttagcaatggcggctg

SEQ ID NO: 29431 - DNA, 1501 bp, Oryza sativa
gagtccctggaagatgaaggctttggtgtctagctcgtgcctgccgtcaagcgcctgtggtcgtcgccctagtcttccgctgtttctcgtttgtctttgtgtgtgccgggccttcgctgcccatgtaataaattatctatttacgcttccgcttgttaaactctgaattgtatcaacttttggtgtaccttgcctcctgggacaaggaataatacacgcacgtaaggaacgcccgttgggttatttccggtcgtgacaagttggtatcagagcccccttgaccctaggacgagccttagatcccaagccttagcaatattttcaaaaataaaaatcctgtcttaattgtgaaaaccctctagtctctctctgtcctgctgcttcatttatcgccaaaatctgacttttaaatgttgcttttctttttgtttttgtttgtagatggccggcagcatcagccgtcgtggtctggacctgactggtttcgtcttggagctgtggggcatgtgagttgtcctggggtatccgcatagagtggactaccagggcaggccgctcccggagcaggagggtgacgatgcagagccccacgctgcttgggaggttactgcagtgatcctcactagctcacccgagaggacttcgttggcagtcaccgcgggtggagattctttctccgccgcttgccagaacgccgctctcctcgccatcggcactcttcaccagcgctacccggacgagttgcagcactcgccctaccgctaccaccctcgccacggaggagcccgcgacttcgccaccttccgggatgctagctcggaggatgacgctaccatcatgcacctggcgcgcatggtggaggcgtacgacgcgacttgtatcgacttccatcagatggtgcgccgtgggatggtcgagaacaacatgaagatcctggagccgcgtcaggagaatctgcagctgaagaaggacctagacgcagtggaggcgcagctgcatcagctcaagatcgcccagggagaggtctgtcgccccaagcgtcgccgcgtctgccgcagccagaagatcaccgcccgcaagagcacctccaggcccgagcttgttcgtcagtccctggcgtggacttgcttcgttcagacccctcgtgccgagcccgcgcccgtggttcctcaggagggggaagcctccggcgttggtagcacggaggatgcgctgttgctcaccttccgtcctggcccgtcgcagcggtagacgagcagttagtaggcttgcgcgtgtgttctttctcgtttgtcttcttgttggagtcgtgtggggcatggttatgccggtgtgtggcataactgtgtcggagcctgtctttattttatttgcttaagcaatttgaactttaattaaccaatttaatagcagtaataaattcaagaattatggtagtcgtggatggttagctttaattgtcagctctctctgtttgctggttctgtgtggggtttttaga

SEQ ID NO: 29432 - DNA, 718 bp, Oryza sativa
ttgccggttcggtctgaatcatcgtaggccttgggttaaggcaggttcgtgtgggttcacggccttgataaataatattgtataattctagaatcgtgattacaaaatagctttgagcaactaagtgtcttttaacgctgtttactgcaaaccctaaccctttatattataactcccttgtactcccttgcatttattctgcacttgtgggtgtgtcttgttgagtacggtggttgtactcagtcttgctcaatttttcccaaacccagaagaggagtccctggaagatgaaggctttggtgtctagctcgtgcctgccgtcaagcgcctgtggtcgtcgccctagtcttccgctgtttctcgtttgtctttgtgtgtgccgggccttcgctgcccatgtaataaattatctatttacgcttccgcttgttaaactctgaattgtatcaacttttggtgtaccttgcctcctgggacaaggaataatacacgcacgtaaggaacgcccgttgggttatttccggtcgtgacaagttggtatcagagcccccttgaccctaggacgagccttagatcccaagccttagcaatattttcaaaaataaaaatcctgtcttaattgtgaaaaccctctagtctctctctgtcctgctgcttcatttatcgccaaaatctgacttttaaatgttgcttttctttttgtttttgtttgtagatg

SEQ ID NO: 29433 - DNA, 554 bp, Oryza sativa
ggtgtactggtaaattctataaatttaatttttaacttttaactttataccaaaaccaaaacatcccacattctaaagcggggatttccgtgtgattcacccgtcactaaacgccaaatattaccccttgaccgttgatggagtagttgagcttgatgaccctagcagcttaccagtattttctttttatctttggactacttaaaaactctacttccttcgtctcaaaatatagctacctagtactgaatgtaacatcatcacctagtactatgaatttggacgtgatgtcacataccgtactagatagctatatttttggccggagttagtactacactagtagtgcctagaattaagctctatgactatgagtgacatgagcacaagcatatgtactctatagcatattttctttgtcccaaaataagtttctcaatgcaactatttttcattttatctactctcattgtattttttttattttctaaaaataaacttattttgaaataaataaaataggttaataataataatctaattttaatttaaga

SEQ ID NO: 29434 - DNA, 1501 bp, Oryza sativa
aaaagtataattgatgcattcaattaagacaacttgcatatagtgttgtagatctggatgagtaacatattttgaatactagccatcctgtacatggtcacatatcactacctacaaatccacttttttttttgcaatatatacatgcatgtgtattatgagttttaaacttaagacctccacctccccaaagagcacctttaccaactcacctactcaacacatattgattactcattcaatattattattttgtctatgcatgttcgaatcatttaatatatatttaatactctaaataacttcaaatgaaaacattatcaactaaagaattatagatctcattgtgttataaaactattgcatagagaatatctccattcgatgtcatttgaataattcaaaatttcatttttcaaaatagatctcaccttaaactatctcaaatgaaaatattgtcaattatagttttgtagatctagttgagctcaatgactttgatgtggggcatgtttccatcaggtcatttgaaaaaactcaaaatttcttttttataagtagatctcatcacttgtaatgcatatacagggatttcaatgatttaaaatggaaatgatgttagttataaagttgtatatatcattgagagcaacaacttttatacaaggcatgtcccaaatccgagatttttttttgcaaaatttaaaattttgaattttcccttatcagtgatgggtcataattggcacccgttatctgtgatatatggtgttaaagacccgtcagagatgagtggtctcatttatgatgatatttgtgacgagccatagttgtgatctgacaggttataactaccatccgtcacagatgacctcacatctatgatgggcccttcccattagtcatatcttaaactagttatttttcggtccgttagagacaattcatttctaaaaagtcatgttgacccattacggatgacccatcactgatgtccggatatgtagtagtgcatgcgttgttccattaaaaatatctagcaagataattaagggagtataaatgtttaaaaaaaagggagtacaagtgttttttatcgaaagtagaactcataacgaaaaggtaacgttatttgtaatgggaataataatagtatagtagaatactactgtttattaggcataactactcctgacaaacacttgatagtttctaatccaaacataaaattgaattagacgttgataggaagaagcatttgacgtattctagtcttcatgacttgcaagggtgcgcagttgcacgaacacgtaccaagcaccgatgacagagtccacacatactcaaattcggatactcgtaaatattgaatttagggcgtactttgtaggtgcgcgagtgtgttgtactccctccgttcgtaaaatataaatatttttagattttgacataatcttcgaaatatatatatatatatatatatatatatatatatatagga

SEQ ID NO: 29435 - DNA, 1170 bp, Oryza sativa
cctttttaactttgtttatttcttcttaattattatttgtgctctgaaaattccactaaaatttatttacgcattttaggcttttaggaaatatacaaaaatcctccaagccttatttgacttttaactttgcacattttaattgtggaggctttcacacggattttaattattctcggcataatttagaggatgtattttagggtcgttttgggacgcgacatcggccatcatacatcggcaaaacacaaccaattaagataataaaaactgctaagggcaatataacttatatcggccatctctaggcggtgtcaacacatcagctaacatgtatcggcagcatccagccgatcatgaattgacccaaacacttgggtaatatttcttcagatattttccattaagcgctcgttcataaatgtcgcgtcccaaaacgactctaaaatacatcctcgaaattgtgcaaagaataattaaaattcatgtgaaagcctccaacaattaaaatgtgcaaatataaaagtcaaataaggcttggaggatttttgtatatttcctaaaagcctaaaatgcgtaaataaattttagtggaattttcagagcacaaataataattgagaagaaataaacaaagttaaaaaggtttataaaaagaaaaaccctaaaagaagtcttctttcccccccttcccttcttgggccggctcggcccaacttcctccctccctctcctctcccccgcggcccatcggccttcccccgcgcgcgcgccgctgatgggcgggcccgcccgccaccctcgctgacgggtggggcccacctgtcatcccctacctcgcgccgcgcccgccgcccgcccgtgccctagcgccgccgccaccgccgaatccgccgcatcccgccgtccccgcgcgccataaagagggggaaatcactccccgtgattccctccctcttttcccccacttttccctctctctctacctcggattcgtccggatttgctcccgcaatcctcgccggcgccatcaatggcggccggatcttccgcggccgattccccctcgtccggccgctctctccccctcccaaccctatataaaccctccccgtgcctccctccaccgtttccgccactcgccgctctttctccccgccggaatcgagc

SEQ ID NO: 29436 - DNA, 182 bp, Oryza sativa
tgaaaaaaaatcgccgaaagctttacatattttctttaattaggtatatgatatagaccatttgctataagtatattggtatggatgcatgctttgatacgtccaaaagtgcgacggaaattaaaaggaaaaatataaagcataccatgggacccaccatatgctggatgcaccacaaaaat

SEQ ID NO: 29437 - DNA, 1501 bp, Oryza sativa; identical to SEQ ID NO: 23862

SEQ ID NO: 29438 - DNA, 1328 bp, Oryza sativa
cactacgccacctgtcatttgacttctttttaacaggcatggtgggatccatggaaatcactttggagtgatgagagtagacttagtaaagaagtgtctattattgccaacataaatggctatgtcaatgcctataaataatgctcttggtaattaccatctatatcatataatataagggatactaggattttaggagcaactaaggaggaaggaaaagtactatgatatccgtaataagattgggtaaggtggttggaataagattgggtaataaacaatatatgtttgtagatgtgacatgtggtactcaacccttaacatcttgagacaaaaatttggattctcgaatttgttgcgcaggagggaatcgaaataaatataagtctatctttagtgacattaagggcccctttgaatcgtaggattgaaaaaacggaggaataggaaaaacacaggattttggtaggaatgcaagtgtaaaaacagaggattgcaaaacacaggaaaaatataggaatgaccgtttgattagaccacaggaaaaatgcaggaattagatgagagagatagactctgggaaagttttccaagaggttagagtggatgttaaatttcctacgtttttgctctagaattgtaggaataggaaagtttcctacgtttttctttttctcattcctacgaatcaaaggcatgaatagtgtaggatttcaattcctttgtttttcctccaattcaaagggggcctaagtagtcttactagccatattttgaatagaaaaatcttcaattaatatatcctaaaatccataaggacatatataatatacaaagaaaaaaatgttagtttagaaactaaaaatatcaaggtatgccaaatattcaaaaaaaaaaagaaaaacacacgagaatgcaagcaggcaagcacgaatagaggaaggcaaagcagctgtgctgtagcaatgagaaaacatgcatgcagcacatgctctttaatggcttataagtaggctaagtttagaacgtcaagaactggcaactttaatgtcaaagcctaagacgtcaataattttaaaactcaagggagtaggttattacgacacaatattttctcataaattaaaaaccaaaaagttccatgtaattttagtttataatttatatgccgcaaggataattaggaaaaataattcattgacaaaaaaaacatgtttagaatagagtagaaaacatttcaataaaaaggttacccataaaacattcataagaaaatttcaaacccattaaataagtgcccgcgcatgtgcgcgggtttccttcctagc

SEQ ID NO: 29439 - DNA, 480 bp, Oryza sativa
tcattgtaccatgaaccagccatggtgattgacctgttatgcattctttgagaatattataagaatttggtatatgcttgagtgttgagtgccttcaaaagctctacatatctatagattattacgaactaacactttcttgtgagtttcttttgcttgctaaccatgtcaggtacaagttccgatgaaccaacactggagaatctagcgcataaactgaagggcatggaaaattggtatgaagagttgatgcgtaatagtaaatcatacaaggaaagcacagataaacatttaaaaaccttaagtgaaaacctagtgaaagtagtggatcaaattgagcaaatgaatcaatcgcataaacaattaactgaaaacatccagaatatgaatattggacatgaaaatattgtgcgatgcattggtttacttgagactgcaggtgaagaaggtgcaggtgccactgctcatcgacaccaaaga

SEQ ID NO: 29440 - DNA, 1501 bp, Oryza sativa
aatcatcacagagaagacaaaggcgattttttcccgaagttcgaatcttgcaatcctactctccgttgaggtgctccaaagagctgggtctcgattaacctcttgcctcacccgtgcaaagaacctcgaagaagtccgaggccttcaactcaacatttctaggtcattttctagaatttgagtgaccaccaagatctaactcacaaatccttctagaaaagaccacaagtgcaagttgctctacctaggagaacctctgaaatctcagcacaagaatctttactcacttacctcgtttccttgcggaggtaaggaaaaccttcacaaactttctcgagacatccacatgatctttggaagctctcaggtggcacctaaccgtttaggagaagatctccaagagtaataagcccaagtaacagcccacaagatatccaagtgctcaaacacacctagtcttcaaaccttctccaaatcactcctacactctcatctattctctcaatctcacaagaatggctctagatttgagtggaggaagcaaagggatcttgggagagtctagaacaacctagggcatgaaagaactgaagtgaaaatggccaaaaggtgcgatctggatatatataacggctaggtgacgacatctagccgttactcacatttttgaactggaagaggtccggaagttcctgacattcggaacttccagacaacacttaggaaaatttcacatgtcgcaaggttcggaagttccgggtccagggaccggaacttccggccagccttctctatccggtctggacccatttgcaaaaatggctcccaaaaatattctaccacaaggaacccactaagagcactttttatatctcagaacaacacttggaacccctcttaatagtacggtttttcctaaaactcgatttcaaaaattaaactatcctattgaccttggagcttcaaatccgctttgaatgaatgttgtaggggtctccaagcatcttttgatgtcctaagttcaccttgggagggactaattacctgaatatctcaataaacacattagtcccttaaccttatttatcattaatcaccaaaatccactagggagataaatgcaactttagtgctgacccttggccgtgtcggcggtcgctgtgccgagccctgcgcagagtggctgggacagcgccatcaccaggccgtgcatggcgtgtgcccatgctcaggtctgccggaaggctcgggatgcgtggccttcggcccaaccgccgcgtcggcgaggccgcaggggggaggtctcacatgacgcggccccgcggcggggccgtacaaggccgtgcttgtccggcggagctcggcggaaccgcacggggccgtggcagcgccgccctggaccttgctgcgagtggagcactctttataatttactatatatatatatatatatatatatatatatatatatatatatatatatatatatatatatatatat

SEQ ID NO: 29441 - DNA, 1501 bp, Oryza sativa
tagtagccgcgccgttgttcagcggcggcgcacaaggacgaagcctccgcgaagcagtctaagcacgacacggaagcggcgtcgtggggcctgacgctgtttcgccatggccgaagcatggaacagcggcggcgcgacgaggccgagtccacgcggagcattgtcggcgcctcaaggcccaccacgcgaggccgaagcgcggcgcggcgctagctcccggcgccgttgggtggagccggcaaggagccacggcctatcgcgcatcagcggggtcacaaggtcgaagccggagctcgatgtggaggcatgccccgcgccggaggccagccgaagttgaacgcacgggttgatgtgcatgagcgtacgtagttttttttttttttgagtggctccgaattcagcctaccacgggctccgaacgcagagcctaccgtagagaggctcggaatttggagcaacttgcggagccttagccgaggcttagaattgcaaacctacacagcttaagactgcaatatatatatatatatatatatatatatatatatatatatatatctcaattgctaacctatcttttttaaagtcgcggagaactactccgtccggccggaaccaggacggtctcgacgctgacttcgccacggagggtacttcactgggtctcttggacgcggaggtctcacattacttggccaagaaaattgcttcgcagaccggagaccgtatgaatctcatcatgacatttttcctttttgttttgaagagtcgcagagaactactccgtccggccggagccaggatggtctcaacactaactccgccatggagattgcttcaccggtctcttggacgcggaggtctcgcatgacttggccaaggaaattgcttcgcgggcaaaggctgcgtgaatctcatcatgaccttttttccttttgctttgaagagttgcggagaactactccgtccggccagagcctagacggtctcgacgctaactctgccacggagattgcttcactggtctcttggacgcggaggtctcgcatgacttagccaaggaaattgcttcgcggggcaaaggctgcgtgaatctcatcataacctttttttctttttgttttgaagagtcgtggagaactactccgtccggctggagccaagatggtctcaacgctgactccggcacggagattgcttcacaggtctcttggacgcggaggtctcacatgacttggccaaggaaattggttcgcggaccagaggccacgtgaatctcatcatgacctttttttccttttgttttcaagagtcatggtgaactactccatccggccggagctaggacggtctcaacactgactccgccgcggagattgcttcatcagtctcttggacgtggaggtctcacatgtgatttgaaatgtaattgcatgatattgtacctactattgcccgaggcagggcaacagcggtggtgcgagccgatcttgagcgcgta

SEQ ID NO: 29442 - DNA, 1079 bp, Oryza sativa
ggaagggctcgagcctgaagcggctggatccgcctaccaatgaaatcggcagcaacttcataccccgacaacccccgttctcggaggtcgtcaacgatatcgatgaaagattggagggacggggtcaaggcaggtttggtggtccaagatggaaccttgtctggctgctcctcaggaacaacgaaggcaggatccgaatcctctacctgaagatagaaccacctcccccgccatttgctgcgagatgaggggcactgaaaggggatgtatcgtgacttcaggccatcccgaagtcggaaaccaacacacccggacacctttttggattccatccagcgtaactcatagtaaaagcggaagaggtcaagaaacggctctaccccaatgtaggcctcacaaaggtgaaaaatactcaggaaggcgatggagttggggttcaaatggagcaaggaaagaccatagaaatttaagaccaaaaggagaaattcagaaggcggaggaagaaaaccgcagagaataaagtcctcaaccgcaaccatgcgacccaggacaggctggggttcagtacctcctacttccctctccgcggtcccgcgactgggaagggcgccatcctcctgcagtttcttcagtgacacactggtggaggtagacttgtcaagatccatggccaccggagatcgccggagaaaggaccgagatgagttggctagggtttttgcgggagcgaagaagacgagggacgcttggaagctggagagttttttcaacgggcagacctcaaattggatccccaaaactcccttaaatagacgcacctccgccggtgcgaatttctgggtccgttacgcgtggcagtttttcggacttcaatttaaattcactcatgaccgttgaacttcactcgatgttgtcgatcactccttgtctctccgtcctcacaccgagaacaacgacaatttcgacatgtgaagtcgcgatcagtttcaccagttcatttaagcagaagtcggggggctactgtcagggttacgagtaaggtataccctctacccttcgatatacgtcacatatcgata

SEQ ID NO: 29443 - DNA, 1388 bp, Oryza sativa
acatcacgagttggagaggtacgctgaattccacgctctttgcaggcacgaatttcagcatggacgttgagaaagacccagcaggcttgcagggtgtgtttcctggttttgtggataggacaccaggaccttgtcacctcggaagtaatcctcgtcggctcgtgattcctgtcggaaagacaaggcttggccgcactaggatccttctcgggctcggatgttgtcgacgttcctatctccgcttcggcgggaggatccttcgacatggagtcgccctgggttgtagccactgcattctcgtttccggccattggcggaccagctgagatcggcactgtggtgtaaaccggaaagacgatttcgccgacctgagtccacaccagtgttgttgaagtaggaactccttggttgaggttggtgttgacactgttgtcgacaaagctggatgtcatagtagtagaaccttgagcaccaagtccacctacctggcacgccactgtcgacggggaatacccgtagaccggatatagagggtattggggtacgctggtacgaggatctacgtagtacgacatcaagcaaacaggaaacagagattatactggttcaggccccttggtaggtaagagccctaatccagttgatatgggattatatgatggaaaccacagattacaaagggaacagtggaactcgacgataccgacaagatcgtagtcgagttgatccgactagatctcccagcgacttggctccgataagcttcggcttcgtaggctgtggtggagttggctctgagattcgatgctttaggtcctcccgggggtcccttttatatcgcaggtcacctgtctcccagttggactcggagaaaccggaccgaacacgacacaatgacgacccagttctgaccgagtaggactccttccatctgtgaaatccatgatgaatttccttaacgtatgccgaaaacatccgtatatgcgtgaacataccatatcgatatgtgacgtatatcgaagggtagagggtataccttactcgtaaccctgacagtagccccccgacttctgcttaaatgaactggtgaaactgatcgcgacttcacatgtcgaaattgtcgttgttctcggtgtgaggacggagagacaaggagtgatcgacaacatcgagtgaagttcaacggtcatgagtgaatttaaattgaagtccgaaaaactgccacgcgtaacggacccagaaattcgcaccggcggaggtgcgtctatttaagggagttttggggatccaatttgaggtctgcccgttgaaaaaactctccagcttccaagcgtccctcgtcttcttcgctcccgcaaaaaccctagccaactcatctcggtcctttc

SEQ ID NO: 29444 - DNA, 201 bp, Oryza sativa
gagatctgctcagcatggaaacgactaagtcaagctgctcttctctcccgagaacacaacaaatcaagtcgatccagacggaagggcaaaggaaatggtaacaaaggacaacaaagtactcaagatcaaaatgctaaataaagctaaggcaatgaccgcacacactagggcggttgagaccaataaaagttttacaaagca

SEQ ID NO: 29445 - DNA, 289 bp, Oryza sativa
tttttgtcccaaaatgtaatttaattaaaatttcaaaatctataaacatgcaacaatattttgggaccctaaacagttttaattcaaaaacttttcaactataaagttgtcggtcgcgtcgagggctacaattttgatataaagtttattttcattagagttcacataaaaaagttatgaattattttttgatataaagtttttagaccgtcctgtttagggaccggggtgacacaactgaacaagttggaggacctaaacaagtgatctgcaagtttagggaccgaga

SEQ ID NO: 29446 - DNA, 1501 bp, Oryza sativa
gcaaggtttataccaaagacttgtgtatctatcagctatgtaagggctggtaccttccttggctccttgatgcaccaactcttgtttagctgtccccttttttgtcttccagcaacatcgttatcaaaatataaaatatatttcatgataaagactacttttatgtatatatgttggtaaatttacaggggtcattattctgctcactatcgaatccaatgcttctgaaaggtagcatggtttataagatgaagtccaagagggagatgttacagcaaaggcaacaattgcccaatcagtatcatttcctttcacatatcaactcagcagtgaattttgaggagaagcaaacaacatcatacagaaatactgacattgcaattgttgggagggatgcagacttagataatctcatggacattttaatggaaaacagcgctgaagagctttccattatatccatagttgggcctgtaggttttgggaagacaagcctagcacagttcgttttcaataatacaggaacagaggtattcagctttaggatatgggttcatgtttccatgggtaatatcaaccttgaaaaaattggaagagatatagtttcacaaactacagaaaaaattgagggaaatatgcagctgcagtcaatcaagaatgctgttcagcgtgtgctaaataaatatagttgcttgatcatattagatagcctttggggaaaggatgaagaagtgaatgaattgaagcagatgttgcttactggtagacatacagaaagcaagatcatagtgaccactcatagcaataaagtagctaagctgatttccaccgttccactgtacaagctggcagctttatctgaggatgattgtttaaaaatattctctcaaagggcaatgacaggtccgggtgacccgttgttcagggaatatggagaagaaatcgttagaaggtgtgaaggcacacccttggtagccaattttctcggttctgtggtgaatgctcaacgacaaaggcgtgagatttggcaagctgcaaaggatgaagaaatgtggaagatagaggaagattatccccaagacaaaatttcaccactatttccatcattcaagataatatattataatatgccccatgagctaagattatgctttgtatattgttcaatcttccctaaaggaactgttatagaaaagaagaaacttattcagcaatggattgcacttgacatgattgagtgtgaaaccatgtgtggttatagttcttttgtgatgggaaattgacaagtactggaagtgcaagaagtgtgtgcgtggactaacattggtcagattgcgacatctgtgccaagacaacggttgtttggttcatgtgtgtgcaggtgatcggggtcgatcttggtcaacggcggatcgggactagactcagggaggagttgaggtccaaagcgatcaaggatgccgggtgacaagattggacataaggttgcacacggtggacg

SEQ ID NO: 29447 - DNA, 1501 bp, Oryza sativa
gacagagagagagaagagggcggctcggctgcagctgggccgattgggccggttcggccgcgcggagagagaaagagttgggccaaaatcggcccaacgacttagggaaggatttaaaaactttttccaattaaaataatcacttaaatgatctttcaattgttaaaaatacttccaatgctcaaataatttcaagaaaaatcctgaaaatacttggacactcaaagtacttaaaaaaattataattagaccatttaatgattaatttaatatttaaattataattagaccatttaatgattaatttaatatttaaataattgctgaactgctctttgtaagataaaaattaataattgagctccgaaaaatccgagaaaattccagagagtataattaaccatggagaatttaataaaaattaaatccatccatgctttatatttaagaaattttatttcccacatttaacttcacttgtaaattaatgaacatttaatataaattctattaataatttattaaataatttataaatcctgaaacaaaaatcaggatgtgacaaatctaccccccttacaaagaatctcgtcccgagattcggaacggctagaaagaaaaaggcataggtaaactgcagtctatcttattccataactccgataattattctaaagctttaaagaaaactaatgccgctttgaaactggtggctgagctgtaacacttgaagacacaactcatgaagacgcaactggcactgcattggctcctgtgacaacaatgttgttcacctgaccttgcggctgctgatgcttcggcttcggacactctcttgcaaagtgccctggcttgtaacatttgaaacacacccgctgttcccttgctggttctgcatttgttgcactaacatgttgatcaattgggtctgttgagccagcacttgagcaagggttgggttctcttcattgttattgtttccacttccactagcgtgagtgttcaccatctgttgcagattagaaaggatagaaggagaggggttacactaaagataagaccttaaccaggttaacactgatctgatgtgtgtagaccattatattgttcaagttgattaagcaagcaacctagtatagtcacacactcatcaatgaacttctccaatgatgggaatgcaaccatacctacacacaaagcaaacaacaaacgttctaccctactaactattcttcaaaattactttggcggtataggtgctaagacaggatccaaacttcattccatcttgaccacttggcacttcagttcttcctcgatccactttacttaacctccatcagtagacctcattggcgtcttcaggtttcaaccactagtttcagaactacttcaagttgaacgagagaggagagtagacaatgaaacaatttgcaaagaattctagataaggaagaaaggagaaattttcacaaattatgttttcggaaaattagtcctt

SEQ ID NO: 29448 - DNA, 1501 bp, Oryza sativa
atcatccttgttacgcatcattgaaccaagagaatacgctgccataggtatgccttcgcaccttttcacaatttgcctcccaatttcagcacggtccatgtttccggctccattatcaaatgctctctgacaaaatattccccaacagtcatcgtcagataaagggtgcaacttgtatgatggaacagtgcctattagatctgcagatacttcactggaagtcgtcacaatgatcttggtgcacttctctgtacccctcaacatctccttcaattcaattagctgatttttatctgtgctaatcaagccatccaagactatcaaactgcttttgtcagaaagaacttcttggaggcgattcttcataaactgcaagttgttatgaatttgatcattcaggacaaactctgaaatagtttcttcttttttgttaacctgtgaaattatatcattggcaattttattaagctctaatttcctgtcgatacagatccatatacgttgatcaaagttccactcttctccatagtcttggaaaattaaccttgctagagctgttttccctatccccgcaaggccgacaatgggaatgatggaaaatttatcagcatcattttggaagagcaaattctttacattttctctgtcattgtccctcccaaggattttatatccatcaaaaattactggctcattgcaatgcttaaggttggatggactgtgctgcattaaactcaatacaacagaatcttctgttgacagatctaactttcttttgattatccttattctttgcaatctactactattaaagaaacaaggacttgaggaacacaacaatatttcctgcaaattatacattgaagtcgtagttttagtgagttaatttcaattgataatcatatttcaaaggattcattttggggaacagtaggggagagcccttgctaaaagtatacaatagcactaacactgccgtagctagaagtaaataatgcgtggtcatagaaagaacccttgctaaaaggatacagcaatataacactgacactgcgtagctaagaagtaaacaatgcatggccatagaaggatgaagcagaactgtaggagtaatagcataagaaatactccagacatcaatacttttacaggtaaagtattagtcacttgaacgatgggaacagctataatactgaaacaatgtcatattgcatttttcaggtcatcagcagtagaacttttgtaatttgcacagccagttgtacagaaaataaacaataatttgttgaaggatgaaataattaatagtgaacatttgacacagttatttttctaaaggaaaaaaggtaaaaggacttaaaatctcttaaatcaggacgtaatctgaaaacgaaattccactatgggggttaccccttttcaaaggattgtgacgaacctttgcaatccaggaactgcccctttgagatccggcctcactgcagtcctcaaattcatctag

SEQ ID NO: 29449 - DNA, 281 bp, Oryza sativa
tggctaccatcacggccggtcgatgtcagagcagcgagatgaattgtttgtactcgtacttgaccagattaataacaaagataatttagctacaatcatggatagagaatcttgtttaacaaaatatgataggcgaccagtagatgtacactgcagcccatagcaattcaaaaatctccgtttaattgacgagcgtgcgagcgtgggaggggaccggtggtctccaggccgttggttggttggttggttatggttgatgagcgatcgggccaaccccaaca

SEQ ID NO: 29450 - DNA, 1501 bp, Oryza sativa
tgaatatcttccgcatttagctagcacatcaaaggtaattagtttaaacacccaaaaaaaatgtttctttctatgaaaaaaattagcaatatttgtttctcagcacattgagacaagtactaccaatttgcaatcacattaaaatatagtaacaaaatcatgatctgctatcatgtttaccatgtgaactgctatagtcatcaatcatcattagcaaactacagaagtatatataaaaacattcacatcattcatagtaaagactattactaaatgagcagagttagatagagtgatttactcgtagctacatgtttcagttacagaaggcccatagatgatgctgtaacgtcttatttttaaaggaaattagcacataatttacatgcagtgccttactttctgaccacacaccatgagcaaacataaaatgggaaaaacataaatgacaggataactaggataccatactgcatcagcaacatcgcaaagtttaactatgttaatgcttactaaatgtcaatttattggaaatataaatctccccttttttgtacagaataggtaatgtatttcacgaggggtctctgcctctgtaaatttactccaatgtaattagtattctgcctgacagaaggggtttaaatatttcctaaacacatcaggttctctttggaacatggaattcttgtaggaacttaattttagacttctgtttcatccaaaaaatcatgtgatctaagcttcaaataggccttgaaatttaaattgaatagaaatgcctaacataatttatgtacccacccttctgtgccacagtaattttactagatgtgacagcatattttgttcaaataaaaaattagaacaaagagtaaaatacatggagggtcatccaacttgtttaggtgtgtcacataggtcactttgcttttgagatgcacatgtgggttactaatgtgagttaagtgagtcatttagccatctaactatccacatgagcacacctcgtacacgtgtgccacataggattggaaaaaatgtttgggcatccgcagccgctgccccctacgatttcacctccgttgctgttaagcttgtcgtcgttgccgcctaggattttgcctccgtcactgtttatattcatagcttatcattgccaccagcgagtttgatggcaagtgagagagtactgagaactagaagaactcatcaaaacaattacaagtgaaatgatttggtttccctaattccgtgtatttccaagtgctagtgttgtgagaaagggaaaaaaaatacgcatgcgatttatgcacatgtccgaaagcaattttttcaatcgtaggttgcatgccatgtatacaaggtatactcatttggatagttagataagtaaatgactcacttaactcacattagtgaactaaatgtgcattttaaaagtagagtgatctacctaacacacctaaacaagttaagtgaccttccatgcattttactc

SEQ ID NO: 29451 - DNA, 321 bp, Oryza sativa
taactaatgactcactataatttaatgatggcttaatgatagttcacgatggttaatcgtgattagttaattaattaatgtgctaactaaaacctgataatggtgggttgtgagcacatggttttgttggtcgtgctcatgacaattaaggaccggttcacgagtttcggttgtgaaacattaaccgtgccaaccacaagctagcgtgggcaacggctttatcttttgtatagcatggttcattgcagagcaccaggttgagaagtggcggagataagcccacgggggtcgctggggagtccattacctctggttttgagg

SEQ ID NO: 29452 - DNA, 543 bp, Oryza sativa
ccaattgctgctattattagagccccaaccgtttcaccaacaattatggcacattcaactttaaatataccttcatgcatgtaagagcaattgtaaagtctatccgtgatttgtattctctccattacgttgccgtttctttccattaatattcttcttaaattatttgtgacatttaaacatgtatttacttcacctcaagcacaccgtatgaactcaagctagttgttagattctatattttgccttctattctcagttatcttcacaaccatgcatgcatccctgagaatagattgtttgtattggccagcttcggttgatttccttttgtctccgaccatttttactgtagatgagtgaggtccatgctgtggccagccagcctaagtttccccgttagggcttgttcggttgggccgttcccggctgggatcggggtctaatccccgtggaaaatcccggcgtggaaaggataccagcccatgcaagtataggcgttcggttaagtccaggcgagattttatcccggcccaccccagt

SEQ ID NO: 29453 - DNA, 1501 bp, Oryza sativa
ttctggggacgatgaggtcctttggcttgctgcctttcagagaaaccttgaagtagttcgtcaaaagctagactgacgattgttgcctttgatccgaagaagacacatctgaaactcttagtccaaacaaatgtctctttggttgatcacttgattttcttcgccatcaacaggttggttattaactcgagattagtatatgattcctctgaaatgagaccctaggtctcctttatcagtaagcaattatacacataatcacatatccgcatcttccaaaagaatcctaatagaacttgtctgtattacacatttctcccttattacatgaatacaaggcactaccttaaacaaaaagggaagatgcttaacatcggtacattgtttctactatgggttatgattaactcgaggcctcacaggtatggcgtttgctccagtgaccacaaggcgagtgacttgtcttcttcttgcataatggccggagtgatggcgtaggttacgcttcggctgtggacaatctctagagaaatgacctggttctttgcagttgtaacaaatcaacgtcttctttgttgagctgtccatctggggacgatcattttgacttggagttggaattggtggttggaaatccttgctaacattggcatcagtggtaccatagttgctatcaccattggagtctttctcagtgtcaaaattgctaaggttgtcattctggattccaacattgatactatcgttgacatcttggtgaatgctactgacattgcacgctttattcgagtggtcgctaatgaggcaagaaccatggttgttggtggtatcatcatcattagtattgctagtgttgttgtctgcattgcgtccatcttcttggggcaggaactcttgatgcacaacagaagatccggtgatctgaagtggctcagtgcgctgtctttggttaccacatggaaatactgggatgttgacaatcctcctcttgcagttcgtcatccgattatgctcactttcgagttgcatggctttgtccacaagtttctcaaaatcttagtaatcctctagaaggagttgcactgcaagctcatcttttaacccctggagaaacttctcttgtttgtcttcatctgtttccacatcttctggtgcatagtgagccaaacgatagaactcgtgcaggtactttgtgacggtcaaatctccttgcttcagatagcgaaactctcattttcttaatgtgatcattcctgcgggaacatgtgatctcctgaatacagatgaaaactcgttccaggtgatggtatgtccttctggccgtgatgcttcgtagctatcccaccactctgaagccggtccaaccagctgaggagttgcgaagccaacccgctcctggtcggtgcactgaatcaaccctagcttcttctcgattgtgcgcaaccaatcactggcttccataggatcgacggcaatggcaaaggttggaggctcagttttg

SEQ ID NO: 29454 - DNA, 1501 bp, Oryza sativa
cgtggttgatcagtgagagattatttaccctccgttgtttattttttttcctatagtctagaaaaagccaaaaaaaattagattagttagggcttgttgagttttcgattgcatcggttgtgtcaacttgttggtcttagcacttagtctattagagtttcttgttcttaccacgcacatcgccatcttcatcaccgccgccatcaccacttttgtcgtcatcagcaccatcacagccatccaccaaattcctttctgtttgtgtttgatatgttccttttattgagtttaattgtcgttgagcctgctgccaccagaaaggaaacagaaccctgattcgagtgatctaccttaaaggaaatagaaccctgattcgagtgatctcccttaaaatagtcgtatctttttcatatggactcgaaatttggcataatatatccacggacatctacctaaaaaaattacatcgccaaattccacactcgacaaaattaaaatcgcgaaattccacttgcaaaattatgtttttgaggcgagaagctttgcaaaacctttagatagaactttgaaaaaaatttacatgcttcatattttgtccgtttgagctaagaatttatgtggttggttccaatgtgctcctaactgtgaaaaaatatcaaaaaaataaaaataaaagttccatctctctcctcagcaccttccgccatttcctgttgtcaccactgtcatcgttcctgtttaggtttgtgtcttgtgatgttctttgtggttaggctcacgtctctacttcggctagcctaggaccagtcaggcccggcccgggggggtcgagctgggcctccacacagggcccacgaagtgaaggggcccaaccccatatatgctgtacataatagcccataggaactaagaagcccactagctcaggagaggaagaagcaaatgtacaggaaaaaaattgcgtcgatttggcttccttccgtgattccgtccgatcgcttcgccttcgctcgcaatcgcctgactcttcgcatgttcggctgttcgccaccctcccaggttccagccatgtttcagctacgtcgacgactgcgcgcggctatgcgtcaacggccggtgtcgtgctcagtgccgtcagcggcaccacgacagccggtagccagatgcaaatctcttatctctctgactctctgttcagttctaggagaccaggaggtaccccattgctctcccctttgatgtatgctaagtttatatgtttaaattttgggatgcaaaatgttactccccaattgctcctcttctgatttctgaaattttgatttaggatttagggatcctcgcggagtcgcggtgcagctgtgcaactagggcagtgaatagttattttctttagttctcaactaggtaatttgccagcactcatttttattataatgttgaattgaatctagtatgacataattttcataaattacttacttttttctaaatttacagt

SEQ ID NO: 29455 - DNA, 1501 bp, Oryza sativa
atttttttttctttttcttttttcttccttatccttttctccctctctcgttctctctctctctctctctctctctctgctctcaaccgtcgccttcaacctcgcccgcggccgccgccgctcctcctatgctcgcccactgtcgctgctccgcccaccgcgctcgcttgctgtcgctgctcctcccaggctcgcctgccgttgccgctcctccttcgctcgcccactgtcgccggtgctactgctccatggcttcatgtccttcatgcccagcacggtgatgtagacatgaacgcgctcagccactcatcagtagccgacggcgaccattggcgcgaacgcggtgccgaacgagcagtcagcggcggcctgcgatgttagctaaataatgcaatcttgtgcatctagtttctgtagttgcattgcatatggttggctgtgttagaatctgtcagcagccgttttacttccagttagcatgtagctgttttctagctagtttttcggttggactgaattggatcgtgggatggcacggtcagtagtggatccagatcaatcgggtgttttttctgttatgcatgtaacaaactctgtaattgaggagaataattaggaaaccagaaaagcagcagggtacttcgctgtgccaaaactctgctcgttctactctgttcttcagttaactattcatatattcgacaaaaggttcagagattgtgagagtgagagtttgatcctgtaaaaatgagaccgtgtgcttcacatccaccatcgtttcttctcctctcttgctctttgcttggtgatgagaatgtaagatgtgtttaagcccgtgattagtgaagactaactaaagaaaatgtttagcggcccacgttggattaacttgagccaagggtaaactagtctttaatgattgtttctctctcctattcctccaaaaataataaaataatcccaccagtgtccagcggctaattaccagttttttacgatgccctacagcaaatacacgttcttacgatgtcccctagctaattacacgtttttcagatgtcctgttgcaaattttacctatttgatatgaacctcatattctttttataaggagaaacaaagttgatctctcattgtcagtaacaaaagcaacttagtttgatggtatgtaaaactagattatcgggtaagttgaatgtaaaattttgtgattatgtagcccttttttttgttttggatatacatatttagttatgatcaattcttatttacctgacttcataattaacagtgcattgggtccatccaattgagctagcctatatatactaatgcgcggcaaagccgtggttagtttctagttccttacggaaaccaagatatatctatatatgaaatatatatgaagtgtgttcaatgtcctgcattctacatatagcacataaacatgtatttatgattactacatagtaggataaaaggtataaacatatgatcggac

SEQ ID NO: 29456 - DNA, 1501 bp, Oryza sativa
atgaaaaagatacgactattttaagggagatcactcgaatcagggttctatttcctttaaggtagatcactcgaatcagggttctgtttcctttctggtggcagcaggctcaacgacaattaaactcaataaaaggaacatatcaaacacaaacagaaaggaatttggtggatggctgtgatggtgctgatgacgacaaaagtggtgatggcggcggtgatgaagatggcgatgtgcgtggtaagaacaagaaactctaatagactaagtgctaagaccaacaagttgacacaaccgatgcaatcgaaaactcaacaagccctaactaatctaattttttttggctttttctagactataggaaaaaaaataaacaacggagggtaaataatctctcactgatcaaccacgctctgataccacctgttgtgaacccgcgagggatttgtatcccaatctttcaataagaggcggagataactcgattggatgaagacgacgtttatggcccaactataaccgtccaaggacgttgcgccttagcaaccgatataccgtcaccaatggtcgtcacgaacttgtggtgcacgacaacccgacctagagggcactcgtatgccctgcaagcaatcgaagaacaagtagaactgctagatgaatatgaaagtttcactaggaaatcacaatatggcagggttccgaatagaagcagacgggcggtttcgccaacacgcgcgctgcaagcaggtagcaagttgctaactctgatcatcaaaaaccaattgttcttggcagtggctataaaggtataagaagagggggagaacaaccacatgggtgttggggttgtgctctaatcataggacgcgtccttaatggacccaacttgatacatagcctattgggcccaaataagttgacgcaatacctttgatagaaaaaggctcggtgataaagcgatgattgcggccactccagaattgatatggacatgaggccagatccatttcaaagtagacttgataagctttccatgaagtacttgcacgcccaaatcggagttcgtaggaagtcgtggcggtcgtcacaagttggagttgtcctgtagtttgaatccagcccgcgcgaatcctctcccttttgatcctctctatcattcctaagtaaaacaagagtgcacatgtctctgggggtataaataagatgaacatgaactcaagaatgaactcacctgatagttgagttgacgtgcacaagcgcaggtaatgttgatattgacgtgcacaagcgcaggtaatgttgatatttcttaacgacattactaggaaattaatcccaagcaatgttgccagagatattagacggtattcttatgggttatagaataaatcctcacggatataccactgtagcatttcaactggaaatatttccaagtatcgtatttatttaattccaagaaaagatatggtaagagagtactatgctataaattcatatt

SEQ ID NO: 29457 - DNA, 1501 bp, Oryza sativa
aacatgcagtggatattaaacatgggaaaactatcgcataaatttctaaaatatctcacatacaggaaggttatattagacaaccatataaaatttcaggacatatgaaattgataaacagtgaggaaaaaaagagtattctttatttgtgtttttttctttgctatttgtaaacttaatatctcacaaacaaagttgagttttatcttgaattttgtatgcccatctaatttcatatagctatcattgagttctttttttcaaataaaactctttttgagaacttatattctgtggtttacatgtttccgacctagttaaacatttcaccatgtatttacactggatatctcggaaatctcacatcgtactcctatatccacattgtctcatgtatagttgtcgatagatcccatccatacaatgctccacattgcatggcaacagatcagaatgtctgatgtttgcacttcagagaacacaaacaacaatttaattggcacataagagggcacaaacaacaatgaactgaaatgaacagacaaatcagtaattgcaagatgtttgcatagaaatcttgaaatgcaactgataagtgattatggttacaaattggaccatgcaagtaggctttagaatttctaagctctgctcagtgctattttccttttattagtgcattgaggcggatcaaactcatctacatttttggtaaggttttggaatttagactttggaattcaaactcatcagcacacattgatttcctctggagtatagacgcttcaatgccggatatcgtcttccattaggagtacatgttcaaaagattcaatctcgtggaattcacatgtctgtacaggttctgaacaaaagagttttaaatggaaggaaatgtaatgaatataactgcacacagcattttgatgaatataaatcagtatccgtgactcttgattagttatggataaaattgaaataggtcatcttatggatttcttttaaagtaaaatcatcagatgattagcattttaatgatgatgacatggcttaatatgatggctcatgttatactcaaaaatataggggagagattttctgggatggaatacattagtatcttgttataccatgtatgttaatttgattaaaaaatatcatcttcatcaatataatttattttcctttgtggctatgagaaacttttttaacatttctgttaatttcgttctctgccaattgagggaaagggaggtaaaaatgttcacagtagcatggtgaatgcaactgtagcaagctatcaaaggaatagatcatgtaaaacatgcacaatttagctataatctgtacatattggcttaaatttacattcataatgttcgttgctcagtatgtggattcatattgtagatatttttattatatacataaatttcatggttctgcaggctgttcagcacaagcaattcggaagttctgtctgaaactacactgaagattt

SEQ ID NO: 29458 - DNA, 1501 bp, Oryza sativa
gtggttaaagtcccagttctgcacctgcatttctcagtcccagcactctatgtcaacttaagaaaatgtaaataaggtcatgaacagaaaaaacatgtgttctgaagaaacggaacataacaatgtagctccttgaatttgagctatggtagactttaattcagattttaatatctaaaggataaggcagtgactcggttatcagaatataacatgaaacaaataattttgagagagcataatacaagtatatgtgatctaaaagaaatgcagcttgttatcaagacaaagttctttgtgactatagggtagcccaagcagaagttctggttgtgatcttcgttcatgcagaggtgaaaatggaaagcaaagaaactctagttttaaaagcaaaatagaaagggcaatttctttctgctgttcttataggtcaaaattgtcccactgatgtgagcatagtagaaacgatttcttggggttagttttgctagattactccgtgccataaaaaagataaagaagattttataaacaactagacaaatgtccataaaattagcatcaggtaagcaaaaggttttggatcttaacgaacaatcatgtaaataacttatataactgctaactttttttaactaatgctaactaaatttaagctcaaaatgccttactatgttttctttttctctctttctttttttttttccttttgcagattagtgcagcagctacctgaccataggtgaacgcatcgctgctaacaaagtatacagataatgaaatgatttggaggtcatttaatcgatatctgattgacgtcctcaaccattgacacatactcatcagattataatatacatgaaggttacgggtcattaatctgctgattgtatgcatggaaagcatgaagcatcatgtcagatatggaaaccttgctaataaattaattgaattcagaaaaaaaaatctagatgcatttttccagttcaattaagaaagtgtagatgagtcagtattcacctaaagaaacgagtaccggaattgataacttgtgtgtatctccggtgagctttattgcctctttgccagagaataaacaaaattgaggatgacggtggatgaaaggctgccgccgtctagctcgttcctccacagcgaggtcagggagaaggaggcctaaagatgagcaggaataaagggagaaaacctgcagcagctgtggattaaccagagaccgtcgggggtggtcgactggagcatctcgctgaggaggatgtcgtcgtcgtcgtgtcgtcgacagtgtcgccgctcagcccgtgcatgtcgtccgaggggagcccagaatagggatgggcaggaggcagcgtcggcgctcgttctgcccggatctggcgcccttgagctcgtccgatgagggactggtggcgtggcttggatggtgcagcggtgacgtctgaaggggatggataggaggcggtgatggggaggagaaggttgccgt

SEQ ID NO: 29459 - DNA, 1501 bp, Oryza sativa
catccaccctggcagtacgaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggatcgattaaccaaggtagctcgatttattcctgtgaaggccacctatggagggaacaaactagccgagctctacttcgctaggatcgtgagtctccatggcgttcctaagaaaattgtatccgataggggaagccaattcacctctcacttttggaagaagctccaagaagagctgggtacccgattaaatttcagcaccgcgtatcacccgcagacagatggacagaccgagcgtctaaatcagatcctagaagatatgcttcgcgcatgtgtcctagatttcgggaagacctgggataagagtctcccctatgccgagttctcctacaataacagctaccaagccagcatacaaatggcaccttatgaagcgttgtatgggcgcaaatgccggacaccgctattgtgggaccaagttggggaaagccaagtgttcgggaccgatatcctgagagaagctgaagctaaagtcagaaccattcgggataatctaaaggtggcccggtctcggcagaagagttatgcagacaaccgacgccgtgacctagaattcgcagtggatgactttgtgtatcttcgggtcacgcccttgcgaggtgtacacaggtttcagacaaaggggaagctcgcacctcggtttgtgggtcctttccgtatcattgctcggcgcggagaagtcgcttaccagttggagctgcccgcctccttgggcaacgtgcatgatgtgttccatgtgtcgcaactcaagaaatgtcttcgagtgccatccgagcaggccgactcagagcaaattgaagttcgcgaagacttgacctacgtggagaggccagtgaaaatcctggacaccatggagcgaaggaccaggaaccgggtaatccgtttttgcaaggtccaatggagcaaccacgccgaggaagaagctacttgggagcgtgaagacgagctgaaggcagcccatcccgatctcttcgtcagttcttccgaatctcggggtcgagattccgtttaaggggggtaggtttgtcgcgtcccaaaatgactctaaaatacatcctcgaaattatgcctagaataattaaaatccttgtgaaagcctcccacaattaaaatgtgcaaagttaaaagtccaataaggcttggaggatttttgtatatttcctaaaagcctaaaatgcgtaaataaattttagtggaattttcagagcacaaataataattattaagaaataaacaaagttaaaatgat

SEQ ID NO: 29460 - DNA, 338 bp, Oryza sativa
atatggaatgctaactgatgtaagaaagtacttaaccaccatccacttcaagaataagaatttatctttatcttatgtcaccccatatctgtatctcagtatcctgattttcttatagacattatattgaaccatagagactatatatagtgttgcctgtattatagaaatttataagttgactggcataaaacggtcttattttgagtagcgctggtaactaattatcccatgaaattgtgaatgcacccttaactgttacaagcacttcacttacagctcaattatcacacctcagccacaattacaagctaaattttgataatgttccgtacagt

SEQ ID NO: 29461 - DNA, 1041 bp, Oryza sativa
ttagatctgtgcagccgggtatggttgttcaggatgggtgggcctgtacagcatgggtgtgctgttcagtgttgattaaaatttctgattaattactctactgttttactactcttaactctttgctaaatgctgctttcgcaaatgagcctatattatgccatcctttggtatccttgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagcttcgctagaccgtaattccgctgcagttttcttttcttttgtaagtatgtaacgctattattgatgattcagtatattaaattgtcagtttgtgtacctcggctgattcctggacgagggttctatgcacaaattagttcggaaattactagtgaatttccgggcgtgacaagttggtatcagagccatctcgactgtaggataagccaaatggtcaaaccttaaggactaattttccgaaaacataatttgtgaaaatttctcctttcttccttatctagaattctttgcaaattgtttcattgtctactctcctctctcgttcaacttgaagtagttctgaaactagtggttgaaacctgaagacgccaatgaggtctactgatggaggttaagtaaagtggatcgaggaagaactgaagtgccaagtggtcaagatggaatgaagtttggatcctgtcttagcacctataccgccaaagtaattttgaagaatagttagtagggtagaacgtttgttgtttgctttgtgtgtaggtatggttgcattcccatcattggagaagttcattgatgagtgtgtgactatactaggttgcttgcttaatcaacttgaacaatataatggtctacacacatcagatcagtgttaacctggttaaggtcttatctttagtgtaacccctctccttctatcctttctaatctgcaacaga

SEQ ID NO: 29462 - DNA, 1501 bp, Oryza sativa
agcaaacaccatcaaggcagcagcctctgcaactgattcagcagacgccaccaaggcagcggcttcagccgatccaacagactccgatgcgacagcagatcgttcagccgattcaccacccggggtcggcaaatgcatcggcagggtttgcagcacctggtgggcaacctgcgcaacaatttgtaaaccaggtcgtcccagagcatttggttcaccatgcacaaccggatggcacggtggtgtctcagatggttcctaagcacttggtacgcaacatccagtcgaatcttcataactaccaaggaggtaacttgagctatcaatatcagcctccttccccgcaagcccaatatcagccggggggattggctcagccccagttcgcacctcagtttggtcaagtcgagcccatgcagcaacaaccacaaggagcagctcagcaacgaccatgggccgatgtgatcgcctgtcgcgaccgagaaaatttgcattttcccgaacgctagtgtattaatccccgtcccaggaaaagctggggtacaccacacaaacatgatacaaacggcacatctttattatatcgataatatttacattattacaaaggcacttcaagcctgacaatcaaaaataaacagcagcggactagcgggccaacggctccatcttcacaggcgctcaactggggtataagccaggactccacctaagacttcttctccaaagcttctcttactgaagggggggaagatagagcaagaatgagtacaaccacagtactcagcaagtcacaccgggagatgcatgattaatgcaagggaaacaaggggtaataatataggggattaggttttgcagtaaacagcatttaaaagacacttagttgcccatagctattttataaagacgatcctagagctacacagtattattaatcaaggccgtggacccacacgaacctgccttaacccaaggcctacgatgattcagaccaaactggcaacccgacctaggtcccagctcgtcccaagccaacccaggccaacctttccaccttttagttgttaagcaatttttaagaattaaaccactaacttgggtacattgctaggcttgcccatatccgagggcacggctattcgaatagatttactctgatcagaggtgtacatctttacccacaagacacatctttactccgcattccatggccttggaacccgtcgtaaacatgtgacataacccttcacccatcctagccgtaaacaaaagtaccgacccaaccctgcctacggccgatatcccgggacaggcaggccaggattgagcccctagcaacaggatctagaccgggtgcgccacacccataggggtgagaccacccgtgtactagtccagtgccatggcatctcgactaacgggcaccgacccgtgtagtcttcatttgcctagacatctcgattaccgagccgcagctcgtgtagccttcatttgcctcaga

SEQ ID NO: 29463 - DNA, 163 bp, Oryza sativa
aaaaaatttaataagcgttagattaactgcaggccccgccgacccactcattgatttttgcagaaatcccctcattatttcggtatttccagtcgagtccactgaatcagagccgttcaaccccacgcgtggacacaatctgaccattcgtctcctatctaga

SEQ ID NO: 29464 - DNA, 597 bp, Oryza sativa
ggatttttggactactaatatatatcacttttcatacattggtagtaactttttttcatactagtatatactgttatttctagtgtactaagtatataccatttttttctagattttcagtatataccacttttctaaattagtagtatgtactgctcttttttttttgtcagtatgtactcaatgacgatttggccagcacgtatatactgcattcctcattgaagctagattgttttttttttttttgcataatagtagtatatactgattttttttcgttgacggagtatatatatactgcccccctttttttttcagtatatatgtagtattctttggccagtatatactacattcctcattgaagatatatgtacacgattattaaaaaaaatgtactcgtagcagatttacccagcaaggggtgtgtatagaattgtacgagctgcagaattgtcagagttacaacaactactgagtatatatatccctggagaaagaagtatcgtttcaatttttgtacaagaattgcatcgcctcaattatgatcgaggctgtcacctggccggaatctctgctgcacggccatacagg

SEQ ID NO: 29465 - DNA, 517 bp, Oryza sativa
atgttagtttagaaactaaaaatatcaaggtatgccaaatattcaaaaaaaaaaagaaaacactcgagaatgcaagcaggcaagcacgaatagagaaaggcaaagcagctgtgctgtagcaatgagaaaacatgcatgcagcacatgctctttaatggcttataagtaggctaagtttagaacgtcaagaactggcaactttaatgtcaaagcttaagacgtcaataattttaaaactcaagggagtaggttattacgacacaatattttctcataaattaaaaaccaaaaagttccatgtaattttagtttataatttatatgccgcaaggataattaggaaaaataattcattgacaaaaaaaacatgtttagaatagagtagaaaacatttcaataaaaaggttacccataaaacattcataagaaaatttcaaacccattaaataagtgcccgcgcatgtgcgcgggtttccttcctagctgtcttaaaaaaaataaagcacctggacagcaa

SEQ ID NO: 29466 - DNA, 488 bp, Oryza sativa
accaaatcctagtcaataccttgctagtcaaattccactcgtcttccaagctccatatcagctacaatattacctatataccactttccataatcttcctcacccccaccatatattctccacctacctacaacatatacataaattatagagccgagctgaaatgctatcctatttcagtatcgactcgagaacaactaaaccttagtttccatacgacctaaacctagctaccaccaaccaataccagtcacataccctcttaaccaataccattatccaaactagttacttctcatcctcctactaatcaaacccacacatgaaatataagcgacagtagttgcttaatcccctctagcctccaaccctttagaacctacacataaaatatcagcccagtaatccatataccctataaaagagataggctataccctaaaccctagccctcctaaccgtttatctctttctttctattttatagc

SEQ ID NO: 29467 - DNA, 1120 bp, Oryza sativa
ccacaagacacaacctcaacatcatgtcaaccatgcgtcgcgatacttaacaagtacccgaatagagattgtgacaataccctctgcataacacaattcaaagcagtttactattcctggatcataatcacccccttataaacaaggcatagactccccagaaacccccgtgtgcttatctccgccacttcacagtctggtgctccagaatgaaccatactatataaaaagtaaagccgttgcccacgctggcttgtggttggcacggttaatgtttcacaaccgaaaatcgtgaaccggtccttaattgtcatgagcacgaccatcaaaaccatgcgctcacaacccaccattatcaagttttagttggcaaattaattaattaaccaatcacgattaaccatcgtgagctatcattaagccatcattaaataatagtgaatcataagttatcccatttatatgagctaatgtctctaagcatggctaagcatcctatgcacttttagctaaaactatataatgttctagctaatccaattattaatcaaacgacaaagtataacaaaggcaataggttattcccacccaatgacattcgaaaataaatgcagtagttgaatagaaacaatagctttaaacgggatcaacatgctcaaaggattgtttgggatatgtgtgacttgccttgttggccttggaactcttcaaagtcttctcctgcaaaatcggactctccaggaacgtcggaatcgaagcataaaagagcaaaatcaccaaaacagcacataaacaatcatgaacagtacatgtggatacttttaacctgtagatctcaattttagaaaaatttagagacttgaaccaactaaatccgagctaagatgaattagttatgagtttttaaagattaaatcggattaaatcaattatttagattttaattgaattatgacggaataaagaattatttttgaaaaggaaaaatgatttattgcgtcagcgggctcgggttcatggtggaccaggtgcacggggacggtctacggaacgaacggccgagatctaatctagacaaaacgaacggccgagatcgatctaatccaccacgggtctacag

SEQ ID NO: 29468 - DNA, 1251 bp, Oryza sativa
agtgtttcatttcttaaaccctgcttactactaaaaggtggaattgttggcctgggttggcttgggacgagttgggacccagggtcgggttgccagttcggtttgaatcatcataggccttgggttaaggcaggttagtgtgggttcacggccttgataaataatattgtatagttctaggatcgcgtttacaaaatagctttgagcaactaaatgtctttaaatgctgtttactgcaaccctaaccctttatggtataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttatcgtttgtctctgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaataaacctcaccgtcaagtccttgcaacatgtaagctcccttggacacaaccttatgtatttgaaatggtcattcccaattaggtgaccacttgccgaatttgttgtctcgagtccttaccggcaaaatcaatttccaaactaactctccttcagaaaaagacttaggcaccacttttttgttataatgccgagcaacccgttccttatccttactcaccttggcaagggctctcaatctggattggaccaaatcttctgtttcatctaccatgagattgtaatactcatcggctgctaaactgtcttgtaaatctaatcgtctggagccgattttagtttcccatggcaaaaccgcttcgtgtccataaacaagtttataagaaggaacttgaattgatccatgacccaacggggcaggtaggatcacagagcatggatgctatgcaaactcaggacgtaaccacctgccccgttgatgaaatcacgcagtagacaccacgtgagctgcatattcccttcaagaacttatcaatcaaggtatgcccgtagtttatgttttttggacttgtacattccgcaagtttctgcttaggttgattactaatagataacctctcatcacgtgaagg

SEQ ID NO: 29469 - DNA, 373 bp, Oryza sativa
cctcctctcccgggcctctcctcctcctcccggcccacctcttccctccccctcccggcccagctccctcccctcccctctctctcccgggcctgcctctccctcctctcctcctgggccgcctccgggcccaagccgagcggcgccctcccacccgtgccgcgcacgtgcgtgcgctgaccgcgcgcctggccgcgtggggcccacgcgccggtcgtcttcctcctcccgcacgggctcttctctctcccgtgcaaacctagcgccgttcctcctccaaatccgccccaatcaagccggctctttccaaattaattggggggttttaatccccattgattcctcttcaattccccccaatttcccccttgaa

SEQ ID NO: 29470 - DNA, 1501 bp, Oryza sativa
gaggagcccctggttgatgaaggctttggtgtctagctcgtgcctgccgtcaagcgcctgtggtcgtcgccctagtcttccgctgtttctcgtttgtctttgtgtgtgctgggccttcgtcgcccatgtaataaattatctatttacgcttccgcttgttaaactctgaattgtatcaactcttggtgtaccttgcctcctgggacaaggaataatacacgcacgaaaggaacgcccgttgggttaattccggtcgtgacaagttggtatcagagcccccttgaccctaggacgagccgtagatcccaagccttagcaatatcatcaaaaataaaaatcctttgctaattgtgaaaactctctagtctctctctgtcctgctgcttcatttatcgccaaaatctgacttttaaatgttgcttttctttttgtttttgtttgtagatggccggcagcgttagtcgtcgtggtctggacatgactggtttcgtcttggagctgcggggtatgtgcgttgtcctggggtatccgcatggagtggactaccagggcaggccgctcccggagcaggagggtgacgatgcagagccccacgctgcttgggaggttactgcagtgatcctcactggctcacccgagcggacttcgttggcagtcaccgcgggtggagattctttctccgccgcttgccagagcgtcgctctcctcgccatcggcactcttcactagcgctacccggacgagctgcagcactcgccctaccgctaccaccctcgtcgcggaggagcccgcgactacgccaccttctgggatgctagctcagaggatgacgctaccatcatgcacctggcgcgcatggtggaggcgtacgacgcggctcgtatcgacttccatcagatggtgcgccgtgggatggtcgagaacgacctgaagatcctggagctgcgtcaggagaatctgcagctgaagaaggacctagacgcagtggaggcacagctgcatcagctcaagatcacccagggagaggtctgtcgccccaagcgtcgccgcgtctgccgcagccagaagatcaccgcccgcaagagcacctccaggcccgagcttgttcgtcagtccctggcgtggacttgcttcgtggagacccctcgtgccgagcccgcgcccgtggttcctcaggagggggaagcctccggcgtcggtagcacggaggatgcgctgttgctcaccttccgtcctggcccgtcgcagtggtagacgagcagttagtaggcttgcacgtgtgttctttctcgtttgtcttcttattggggtcttgtggagcatggttatgccggtgtgtggcataactgtgtcggagcctgtctttattttatttgcttaagcaacttgaactttaatgaaccaatttaatagcagtaataaattcaagagttatggtagtcgtggatggttagctttaattgtcagctctctctgtttgctggttctgtgtggggttttc

SEQ ID NO: 29471 - DNA, 1501 bp, Oryza sativa
tcccagtttccattccactctatcatttgaaacttagaagtggataagtgcctagctagtggtcaattatggcatagattagccatggatatttgcatatggccaattaattgcccgtcattttttgaaagtaagcatttgttggggcaatcaccagggcatggatgattgatatacgacccagtgaagtatttcattgcgatgacactgaaaatatttttgagaaaaaaacccaataaaaattgttttagatctggacgattggtatttattttgttggattatttatttctggaaaaaaattgggttgcactccatttggatttttagaaatattagcatttaattagtgtcgttgtgtatgagttgcggaacacaatacatcaaaaagtacatcttcacgcactacacacaattcacccatatcaatataaaaataatatatattgcagaaagctactaataaagattaaataaaaaaagtgagagataaagcatgagcatatatacgatatatacaataacatggttgatttttttttaaaaaaacatctatttagatatacatgtataaataaatactcgttcatgtaggtgtatggctgcatgagtcatgacaaaattttcacgttacaataaaaatgtagttacagaaaacattatgctgtgtcaaaaaaattatgtcttttctattaataggaaaatcaaaccgttctatacaggaaggacacatctaataagggtttggtggtctaattatctaatattggaagaaaaccgtacatgtcataattgtagaacagaaacatcgatcgccagctccagatgtcctgcctatggtactctccttgtttggcagcggggaatgcgcgccattgatgagtctatttttctgtctgcccctccatttctgcccccacccccacacccacctgaccacctcctccccttcccacatccaggctcctcctcttggtggtacgtgcatgctcttctcttccaccactacatgattttctttccaattccttgtttgatcctggttcttcctatggacattagtaataattgtgttgctccggcattgtatgttctttatttaatgataaaatgtaagcatcagttatacatcttttcccatgtggactgaggataaagaggctctactttgttttctacctggttcaatacttgttgtgctccaatttcataagattgggaaaatctacatcggaggcagttgcttatttgtattttggattctttgggtggtcggccagggattgtcaaggggatctaggatttggtacattcttggttcattgtggttttttgggcctttataatttcttcatttgatttttgatggttctgattgtgttgcatgtcatgacttataatgggtgcaagaattattcaaattattccagatcataacacctatcttccacttagattacttttctgctatttttttagcgaaatttattctgttttgtgt

SEQ ID NO: 29472 - DNA, 1501 bp, Oryza sativa
tatatggatattcatgttgacttcctactggatatttgacatgtagttcttattcagaactgctcactatactgattcatgtttgaaagtactttggcactgttatattattgctactaatgacatattttatgagaaaacaaagctcaaagtttacaaactcacgcagcaaatcgatactaacccactcaaggtttaaacactttgattgctacatcttactgcatattgtccaatggtatccagtggttaatacaacaagaataagttaattgcaatgtggaattgttcattgagattgttgaacatacaaatcaacaatgatcctgatcctaatcttctttctaacttcagaaactaactgccaaggcattttaaagaaaaacataagtctaggcagactcatttcgtcaacaaaaccattcctttatatttcaaataggcagtgtcaacatttcacatacagctgaacaaggagattttgcaatggctttttatgtcctgtccacccctttggcgtcaagccagaatctctcctgttgaggaactgtatattttccatcaagttggatttaaagtgcatctcagatgtccttcatccaaatcaagacccttgcagcttcctcttttgccttcgattcaacaacacttctatgatgacactccagcttccaaagcagttcctttttacagctctctccccctcaagatatgccagggtacactcaagacctgaaacaacaggtattctctcacactaaagaagctttgtaattgcttgccaatgaaacagctttgtaattgcttgccaggttttttcattggctaaatctaacagtgctgaacaactggttctgctagcacataagttatccctgaaacaacacatctcatgttataaaatggcctatttattctcaacaagtatattggtcatttgcgtagataacatatgaatttgaaataggaagcaaccatggcacgaagtccagagagttttatatagtagctaatagagttctatatagtacagttattggattagaaataatagctaatagaaacgttgttgtttggtaggtgacgctgtataaaacagcaagagcaaatataatagagtacaagcagcaatatataacagatagacatgaacaaagagcgaatataatatcatttcagccttcttaccatagaaatatacgaaattattgtttgattgtactaaccaaattgtccatgtccaggataataacaccaaatatatccagagttaacagactggtaatcaacacatgttgtttctacagcagtggaccacagttgatctctacatgaaaaatcatgcaagtaaataatgttctgaaaacataccttcaaatcctttatcaatattctcaaaaaaaaaagtctgactacactgacgagcagcaacaacggttctttgaatttcagtgaggcaaggaatccaatatccaataagtaagattgccattccattgta

SEQ ID NO: 29473 - DNA, 1501 bp, Oryza sativa
ataaaactgaagcagaatccaagatagagatcgttccggaaacagagtaagaattggctaaagtccgaatcagctgcgaccagaatcggcagagttcgagtcggacaaggttagccgattgagccgattccgacaatgtgactcggtacacgttgtcgggttgagttaatgtgcttcatatggattgccacgcacggattaagtcctgaaaaaggcaattgtatctattagttaggatattttatgtaatttccttagaaataagtttgggcaaaagtctgccgcaaagacttatggtattttagagtttttttagagataagagtcatgtccgataaggacatattttgtatctcgggtataaatatgacccgaacccatgtaatcaaacaacacacgttcaatacaatctcggcgcatcgccacccttttactttcgtttactttcgacgagttcttactttcgggttgagttgcatcggtttcgatcttcaactagaggtaaaacttgttatggcggcttgcgttctcgggattagtgctttcatctttatgatactctaatcttgtttatgtaattcatcgagttatcatatatcttataatactttgacaatattgttatttaactttcaatcggccaacatccatcattggaaggcagccgattaggtttaatatcaatgttgacttagattatataggatatccaccaccctatgaaacattcaaagccttgattgtctagatattgtccttcttttcctacttatagctgcatcagttgagtttgaccttataagtcgtgattagaatcttaatctctggcctgcttttgagttgccgattagggtagcattagagttccagccgatcttacctgatttaactattttatatcttatatgcctgattgacatgttaagtccgccctttatgctaagatcttgtcgcatataggtatattaagcttcatgtttgatatattttgcctgctttaatatcttaatatagagtagtatcggagtattagccgatacatgctggatctatttgatcggctatgctatgaatgcttataatttcctcgttaatatatatttcgatttaagtgatttatactgtctcggcatggcgaccgatctatcccaatcacttgatttaagtatatatcgacggaagtattatatatcattaataacttcagccgatcgaatagatttagttctttttttacctatttatgactgtcgatcgacttaaatatgacatcggctcaaagataaatgatacgtcatcggcgactgaccgatcggctatcgtttatagatttaaccgctatttttcctgtctttgttccttgctgattgcaggataaaatcaactggcacgctcacgaacctaaaggtaagatttttggaactgcactaaagttaagcagatcttccaggcctcgtgtttttcgcatcaacacgcttttggcacacctggtgggacacga

SEQ ID NO: 29474 - DNA, 203 bp, Oryza sativa
aagcacaactcattttgacaatagttcttttcctgctctcatagtataatgtctgatttccatcaaatcatcacagatgtttagtaataaagtcctcattggttgtcacaaccatattttcttctgcataaaacatttgcatgctgttaacaatattgcaaggtcaataaagtcattgcatcaatatctggcggtcttgctaa

SEQ ID NO: 29475 - DNA, 316 bp, Oryza sativa
accatattaaatgacgatgataataatttgtttagctcctggtttagaatggtatattcctggtttggaggtagaactgtgcagccgggtttggttgttcagaatggttgggcctatgcaacgggtatgttgtatagcgttggattaatattgtttaattaaatactttgcaattttattaaattctggagtatttattaaatgccatttatgcaaatgagactatattatgccattctttgttattccctgcatttgcatatttgctgcgtggcttgttgggtatgtcatatactcaccttttaattattcatca

SEQ ID NO: 29476 - DNA, 1501 bp, Oryza sativa
attatatagatagataggccttggtataatgctcattcaatcttgactgactgactcaggcagggcgtcatcgctcgtcaacagctgccaattgtttctgttatgacgccaattattagttgggttccctgaaaaaaagaaaaaaaattaaatagttgggtattgatggatcgaggcaatttattcgggccgtgaggctgtgctgtcttggaggggttgggaacggtagattaacacgtgattaataaagtattatagcataaaaacttgaaaagtggattaatatgattttctaaagcaacattcatatataaactttttgcaaaatgcgtactgtttgacggtttgaaaagcgtacacacggaaaaaacgagggagatgagttgggaactgatgtgaaagaacacaaccttaatgttgggaacccttccccgtgtaaaataaaaataataaattaacacatggttaattaaatattagttaaaacaataaaaatatagttcaatacgatttttcagctattctataaaaagttctataggaaaatatttggaaagcgtatgcgtaataatggaaagagcaagatgttggagtaagaagtcggtcggcggaacgaccgaccgagacgacgtggaagaaatttccacaccaattgactccgaaatttcgagaaaatttcatttcgtatggtttcaacagcttttcagttcagcgctcagtcaaaagacgtccgactgtcatgtccttttctgctgtacctaggttgatcggagggtctcgagtcaagtcaatatgcctgtaccatatccagcttgctgcaactgtcttcacccggcgccgcaactttcagagccggggataggaaaaccagagctgcagaaccgttcaagcccggttcaggggccacacctctgtttatatctcggtgataacaaccatcaccgtggtttacaatagatagcacatgggactagatagatagcaagatagcagctaacactactactagaaaaataattttctacagtgaggcacatatattttcacatacagacattattttttactacaattatcagcctgcgaaaatatataaagagtggtctaatggttggccaccagaaaaatctattttcataggcagacggcttaaagatgctatctacaataatacacttttttttttgcaggtgggctttttaagctgtccgcatgtgaaaatcggttatggcatttaaataggtgcgagaggatacagagctccacatgatatttctaagtcctcagctccttgtcctcttctctcctctcctctcctctctcaaactcctctctcctcacccaaacggcagcaaaggcggagctcgacgatgtggatgcccacgagagccccatgtcatagagagcgagtggcaaatccttaattgccatatcttaaaagtggcaattctttaagcaggcttgggatattatcaaaacagatctcatgaacacggtctcc

SEQ ID NO: 29477 - DNA, 380 bp, Oryza sativa
gggggggtcgggttgcgcttgccccggccccgagggccgaggcaccccgaccccttaaggaagtctgcgccacatatatgggataagtgagcacagctgtgctcacctaacagcatttattgcagtctggtcaaagcgtgtcacgctgcatgcaacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaagg

SEQ ID NO: 29478 - DNA, 276 bp, Oryza sativa
aataggctctgtcacctaggattgatcactgcatctgatccaaaacctgcatacagagaacatatatatcaaattagtaatgtagtatagtgctgaaatggaattaggcccgagtgtgatttggcaacacagctgagcagtgaaacgtgtaggaactaggaagggaggcggagatgcaggagcatggcggcagggccgtgggctgcgcgcgcggtgtaaacgtaggcgctggggaggcaaaaccgcactagcggtgcagcgcacagccaccgggca

SEQ ID NO: 29479 - DNA, 369 bp, Oryza sativa
atgtgatctatttctataaaacaaatgatgcatgtaaaaaaatttgaaaggccttatcttttcgcttatgctaatacttatcaaccaaaatataaattcgtaactttaaatttggagctaattttaaggtttttttcattaaacaaaaaacaaagtaattataatcagcctttgagccttctcccgtgagtggcatttggctgctcctattggatcgagtgataagcaaggcaaagcatccccaagaacgaaaccgccgtggaactttccggaacagcccggacatgtgccccactgccccctccctcctcacctcctccccctcttcttcttcttcttcttcttctttcactgcggcgccctcctctt

SEQ ID NO: 29480 - DNA, 1161 bp, Oryza sativa
gaatagagcctgctggttgtagttgtgatacttggatttgatgattcagaattgaaaaccctggttgtgcatgattccctggttgagttcttccattgacattattggccccttctggtgcagtggttaaaggcacctaatcaagtaaacatatagaagtcaaataccgagatgtctcaggttactagacctaaagaagtaacaccttattaccgaaaatgtagtgtttgtcatgccaccaggcgtcgcaagacctagggagccaaggatatcccgaacactctgcagataacaggtgggaggaaatcacatcaataaacatataaaggttctggtccccatttagacaggtacatataacactagaacaaagcatataccctagccaggtcatctatcatcccctcagaatgcatagcctctataatttcctagaagagagttaatgaaaaagaattcaaagaaaattaaagttaacctgtagttgttgctaagagttaagcagattggaaattttaagtatacgagacaaagcgatgttagaagcataccctggagatatctcctaacagtccatttccagcaacattaactgcacgtaaaaagattatcagacccatacccagcatattgctgtaatatacctaaaatcaggtacagaggaaatacactctggtaccacaaaaggtagtgccagtcaatataacccaagttgatttgttatgctctatctatatattgtaataactagaaacacagtaatgcttacataaatacagttaaataatggtgtttttagttcacaaattaaatgaaaaataaagcgaaggactgttcaagccttcatctacttagcctgaaatgcttacctagctattttttacaataactagcaataactatttttctgcccttcaaagggcaataatattttatccagtatgagcttgacacaattaatatatagaacagacacatggaaacatggtattgaagagtgaaaacgcacataaattgtttacgatactacgaaaacttgtgcagcacatggctctgaggactaataggtcataggcatatcaggtgcgttctatattgatagtatactcttcaaagcaacccccaacttaacttaccattagcatgggtgttttcatcaga

SEQ ID NO: 29481 - DNA, 1501 bp, Oryza sativa
catctagaaatttagcccaaattttcagactattttgtgtattaagtccctgtccaggaatcagctagggtacacaaaacaacaagtaaatatacagatccaaatataaataaactgtaaatacttacataagaggcacttagtcctcacacagaaaaaaaacagcaacaacggacaaaggcgatcctaatggggctttagctccactccataggcaaaactcaactggggtataagccttggtcctctaacttcgtcttcaactcagaaacactacacttttgaaaaagggtgaataatagcaaggttgagtacaaatattcagcaagccacaccaatgatgcagacatgcaagggggaacaaagaggggtttgtggctagttgcataaaggcgattgcaaacattttatagtttaaaatagtaaaacggttgattaattaaggcactattaaatctccactgaacaacgctacaccatgttgaacaggcccaaccattctacctgatctaaaccaattcattaagtcaagttaattaatagaatgtgattaatcacggtgaatctggttgatcgcccataaccgagggcacaactatttaaatagttttactctggccagatgtgcacaattgtaccgagaagacacaattcaacacatgttgccatgccttgaaggaatttttttgagaattaatattatttttatggaaaatcgcaaaattagcggccatctgttggaaatcgcaaaaataggctcctatcgaatgggggaggaacgacaaggggcttatcgaacatccagccttcgattgggccctatcgaactgtagccatttgacaggacggcctatcgaaccggggttgttcgactgggcccaccacccggtgccgcgcggcctgtcgaatacggggagttcgactggtcccgccgccgcccctgtcgaacaatgggcattcgacaggtccctttatatcggcagcccgaacctagctttctctaaaccgattgaggaggaccacatcgccatcgtcaccattgcagtcgccagtgctgtcgccgtgcgcgctggagggagtgaggggagggtgtgggcggccagagacaaggccagggcggcgccggcctggagggcagtgaaggcaacggcttgaagcgacgacattgaggtataaatttgtaatccctaagtatgaggattacgattttttaatcttatagaagaagacttgtgatttgttaattgtttatcattctccaatgtgactacatatcatatgatacgttaacagttgtcattgtgaaatgtgagtagagatattaaattagtcgtatgctgaaattagttaagttagtacatggtagtacatatatttaatgtttgatgtgtttaaataggtagaggttagtacaactgggtatgatgattattaaacgtaagggtaagatatgtgtcggtcagtaccgtataataagacaatttataatgttttatcagga

SEQ ID NO: 29482 - DNA, 1501 bp, Oryza sativa
tgccaacgcctacgccgacgccgccgccgccgccgcaccatgccaccgccgccgtgccaaagccactgccgatgccaacgccgacgacgccgctgtgccacgccaccagtgccgtgcaacgccaccacctttgccaccgccgcctttgccgacgccgtggccgccactgccgaacgcgaacgacacgtgaacgaactggaacgaacgggaacgaaacgtgtacgaacgggaatgaaatgcaaacgaatgtaaacgaaccttgaatgaacgggaatgaaacacgaacgaacgggaacgaaacacgaacgaatgtgaacggaccgcgaatgaacaagaacgaaacgtgaatgaacgcgaacgaatgtgaacgaaccgcgaacgaacgggaataaaacgcgaatgaacgcaaagttacatgtctcacaaattaatccatgaacctaaacttctactcccctccgtcctagtttaatcatgcagcgcactaatcaaaatatgttcctttgtgtttagactaacacatttttttccatgttgtaggaaagacgtcgtcgtcgtcccttaagccaaagtggtagctagccctagtaggaatttgcgcaggcaagtgatgtaattatatatgagtattagagtattaatatatgattattagaattttaatacaagagtattagagttttaatatatgattatttagacttagcatatatgactattagagttttaatatatgaaacttagacttagcatatatgattattagagttttaatatatgattattagagtattaatatatgattattacgaattttaatatatgattattagagtattaatatatgattattagagtattaatatatgattattagagttagcatatatgattattagagtattaatatatgattatttagacttagcatatatgattattagagttttaatattagaaacttagacttagcatatacggttattacactcagcatatatgattattatagttttcatataagattattagagttttaatatatgattaattattagacttagcatatatgattattcgacttagcatatatgattattagagttttcacataagattattagagttttaatatatgattaattattcgacttagcatatatgattattcgacttagcatatatgattattagagttagcatatatgaatattagacttagcatatatgattattagacttagcatgtattaatatttatcgttttaatataagattatcagagttagcatatatgattattagagtattaatatatgattatcagagttagcatatatgattattatagttttaatatatgattattagagttagcatatatgattattagacttagcatatatgattattagagttttaatatatgattattagagttctaatcaaatattatatacgtaaataacaaacggctgcaaatatttcttgtatgaacaga

SEQ ID NO: 29483 - DNA, 448 bp, Oryza sativa
gtaaagatgtacacttctgatcagagtataatctattcgaatagccgcgccctcggttatgggcaagccgagcaatgtacccaagttagtgttttaattcttaaaatttgcttaacaactaaattgtagaatggttggcctgggttggcttgggacgagctgggacccagggtcgggttgccagttcggtctgaatcatcgtaggccttgggctaaggcaggctcgtgtgggttcacgaccttgattaataatactgtgtagctctaggatcatctttataaaatggctttgggcaactaagtgacttttaaatgctgttttctgcaaaacttaacccctatatcattaccccttgtacccccttgcattaatcatgcatccgccggtgtggcttgctgagtactgtggttgtactcactcttgctcaatcttttcccccccttcagt

SEQ ID NO: 29484 - DNA, 1501 bp, Oryza sativa
aaaagaaactaatagatgaaaaggagttggaagctgtcgaaacaagatttcagcaatactaaaaggggtggctatcaagctagaaaagtggatgggtttgaagacaaggaattttatacaggttcaggcttccttattcaagaagtaataccctactcctgtccggggatgattccgccgagtgtattattgatcgtatgatctgggagaaaatcgtgtcccgagagggacccggacccctccttatataggggaaggggtccgtattacaaaatacagtccatatccctaacggaatatgtgattacagataaaatacaatcgtaaccgactaggatcccgggtatttccttgacatacaagtttagaaactaacccgagtcctcataaagatattctatctatattcggtaccctgtacccaactagactataactgccgtgtagatatggggtatccataatctccacagtagcccccgagacctttgcagtcgatgaaatagccttctccgaacaaaaagcaataatccgagtgcttcaattcctcctgctctggtctgccgagtactaaaatcaaagactgtgaagggcgaaataaaacatggtgcatcgagtagatgcacctaattaggtgtagcccccgagtatgtggttagttaaaaaactaaacatgtagtcaagaaccgagtggttttacaaccaaacatcatatagcaaagcatgcgtggtattcaataaaacacccagccgactgcttcttagctttaatatatcgagaatagaaatatgaaaaggcccgagtgacaaacactcaaaagatccacaaatagacatattttacaagaatccgagtaagaaactcttaaaatgatccgccaaatatgataaaaaccatggtaattaaagaatctaatagcctaggctatgactcttaccacaatcaaaataagcatataacatgccaagagaatgactcctaataaactagtcatctcaaatcaacccaaacagcttttgcagcctaataaagcttacaaaaatagtataacacctttttgtcgggcacctttttatttgcatcataataattccaaagaattatctaaccgcgttaaaaaggattttagcagcatcgggtcacatcattgtgagcacaaattgccaaagcaaaaagcgcctaagtccctagggatcacaacgggccacgctggtaataatattgggctgaagtattgtacaggcccaggcccattagcactcccgataccctaacaaaacaccgaagtccaagcgacgcttcgtcttccccgccgagactctcgccatttccccattcctcgctacagtacaaaactgcgccgacgaagctagggttcatcaatccgccccaatccattctcaaaaatcccatgaaacttctccgagcgtccaccgcaccgattccccatccccctccagctatatctcggaccaaatcagaccattcagctcgcattca

SEQ ID NO: 29485 - DNA, 1501 bp, Oryza sativa
tcgagatgtcatggcacagggttggtgtcctgctgctgggggctcagtcctgcctacctgtcccgggggtgccggccgtaggtggggttgggtcggtactcttgtttatggctaggatgggttgggaactatgtcatgtcttccgtccgtataccgtggtggtatgtggcacgtggttacacgtgaggaagatgtgtcttgtgggtacagatgtacacctctgatcagagtataatctattcgaatagccgcgccctcggttatgggcaagccgagcaatgaacccaagtcagtgttttaattcttaaaatttgcttaacaactaaaatgtagaatggttggcctgggttggcttgggacgagctgggacccagggtcgggttgccagttcggtctgaatcgttgtaggccttgggctaagacaggctcgtgtgggttcacgaccttgattaataatactgtgtagctctaggatcgtctttataaaatggctttgggcaactaagtgacttttaaatgctgttttctgcaaaacttaacccctatatcattaccccttgtacccccttgcattaatcatgcatccgccggtgtggcttgctgagtactgtggttgtactcactcttgctcaatcttttcccccccttcagtaagagatgctttggagaagaagtcttaggtggagtcctggcttataccccagttgagcgcctgtgaagatggagccgtaggcccgctagtccgctgctgtttatttttgattttcaggccttaagtgcctttgtaataatgtaaatattatcgatataataaagatgtgccttttttatcatgtttgtgtggtgtaccccggcttttcctgggacggggattaatacactagcgttcgggaaaatgcaaaattttctcggtcgcgacaagatggtatcagagccatctcgactgtaggataagccaagtggataaaacctaaggacatattttataaatgaaactatttgcgaaagtccctttttcctcctttcccctgtgctatttgcaaaatgtttactctttcttccttcttcaaatttcagctagtactagatggttagttttgcgaagaagaagatgtcgtcaattgttcgccgaaggtccggaagaccgtagggtccgctagcgaagcgaaggaagcaatgaagccagctgtgaagcaggagtgaagatcttggagaaccagtcgcagaacctaagccgtcctctaggatagtgttgttagtcgtgtgtttccttgcttgtgtgtgtagtgcgtggtttgcatcggtgggttgtgatgtgaccatgctaggttgtttgcttaatcaacctgcagaataagcaaaacaaacaacacatcaacaaaaagagttagttcctttaaggtcttgtccctagttctggtccattctttccttgtctgcttcccctctcaacctctaccttgtgacagatggataacactggtaacaaaggctatgggaa

SEQ ID NO: 29486 - DNA, 1501 bp, Oryza sativa
ttcctcctcgccggctcgttgtctcattgcgccgcctctgtcatcggattcgcagcggcgtgttccacgccgtcctcgtctccgtgcagctaccgccggctgcccacgtcgcctcctcgccggccccggtcgtcgtcgtcctcccgtcgttcccggtcatcgtggtgttcgtccctctgtcaagccgttctcgttcgtcgtcctcgttccgtcaagtgccgcagccccgtcattgtcttcgtcctcgcctccgtgtcgccaagcgttgtgctggctgcgtctcgccttcgtccaaggatcgctgccgaagtcgtcccctcgccttttgtctccgtcattcccggccgtctccgccgcgcccgttcgtcgttgtcgttccctcgcctcgtcgcgtggtggtaaggatctctccttcgttgccccgtcctcgtcctttcggtgtcgcccgtgcccgttgtgcggttgtcgaccccggtacccgtgtaccggtgtcggtagtcgtttgcttatgcgtgtggtgaccgtgttagtgtgcccgctcggtagccgcgtggtttccacgtgtacagcccacgtggtgtcttgtggagtccatttgtcggccactcgcctcggttgacacacggggtctgcttccgtcgacccgtcgaccgtctctgtgtactcggtctaccgcggtcccttaggttgacatgtggagtccgcatgtcaacagcgcagccttcctgtcttttccaggctagcacttacacatgttttatagttgtaaaacctaattacaataatccgcaaatctccatataacagcattaaacttcggatgaccatgtcttggtcatacgagctccgaatcgatatgttcaagtctcctaatttttgttataacctaaagaaccgtgtgctttctttttatgtatagttattgcttctttataggcttgtagctttgcttgtgtgcttcgcgtagcttctgtcgttctggaggttcccgaagcgtggttcgcggtcgtcgccgaaggttcggaagaccgttctctttgagcaaggcaagtcacatcatccttgagcatattgaatcccagtttataaaattattttgatttaaattaatgcattatcgctttatttaaattcccgcgttatcactgttttatttagccatgcctatttacctttgttatgaccttattattgttgtattgttattattaccttgttcaccctaggaaaataaaaccccaactagtgggtactctattcatggttccactaggatgaatttaggtagatgcttcgctgattaattaggcaatattaggtggttttataactttagactttgggaattctcatatcacttggatactatggaatggttggcttatgttggaattggacacacacctccccctctattcaaaacccccaaaatggttttaggctgggctcgaggtgcgtggttgggttttgttagtcgtacctcgggtactataaggattaa

SEQ ID NO: 29487 - DNA, 691 bp, Oryza sativa
ctgatatggagcttggaagacgagtggaatttgactagcaaggtattgactaggatttggttgtgtactagtcgatgctagagttgagtagcataacgactaggtttggtatcttctctagccgatgtcgacgaatatcaacacggctagaggaataggaagtttgtgtaggtttagcgggatggaagtattactccgacaaccgtgagtggcggcggagcggctaggatcacacggagcccgaatttgggttttgccgggctttacaactaattgttcgacgtcggggccagtagaccatacggacgtccacatagaaggtgcaaagttctaaccgacggattttattggctaaagggtattttgaaaataaaaggaaatatttgaaaggcaaatataagtttaactcaaatatttattaaaatggtatttgaataaattaaggaaattcaaataaaatcttaaaatagaaaatttggcatcaaaatgtagattttgaatttagatgaatttaggtccaaatttcatcggaatcggatctacggtttaggagatatgggcttctaaagaataggatttgaattaaataggaaaaagtgaaatagtactgtacagggcccacctgtcagtctttcttttcctttttcttttctccttcttccttcttctcgtcttcctcctctgtcacagg

SEQ ID NO: 29488 - DNA, 748 bp, Oryza sativa
agctctagttcctaactctaatttacccggagccggagctgtgccaaacagttcagatcctccgtttttggaagtggagttagctaagctactcataaaaaataaaatacgggggtggagctaaatttttgctgcggcacagttccactccaatctaaaagacccactaccatttaatttttcaacatatttacataaaaatgccaccgaactaccccacctctcacctctctttccctcccataatcctcacctctcccacccggccaggcgcacaggcggcatagtcgacggcttggggtgcgcggtaggccacgggcggcgcacggttggtggggggacggcatgcgggcggtgaccgacggcgcacgtggggatggcgcatgggaggtgtccagtggcgggcgatggcgcgcggccgacagccggtagcacacacggagacggcaacctagggcttcagattggggattgctttttttcccttttttttttctatttagatctagagctgaatgctagacaaacactttttagcttgtccccaactctcataggagcccgctcccactggagtgagagtttagagctagagggccaaaatttgacctttttgaaaattttcattttatttccaaaccatactagtattgcctttgtctcatagcataacgatctagtaccggatttagggtgtggttagttcacgtttaaattagaagttttattgaaattggaatgatgtgac

SEQ ID NO: 29489 - DNA, 634 bp, Oryza sativa
gggtactgtacactgccgcgtgccatgctgcagcgtgcaaaacagctactgtagccggcatgctaatgtctagtaccacgctacaaacggaattgctgctcatgtctctagtcacaccatgacaccacgtagggtacttgacacttgctctagtactagtagtactgtagtaggaagtaactgaggcctgtttagttcacacacaaaaattatatcgaacgtttaaacacctgcatgaagtattaaatataggttaataaaataattaattacacagattgcgactaatttacgagacgaatcttttaagcctaattgctacatgatttaacaatgcggtgatacagtaaacattagctaatgatggattaattaggcttaataaattcatctcgcggtttactgacgaattctgtaattagttttcttttattagtatccgaacaccatatacgataccctatatgacacgtcaaaactttacagccccttaaactgaacacccctgagtcgtcactgttgagcctgtgatctgcacgtacccctagcagccaggctgccaagcccaagaccagcattagcgcagctagccactgtagctggtttggccagcatgtccccttcccctccgagt

SEQ ID NO: 29490 - DNA, 914 bp, Oryza sativa
taacaaataacttaaaacaagtgatttaagtaactttgatgcagaaagtttctagagaaatcatactattaaaagcatggtacgaataattcgcaaataatcctggccccatcaaccaaaaagaaaggggcccaacattggatgagctgacatgctggaatgcaacgaaattcaatctttgtaaataatctgtaataaatatcttaatatttattaaaacagggaatgtttgatatctagcaaaataacaagccagcaattgtttcaacatggcattatgtggcatgtgggatgtgcccggcttcccctttttctctgaaatcttgcttttgtgataagccagcaagcagtgtgtgggctatgtatatatatacatgggaaattgagatgtgtttatgtctctatcaaatggttactgttcggccatgagagcaaaaaagcatgggcaagtgcccacactttggcgacacaaacagtgactgcacactggcactttgctgggtaaagaattaacagcatacttagtttggtacatgtaaagattcttagaacaatatgccagtttgaaccaaaaaaaaggccctcaggaatatcatgctttaagtagctagtaacagaaaattgactataacaaatcaacaagatttactcttttctatcttttggggacaaggtttgttgtattgaggtgacaaaaaaggagaaaattaccggaggaattagtttgtgcttttctctgaataatcacgcacattgacagtcatttagaaagtagtcggaattattgccatagctggtcttgatgattgatctgtcacctcattctgaagtttacatgtttgccgaattgacacttgcctagattcaagatccgacaaggaggtcttgccgatcaacaagaggatgctgaacaa

SEQ ID NO: 29491 - DNA, 1501 bp, Oryza sativa
tcgatgtcattgcactccggtgatcaggttcacctcaatagttaaattctgtctgaatgggatccatatctaagaaattttgaattcagttttgagaaaagaaattctgaattctgtttggctattcatctgcacttctgtactagaaacatcatgatttggtgatagtttaggtgtttgcgaattagacttggggaacaaacttttcttaagaaccaaagttgggatttctgattttaataaacataacggatgctgttgcctgttggcatctctagctgagatgtcattttttctgctttggacagatttatgacatgcaaatttgcaatttgatctgttgctgttgggccagccattacagggtcactcgtttgtcacacgcttgtcaatgaataaatttgtagaaatcagacatccagtaaccaatagcaatatagcatgccagttttaatatttggaaatagacttgagtagttaggtttgtacttgattcgtcctgattatatgattttgtaagagactactaagtacttccaaacatatggttacacaatctttaaatgcatcaaacaagatataaaggttcccaagacttctagcgggttctttattgggccccttttccctgatagggacaaatgggctttgagttaagcatgggttaatgttctacttcgtaagcaacataaccttgtcacaaatggttttattatgcttcatgtggtattgatgcattctttatgtagttaggtgcctggatgaagtgcaattgtaatttgtggattaacaaactaaggataatgttacgcaagtagtggcatttggacataatatttaaattgtaaatgaatgtagcacttaactgtcatgtaatatcttgttcttttattgctgtgtcgaggagcgatttgctcgctgaagttataagtgattctcaaattaataaattaatagctatctgacatggttctggagttttgcttcaaaggcttatgcctcaattttgttcctagatagttatattccagaatagcacactgcatatagaaagaaccaccattaacatctgttaccccctcagttttgcatggttaacttgaatgttttgatagtgctgatctctatagctctgttgaatgtttttgacttgcagttttccagaggatagaatgtaacatatagattttttttcagaatcctgtggtatctcattgttaaggaagttaattcttatgtaacaggtcacatgtttgatttccactttggtggcttgagagcatactctagttgtctgaatcaagttctctgaaagagagaccggagatgagagaggagggaggaattgcttctccggtacaatcattaaatctcttactttttctgtagactatttaaaatttgaaattatttgtaagtgcttgcggaaaatactctcattttttctgtgtctggcaaaaccagggcgaaaagcctattccgaatggtgcttccccaaatc

SEQ ID NO: 29492 - DNA, 546 bp, Oryza sativa
agaatgtatcttgtccaattataggttactcccttcttctcaaattgatcatcatataagggcaagtactataataccccatatgttgtccctaagagtgccatattaattgagtgatgaggtggaggagagaagtgagaagagagataatgagccacccctaaatcaagatacaacctccacacaaattttaaaaaggatgtgagagtattagagatattggtatttgtgtactagaggtgatacattgtatgggttgactcttagtttatgagtgaataaaatatataaaattagaggtggtaggcacctctagcatagcacttgccctaagtttatgcaccaagactaaggataatttaaatcacatcaaacaagacaccatgcacatattctcccacaatgtatgcatccattaaaaccccatgccaattacaccatagcatgcacacattctcccatactgcattaattgtattctgatgaaatccatatcatgcagttatatgatgatcaatttgagaaattttggattttattacatga

SEQ ID NO: 29493 - DNA, 526 bp, Oryza sativa
ataatggtggttgtttagtggaattaagtagtagtacgttagggcagtcccaacccataacactagacatggtttctatgaactccacatcatcaaaaaaactagtactagacattactcttccaatgcaaacaccactattcctactttaatttaatgttacttatctcacataatgtcttggatgttgtgtagatgcaacacatgattttcttctttttttcttatttattcacttgccacattattttttatcatagataacaacttatttaatactatggacaccatctagttattgagttaggaatacccttacacagtagcagcagaccgtggcagtactctctgcccggtcaaagacaggaagtatttatcagtatacaagtaacagctgcggtaacaacatttttttttcttctcccttctcccttttcttcttgagatgaaagtggtagcagcacaggtagtactagtactacaataatgacacattgaagagcagtagaagaggagaggagaggag

SEQ ID NO: 29494 - DNA, 1501 bp, Oryza sativa
agctgcctgacacattctttgagagcatcatctaggtggttcacttgatcatccaaagaggcattcttctgagttgaagcttcgagtaacctcttcagggtactaacttcagcttcagcttgttcccaacctacaagtaagtcaaaaataaagttcaatatgaatttggttccatattggaataaataaaactatgattttcttgagaaggtacaactgaggagacagacgacacactcactccacacacactaacacgcatgtgcagacaaacagaattattggttgatactactattttaactttgccaaagaactatttgaatgagtttcctctttcttagttctattgatgtcctcacatataaaattaattttgaataatgaagggaagccacagactcaataaatgcatgggatcacaataatgcaaaatgtctaaaatcatagtgaaaagaaagattacctgcaacagcctcttctgcaacctttgtatgctgcttcaccaagtcatctttagcattgatagtcaaaagggctgaagcaagcttctcactcaaactcttcacagaatcttgcatatcttcatctttgacatttgtgaagacatctggctgtggtgactgacaatgctgtgtggaagaatcatctgacacagtttccaacactagcttttcatttaaagattttgctgttgcagttccttgagtctcattatctgtaattcttgagcaaattttaggtgattggctatgatttggggaagcaccattcggaataggcttttcgccctggttttgccagacacagaaaaaatgagagtattttccgcaagcacttacaaataatttcaaattttaaatagtctacagaaaaagtaagagatttaatgattgtaccggagaagcaattcctccctcctctctcatctccggtctctctttcagagaacttgattcagacaactagagtatgctctcaagccaccaaagtggaaatcaaacatgtgacctgttacataagaattaacttccttaacaatgagataccacaggattctgaaaaaaaatctatatgttacattctatcctctggaaaactgcaagtcaaaaacattcaacagagctatagagatcagcactatcaaaacattcaagttaaccatgcaaaactgagggggtaacagatgttaatggtggttctttctatatgcagtgtgctattctggaatataactatctaggaacaaaattgaggcataagcctttgaagcaaaactccagaaccatgtcagatagctattaatttattaatttgagaatcacttataacttcagcgagcaaatcgctcctcgacacagcaataaaagaacaagatattacatgacagttaagtgctacattcatttacaatttaaatattatgtccaaatgccactacttgcgtaacattatccttagtttgttaatccacaaattacaattgcacttcatccaggca

SEQ ID NO: 29495 - DNA, 1501 bp, Oryza sativa
aagatttgaaggacctctagcaagtatgcccaattaactgtgtcgaaagccttcgatatgtcaactttgaggaaaagagtaggcttttttttcctgtgaaacgatttgatcatgttctgcacaaacaggacattgtcatgcattgctcttttcctaatgaatgcactttgactttgagaaactagctcatctaattttggtgtaagtctgtttgctagtaatttagctactatttttgcaaaactatgcattagacttattggccggaaatcctccgcttttgttgcatccgcctttttagggatgaggcagatatgtgccgaattgagttcttgcagtcttgcacatcccatatctccaaagaaggaaatagcttgaatgagatctgtttttattatgtcccatgcttgtttgaaaaaggctccaataaatccatctggtccaggagatttttccaaaggcaagtcagagattgtatttttgagttcttcttcagtgaagttatcatcgagatctgagagatcaagcgtagggagattgagagcagccaagtttaatctctgatttctgagagcaaaggctcctaatttttgtgtgaagtaacgcttcaattcttcctccttttgatctttagttacagcaaagccatctggagtttgaaggatctgtatgtgattttttctctttctaccatttgctttgatttggaagaatttagagttaacgtctccatgctttaaccaagtgatcctggctctttgccttagtcgtattctcaagcttaaaattataagaagcagttgattagtagccagcttctgagaatttggaaaagcttggtttcctagcttttggcttctagttcattttctggattctacaacttctcagaatctggaccaaaagctgaactgtttggaggagcttctaattctggaagaaactgcagcagctaaaagctcccctgaacatatgcccttaaacttgctctacaacacctggtgcccactccaatgcatccccaacagtttacagttctaaagtagctaagcatccgcgttggcccatgaggcaacatgggtttgttgacacgcggtgtaaacgttacgggctacgatcgttacagagctgggctgtttgttggcgatcgtactctttgcccatcacgaaactcactatactcccgtaaccaggcccttttgctcgctgtagtgcaatgtctgtggcatcgccccacttatctcatgagcagagttttgtgtgctcatttcactgcccattgcctttgtgcctgtagctggtattcgcatgagggcagcgacctttgctttagcgtattacctcaagctccaggagtccttttatctagcgtatcaaagtgtaagtgaagcacaaccctgtggacggcctatatagcctgtcctcttgcccatttccaaaacctgaatttgcaaggcaacctggcatgattcccaagatgacaaacaaaaaacaccacctc

SEQ ID NO: 29496 - DNA, 165 bp, Oryza sativa
aaaattgtgatgattactaatacaccatatctggacaaatgttcattctaaagggttgagaatgtcatatgcaagactgacaaatggaaaacaatatcttttttttttaactttttgataattcataaactaccatcctgctttttcatgcacagattgatctac

SEQ ID NO: 29497 - DNA, 1501 bp, Oryza sativa
atcatttttatcacattacatcaatcagtatcagttttttcatcatcagagttatcaggaccagtcggtcgaagatcggtgtcctggaacctctcgactacatcgaccgctatcttgtcggcggctttctgcgcatcattgataaggtcaagagcagcttcttcgctcgtcccgtctgcaaagccgtcaatggcatcaatgtcgattttcgagtaaagggacttggtcattgctagcgccagactcgctcccatactcccggcctctttgatgttcttgaaatatgtatccggagcaactctcagcttgtcaaagatttcggaagcatcgaatgtactcggaccgttgttattgaagaacatagcttggacgagtggggtagcagcgttagcaacttcatccctggccccttcaagccttttgattttgccaaccaggacgtcgaattgagcctgcgacttgatcttgcagtctgcatcaacagattcatattaatgagtcagtatatagaagattgatggtaccttcaacgtccttcaaagccgagtccctctgccttgccagctctgctttatcgctttccagagtctgaatctgcttctccaattgagatatcttggcggcttgcactacattgactccggttaattgaagttacaaagatgacagcacaagttagtcggacagattttgtgtgtaccttttgatgagccactcagttcgaagttagactcctggagcagggcgatccgatcccttagatcgtgtcacgtcctgataaattcattcctaaataaaaatcattccctaaaaggaataatagaattaattaaaattcgaaaagaaattggcaaacactaaaatacatacaagaaaaattcgaatgtggcccagagaatttttgttaaattctccttggtctaaaaggagccctcaaattttacttgaattttcagagcaccgaaaataattattaagcaacaaaaacaattaacaaagtttattaaaaagaaagagctaaaaataatccccctcctccctttgggccaagtctggcccaaagtcctctctctctctcggcccgcggccaaagtcctctcttcctccctctcttcctctccctttcctcctctccctccttctcttgggcctcctctccttcccctcggcccactccctcctcctccctctctccccgaggccacctccccctcctctcctcctaggtcggccgcccggcccaagccgcgccacccagccgcgccagcctcccgagccgccccccctcacgcgcgccgcgcgcgcgttgcacgcgcgctgaccgcgtggggcccacgcgccggtcgtcttcctcctcccgcatggcctcctctctctcccgtgaaccctagctcctttcctccctcaaatccgtgcgatttaatcatgggattccaaaattaaatagggggaattaatccccattgattcctctttgatttctcccgttttcccccttgaa

SEQ ID NO: 29498 - DNA, 1501 bp, Oryza sativa
gtcccggccgccattaatggcgccggcaaggttaggggaggagtttccaaacgaatccgagggagagagagagggaaaaatggggggaaagggggaggggatcccggggaataattcccccctattgattgcacgcggggcggacgggggcggcgggattcgcggcggcggcggcgctagggcgcgggcgaggcggcgggagcagcgggaggaaggggatgacgggtgggccccacccgtcagcgagggaggcgggcgggcccgcccgtcagcggcgcgcgcgcggggaggaggccgaatgggccgcgaggagaggagagggagggggaaggagatgggccgaggcggcccaagagggagaggggggaaaagggactttttagagcttttctttttataaaatcattttaactttgtttatttcttcttaattattatttgtgctctgaaaattcaagtaaaatttgagggctccttttagaccaaggagaatttaacaaaaattctccggaccacattcgaattcttctggcacgtattttagtgtttgccaatttcttttcgaattttaattaattctattattccttttagagaatgatttttatttcgggatgaatttatcacgacgtgacaacgaacctgccttaacccaaggcctacgatgattcagaccgaagtggcaacccgaccctaggtcccagcttgtcccaagccaacccaggccacccattccacattttagttgttaagcaggttttaaaaattaaaacactaacttggatacattgccaggcttgcccataaccaagggcgcggctattcgaatagattatactctgatcagaggtgtacatctttacccacaagacacatcttcctcacatgtaaccacgtgccacatagcaccacggtatacggacggaagacgtgacatagttcccaacccatcctagccataaacaagagtaccgaaccaaccccacctacggctggaacctctgggacaggcaggcaggattgagcccctagcagcaggacaccagccctgtgccatgacatctcgactaccgggccgcagctcgtgtagccttcatttgtcctcgagatgtccatcgacccccgacttcgtccatctccatccgtgtacttttgtttataaccagactaagccacaaactaagtcttacccactagacatgtggatgtacggtagtgctttgcaacagaggcccgagcttaatccttatagtacccgaggtacgactaacaaaacccaaccacgcacctcgagcccagcctaaaaccattttgggggttttgaatagagggggaggtgtgtgtccaattccaacataagccaaccattccatagtatccaagtgatatgagaattcccaaagtctaaagttataaaaccacctaatattgcctaattaatcagcgaagcatctacctaaattcatcctagtggaaccatgaatagagtacccactagttg

SEQ ID NO: 29499 - DNA, 1501 bp, Oryza sativa
tgtaactgttcatcaacttgcttcttgacttccaccaactcgttggctcccattctataaggcctcttgtggatcggtgcagttccaggtaccaagtcaatccggaactcgatatccctttttggtggcattgttgtcagatcgtccgaaaaaacctctggatactctctaactatgggaatatcttccaacttcttagtggttttctccactgctacctcttgttcttcaatagcagcctggttcagactgatccctggcttctgtggcactggagactggaaggtaaccacttctcccttcgcattggtcaacttgatggtgaggctagtgcaatcgatcactcctctgtgccttgttagccaatccattcccagaataacatctagatccttagattcgagaagaatgaggttggctggaaaaatcaacccttggatttcaactctcactgacgggcaatagtgagttgtggtcatgccacctccaggagtatgaactcgcataggtatcttaagcttcactaaagataacccatgtgcaccagcaaaacgcttggaaatgaaggaatgagttgcaccagaatcaaacaatattactgccggtgtcgagttgacgggaaatgtgcccaatatgacctctggtgctgactgtgcctcctctgcagacgcatgattgacacgggcctgcacaaacttgggtccagcatgtcttggcttcgggcactttccaaccgtgtgtcccggtttgttacaattgaagcagagttcgggctttccttcgaactcctcgggctgttttgactgagcaggcagagctggctaaactgactgagctggaaacattagtggacttggagtcgggttgaggctgtgcttctcgctgttgccgtgactgccacaatggtagatcctgccgaagctacccgggtggtagggacggtgctgccggataatcatggtggaaggtccaccctaatgtcccatcatgaagcgaggcttctgactgttcccctgggaagttctaaactgagatgccttcctttttcagttcattttgttaccctgctcctcctgacggatagctttgtccaccaacttctgaaagtcctcataatctcgggagatcaactggttggtcaattcatcatcaagacccgacaaaaacttctcctgcctctcggcattagtgcgcacgtcctcaggagcgtagcgcgcgaggcggttgaactcgtgcaaatactctataactgttctggttccttgttgcagagaatggaactctctcttcttttgtgccacaattccctcgggaacctgtgctttattgaaactctgacaaaactctgcccaagtaacctctgtcccagctggacgggtcaccacgtagttgtcccaccaaacagaagcggaaccttgcagctggtgtgtagcaaaagcaaccttctcttggtcgttgcattgcaaaaggttcagcttcttctcaatagcatgaagccagt

SEQ ID NO: 29500 - DNA, 1501 bp, Oryza sativa
ttccccctttgcagtatcatggtgatacttcggggcatggcgacatgtgtggaatcgtatcttgtgggtacagttgtacacctctagccagagtaaaactattcgaatagccgtgcccgcggttatgggtgatcaaccagattcatcgtgattagtctcacccctagtttagcttaatgaactggtgtagttcaggtggttggttgggcttgttgcaacgtggtgtagcgttggacagtgattggttaatattgattaattactacagctgttttactgctttcaactactgcttttaaatgctagctttgtgcaaaagaacccctagccttctttggttatatcctacatcatacctcctcttccggtatgacttgctgagtacagtgggtagtactcagtcttgctctcttttcccccacaccagagctgaaggtctttctagttggagctgtcttgttgaagttggttttgtcgctgccgtcaaggattgcctgtggagtggagtcgccccgctgctgaagtcaagcttcccggtttagctcgcttttatcttttccgctgcatttgtaatcttttctatttttgtaagacgtggatctgtatgtcaacaattgtcatttatgtaccctggctggtcctggacagggatttaatgcacattcagcttcgaaattctggttcgtgaatttctgggcgtgacaagttggtatcagagccgaccttgaccgtaggacaagccaactggaaacctaagagccctctgaacccctttttcatctgcatatgccttttgcacctggaattgtttcgggaaaatttggagttttgcctctttggtttgcgggaaaaatcttggtcgttcattcggatctgatttttttaaaaaattagctcagtctagagctttagaaaaattttagttggagtttattcgacagtcagtcgggaatctattgggggttatgcattaggtcgtgtctatgttcgatggggcaatgttatgcgcatcattttccatgcatccagtctatgcattaatttattgtttagttgcaattgtgtctttatctgggttcatgaaaaatgttctatgcataaaaatcatcatgttcagttatttgtttgagtcatttgttgcttcgtttaatttggattcgagcatgaattggttcttatcccttgtccatctttagatgtcagtcctatccctcgattgcaagcgccgctccgagcttcagagtcgccgcccttagctttattgtcttcctagttttgtttgcctgctagtttccgtgcataggtttgttgctggtggattagtcggcggtcgatatcatgtgtcagtggtatggttgcctcaattaggagttgtgtgcctctctttcagtgttttaatcacgattaagataattgcacttaaacttataggaaagattagtttctgagccccctgtttttcttccttttctcatatttctacctatccccctccagatgg

SEQ ID NO: 29501 - DNA, 1501 bp, Oryza sativa
gtcgtcgccgtcggcagccgcgcacgccaccgccggtcgccatggtctccgctcggctttgaagccgagctgagccaaccgggtgccacccccctcttcccccttgagccattgcccgtggggcccacatgccggcgcccctccctctccccttgtgccgctgacatgcgggccccgcctgtcggcgcagcccgcccccccctcactgacgtcagccctgggtattattgcgcaagaaaataattaaggactttttctttattagtaaaaacacagtttatcttctaaaattcataagtaattcacctgagctccgtttaagtccattcaagtctcagtaaattcataaaaatgcaaagaatccattaaaaatggttttgtttcctgtttcagtagtcttatagcatgttttgcttgtgtgctttgtttatcgcgtagttttcggccgtttcgtcgatctgcggtttctcgaagacgttgctgaggtctcatcagtgcgagagcaaggcaagtcatgcattataattgatcatattgtacccaatttacaaagcataaaattgcaatgtatgtttatgttggcaacttttttttgacaagaagaaaattacgatcgggacacctaaagctttgtggtgatatggagtcgtcaaccaccccgatctagcaaaagctaaatcaagatgggttttgtagaaaaaagctaaatcggctagcggagtagatttagagatcaaaatcagactctagaccgatttagatcgatatgaggataactacccgtctcgtgggcaaacggaaggtttacgggataaacctacaaaggggtattgcactctcgtagtgatcatgggcgaatcgataaagatggactaaactagggtaaagttgcaaacattgttgaaaagtaaagttaaaagaacgattcaatagattgtagggactgtggtctgttttgaatcgaacaggccttagcccttataaaggggttgggttgatctagcattctataggtcctcctccatgtctagaggaccacgtccaactaagggtagaaaacaatggaaactcaaaaaatacatttccaagcaaggaaatccgagacccgatgaaaatcagctcagactcggactctaccggtctggtcgaacacatgccaccagtcaaaccggccctacacgctggtcagaccagccccgtgaaggaaacccgacgccttccatattttggcagattccctatttcgactctaggtgccaaatttgagtgtaaaacacatgcccccactgcctttttgatgaacttatgactaaaagcatagaatatgtagaattagggcgataatctaattactggccatacgggattccaagtgcctagtaaatcgttctctttgttttttcctaacaaatcaacgatcttctaagaacgattcatactactcagtacagacattcccaactagatgattacccaaaaagcactttacacttaaaccctg

SEQ ID NO: 29502 - DNA, 1501 bp, Oryza sativa
gggatatgaatgctgaaaataagttactgtctaggcagaaaattgaagacagtggctgccaggtcttatgccttcaagaaactaaaaaggaaaactttgagctttttgacatcaagaaatttgcccccaagcgcttcggctctattgcttttgccccctccatgagtgcatcaggtggaattcttattgtttaggcctcaagagtcttcaatgggtcacccaaagaagttaaccctttctctgtgactgtggagttaacttctagattcacctcccaagtatggtccttgacttgtgtgtatggtccatgtaatggccccaaaagatcagattttgtgacctggtttaaaaatatccagattgatgctcaacagaactggctttttctaggggacttcaatttctacagatttatctatgacaagaataaagtgggagctaacatgaatgatattttaattttcaatgagattattagttccctgggtttgcttgaaatccctttaaaagggagaaggttcacctggagcaatatgcaacaaaatcatttgctagaaagacttgattgggttttcacctctgcatcctggactttaaccttccccaatacaactgttctccctctaactaggaatatctctgaccatgtaccatgtgtagtaaagattgatacgaaaattcctaagtccccaattttcagatttgaaaatttctgggttgaagcacaaggcttttttgaggtggttcagcaagtttggatgctagatcctggttttcatgatcctgcaaaatatatctcctacaaattaaaaattctgaggaagaaactgaagctttggagtaaaaatttgtccagaatcgtgcttctcttgagtaactctaataaagtaattgattttattgatcttctggaagaagagagatgcatttctttaattgaatggaatttcagggaggtagttaaacattgtatcttaaaacttctggaattcaggaaaatatattggaaaaaacgatgtactaatagatggatgatgctgggagaagaaaacaccaagtccttccaatctattgccacagaaaggtacagaataaacacggtttcacaaattttgaatcaaaatggttagatagtttatctgcatgatcaaaaggcaaatctgttctatcagagtttcaagaataggatgggtatctcttgcttcccaacaatggattttaacttgaatgagctttttgttcctagaacagatttggagtgcttgattgacatgttttgcacacaatagattgatagtctcatcgctataatcccagcagataatgcacctggcccagatggtttcaatggttttttcatgaaaaaacgctagcacatcattgcacatgacttctacagacttgcggctcattttcatgttgaatctacagatttacagattctgaataattcttacatcaccattgtgccaaaaaaaaacttctccagaaacagttaatg

SEQ ID NO: 29503 - DNA, 1501 bp, Oryza sativa
gtttcccatgttttctccagcactcacgctacgcagagaagagtgagagggactggataaggcacttgtcgggctaccggaggccaatccctagtcccgaactcccgatatcccagcatgatcggttgcctcgttcccttgcgaggcattgaagcatgccagcgtcctgaggccgcggaaagcgggagtggctacatagcagcagcggcagatgtgaggcagtaggagaggaagcaaacaacgatgatcggaaaatggatggaaggctttgacaagggatgcaccgacgatgacgggtgcaccgcgccgctcctgaagacaccagaagtcttgattttaaaacactaatttaagggcctgtttggtgtgacaggatggcagccaacaaccacagtagcaaacatacaatttctaccataattattgcagcagcagcactgcacaaccactcagttggacagccgaacacaccctaagtcgcccgatcgactcgatgctagaaggggttcatgaggtgatctctacaagttttctttttgtcaacagagaagccgacatctctgccccggctaagatgctattcaaagcagacaaagaataagaataagaaaagagaaaggaataacaacaacaagcaaagtagacgaagaataagaaaagagaaaggaagaacaacaagcaaaaccgattgaacggcttcaatggcttcacaagaaggtcagttatatcaaaattttgcattaagcaccagatcgatgatcatgtttaggagaaaaattaagtgattaagtaaattagactccaaaattttaattgtatagtactattccgatcccattgtataacagttaggcctcctttaaaactaagtgattcccagcgtcttgctacggggattacttagtacttttcaatatatatttttttttacaatcaagccaagggtaaaaggaaaacaaatgaaatatcaggtcttacagtttttagcataaaacaaacaaatgaatctcgcacttcaatgtggaacatattgataagtttatgttaaatattataaaaaagattagaactactattgggagcactgcacgctcctatattccaagcgccaaacgtgtatcagccaggcccacctcaccccacatttcatcatcccgctcccaccgttatcggagtaaacgatttactttgataaaaacaacttccctggttacgatcccaccccacgtcccttcatcccactcctaccgttatcagagtaaacgatttacttcgataataaaaacaacttccctttcgatcccaccccacgtcccgcatcgtgctcccaccattatcggagtaaatgatttactccgataaaaacaacctctctacttctggtatatattctattttgcccgtacccaaccaacccctctcgcccccacttcattttttttcctttttttccagatctcaatcgatccaccatcccagcccacagatcggcgacgcacca

SEQ ID NO: 29504 - DNA, 421 bp, Oryza sativa
catattttgtctgtttgagtttattttttatacggttggttcctatgttctcctaagtgtgaaaaaaatatcaaaaaaatgaaataaaaataaaaaattgcatctctacgtactgtttaacttatatatgtcatttcatatggttatattttgaattagattaagtaatttcatatagtggtagagtgcattatgtttaacatgctgatcaaagggttttactaaaggagttatggtctaattttagtgaaggtgcaaagtagactaagtggtatgctagatattttcaaacttagctaagtggtagttcgagtttaaattttttttgtggttggttgtatcgtgatcctgagtgtgaaaaaacatccgaaaaaataaaataaaaatgacaccgttgcaactccatacagagaaacaggaa

SEQ ID NO: 29505 - DNA, 274 bp, Oryza sativa
cccgcgaattttcggagcccaagtaacattatcaatacaaagttcatttaatcaattaaaataaaaagaaaaccaatttaaattccccttctttcccttgggccggtttcggcccaagtctgctttgcctccccgcggcctgggcgccctccctctctctaaggccggccgccccgtcccttctcccctcgggcctccggcccagatcgcctccctctcgaagttttttttgcgtcccccaaccgacctcctctctctccctctggccgacagg

SEQ ID NO: 29506 - DNA, 443 bp, Oryza sativa
atatagggtgtgttcagtttgttgctataatcaaccatatcaaattggtaaggtaactgttctaaaaaaattggtaaggtaacaaattaaacaacattttaccatcacaatcttttcaatatctaccaacatttagtatttttagaaacttctactcacaataatatatcaaattaagatgtccaactaaacaccaccttcacatcttgatcctactaaacttttataattgccaaattttaactttaccaataaatacatggtaaggcatttttcttcgcaatcaatgaactgaacaaaaccatagtactcttcaacaggatggggtgtgatgaatatctttcgatcgctcggtagtccatttcctcggtgtcgacttgcttgcaagccaatccatttcaaaaaaaaaaaatttctccctgacgtccaattgaattcaggga

SEQ ID NO: 29507 - DNA, 302 bp, Oryza sativa
cccccccccccccgaaattttttatttttgttttatttgtttgatatttttttcacgcttagggacacacaagaaccaaccatagaaaaattgaacttaaatggacgtaatatgtgacatgtataatttttcctctcctctcctctctttccgaactagtgcagaggagagagatgtgcaacttttttatttttattttattttgttgatatttttttcacacttaggacctcacaggaaccaaccatgtaaaaaataaactcaaacggacgaaatatgtggcatgtggaattttccaaagc

SEQ ID NO: 29508 - DNA, 161 bp, Oryza sativa
agaagacgtgtgctctgcttgtcagaggtcacttccgactgtagattagccctcattgtaaaaagcatgtttcctttcttaggtagcgagaggcccttgtggtgacccctgaccagataaaaaggaggcccaggcctaggagaggggggcgctggagggag

SEQ ID NO: 29509 - DNA, 308 bp, Oryza sativa
agggaccaggaaattaatcttgtttttgtagcaccagccaatagcactgccgcatgtataagacacctatctgtgccactacctgaccaagtgacagccatctgattaattaaatgcaacagtaatcgatcaaaagctctggttacggaggaaatcgacacggactcgacgtcagccaactggagacgacgtacaaaatattcacgcaaaaacatcttaaacttttataatagtagatagatatgccaaaccaaattattatagtcattatatcatcttgctacaataactttcactatcccaaaata

SEQ ID NO: 29510 - DNA, 477 bp, Oryza sativa
atttgcgtgttcattggtgagtttgtagtgaatattgaagaaatctgttgatcaaaagattttatgtttatgttgtaaaatggaaataaaaaaatgtgttctatttctttactattattttaataaaaacaagtgaacgaggtggttttttaaaatgcgaatactaagatttgaaaaacgtgtcttgcatactagtatgttctataagggactctcattgtaatgaagtattgatagggactctaatcaggcctcctataaatcgttattgatttgtcaaaatatctctggaaaagaattactactacctgccggcgatcacaacaccgatttggacaggttttattgtttgagcacgacgcgaaatctaacaaaagctgctccacacgaacactgcttgtagaaaatgacgataaattcacaggctcacagtgcagtggcccatctctttggacggagagggccaccggagacagg

SEQ ID NO: 29511 - DNA, 1501 bp, Oryza sativa
gtttgttggcttttgcctagatatattctgaatagaactttccattactcatttaatgatctgtcctccatatgcataaacaaaagagtttgtcctgattaaatctaattgcattctaaaccccacaggcaccagataactctcaatctttagatagatctcatatgcatgcatcatattgatattcttttcatgtacttgtttttatggaacctctagtgcctaaccttattatatatcaatcagttcagatccagccacacgcaaaaagttggccaatcttttggccacttgctaattagcagcaaatgcagcttgtagctccatgtgttgaacactccaacaaccatagtagccggattcggctcccctatcttgagagatgtatatgaacagttagtctcaacctaatgcatggaattcggccataatcagggctccaaagtactctacaaaagctatttcccagtcaaaaaggttccaaagtgaaataggcagtcgtgacttgtgactctgtgaggggccgttcgaaaggcaggagtaattttggtgaaatatatatctgcaatagttatggtaatttaattctatcgcagatatatatcttcgcatgcggacgcccgccccgcctgcgaagatcggcgatcttcacagtcgtttgcttacaggcggacggccgcctcacctgcgaagacacatttccaccaccggcggtaatgcattttctagccgtgatatatcacccacgagaaaagagaaccttgcgtagacaactaaaagaaattctaaatgtgctttacgtgaatgtttgaattcctttcagtttgtataaaatgacaatttaatattggaatcttgagagttcaccagtataatccggccgaacatgcatattgatgaagaaagggcttgaatgaacattattgtagctctgaaaattaagtaaatgaattgtaacaataatattgtatatcaattataaaacacaagggaaaatggagagctagcttttaatatgtccactgacatgtaagagcaaaagctgctgagaatcttctaattaaatttctaattcctgcaactatagatttctataatcaaggtgaaaacttagactatttacgagaacttgagattgagattttagaagaagttacaggcttacagctatcaaaaactcatcaaattgagacatagtcttgtatgttatttctatccatttgtcatatcattttctttttttttgaaaaagaaatatcagcaaatatctactactcctactttaaagggtcgtcatccatccgctcctttccatgttgtgcaaagaaaaaatatccgttgggcctagtgcttggtctatacttgtatatcccagtatataagcccagtatatatatccatccttagtaatataggtctatcgtaatacacatttatgtaacctcttcttattttgtctagtttctttcctaggtagtctactgttgtctctctgtcgacg

SEQ ID NO: 29512 - DNA, 340 bp, Oryza sativa
tctcagatccacctatacattactactatttaataagaggtattgtagtattttttttctaaccctaatacatgctaaacaacctagaatgggacggaggtagtaacatttttcctcgttgtttacacgattaatcacctcataactcatgaaggtgtaagaggtattgtaagaggtattgtgtaagaggaaagaattggtcctcataactcacgattaatcacctcattactactatttaataagaggtattgtaagaattgaggttgtgtatgaggaaatctctaagttgcgatgagcgatgcgtgctaacaaaaaaaaatattgtttaactttgtag

SEQ ID NO: 29513 - DNA, 1501 bp, Oryza sativa
ttaaaaccggcatctatttctgtcaggggtaaaatgtaccggtttcctattaggagataaagatgccggttcttgctattttggtgggttggcgggcgtgttggcgggaaaggtattatacgtaccggttttaccacttttggctcctatagtgtcggcatctatttgatgttttgtagtagtgagtctttaccagcaggtagataagtaggaccagacgtcgacgaatgaggctagatagatggcttcgataagaaaggttggcggtataggcatcgaggaggagacgagcaagaacatcatggtagctgtgaaagaggagagctcaacatggcaaagaagggagttagtgttaagtccatccatatagagatggagaattattgagggtactctacaacgttgtccatgcagtgataatcattgacatgtagatttatgtgtcctatctaatcatctccccacagtggcgaagccagaaattactaaagagtagggctaacctagggctcaactaatgagttgttgatttctctctaaacttacatggtgatttaacataatttatacatgatattggaagcaagcctagggctgcctccgcccctgtctccccataactatcacttgatgagacgtgttaatgttaataagactctagttaaaaattctgctttccaccgctagtcccgagctagagggggatagagaaaaggaaagtgaaatcggtgtttgaaatgtatgtctgcataaatcttgtgacgaactaatagcaaatattcgataatcaactttaaccttatttcacaagacaagtaataattaagagccaatttgatagagctctaaatctgtagtggatttgaagttatggagatgaaaaaaggtaaccccaccattcctatatattttctagagcagatcgatttactcctaaagttgagaattaagtaacgtttggtctgctctagcttcaccggatacggattcaggatttagaacctagcaaaacagaccctaagagcaactccaagagattatgtatatgattagctaagtttagagagtaaagaggtctgtaaaaaggaaaaaagatcccaacaagaggggtaaaaccaacagcctagctaaatattgactctccatattcaaaagggtccacgtcacggctcccgttcttccggaccggttgactccatgacttctcgtttctccgccgccgccgctggtttccggccatcgcttggacgtcgttcacagccggctgcttccttctgcacgtcgctgcctctcgttgcaccgcgtcgccgtcggcagatcgtttatgcacgccgcgcgcctccttgttgcgtcatcacgccgccgccgaccactcatccaacaggtgcgtacactatcgccatgtagaggaagattggtactgcagtcttgtgtgaattcaattaacatcagtagaaattgatcagtcttgcgtgcagggtatggagtccgatgatgaatt

SEQ ID NO: 29514 - DNA, 156 bp, Oryza sativa
ggaccacgtccatctgattccacctccggacttgggccgcacgtcgtgttccaccaacacatatgggccgcttgttagcggcaatcccgttccacttatatgggccgtcataaacgggtattgagatctcgttccgggctcacaagcgacgcgtca

SEQ ID NO: 29515 - DNA, 680 bp, Oryza sativa
cccccccccccccccccgagggggtcaggccacgtgggtgaccgcagctacccaagcctctagtcacgatacccccggccccatgtcaccgacagtagcccccggcgttatgccagggcgatcgcccctctcgagggaagcgctcgggcgtgacgccactccttagatccggtgacaggtggggccggtccctacaggcgggcagaaacccagcggtcgcaaatcgcgcgcatcggcaagggaaaaccgaccgacaacaatgagcggcttctttaagaccgctacattactcgagcagcgcgcgaatcgggacgagccggttcgtttcgcctggagacatgatgatggcgcttttcacggttggcgagcgtagttaatgcgtgcacaatctgccccatctcaaccgccacggccgcacatctgccgcgtgcgctgcaaacgggcgagtggggttagtggaggcgtggacgcgagaaacgagggggcgcggtagtgggcgcgggaagcgaggagccgggcatagcgttggcaagggtgtaaagacgccgaggaagggattcgtttctttcctcttcgccactcttccccttgccttcgccacttgtgctctaactcttcgtttcctgtgccctgcccttgccgcactcgctcgctctcaagctcctcctccgccggcgtca

SEQ ID NO: 29516 - DNA, 1501 bp, Oryza sativa
gtgtccaacttttgaccgtccatcttatttgaaaaaattatgaaaaaaattaaaaagataagtcatacataaagtattaatcatgttttatcacataacatcaataaaaatactgattataaaaaaatttcatataaaacagacagtcaaacgttggacacggaaacccagggtttatcttttttgggacggagggagtactaacctaccatcggttcgcaaatcaagaaaaattttatcttttaaatacccctcacatacccatcaatacaacttttttattaattagggatagtttggtcgtttgtcttcctccttaattttaccttgggaagctagggtttgaaattttatggatagagggagtaacaattacaccacttttagatgacatgcatggaacatatacatgggcaggtgtgatgtgttcgaccatatagagccctaaattttagggtttaatccattttaatacattttactatgttttaacattctcatgttgttttgtagatttcacatcctcctccaatgatctagctagaacgagcttgttactgttgtctttgataagtgttcgatgatcattaaagccacctcaaatgcccatagcccacgacgacaatgtaaacacatgttcagtgaagatttcatttttatacttcgtaaagaaaacattgtcaagccacctcaaatgcccatagcccattctaagtttgaacaaattataatcattgacggttggtaagcttcctcggtcaaccatctatacatatattgtgttctactactactatataaccccagtagtcattagtcatgcactattttattttaacgagtacattgtacttatggataattcttctaatatggatggatagaagatgcataaacaggagtggatacttctaaaattataaaatacgtgacattaagttgaaaagtggcttaatggtgcgttttatactacatactcctaacttttacttccttatatttcacgtgcatactttttaactgctaaattatatttttttaaaaaaaagttatataaaaagttgattttaaatatcgtattaatttattttaaattctttaactaatccttaattaattatgctccaattcatcgctccattttacgtgttcctaacctcaaaacaacacagcctaaagcctaggtctatttgtacgtaacgttagtctatatacacaatacaaattaaaatttactcctttgtttgacgatatcttttcgttatggatttagtacccgggccgccaatttacagtgcacataagcttgtagccaacaaccgaccgtgctatttcacattccctaacgtaggagtgtcttttactcccctgttctaaaatataataatttttagtcttaatatttgttccaaactattgttataaaagttagtcgatatagcggaacaacgactaaccatcccgatcgtttcagtcatatgatcacccaaggcatccagat

SEQ ID NO: 29517 - DNA, 583 bp, Oryza sativa
aggtgtcccgatcgtaattttcttcttgtcaaaaaaaagttgccaacataaacatacattgcaattttatgctttgtaaattgggtacaatatgatcaattataatgcatgacttgccttgctctcgcactgatgagacctcagcaacgtcttcgagaaaccgcagatcgacgaaacggccgaaaactacgcgataaacaaagcacacaagcaaaacatgctataagactactgaaacaggaaacaaaaccatttttaatggattctttgcatttttatgaatttactgagacttgaatggacttaaacggagctcaggtgaattacttatgaattttagaagataaactgtgtttttactaataaagaaaaagtccttaattattttcttgcgcaataatacccagggctgacgtcagtgaggggggggcgggctgcgccgacaggcggggcccgcatgtcagcggcacaaggggagagggagggggcgccggcatgtgggccccacgggcaatggctcaagggggaagaggggggtggcacccggttggctcagctcggcttcaaagccgagcggagacca

SEQ ID NO: 29518 - DNA, 1501 bp, Oryza sativa
ggaaccagggcttgaaccacatcaacgtgctttccttatgaccaaattgactgtaataaaacatccaaatctattgccatgacataatcgagaggatattactataggtaattttggatgttacaatatatagtgaacgagctgtaaagaaaagggtgaaggagttaccgaaacgggaacacgactcctctctttgtgggcaatgaatcaacaccaatgtcattcttgttcgtgtcttgattcgccgatataggcattgatccaacctaaaaggaaaaattgttgcttttgttgcaatttgaaacagctgaaggatccatgatcacaccaaactccttgtccatgttggatccaaatagactatcaagttgcaaatcttccaactgtttgttttcccaaagctcttcttgcatccttggcagcaacattgggaaggtaatcaacaggattagttgaatgtcatctggagtgtaccttatcctttcctcaccgtatttgtccgtgccatgaacaattgcattcctgtaggacttcagaaagtcagtgatttcctttttgtagcacatatctttctcccgcctgaacaattttttgaggagattatcccctttcagtttcttgtgccaataagatttgtatggcatatcccctgctggtttgtcacaaggtagcataaacatgatgtgtctatacatccacaggaaaaatgtttccctgttccttagagggacaagagaagcatgtgtacagatgagatactccaactccatactaatagccttattaggattgttcatcaagtttaggagatgcttcacatctttaggtatatcatccttgtgttgttgcaacactatttccacaattattttgtgagcatcctggtagttttcaaataccttggagtcgctcttgtcatcaagattacattctcttatttctgctatcccatcttctctgataaagacatttgattcatcaaaatgctgtgggcactttcccattttgtggaggaaatacagctctatgagaagtgctctactgacaagcttggctttttcagtcatgatgttgtccataattggttcagcctccttatattgggtgagtggtttgaattcctcatcgtgcatgtacttctcgtaactgatttgatgcattttgctgttcaagtaaacaaaaaaaagtagcacaggtcaattagtttcaagaagcattggatactaatgacaatattaaaagaatgaattgatgaacaatacaattactcttcactaccaagcaatgaactcagtggacatattgagacatcacgtactaaataatggatcaggttaaaattagaggttgaagaaaacagtcgacagaggtccataaatatgccacttactatctgtctatctccatcccgaaaagcatataattctggctagatgcatagccaacttacaattttttttttaacggagctagtactctctccttttcaaattgatcatca

SEQ ID NO: 29519 - DNA, 1501 bp, Oryza sativa
tagcctagcgccctgaacaattgacatatagcacggagaaggttaactcaatagaaacaagtaaatcatacctctcttatgaatttggcttgaatagcagctataaagctttgggagtgtaaagctggtgaaaaaccctgcaaagttccattaaacacaacaagcttcagcagagcagtcaccctaaacattgatattcttctttgtgtatacaatcgtacctgtggccagaagtctccatactgtaaccagactaccgtatttagcaccaaacagaagagcaggtaatacctaagattcggcaacaatagacttctgtattactcaggggaccgtttgtgtgccaaaagaatgtcatcaaattcggtacatgcttactttgagagtcatcgatggttcaccagagaagatcacttgtgcagttgatatcatggagtttgcaactggcaacacggctcgtgcagcacgaagcacatcatcttcagtcaatctgaagctccttcccctctctacctgctgcctgctgcagatgagaactcagattgattgccttgattgaaatgggtttacaaacagattgccactggctcatactgtcatacctctgaggaatggaatctttgaagaaggctaagcccaagaccatcacacccaagtgacaaagcgccgagattgggctgcagatcatcacccgaaagccgaaactcagtaacagtacatgatcaaaagaacgaaatgaactgcaaagcaggaaatccaggtagaaggggatcagattgcgcaaacctgaaggtgatctcccttgaaaaggagcaggagaagaagaacatggatcccaacccaaaccagagtgccgatttcgccacattcttccacatcaccaagtcgacgatcctttcccagagatcttcccacccagactgctcgagggcatcagcacctgcgccacaaatcgagatccgattagacacgaactcgaggaggcaattccccatacacaacgagagcaagagcaaaagagagcatctggagcagtgattttctcgaggcaaaaattagccccaaaccaataagaaccaacaagagatggcttcgctaacctcgtatcgcatcggtgctagccagcaccaacgccatgctcgtatcctccttatccgccgccgccgttgccaccttgtccgcggccgcaggcgcggccttggtcgccgccgcccgggtggacttcctcctgcgtgccctccgcgcggcgtcgtcctccacctcgatctccttctccagcctccgcctcgccctccgcccgttcctcggcgacgccaccgcgggcgccgcgcactgctccgcggccacgcgccgcctccgcctcggcggcgtccccgccgccggcgccgccaccatctccaggctctcgtccaacccagccccgcgatgccgcgaccagttgcggcgcgccgacccgggcggcggggacatcaggaggagctcctgcagcgagcaccccgac

SEQ ID NO: 29520 - DNA, 1501 bp, Oryza sativa
aaatcgtttactctgataacggtaggagtgggatgaagggacgtggggtgggatcgtaaccagggaagttgtttttatcaaagtaaatcgtttactccgataacggtgggagcgggatgatgaaatgtggggtgaggtgggcctggctgatacacgtttggcgcttggaatataggagcgtgcagtgctcccaatagtagttctaatcttttttataatatttaacataaacttatcaatatgttccacattgaagtgcgagattcatttgtttgttttatgctaaaaactgtaagacctgatatttcatttgttttccttttacccttggcttgattgtaaaaaaaaatatatattgaaaagtactaagtaatccccgtagcaagacgctgggaatcacttagttttaaaggaggcctaactgttatacaatgggatcggaatagtactatacaattaaaattttggagtctaatttacttaatcacttaatttttctcctaaacatgatcatcgatctggtgcttaatgcaaaattttgatataactgaccttcttgtgaagccattgaagccgttcaatcggttttgcttgttgttcttcctttctcttttcttattcttcgtctactttgcttgttgttgttattcctttctcttttcttattcttattctttgtctgctttgaatagcatcttagccggggcagagatgtcggcttctctgttgacaaaaagaaaacttgtagagatcacctcatgaaccccttctagcatcgagtcgatcgggcgacttagggtgtgttcggctgtccaactgagtggttgtgcagtgctgctgctgcaataattatggtagaaattgtatgtttgctactgtggttgttggctgccatcctgtcacaccaaacaggcccttaaattagtgttttaaaatcaagacttctggtgtcttcaggagcggcgcggtgcacccgtcatcgtcggtgcatcccttgtcaaagccttccatccattttccgatcatcgttgtttgcttcctctcctactgcctcacatctgccgctgctgctatgtagccactcccgctttccgcggcctcaggacgctggcatgcttcaatgcctcgcaagggaacgaggcaaccgatcatgctgggatatcgggagttcgggactagggattggcctccggtagcccgacaagtgccttatccagtccctctcactcttctctgcgtagcgtgagtgctggagaaaacatgggaaacagtagcagcatgcatgggtagcttttgaatgtggatttggataaatatctatatctatactaatataaaaagaagttgcccccctccaatgctacaggccaaatcatcccccaatcatctttgtcctcagccgtccgatctgttgatccaacagcgaaatcaccgattccgccatcccaccaccacacaaatccaccgcgctatctacgcccccacgctctccccgcgcgat

SEQ ID NO: 29521 - DNA, 1501 bp, Oryza sativa
atggccggtccctcgctaaggcgcccagcagatccggccagttgcctcagcaacagagagtccacggacctctccgctgctctgtaagaggatctggactcttctgccaacgaggccactgtctgatccaccatcgtaggggattctttccgttccctaaatgcaccacatatcttcccctccggaaattatttttttcaaatgaaattgatagaataccaatggctgttgtaacaaggtaatttgccctcaacctttagcttttcaaattagaatcaatttaattacttctttgtttacgcgcatcattttaccctaaagactgatgcttgcactgatgtaccatgttgtcatgggggatgatctagacgtgaggactgacaagccatctcttgatatgtttcttgctgagatgaggaggttcgaggtattgccatgtaagtgctctcacctataatgttctttatactaaacacaatattataattttacctggcacaagtgcattgcatgttgttcgggtcaatttggaaccagtatttcaagctccttcttctgtagcagcagttaaaaattgctggaatgtgacttcgctcctcctcgctcctgtgtactgccgccacgccgccgcatcctcgccggagccactttcttctccatccaccgccggagccgaggtccatcttacagtttaattcctcactgaatgttgactatccctgccaatccatcacacgattccctctgaatgctaatccattcaattaatttcctgcactggtaatatctctcccatagtggggaatcatgtgtcttttgtacaaattacataggttattaaactggattctccatttcactttagaagttgattttcttgctttcttggctatatttcctgtcatcacatcttacatttacaagtaggaacgaaatgatggccgactaccttcttgatcactgcgatgtgccccttcgcttcaaggatatgcataaatccaaggtgattctcatcttccaaatctttatctcgatatttcccctaggaataaaagattccaaacccatattcacctatttacagtgagcattaggatcattttatagaaaaagatatcgaggtgatctagaagttattatacattaggtctgctgcttcattataatagatcatatgtgtatttctgaatatatcttctttgtttggtttttcccagtccggcactctgctactattctaggtaccggactacaacctgtaatattattttgcggtgtactgattgggtggttagatttcaaaagcaatttcaaattatctgtcctgtccaataactattgccagattacccaggtgccatgtacaatactatttttttttaaaaaaaagtggcactgaggaagtttgagaaccagtatgtactcctaccaatgaatatcacatcatggtgtttcaggttttgtttaagtttggaaagaaaatatacataatttgtggcaa

SEQ ID NO: 29522 - DNA, 259 bp, Oryza sativa
tcttgcacatattgtaagtaaaggtataaacaaaataaacatgtatgcattagtatggaaaaacatactgcaacaataagggaccactaatgaatattcaaatatttttatataattgagaaaaaaaatatggacatagaagcttaagcattaaatgaaccatggtgcactttggttcaatttgcagtacaccatgaactataacacttcatcccatttgtgcagttttttatgcaatttatctagcacgatagaaaaa

SEQ ID NO: 29523 - DNA, 304 bp, Oryza sativa
cattagtcattcacacacaaaaaattgtggggctcactgacatgtggaccccacatgtcatcctctctctgcctttcttcttcctcccctcttcctcccttctctctttctttctctctcttctctccccttcggctggccgcagggagcacgggcgactgaagctggagtggcggcggtcgggggccagagcggcggcgaccgcgggagctgaagcggcggcggcggcctcgccatcggcctcaccaagtggagagaggagaggagaggagaccaggtgagggaagaacggaggtggtgggta

SEQ ID NO: 29524 - DNA, 434 bp, Oryza sativa
attctacatgtcacatattttgtctgtttgagtttattttttatacagttggttcctatgttctcctaagtgtgaaaaaaatatcaaaaaaatgaaataaaaataaaaaattgcatctctacgtactgtttaacttatatatgtcatttcatatggttatattttgaattagattaagtaatttcatatagtggtagagtgcattatgtttaacatgctgatcaaagggttttactaaaggagttatggtctaattttagtgaaggtgcaaagtagactaagtggtatgctagatattttcaaacttagctaagtggtagttcgagtttaaattttttttgtggttggttgtatcgcgatcctgagtgtgaaaaaacatccgaaaaaataaaataaaaatgacaccgttgcaactccatacagagaaacaggaa

SEQ ID NO: 29525 - DNA, 323 bp, Oryza sativa
gcaagttggatgctttaatcataataacttcaccaggcataaacatggtagactgttctcatgtgctacctatttgcgtcaatcttagcagattgacataactggctaatacctcatgcccatgccttttagtactctcttcattttctgcaactttataaatcacggcattgagcaatgttctgagatctttagaagtcatatagaattaccttcggtgaaatcccctttttcagaaagaaaggaagcacacgtgtatctgttgattaattttagatgttatacatatgctgattaatcactcatgttctttgttggaagga

SEQ ID NO: 29526 - DNA, 1501 bp, Oryza sativa
tctccaccgtgctccctctctccatcggtccccggcgtgctccggccacctctagccgccgccctagccactgccgcgccgcgccgtttgcgccgccggcttctccgtgcctcgccgcaccccggcctccgctccgtttccctatttaatcgccgcaaccacccttccacagtgcatcccaagccacctccaccctacgccgccgggccgccgttccgccttcgtcccgaggagcgccgacgccgagctcccccgcttttccccgcccctcgtcgtcgcgtccttggtgagctcctcctctccctccttgcctccctcctctgtctcccgtgcgtgctgccgcgccggtggccgccgccggcgaccaccgggccgtgcgtcgccgccgttaggtcggccggccggcttgtcgccgccccgctcgcctaggccgcccggatccccttgccgcgccgcgccgccgctttcccgcgtgcgtcggccgtcgccgcaggaggccgcgccgccgtgagccgttgctcggccgggccggcctaagctgtgcccgtgctcagccgcgccaccccgtggccgcccgatcagctcgggctgatctgggccgtcggttcccgtggaccggcagtggaccaccccgtggtcccagttcacggtggaccactcccttgcccgctgtcatgtggggcccgcttgtcggcgccgctgccctttgatgacgccagcaggagccttttcctttgataaaataattaacaattgcacaataattcgttaataattctagaaattcatttaaatggctcaaaacttctaaaattcatatctaattcattcaaactccgaattgagccattcaacttgcaaaattcatctaaaattgagctctacatgtttgtttactttttatgtactgtttccttggtttttattagagtttttcctcgttttgcgtgcctgcgtgtagaatccgtcatttcggaagatcacggtcgcaaggataagagttcggaagattgtttgaagaagcaaggcaagtcacacattccccttgagcatgttgattccaatttataaatgttttactgtttgcaaataaatatgcatattttgctaattacatggggtcagggttttacctatctgctcgcttgtgccatatttacttgatatatgtcctttgtcaacattgggtaataaatcgactagctcatgttacttatgtgacctagctagaactatatgcttagccatgcttaattaccactagctcagttgatgggataattaccgtattagaccttttagtatcagaatgagctgcgtgctcgagacatctggccatgcttcatggtcgtaattatccaactaaaatgcgactgaatggtgggctgtgggtgcatggttttgctggtcgcacccatggcagttaaggacggctgggcaacggctgggcttgtagtgtagctttcctctagtcgacgcatccaggcaagggtgggcgtga

SEQ ID NO: 29527 - DNA, 1501 bp, Oryza sativa
gtaggattttaatcgtagtgtaaaacagaggattacaaaacgcaggacaaaacacaggaatgaccgttcgattgaaccgcagtaattggattggatgagagatatagactcaaaagaaagttaccaagaggttgaagctcttgctaaattttctccaaaatccctataggattgttcattccatagaaatttcaaaggattagatatgattcaatcttttgtttcaaagggcttcataggaaattttcctataggattgaaatactaaaaaattcccatgtttttcctccaaattaaaggggccctaaacaagatcaagagctttattactccacctgtggctccgtcccaaattatagggcgccccctttttaaggaaaatcaaatttggtatcttttgactaataaccatactacctatatatatactaagtataatgcatgttatatcattatattcatattttgaagtaatttcatgtgatgctaattttatatttgttgggattatagaatgaaataaaatactggtcaaaatatattatatattattgaagaccacataaaaatatagcgcttataatttggaatagacagtattttttaacatcacatctagccactgttgccatcgcctcaacaccctagcacgcttcccctggcttaggccaggcctgccacaccggacacttccccctcccctctcctcttcctcctcaagcttgttgccatgttgttttcccaatctctaataacttccgtagcgctggagacaccatcatcaccgacaccgacaccatcatcacctttgacccctctcatttcccttgccttcgcctccgacaccggactaacatggtcctccatctccgtggcttcagctacagcgctgccatttcacaatcaacccattcatgtttaccacttaccactaattatgtccatctctttgaagcttagaaggtgtttggatcctttagttgtaggactaaaattagtcctaggactaaatccatacctgtttgaatgtagagactaaaaaaactaaaggtcaataattgcactatataaagaccatgttaacccctaacaccatgtaaagagaggattgtgcatggggcagtgagtagaaagaagcaactttaatccctataagctcctttcatagggactaatggactaatgcacttttaatcccttttagtcatccatgtttaagactttagggactaaaggggattaaagtgaaggggctaaagttttagtccctccaaccaaacaggctcttagggaaaccaaagtcccatcgaatatcatcgtttaccaacttaaaaaaaaagcattagagcaagtttaagattgagttcaatggtgccttttcccaagctcaccttacttgtttttcgcgcgtatgcttccaaaatattaaatggtgcattttttttattttttaagttgctttaaaacaatcttagagcatctacaacaacatggctatttt

SEQ ID NO: 29528 - DNA, 1501 bp, Oryza sativa
tcctccggtcggtcgttcgtcctcgccggctcgtcgtctcgctgcgccgccaccatcgtcgtcatcgcagcggcgtgttccgcgccatcctcgtctccatgaagctgccgccggctgccctcgttgcctcctcgccggtcccggtcgtcatcctcatcgtcgtggcgttcgtccctccgtcaagccgttcgcgttcatcgtccgcattctgtcaagtgagccgctgcagccccgtcgtcgtcttcgtcctcggctccgcgtcgtcaagcgttgggccggccgcgtctcgccttcgtccaaggatcgccgccgaagtcgtcccctcgcctttcgtctccgtcgttcccggccgtctccgccgcgcccgttcgttgttgtcgttccctcgcctcgtcgggtggtggtaagaatctcttctctcgctgccccgtcctcgtcctttcggtgtcgccccgtacccgttgtgtggttgtcgaccccggtacccgtgtaccggtgtcggtagtcgttcgcttgtgcgtgtggtgaccgtgtttgtgtgcgcgctcggtagccgcgtggtttgctcgtgtgcagccctcgtggtgtctagtggagtccgtttgtcggccactcgcctcagttgacacacggggtccgcttccgtcgacccgtggaccgtctctgtgtactcggtctaccgtggtcctttaggttgacatgtggggtccgcatgtcaacggcgcagccttcctgtcttttccaggctagcgcttgctcatgttttatagttgtaaaacataattacaataatccgcaaatcaccatataacagcattaaatttcggataaccatgtcttggtcatacaagctccgaatcgacccgttcaagtctcttaacgtttgttataacctaaagaaccctgtgctttctttttatgtattgttattgcttctttataggtttgtagctttgcttgtgtgcttcgcgtagcttctgtcgttcctgaggttcccgaagcgtggttcgcggtcgtcgccgaaggttcggaaggccgttgtctctgagcaaggcaagtcacatcatccttgagcatattgaatcccagtttataaaattattttgatttaaattattgcattatcgctttacttaaattcccgcgttatcactgttttatctagccatgcctatttacctttgttatgaccttattattgttattgttattattaccttgttcaccctagattaaaccaaaccccaactagtggacactctactcatggtaccactagtatgattttaggtagatgcttcgctggttaattaggcaacattaggtggttttacaactctagactttgggaatattctcatcacctggacactatggaattgttggatcattgtggaattggattcacacctcctctctattcaaaaccctcaaaatggttttaggctgggctcggggtgcatggttttgatagtagcacctcggccatataaggaccggt

SEQ ID NO: 29529 - DNA, 1271 bp, Oryza sativa
aattggcctccgtggtcctcccctcccttggttgaattgcataggaggcatatgattgaacattggcggcgtcggccccatggcatgaagcaaggataaggataacccacggcggcattggataggaaccccatgacatatcttgtggataatgatacgaaggtgaacgcgaccgtcttggtgaatgaccaaatcgctccttagaaggtgatcttggtcttttccctttgttgcgaattttctcaccaccttgcttttcatatttctccaaaagcatattaaaagtcaccttggtcttcctaggggctttagaagttgaagctccactcctattctctttccaaacgccaacctccggcttctttagcactatcatcttggaccttggttcaccaatgaccacttccttccccttagtagattcggcttgctccggccgaatcaacaccttcttatcattgaaattaattgtattcaccggaaaatgatcatgatcaagcttcatcttggagccatcggtgaacttcaatcgtccttcatctatggccgattgaacctgtcgtcgaaacacattgcaatcattagtagagtgagaatgagaatcatgccacttacaatatgctcgacatttcaactcttcttgagaaggtatgacatggcctttaggtaatctaatttgtttctcttgcaaaagataataaaaaatcttatcacacttggccacatcaaaactatatttaacctcactttgccgatctttgcgaggagtcgggattaggttagaacaaacaaaagttttatttttgttagtccatgaccattcggcaacataaatatcatgatcaccctcttcctcactatcattagcttaagggtaatcaaccacattaacattaggctttttatcaaatggtctagcaagttttctattatccttaacccggctttcttgagccagagccctttgcatgagttgactaacatcaagaaattgttggccatctagtctttctctaagaggagcaactaaaccattaaaagcaagaccagccaaatctctatcagttatattcaaagtataacatcggtttctaacatctctaaatctcttaatataatcaatgacagattcattatacttttgcataaccgatgtcaaatcacataacctaagctcagtttctctagtatagaaataatcatgaaattgttcttctaattgagcccaagtatgaatagaatttgctggtaaagaagtaaaccatgtgaaa

SEQ ID NO: 29530 - DNA, 348 bp, Oryza sativa
  unsure (1)..(348): unsure at all n locations
acttcgannnatgcacctacnagttggnacagnagttcatcatcgataggaatctttctgctgccactctattacctacgtacaagtcaaagcagtattcttgagataatcttttggacaagtagatcacttagtttttggagtaaattgcatatatgacctagctcttcgatttcctaaacttccaaaagctaaccttttcaggaatcaggagcctatagctaattaacctttttcagattaaagttgtttaagggagtaggggttgggtatttatgacaatatatttgttgggaaacgcctgggctatgatggcataaattaaaatttctttttgcgtaacccaga

SEQ ID NO: 29531 - DNA, 653 bp, Oryza sativa
gaggagagagagggagagagatgggccgagccggcccaagagggggaggagggggaaaaagactttttaggttttttctttttataaaacctttttaactttgtttatttcttcttaattattatttgtgctctgaaaattccactaaaatttatttacgcattttaggcttttaatgatgtgacttgccttgctcgctttcccaaacgccggcttcaacctccacgaagagcggatcttccgaagctgcagcgtctacacgaccaacggaaaagaaatggcttttactctactaaactccatataacaagcagaaacaaagcacaaaaatgggttcttggcttcttaaggaaaaattagagacttgaacggtccaattccgagttcaaatggccaagttatggccatttgaagtttatatgctctttaaatggatatttatgaatttcttcatttaaattttaatttaaaatcggatttattgcgtcagccgaggggaggggcgcgcggaccgggtccacgggagtggggcccacgcggcagcctcacggtccacggtggaccgggtgcacgcggcttacgccggccggcgccgtgggtcccacgcgtcagccgcacccgagggcgcgggcggctgacggccgggccccaca

SEQ ID NO: 29532 - DNA, 1501 bp, Oryza sativa
aatcttaatgtttatgagtgatatgcgaaacataacattatattggcctactcccaggctaaagatgcctcttgagtttagaaaaaaaaattagtgacattagctacgggagccataaggaatcctttgtcaatgccaagtcatactcaagtaggccttaggctcagttaagtcaatgaggaaaaataataataattccatagactttaactgataaacaacattatttattgctaaaatattaagtggcactattattgtggttgcttgtgcaaatgatgtacattattacaatcacttacacaataacgatagcttaatctttatttcgctttgtctcaccgttgggaagagacaaggcgaaagaatcattaaatgaaattacttataatccaaaaatcaaatcaccgttgggcagaactgattagggaataaacattaatgtcttaagtcacatcaccaaaggttagaagtgataatgtaaataatttaaaatcccaaatcaaatcaccatacggtagaaatgatataggaaatgacgccattagtgatgccatagaattaaaattaaaatccttagccatatcaccgttgggcagaaatggtaaaggaattaagcttactgatagattagatccttgatcacatcaccataaggtagaagtgacaaaggaattaatgcactaatggcataaataaaattctaagtctaatcaccgttaaggccaaaatgacagagaaaattaaaataacgattgacaatacttagatttcttcccttaattacatcaccgttgggcaaaaaataattaaggaaattactatcttaatgaaatattttttctttctagataaacattctgttggttccattaatctagaaatatttaccaagtattgcaactgatcttaaataataaacattgccaattgcatataattaattcaccttggcttagtcaatcatatgcaaaataaacttagaatttcatagtcaaaacaccattggtcataaataattatgaataatcttaaaatttattccttaattatatcaccatttggtagaaaataactaaggaataaaaaaattataattgacatgcaattataaaaacgtgggttaaatataacttcagatcttaatgctttctactcgaatttctcgttggttccattcgactataaataattaagttactaaggcactgaccatcataatgatgttgacatgaaatcataaatactttctagttaaatttctattcaactaggaataaattaagtggcttaaggaaataataatcttaataaatattgacatgaaatcatattaacattggtcaaatataatatcatatcattaatttctttctagctaaacttcctgttggttccatttaactagaaataattttctgagtgatcaaataattgaccataattttccagcaatttttaatggctaagaaaggtcataaataaatttctggaaatacat

SEQ ID NO: 29533 - DNA, 160 bp, Oryza sativa
  unsure (1)..(160): unsure at all n locations
agtgattttgactgccagtcggacagnaccncatcatgtcgagaacagtttcgccgctagatcggtttgtaagaccccaactcgtgagcttaatcattcatctgcaattttgattgttttctatctcgttcttgtttgtgttcttcgattggcaaacagg

SEQ ID NO: 29534 - DNA, 381 bp, Oryza sativa
tgcagcttgatgattaattaccagtacttgtacacttgactctatttggctattaattgacagaaccaaagagggctaacatgcataatagtcataatgaatggcacagttgacttacacaaaatcgatgcatatgcatgtaattcaaataagttttgtatacaagtaacccaaatatatgtcgagcaactctgaattttgcagcctacgtataagtccagtttcaaaatccgcaaatgaaattaattgacatgtgtgattaatcagtagtactccctctgtcttaaaaaaacaaggcgtccttgttttccacaaagtcaatatttaaaagttttgactaatagttaaacgatattggttgtagatatttctcttttcagg

SEQ ID NO: 29535 - DNA, 152 bp, Oryza sativa
agtttgctgttgctgagatgagccaagtcaataccatgccatgtcttcctgttctttgcctcccttcgtctggatgcttcttcaacttcattacttgcttcatcttttatagagcagctttgaatagtttatggctacaactacaagggtca

SEQ ID NO: 29536 - DNA, 699 bp, Oryza sativa
cggtctgactttgcttagatcgtttacacgtttactggaatcaatttttttctaaaaaaaacttactccctctgtaaaaaaaataataataaacctcgtactagaattggacatattacaacgaattggatatagagatatatcctagtataacgaatttgtacataacgagtttattttgggatggaattatagtacatcaaatctggatatgctgagtttttttttatagagagagtactgcgtatcaaatttgcggtttggaattagagcaagaattttctcctataaggccttgttcaatttagaggggattgaataggattgtaggagattgagggagaataatttcacgccacaatagatgtgaaataaatctcctctaatcccttacttatagggattaatggaacaaggcctaacaaataaacacggtttgttgcgacatttgcgtctcatatatagtacgggataatagtatgcgcaatcaggggcaatatggggatcgtacaataaaaagaaaggcagaaggtgggccccagtttgaaaacagcacgctcgccttctccaaaacacccccctgagaaacgcgaaattgtcttttgggtgcgcgaggccgccgcgcgctcgaatcacagaggcagaggctatctatccatcccatccatctctccgagataaaaatcgaacaaagaagcg

SEQ ID NO: 29537 - DNA, 297 bp, Oryza sativa
gggatgtgacccctcctaagattatgaatctggactaccctttgtccagattcgttgttctaggaggggtcacgtcccctcttagattgaggttttttgtagaaggagggagtagaagtcagaagcaggaaaacttaattttttttccagattctcagaagttgttaccaaccagctgtttctcagaaatttaaactcccctaaataagccctaagcttcttagctggtagggagccgctgggaggaaggcaccgatctcggttcaaacctagccaataactttttttttacttagt

SEQ ID NO: 29538 - DNA, 492 bp, Oryza sativa
ccacccgcagcgatgtcgacttccgccagcccgttcgcagcgccatcagccgagtatgcagaggtacgtgtccatcggctagatcttcttctttatgcaatagattggtttttccttgtctcatcttgttttcttcttctctatttttatccgtagcatctttccaatctggttgcgattcctagcctatcacatgagcatcagattggccaacccaaatctaggtcactggaaagatactttcaagtcttggccttcgcttgagaaaagttctcctgagaaaagttagcccgtatggtacaagcgtgtgttggctagcaagcaaggtcactgggatgaactcggaatcagccaagcccttgctcttactttagcaaattcagctaaggacgaacccctgatggcttctgcaacatatttctggtccaacaccctcaatgccttcctattcaatcaagggccgatgaccccccactctgcttgatgtcatca

SEQ ID NO: 29539 - DNA, 1501 bp, Oryza sativa
cttctcggcgaggtcatccgcgtttcgacacgggtgataaccagaggagacgtggtgctgcgattgcggggctcaagagcgtgcgcgttcatgaagccggatcgatttgtgtcgcgactccgcccaaatatttgtttatcagaacctttcggaagatcgggaaccctagtgcacatcaaagcctagcaatgtacccaagttagtggtttatttcttaaaacatggttaacaactaaaatgtggaatggttggccagggttggcttgggatgagctgggacccaggtctggttgccagtttagtctgaatcatcgtaggtcttgggttaaggcaggtttgtgcgggttcacggccttgattaataacactgtgtagctctaggatcgtctttacaaaatgaccctgagcaactaaaagtcttgttaatgctgtttactgcaaaccctaacccctttattataaccgccttgtactcctttgcatttattctgcattcgtgggtgtgtcttgctgagtacggtggttgtactcaatcttgctcaattttttccccaacccagaagaggagttcctggaggatgaaggctttagtgtctagctcgtgcctgccgtcaagtgtctgtggtcgtcgccctagtcttcagctgtttttcgtttatcttcgtgtgtgctgggccttcgtcgcccatgtaataaattaactatttacgcttccgcttgttaaactctgaattgtatcaacatttggtgtaccttgcctcctgggacaaggaataatacacgcatgtatggaatgcctattgggttaattccagtcgtgacaatggcacaaccttcttgctcctgacccactcgactactgctacttcggaatcatcctcttcatcggaaccatacatgtaagggtacacgtggttgatctttttgatattcttcttagcctctgcaaacatttgttcatgcagggttaccttctgtgcaagatgagataagctttcgaactcctgagatgaaaatttctccttgatcggagctatcagaccctgaaaagccagatcggctagctaagaatcggtcaaagccaaactgtagcacctattccttatctgtctgaatctctgaatgtaatcctgcataggtttatcatgcctttgtctgattgctgtcaagtcagatagtttcatctcatggattccactgtaaaaataactgtgaaactgtttctccaaatcggcccagctattgacagatttgtagggcaaagaagaaaaccaagtaaatgccgatccggacaaggacaaaggaaacaacctaacccttaaagcgtcaatagccgatgcctcaccacattgagccaagaatcggctgacatgttcataagttgagacattgtcttgtcctaagaattttgaaaaatctggaactttgtatcggttaggtaatggaaccctctcaaaccactcaaggtatggatgccgatacaagtttccagtatccttcg

SEQ ID NO: 29540 - DNA, 351 bp, Oryza sativa
ttcctgcagccccacgtgacgccgtcgcccggggtagatgagccgccgtcgccaccaacctacaccggccggttgcgttgcattgatggtcgcggttgccccctctctccgtgccgttgagtggagcaccgagccgggcggtgtctttgccagagctgggtgtcacggcggcggcaagccaagaagagcttggggaagggcaagggcgagcccgccggcgagatgggcgtggtaggcgtcggaagggatggtggggctgggagcgtggcgccatgtgtgaccgcgtggcaaggcgttgcgcggagaaggggatcgagccccgtcctcttgtggtgtcggctcggctcggct

SEQ ID NO: 29541 - DNA, 1501 bp, Oryza sativa
acccaacgcgacgccgattatcgagaggcgcacgagctgtttgctcgtcaggtgcatcttaaacttgcggcccgctcctcctcgatcactgatgtggatgacctcgggagagcacttgccggcgtattcgaggcaggaattgaagtattctctctgaacattttttctctcgacgacgaggaggaagaagtagcggaggcggcgtttcggctcctgctgccccgcgcgttcctctagcttgctcagcgcatcgccgtcggtggggagctcgacgtcgacggcgacatccctccagtagaggccgtacatctcccgccaccgtttgcagagcgaacccatgaggatcaccgacttgatcgggaggaagtcgaggatgcgcacccgagccttctcctgcagcgccgtgatgcggtcgccgtccaccttcgccgcctccgcatccttctccggcagctgatccagcttgcggtcgacgtccaccttcgccgcctccgcatccttctccggcggctgatccaggttgcggtcgtcgtccacctccgccgcctcttcgccatcttctagatttagatagcccttccactggtcggtgttagaatcgtcgtcgccggattggctcgccttcgccgcctctgcatccttctccggcggcgccaggttgcagtcgtcgtccacctccgccgcctcttcgccaccatctaggtttagaaagtccttccactcgtcggagttggaatcgtcgtcgccggattggctggccgtcgccggctcctcctcccgctgccgcttcaccatcccgcctctctctctctctctctctcctctgccttctccgagaagccaactcgccctgattcgaatttgaaatgaggaggaggaagaagagaagcgccgagaaggccagccgttttaaaggcagcttgtctcgcaatcctggtaccagcgtgggcccaaccttcaccctacatgggccaggcccactaaacccacgaagcttccggagatttcttacgagacaagaaactgggcttcctcctcctcctcctccccctccctgagccgtagtagccttgttagctaagcaaaagcccacgcgcgatgcgaaacccatcgccggaaacgcgaggatttccgcggatttttgccgccgcggcgaggccggaaacgcgaggatttccgcggatttttgccgcggcggcgagcgacccatataagctaagctaaaccacccacgccgctgtctctcccgcatccgcttctccgctacctcccaataaactaagcttttggcgcgttgctggctcccgctcacgcctcgtctcgctcgacgtctccgaggaggcgaggagctcgagctcgccgcctcgccggccggccattactttatccgcggcgggtagctggggagggaggggaggcggccggccaccaacccatcgtcgtcttgtggtttcccatgcggttgccgccgcgggcgccgctgcattcgcgggagcgggcg

SEQ ID NO: 29542 - DNA, 159 bp, Oryza sativa
gtagtactttacaccgaaatcaattaatgtaccgcatgattaattaattagtaggaatataattttttttgggaaacaatctcatataactaactgttaaaaaatatatatttaaaacttaaagtatcatcgaacaggttccttttaattcgcagacaa

SEQ ID NO: 29543 - DNA, 1501 bp, Oryza sativa
ttaaataacacgccgtgcactacaaaatattctgtattcatatgcaccaacccgtttcacattgctaaaccaaattaattaacaaatgcatataaaatacatcttgtgtttttcatgtatttggaatattcgttcagtaatcccatagcaatcccacttgtcccaaataatcccaagcaaactcccccagtacacatcaatatatcgcaatctaataaaatccccagtgtctagctggcgcatcgaaattagtcaattttattgaaacaatctcactaaggaagcatatgtcagctcacggaggcatcgcaattggcaagccggaatcggatacgcaagctagcaaagcaaagctgttcaaagctggaactgaaaagtgagtactggacggcgaaactggtaaagagacgtgcttagtcagagctgagaaatggcactactccagcaggggaagacaaggactttggagcacacgtaccacgtcccgttttccccacgtcgcatcctgaacaatccggtagtctaatcgtacgggcagaagaaatcaagcacgtcccaatctcggatttaatttctacaaccattttgttgggttagttggtgtgcacaaaacctcgatcgaaatccatcctgctgctgttcatgagtaattttgatatgataaaccgcacacaaatcaacaaagtgacagtacacagataacgaattgctaacgatgaatgcgttcaactaaccactaaattgctaggattagtacaggacgggaaggatcgagaaggaaggaggcgatggatggactgacctggagacggcggcgaggggcgaacaagcggaggtagacgaggtaggcgacggcgatgccgagggggaggccgacgccgaagccgaggaggccaccgacgagccccatcccgttcccgcccgctcccgcgaatgcagcggcgcccgcggcggcaaccgcatgggaaaccacaagacgacgatgggttggtggccggccgcctcccctccctccccagctacccgccgcggataaagtaatggccggccggcgaggcggcgagctcgagctcctcgcctcctcggagacgtcgagcgagacgaggcgtgagcgggagccagcaacgcgccaaaagcttagtttattgggaggtagcggagaagcggatgcgggagagacagcggcgtgggtggtttagcttagcttatatgggtcgctcgccgccgcggcaaaaatccgcggaaatcctcgcgtttccggcctcgccgcggcggcaaaaatccgcggaaatcctcgcgtttccggcgatgggtttcgcatcgcgcgtgggcttttgcttagctaacaaggctactacggctcagggagggggaggaggaggaggaggaagcccagtttcttgtctcgtaagaaatctccggaagcttcgtgggtttagtgggcctggcccatgtagggtgaaggttgggcccacgctggtaccaggattgcgagacaagc

SEQ ID NO: 29544 - DNA, 1501 bp, Oryza sativa
aaacgatgatgtagcaaacagtgttctagcaagcaaacataagacaggtaagtttgctgtgaactgtagcatttgacttttttcttcttctttttaatctattgcatttcttgttgttactctcaacacagtatgaatttcaacttggaattttatgcatacagtagattctctctaagttcatccatcgtttttaaggaaataaaaaggcatgattatgttaaagttatgtaattaactattgcatttttcagaactactctagcagtggacccttttgtagaattcttctggcatgttgtaagattggttgattttgtcactttcattaataagttttgcttcatgcagtagtacatactccagaatcttctttctcgatcatctttcatccaacggctgatgttcatttcatctattttgtttgctttttaatccaatggctatttgttgtgaccttaggtcacgaacaagatcggggataggccggaaagaagtgttttcccgcctatccttagaaacgagctcgaacagcaaacacaacttttgaggattacttttgtattcaagatgtcttgtcctgctacaggtttttgactggcttttattaccggtggtcgtacacgtgagattacatttttacccctgtgggtctttgtaagtttactctaatgcccctgccacatcagcgtctgtgggggcattctagtacatctccaggggtcttttagtcttttaggtgctagctggcgagagtggttgaaggtggtccccagggaatcttcccttggcatcttctcttgttcgggtagtgctcttcctcgaactcttgggaaaaatgcattttccgtcctggaccgtcttcttcctcctgggaattcgaattccccctttgccttctctttcatccttggaaaacacctgtgaaattgtaacttgtccaaaatatgtgtagttgtattagcgattatggaatgtccctaataaggtgttcttcacccaaagaggtattttctattcgaatgagtgttcttcctctaggaaggtattttccttttgggaaggtgttcttcctcttgaaaaggtagtttccactcagaatgagtgttttcccctctggatacttaggtcttgcaaaacctcgtagtgttttgaccgaattggaggaaaaggtgtttgcaccctgctacaacaagcccctcacgggtaagggcgatgtgtattttcggccgaaaccgtgcttgagtttatggaaaaaagggggaaaaccgccgtcctcctattcggtcgaaacacactattcaaatatgcatatatgccacgtttactattcattatttttatttttattcttattattttttatttttatttatttatttattattttttaaatgttgttttttttatgccacgtgctggtatttcattggtgcgcttaaggggtcgcgtcgctttgggtttcgtgtccgctcgtaaacccgcgacccttaccaccctg

SEQ ID NO: 29545 - DNA, 1501 bp, Oryza sativa
ttgatttgaagggctatatagaaaaaatttctataaaaataaatttctccaaaacttctatgaatttcttttgaattaaaggtggccttattttacgaaacagaggtagtgatgggaagagaacaagcaaccttcacatgcgagtatatgcgaccgagctagcttggccaagcggtggaagcagcagcagcagcagccagcagcagtggacgcggaagcctcggccgcgccggccacgcgaatctcgaggcaacgcccggtcgcctctcgcgacctcgcctccccgaccaaaacatctccccgatcccatcccatcccgtcccatcgcatcatcctcctcctaaacccacacgtggcagtgcccgctgcccgacgaggtgtccctccctcgctcacacacttgcccttcgcgatttttcataccaaaaagatttcatataataacttactagtaacctgattctgagaagaatcaaagaaagaattatgagtttgtttgaaccccttgtgaaagaaatcacgagatagcgatgagagtgatcatgtaaatccagtgatcatggaaagaggtcatgcagttttggttaacacaaatattttaattcagtttatttgcagggcggctgcatgcatttgtttatctctactttccaaacaagagaggtgaataattgtgtaatcatcggctaataccccttgtgcaaaaatatcaggttgatcgagtacttgaggaggagagaggggttgaactgaaaagtagtgttaattaatcaacgagaccactaaacaagaggagttaacagtggactgtactagtgggtagtagtagaagtacttgcttaagctcctcttcttcccttgactcctcttctcctctctttctctctcctttcccctctctctctctctctatttagttcttttgcccccatgtcagctgcagtctgggggaatctgaggctgctgctcacctgagagactgaaaggaggcagaagcagcagcagcatcagcatcagcagcagagcagatagctgagctgcagagggggaggagagaagatagtagtggtagtagtagctgagctgtgtcaagattgcccttcaaattcatcatcttttgctcttgtgagaaaaggtgagtagtggtttctgggttgcgtctccctttttctgcaagatttctgagccaaaattctctcttttgctcgctttgttcccttttctttcttttctttttttcccttcttcctcctttctgctctgctggttggttggttctttctcctcccccagcctttttcagctatgagctctgattgatgatgacgatgatggcggctgtgcagctgaaaagcttcttcaccttgtggtagtggtaaaagctgtgggaaatttcatccataaagatcgccgtggcgctcgaattccgctgaattttgtttgtgctcgagctgatcggtggaggtgaaagatttttgcgtcgaagagatgataactttcg

SEQ ID NO: 29546 - DNA, 1501 bp, Oryza sativa
caaagggggaattcgaattcccaggaggaagaagacggtccaggacggaaaatgcatttttcccaagagttcgaggaagagcactacccgaacaagagaagatgccaagggaagattccctggggaccaccttcaaccactctcgccagctagcacctaaaagactaaaagacccctggagatgtactagaatgcccccacagacgctgatgtggcaggggcattagagtaaacttacaaagacccacaggggtaaaaatgtaatctcacgtgtacgaccaccggtaataaaagccagtcaaaaacctgtagcaggacaagacatcttgaatacaaaagtaatcctcaaaagttgtgtttgctgttcgagctcgtttctaaggataggcgggaaaacacttctttccggcctatccccgatcttgttcgtgacctaaggtcacaacaaatagccattggattaaaaagcaaacaaaatagatgaaatgaacatcagccgttggatgaaagatgatcgagaaagaagattctggagtatgtactactgcatgaagcaaaacttattaatgaaagtgacaaaatcaaccaatcttacaacatgccagaagaattctacaaaagggtccactgctagagtagttctgaaaaatgcaatagttaattacataactttaacataatcatgcctttttatttccttaaaaacgatggatgaacttagagagaatctactgtatgcataaaattccaagttgaaattcatactgtgttgagagtaacaacaagaaatgcaatagattaaaaagaagaagaaaaaagtcaaatgctacagttcacagcaaacttacctgtcttatgtttgcttgctagaacactgtttgctacatcatcgtttcttttctcttgaatttttcatataaaattgacttcctgattttattaatagcagcaaccctattctggagttcatctggacaaatataagggcagtgtgcaaaccaaaacataggactgtcggtttcaaaagaagaagaagaagaagaagaagaagaagaaagaaaaagaaagccataggattgtccatttacccaagaaatctatttttgacaggtttaccatcatgacttattagaagagtgaatagaccatcaatagcaacagcccctattaacagtccctgcttcactgaacttgcgttctttaattatgagaaaggagggataagaggttgacaatgataggttatagaacattaaatgagtctaaggaacagaggccgctctcccttgtacattaacacatggtttccaattccacaaacacttaatgatcaccaataattctaatcaagataaggatcaagcacaagaataccataaaatcagcacataatgctaatacccagcacctcagagacagatggaacactgtgtttgttatgagtcactatctgcatatgcacatgatgccatctgccatccgataacaaatctgggatgtt

SEQ ID NO: 29547 - DNA, 1501 bp, Oryza sativa
cgcgctcgactgggcccgtgtaatgctattgttcttttttttgacgtaaaaaatatatttttgacgtaataatgctattactctcgttcgatgtcggcaacagtggagtgagcaacagagtcaacggccatgcacaagcctgcagtgcagagcacagtactgctacgtccgcgacatgtcaagcacgagaaagctttggtaccggaattcagcaacgccagtagtgacgagtggtcacgagctagactagcacggatcaacacacagaagttcaagacaaaattggttctggagcattgaaagttgtccattttgattttatagcatccaaagttcacatctcattttgatagcatcggaagttacatccgttgcttctttttagcattccgtccaaacttccgttagttttattttctaattagtattattcttcaacaaaaaactaaatcaaaccccaatggtggccctcttcctcttgcttgtcacctccaaacagtagtcgtacaggagctcagagcggtcagtcatggtgcgaacacaggatcgatgctggctccacaagctcgtcatgtaatacgtacgtgagcccagcctcacaagctgatcatccgcaagccactgtgttcgtccgcgcttgctaggtgtgatctatccactttctaggctctagctttgcccggacagcgccatcgtcgatcgatctcatctgccattccgccatgctagagcttgttcaaatgcggctgtgccgcttccgagttcgtccgcgcgcactgctctcggtctctctcctagatgcgtcatccgatccatgaatgcccgaagcgaagcaacgtcctccagattattatcggcacccttgagctcgctccgatatgctgctcttgagctcatccatcggcccccgaagcaccaccctcgcgctcgtcgcgggctcgcctgagtaccgacccgctcctccttgccctggatccgttgtctgctgacccaagtcaagagccgccgcctctagcttgccagaaccagccaccatccaaggctccaactcgctcagcgctatactgtcgtggtcgagctcacctgctgccttgaatcgaagagtggtcaaccataggagggagagtgcaggaggaacaagacagatgtaggatggggtgaggagacgaactgctgacggaatgctaaaaatagtaacggttccagttttgagtgctattaaaatgaaccataaacttttagtgctatgtaaccaaaatcgagtactttcgatgccatagaaccaattttgccaaagttcaatggcctaatcttttcacttatacttatacttatcagctaaaatttaaatttatagctttaaatttgaatttaattttagactttttcatcgtagtttatttttagcctttgtttttatatcgttgagaacacgtatataaaagtagttattcataaattatttttttatttgtaaatactcactttattcacaaaagtt

SEQ ID NO: 29548 - DNA, 1501 bp, Oryza sativa
ttatctgataaataatacacttgtatatttttgccaatatgtggctactggctgttgcaactttgacagtacaacctgaggggagaagagaaggtgccgtccacggatggcatcatggtaagtgtagctgcagtggacgtcgccgtcggacggcctgctggtcggtcagtcactgcagcatgtaggcaaggcaacagaacacacgacagaacaagacatttgcgatccgtcttgctacagatttttcctacagaaacttgcgcccggtgtttcagattgtgatgtgagttggaagcgtgcgaccgtgtgaatgaatttcgatggctataaaccaaagcaggggaaataccaggtgctacggtaacggtagcatcaatgcatcatggtgccgttccacgaaatattcagggaaaaaaagagagagtacaaaatgcagagcgtgctgtcatatagtacaatcttgcaaaatttcaattccaaattcagtgacacacacaaattttgggccattctgactccacttcttcgattctttggtatgatgaagtactacaaacagagcatgcagatgtagttttttttttcagacaattcaacgcatttgcgcgcaaaaattcccgtaatcgcattcgtttagtaacggttcatggccgagtacacaccaacgatcaaatgcaatatgatcggtttacatgacagtaggatagatccagtctggtaaatctgccgataaatatgggtaccggattacagtcaatcccattctgggagctctaattaaagaaaactgaattgcctccttgaaattgcaccagtactaggaaaccggcaatttttgccttcaaaattgccaccgtgctccaccagctgtacaattgagaatagctttaatttaccctacctcgctaagttatcgccgcttgtatctgttagtatattcagcctacgcgccgtcttcgtgaactcgctgcaaattcagaacaggtactttagtccatcaagtattatgttcggtacacaaggaagaaagaactgtagcaaacacgaattgagaacgatggtttcttggacataatggatagaaggtgttttggtgtcccagcttggaactcctctaaagtcaatgtaccatatggatgcttccaaggcaagaagacctagagtttgggtgcttcaagttaagctaacttaaatataccacttaaaagcctagaaatatcacaactacgacaatgtggacatttcaatgttcttaaaatgatagccattagccaatttaaatggagttataaaggttaccatatgcatcttatcagatgaccctagggaaaatttgaagtaagtaccagcgcattaatgatttgtttacagcataaaacccgagaaaataggataaacggccttctatttgatgagtggacatgactaaataactaaccaattcataaaacaggaagtattctgcttgaacaaactataacaataatctaaaactggactg

SEQ ID NO: 29549 - DNA, 1501 bp, Oryza sativa
atcagaagagctcttcttaacatccaccgaagcagcatcacccaaggatatctgctgctctgtgagtatgggttttccgaaaagcatcagctgggctggcgccttcttgccatctgatttcttgttgttctgggggctaccaatggtcaacaagcatgagatatcatcccgagcagccggatgaccgataattagaccagcggcgatcctcggctgcatgccgtgatcaagctggtgaaagccgtggggcgatagactcgactgcagtttgttaaggtggagatctgataaagatataccaaattgagcatgcctggctccctgtatgcctgcaggagtgccatccgggaaatagcacataggaccaaccccacgggcgagcgggtttccatggaacatcggtgtcggaaattggccgtcgatgggaagctcggggtacaacggcacgcaaagcttcttccgtggaggcgagaatggagcaaggtggatggccggcatgtttgacacaagctcaaccaaccatgggctcaccctcttcacattctgtaacaagtccggttcatcccatgaaacctgcaaaagccattcccaaaacatcaatgcaagcaacaaaccatggacacgatcctgaataccaataatgctactggaacattttgtttgcagttgcagtagtccttcataggacagtgcactttgagacagagaattcagaactggattgtacctgaagaagcctccatggtgaattaggcatctaatggggtcagcaacctgcacggccgatacagtgcccatgaaccagctgatccttgatgagtcctccgtctcgaatgccatcttgaacctcatgccggcgaaccactgcgtccgcatcgccgctctgaccgccccggccttcacgcagaactccggcgtgctcgccctcgggtagtagacgacctcgaatggttgcccgctcacggcgagattggccgcctcgacgacctcctctggccggacacgggctctgaccttgcccctggccgccgccgccatcttgttgccgtcgtcgtcgcccctcaggaacatggagaacccgccgtaattgccgccggcggcaggtgtcggcggcggcggcggcggcggcggcaggaactccgggcctcccacgccccctttcttggcgcggcggatgccgacgcagagatccccgttctcggtgcgcatgaacacgatggagtcgccggcgacgagcttcttctggttcacgaaggtgctccaccccgtggtgaggaggtggcgcctcggcgtgccgcggtagatgtggcggaacttccagaccacgccatggacgtccttggcgaggacggtctggacggggggatcggcggagtagtcgagacgcgggaagatggtctcggcgcagtagcgcggcacggagaaccccccgccgttgttggcgtcggactgcgtgagcgtcttggcgaacgacgcgggcttctcctcctgcgccgccgcg

SEQ ID NO: 29550 - DNA, 1501 bp, Oryza sativa
agcatcgtccgcttcagttcgatgtgcgcagtgcgcgatatccgattatatgtagattttcgtcgactatagataaagatttagggctcgttcggttcacaggattttcaaaacgtaggaatataaaaaatgtaagaatactataggaatacatgtgcaaacctatggattgaaaaacacagaaatttttcctatgttggttgagcaaaccaaccaaaggaatgcaaacattaggttagagtggattattttttcctatgcttttccttcaaatatggaggaatggaaaactttcctaaagttttcctatggtgcattcctatgatatggtattttaaaacacattcctattcctatgcttttcctttgcaattcctttgaaacgaataagcccttagcagtaggttgtcatctcaaaatttagcctatttccagttaattttcttgctttcattagactgtatttatttatgaaaaaacgcagtcgttttgaccaataaactctgtaataatctgttgtaacttattcgaagcaaaggcaaaaaaaaaaaactaaaatagcccattttaacggtgcacttaacatacttgtgctatctgttgggcctgactgaacaatgcagtggctctgaagagtgacatttggtacaatacaaccatacttgttcggtcctatatcaccagcccgcgtgaacgaagtgcggcccggcctgctaaacttctccctatcaaaaaaggaagaaaccagtagtagtagaagtttagtagtagctgacttttgtgctgatggggcgagctgtccgagagctacagcaacttgcaaggagcgagtgaaggtggtggtcggccgcggcgcgcgggtcatgtcggacttggagagcagcgacagagagagacggcgggcggaatcagcgtgcgcgcgccaaacaaaccgtggggggcaggaaggaaataatgcaaagaatccgaatcctcccatcaaccggggggccagacgcccagagtcggacgcagcctgcacccacagaatccaccggagaaaaaaaaatgctcaatttgggatttggaagcggacagcgacgcatgcaccaatgtctccttcatttcttcatcaagccttggacgaagataataattttcacaacacacgcttttcaaactgcgtatttcatacgaaaattttctatataaaaattgttctaaaatatcatattaatctattttaagtctataataattaaatcttaattaattgttctaaaaatcttaaccttcattttcatttcatgctcaaagaaaagagcactactacccaagtcgacgcaaccggatgctgactaccacccaagcaacgatcctatcgccaaacccgccttaaaataccactaaaccaccggcgattccaccccgaaatccaacacaatccgcgggtgccacccaacgacgtctcacctgcctcctctccttcctttttccacatcttgtattagataaaagcttc

SEQ ID NO: 29551 - DNA, 1501 bp, Oryza sativa
atccgtgtcgatggcggtggccaaatgaaatcacattgttaattgtttatgaaaatagttttatagaaaattcacgtgcagaaagttcttatgaaaattacaccgtatacagtatggtggagaaaagcgggatccactttgcttcgatgtcacacggataggatagtgtttatgtatagttattttgctgccatgtagatgtaggataggtttctattgatttgcatagagttaattaaataggagaaaagagtaggacatgatatctcacgttagacatgccttggctactaacctacgagaaagacaacaaatgaaagagcaattgtagcaagcatttgttggatctgttatcgaaaatgaatgtcattgttcgctcttgaggatctagaaattatcaaatttgaaaggcaaaaaatgatttacacaattgtagatgaaggaatacatgtttccatggatataaagctcacaattgtatacaagatgtaagtaaactttaaaaatctattgtatagaaaatacgattgtatgaattatttgtaacatcaaatccaattgtatccatgaaaccaaaagttaagagtcgtgctcgtatctatgaggtatagtgtctggaaatctaactacatgtaaaattactcggagccattttatttagattatcaagacgattatctactttattataggaaaaattaaatattttaagaaacaagtaaaaagttctaaaggaaaaacatattttttctgaagcatggagaaaataatccgtttcaataagcccggttcgcaagagatggagactgtatcaagtaagatcacgtaaaatgagaaaaccattaacacataatttgttgagttttaattattataatttaaaaaaaataaatctatttgatacttcctccgtttcaggttataaattattatatacctagattcattaacatatatatgaatatgaataatgctagaaagtcttataacctgaaacggtggtagtatttttacaacaacatttttaaaaacgttttcttactaaaaccaatgattggcttttataaaaaacatgctaaaaaaaaccttggtacaatctatatctaaaattcaggaaaaaaaatccttaatttctagtataactaccaatgggaatatactctaaaatgctagtaattagaagagcggaggtaggagatagtgaggaggtgggggatccaacggcatcggaaatacaaaccccgaaaagcgtggaaacctctcgtcttccctttccatccgaaggcggcaatccatggcagggcatccacatctcgcgcggcgctcgcctcacatgcacatgccgctccccttcccccaattagcgatcccacccccaccgcccgccggtttctccgccgccgccgccggaggagcacggccggaatcccccccaagccgaggaggtgctcctcctcctcctgtctcgccgccattgctgatcgtcggcggggatcatcat

SEQ ID NO: 29552 - DNA, 427 bp, Oryza sativa
atttcaggggatatactgttaaccatctgccagtttagttaattgtagggtataatcggctgatgccttttatttttaacaacagattcacagttgtactagtattaattgggttctgagtgtattctatcagttggttttacaggttcaggttggtgaatggggaattcgcacagctgtagtgttgttgcttgagcacttctcagaaaaagcatcccaacaaagcttcgagccgattacaagacagtgggcaccaaggttgcctattgctttatgatcagcaatgcagagaatgtgctcaagctaagatgaactttctgaaccttgcaggtttcatctcactttatgcgttgtgtaatatgtaattgttgcatgacactcttgctctttgccttactaaattcacctggccgtgtacatcctaagc

SEQ ID NO: 29553 - DNA, 1097 bp, Oryza sativa
cccagccccaggtatacttgtaatttttttccccaacagacttagcattggttccttaaggctttgctcagttaatccctcttagaaggggattgaaggggaattagaggggatttgttccacacctattgaggtgtggaattaatcccctccaatcccttcctcttcggtattaaccgaacaagccctagaaaaacaatttgcacctgtacatgtatgccagaagaaatcacttggttgagttcttgcctactgaaagctgatgtcatgaaattcagtgctatgacatcctaaattgcctgtatcttgtatgacaattttcaccactggagtcactgatcgtgattatttttctacatattactgtagcaaaatatacaccaccatgtgctcaaagtcattattctggtccatacgatgagttacagctcacagcaatcacatgaagttaggggggctcctcaaatggtttggtactttggttagcagttagctatagttcacagctgatgacgaaatggctacataggtgggtagcaaaggcagcataaatgtgtagccttgtgggaaatgaaagcagcaaaagctttaaaaatactagttaaaatgcaacttcattccagagaaaatcacatctgagtttcctgtagcatcatgtgcgaccaaattgctgctgtgctaataaaatagtacatattttttatacttaatttgtaaattcgatcaacaactaaactgtagatgcaccacgttgcagcaatgcatatatgtggatttttgggtgcaagtctactgtagcacggattgaggccttgctttctaagcacactaaattaagccaaatcatcatcaccaccacacaaaattcatgaaagacacatttttttcgagaaactgaggaagtgaggagctgacctataaatatgcaagcacagacaccaattgcagttgcaacagagctgtcaccaccctttcatctgacgcttgtgcacaggagttttgcagctcactggacatgtgcaagcactagaaatttataagtgttcattttatacaggattccatctatctggtgcaagtctgcagtaactagcaaa

SEQ ID NO: 29554 - DNA, 165 bp, Oryza sativa
aatgtctgcattttaagctgtatatattcttgagaaatctgttacttctgatgcatgattagtagtgatctaatctgtaaacagaataggattttttttagcaagcccatctaaatcaatttgctgtgatctaatctgcaggttttggatacccgtggtcgcttg

SEQ ID NO: 29555 - DNA, 1501 bp, Oryza sativa
gctaaaactttgtctctctgttgaatctgagagatgaggaagggaaagttttggtttgatgtgtctagctatgtgctgaggtctatttatacagaggatttgtaagatatggcatcatttggagggtagacaaacagaatcctgccagttcacctcccagatgctgtctgtcagagcaggtacaatagcaggctataagccagctgcaaacatattttaagaagataaatcaggagagagaagagcagcgggctacagatttgtagccagctgtagcacggactccaagacgcagtatgtctatgacaggtgggactaggtattaatagtgtagtatgtaactattgtatgaatgagctattagattggctatagatgaattggagctagtagttggctatactattgaacttgctctcaaggtttgagatctggcagcagcatgcagaatcttttccatcactcatgtgcagttcaatatttttagtgcactacgtgtcctcccgatgagctatcacattgtcatgttccaacaattagcagcaagaatcagcaggctagttcacttgactggtggatcttgacatatttgtgtgctcaatgtattattttaatggggtgctaattgagttttattgctggcatgcgtgttctctagttttgttgcagttgttaatttccataggtgtttttctatgcacaattcagtctgcttacacgctcaacctcgtgtgttgaagctggcttgtttttttctgtggtagcaagatccactacacaaggatcctttgcttgttgctggtgcaacatatggcatctgaataacgtggccatacaatagtaaataatttcaaagatcagagtgaacagtctttgctaactacttctataacaggcaataatggcaagcatcttataagaaaattaggtgcttctgtcaaagcatggatgaaatgcaacaagaagtagataaaatactgtgctttgtttctcaacttaatatctgtacaattcctctaatgtatatacacattgctaaaatgttgcagtgaccagcagatcctttaaaatttggacaccagtcacaggggatcaaagtggtatatgatctatctacaagctgagagtgttgagaagagaaactctgctctggatcgatttcctgaacagattcttgactccagtgtctaaatcagcaatgttcgactccaacacttgcaattgctcctcttggcagaaaagtgctctcttcttgaatgtcttggagacaagagaccacttgctagaacttggcatcgcaagttgccttgagagaagatggaatgaggtttcaagcattaagatagctatctctcttgcttcagccaacagcttgaccaccctgcagctttccagatcaactgaagaagacttcttgctgatcttcctgaactgtttttgtgccttcttgataaggcagatataagactggatcttcacttgcacagctgcattatctcct

SEQ ID NO: 29556 - DNA, 1501 bp, Oryza sativa
catgcagttgttcaagtgaaggctcagtcatacatccgcctggtgaagaaggctaagcatcacctgaagaaggccagcaacaagtctacctctgatgaggatggaaggcttgtcagtctgttgacaacagcgagagggatcactgcctcggtcctgaaatctgccctagagctcctgtcgaagcaaatctccacctgcaatccaagcaagtggtctcttatctccaaatcgttccagaaggccaaagtttcatgcgaggaggtgcaattgcaggcattagagttgggcatcgttggcctagagagcggagctgagaatctgttcaggagattgatccaaaccagggcttcccttctgaacactcttagctcatagatgctccattggcattggcatccaacttttataggacctgtcaatcaccacaaattttgaataatatgtacgtaagtctaaatgtatagcaagatacataattgagaaggcatgcattgcttccttgcaaaaagaaattacacagttttgttaacatgtgatttgttccttctctaccatcttggagcctgtgtttaccctatcaacttatgaacaagtggcacattatctctatccaggtgtacaatcggaagctacgcaaactgacttgactactgtgacaacgattgtttgatttctcaacacttccttgcacgcctgcaaactcttaaaatatctcaaaaaattttgccagatgatgattgcattcgtgtgcaagtgttgcatcctagaaagttcttgtcaaaatttaagctaactaatcaagtcacatttctgctgtatgcttagctgctcactgctaccttccctaataaatatgatttgacatgatcgtgtcatatctatccaaccgaaactttgatattacaagataaattatactggttgttgagtcaagaatgcgtgcacttgcatggtcatcctttctgtggatagctggaacatgccagcgatgctgctgctgctgctgctgcatgagagatgaatgttcaactcgtcctaatgtaggagtatcagaagaaaaccaaaataattatttcctcaccagcaccaaaaggctgcttttcctccttccttcctgatgatgtatctggatctgaaatcaaactaaaccctcgtgcaagtatactgtcatcaatagttgagacatgacaggctcataagctcactcattagcatttgttgcactaattaaaaatcagatgaataacaacatgtctaggcttgaatggctatgtttcagaacagatcacttattatgacaacgcacaatgcagggaggttagtagatgagattctttctgtcgattgctctgttcaaacccaatcacgtttttggttctgcttcttcagttataaataagagaggagccaaagtgtttgagtaccagcaaagtgcatcttctctcttccttgctcttctcttcccattcccacagaagaaaataacaccaaagcttcaatc

SEQ ID NO: 29557 - DNA, 1344 bp, Oryza sativa
aattcctgcagcccagaaggaaactcccatcatcatgggagtaattttctttctagtcggttggtctattccatcctgcctccactatctgtagtctgtactagttagaatcaatggactgcatttctagatgagaagatttagctgacatcatccagttggtattatcatgcaaaattggtcctgaaaaaaactaaacaggagggattatctgggaatagtaacttcaacatttttctcttgtttttccccctcttatgtgagaggggtagttgattattcagtgcccaacttcaagcaagcttgtacagtaggacttagtgggaggtctgtgtgtcctttcagtataacttctggctgcttccctgaagctctgactataccttgacaggataggaagatattactaaaagaacaagtgacattatctatatatgaggtcatttaataataaaaacccttcaaaattacatgtgcatgtaagtgagactaccaatatttaggctcctcagtcctcaccaacccatctgagttacagctttcaagtaaaagacctgacactttcaagtccgtaccatgattctccaatggttgagctagtcaatgttatagataagatcacatagaagtaaccactgagctaccatctcgtgtttgtgcagtaaccactaaccaacaggctcatgattccattaaaatgcaaggttttagacagattacatggatttggtatacattcgatggatatggttagttgattactgctcatgtaacggaggtggctagcttttaaaatgcatgaaaaagagaatgggtctagtatttccatcactacatcagctaaatgcactgaataacaacctggattaccaaccttccagctaagaaaacgcgtaatcgatgccgcttaacattaaaggtactcttgattagagggtaatttatatatttaggttttgaatattgatcttcatggccactttgcgttttgaactaaggtaccctcagtaaggtatccctcttgctttatttagcaattagcacaatgactttctgaaaaggttgaaagaaatgactgggcttaaaggaaaatgttgtgcctgcctcttcagacaaaaatataattaaaaaatgctaggaagtgtagcttgtctacctacaaaatcatccaagattgatcactctatctgacagataatgagagcatggaattagttctagcaggctgtaccaacggcatatgcatgacaaattggcaatgctaatagtaagctaacaattagaactggaatgctcctcttgttcattcattggcatcgttcccgaatacgacccaacgcagca

SEQ ID NO: 29558 - DNA, 238 bp, Oryza sativa
cgtcaatactaataaaactttagccagaaaaaaaatgtttttatgctttggtcatagagtcatggtgtggttttggggttacaaaatccattagctgaccagaacaaccaactcgctagtgttcgtgtagataggtacaagttgacgaactgacgagcgtttagatgtgtggtaggccggggcaagccatctgatctgctgattctctaataatctctactgtattgcctaatcaagg

SEQ ID NO: 29559 - DNA, 165 bp, Oryza sativa
attcctgcagccccactctaccatgaactagttactattaaatgcagttttgccaaatttgcctctctttttttattctatgtgtctccaatagtggataacatttttatgctcaaattgtcctcaataaatgataatgctaggctcattgtttttgcccttaga

SEQ ID NO: 29560 - DNA, 1213 bp, Oryza sativa
  unsure (1)..(1213): unsure at all n locations
attcctgcagccccactctaccatgaactagttactattaaatgcagttttgccaaatttgcctctctttttttattctatgtgtctccaatagtggataacatttttatgctcaaattgtcctcaataaatgataatgctaggctcattgtttttgcccttagaatatttcacagacttgtcgtgcccccacgaagctgcggttattgacctctgttttggactgttcaatttcaggcatatgcatgccttgccgtggacgatggatcatcgtatgatttgaaacactacaccggatgttaacttagaacttaattaatagagaaaccaactctaatatactcatgctcaaagtgtcaaaagtcaaaacaacactcgttttatcgctaatctgtaggagttgtacacgtcagaaacaacattgttttgttctgttttggaaatagaatataaccaacaaagaaaagggagaattttaggttgaaataaataaagtatattgcaaaaggagaatccagccaaacaagtaggagtttaggagaagacaacattgacaaatttaaaactctgcacacacttacaacagggatcacaatgtaataatatattaaaatattataaggttgatccgttgatttgagttggacattattgattggccccaaatgttaataaagcttggaatttctgtggaaaccattcacatggatcgagtcaaataagtacaggctgctgggttccagacaagaaacacagtgatatgccaatgtgcactgtatctgtactggacatagcttggtctagccactgtccagcgtcagcatcttgcagttccagcatagtgcaaaagggattcaatgatggcaataaaacagcaaagattagcatgatgttnattgttgggcgagtcagcatcaatatttattagcgtggattggcttaatctgcctaccacatgagttttgtgttaataacctggctgcgtaattccagccttccaatttgacatacagaaacaaaggtctaaatgcatttagttggtgtgactaactcatacttctggcctataagtttcaatcgtacaataaagaaaaaaagagtactcaaaaagttaattacatatctcttacctgctcatcgtaccacatcataaactgccacagccagatacctaaaactaagcaacatttgcttttcaacgaacaaataaaga

SEQ ID NO: 29561 - DNA, 1501 bp, Oryza sativa
atgtaaattgtgaaattgatatttagctgcgtaacacagattcagggccagagacatatcaacgttgctgcggcaatggcgatgtcttgcaaattctgagtccctaggtagggctgaggcgatatttatttagttttgatacagccctcattgtaacatgttgtgcttttttgtatgttgctatgagctgctcttcacgcccacattttctctcttttctttctagtttcctagctcctcccatctgttgaggaataggcgtttttgtcagattggaactgttattatatgatccattctttgtagacatgaagagattattatgacaccagcacaaccttacagttaatctgccctcttgagttttgtttacacatactccgtttctgatgtgcatcattttctcttcgtttctgctgggaagtacagtgttctacaccgtaaactcaccaatttaatcaacgtacgtgtaaatactaattagttgaaaatggcagaaaattattcgaatacatctgatttttattttcagcatatgcatcgttttcatgttattcagctctgaagtgaaaatacacgcgcatctgaatttctgaatgtaaatcagtaactcgtagaaagggtatgtcttgttgctgcataagcatgtagccaagggcatgcatgtggtttattataagtacaaactttcttttacaaacattttacaaacgatgtgattaaatggagggttttcggggagggttttcggggacagcagctgcgggcttaaatgtgtggttatttctgaagcttttaccttggtaactcttgttcactaccctaggggaggctagagtagcatggccatggcttgatctgctatggcaggagaagccatcggctttaattgttacggtccttattataaaccataacgatttattagcaatttaagaaaatgatatatgagtaaaattttatatatatgttcttagtgattgaaatgccaaatctaaaaaaaaaatactatgttgaaaaaccatcaaaatcaagttttactattcaaattttggctttggcttataagccataaggcaaacaatgaggcatgtaaagtggctagtgagcgatgtaattgttctttgatctaataaattacctgagttttaaaaaaaacgatgtgattaaatcttgatgttttaaaactccaatcgataataataactaagtagatcaaatggtttatttctttatcactccgaatttatttaaaagctcctttactagcccatttcaacagcccatctcaagtgagcacaaagcgagagggagggcccagcccacctcaccctcaaaaaccctaatcgagcccctcccgcatccatccaacggtcaagatcacccctcctcacgatccaacggccgataccccttcaccgaacactataaacaccccactcactctcccacctcccccttcttcctccccacccacccgccgccgccgtcgccgcccttc

SEQ ID NO: 29562 - DNA, 1501 bp, Oryza sativa
gggggagcatccccttgccgagcaccttggtgtagccgaactgcgtgacgtcgatgacgggggccttgccggcgccggcgccggcctcggcgggcaccatggaccagaggcgctcgacgttgacggcggggcagtggaacctgttgctgagcctgtggaagtagcgcatcccgaccttgccgaagtagcccgggtggtacttgtcgaacaggatgcggtggtggtgcatcccgccggcgttcccgcgccctcccgggtgcttccggtgcttcccgatccgcccgtgcccggccgacacgtgcccgcgcttcttccggttcttcttgaacctcgtcgtcatggcggcggcgaagggcggcgacggcggcggcgggtgggtggggaggaagaagggggaggtgggagagtgagtggggtgtttatagtgttcggtgaaggggtatcggccgttggatcgtgaggaggggtgatcttgaccgttggatggatgcgggaggggctcgattagggtttttgagggtgaggtgggctgggccctccctctcgctttgtgctcacttgagatgggctgttgaaatgggctagtaaaggagcttttaaataaattcggagtgataaagaaataaaccatttgatctacttagttattattatcgattggagttttaaaacatcaagatttaatcacatcgttttttttaaaactcaggtaatttattagatcaaagaacaattacatcgctcactagccactttacatgcctcattgtttgccttatggcttataagccaaagccaaaatttgaatagtaaaacttgattttgatggtttttcaacatagtattttttttttagatttggcatttcaatcactaagaacatatatataaaattttactcatatatcattttcttaaattgctaataaatcgttatggtttataataaggaccgtaacaattaaagccgatggcttctcctgccatagcagatcaagccatggccatgctactctagcctcccctagggtagtgaacaagagttaccaaggtaaaagcttcagaaataaccacacatttaagcccgcagctgctgtccccgaaaaccctccccgaaaaccctccatttaatcacatcgtttgtaaaatgtttgtaaaagaaagtttgtacttataataaaccacatgcatgcccttggctacatgcttatgcagcaacaagacataccctttctacgagttactgatttacattcagaaattcagatgcgcgtgtattttcacttcagagctgaataacatgaaaacgatgcatatgctgaaaataaaaatcagatgtattcgaataattttctgccattttcaactaattagtatttacacgtacgttgattaaattggtgagtttacggtgtagaacactgtacttcccagcagaaacgaagagaaaatgatgcacatcagaaacggagtatgtgtaaacaaaactcaagagggcaga

SEQ ID NO: 29563 - DNA, 385 bp, Oryza sativa
ttttgtgctgttgctgctgttttttgtgttatggaacgaattgatggtatggctactaagatctgtggtggctattcatgagttttgattgaattacatgatcatgtaggtttatgtcaaatatttttgtgccgcatatcattctgattattattcttgatatcgaaatgctattgggaatggatggtttgtcgcatcaagatttgccatgtagtatctgtattgcctgtcagatgcggatgccaacctaatgcatttggatttgccttggattttggcgtaacctaatgcacatataaggatgcagttcactctaatatatttttaatagagcagcaaattttaatagtagaatttgttgggattataccggtgttattattca

SEQ ID NO: 29564 - DNA, 1501 bp, Oryza sativa
gaaggaaggaaggaaaagaaagctgcaagaacatggacaagtcgacaagaacaggagagaaattaatggaggagataaaaaaaatgtagtgaaggtgacggaccttgaagtcgctgttgaccttggcgaggccgaccttggtggagtccttgagggcgccgtaggccttgcgccgccacgaccccatcgcgatcggcgcgacggcccggccgcgggcgtgcgctgagacctccggacgcccgcacgtactctctccctccctcccgctacggacgacaacgacgacgacgacgacgcaatgcgacgcggcctccctttttccgatcaactcctccctctcccgctaattttagcccgcccgcgcatgcgatccaccgcgccgcgcgcgagctaagctccccaactccctccctttcctagctcgtgcgcgcgctcgcaatccgcgtgtttgcaattttatttttgggttgattggaaatatgcccactcaggtaaattttattttaattcatctagtcgtattcatgtcattcgaattcgcacaaaattaaaatcataccatcaccgtcacattttcggttatcatacagaccaaaatacccctagacgactagacgtgggacccacattttagttccatcttcttcctccgttctcccatcttctttctttcccatctctctccacatgctagttttatcttcatcagtgaagccaccccacagccgtcgtaaccctagtccccgcaccctactcctctccttgccggtagcaagagcttcgacaagtaggggtgggcatttggttagaccgaaatttgtggtctcggtcttcggtctttcggtcatttcggtttttgaaaggtgaagaccgaatttcaacgcaaaaatattagaaccgaaaaatttcattaatgaaaatgttgctaaatttcggttaggaccgagaccgagactgagaccgaatttggcggttatgatatttctgcgttgaaattcggtcttcagcaatattttcaatgctgcctgaggaggaggccgagcccgacctcgccatcctatgcttgaggtcaatgcattcctcgcctgaaggaaggaggacatcctaccgaccatctgagtcagctgacacgtcgaataaaatcggagtcaaaaaccaccgagggaacttgcactggatttgtaagttgagagatgcgttgtatccggttttaaggtcgagggacgattttataactcaatgacaagttgagggaccttcggtatacattttccttttccgaaacagtgagcctctacacatgtctgtcacacaagcccaggtcggcccagcctagcccagcccaacccatcccaccccgtagcgaacaaatccatcccttgaccacccacccacccttcctcctcctcctcccgtctcggaagccaccaaaccctagccgcgagccctgacgttgcgaggaaggggaagaggagagatcgagatcggagagatccatcca

SEQ ID NO: 29565 - DNA, 217 bp, Oryza sativa
caaaaggggcaaggtccaaggcatccaatgttgcactcatctatgaaacaacctgcaatccatgggagaaggacgacaaggagcctcgcatgggggttcgatttagggaggaaatgtttgtgggttcgattttgggaggaattgtgggttcgattgcgtgaccacgaaaggatatcgaaagctcgacaacgggtggttctaccttagacggacggta

SEQ ID NO: 29566 - DNA, 1501 bp, Oryza sativa
agaaggccatgaggccgtagatgacgtggaagagcggctccggcgagctggtctcgatgtacttgtcgatgtagcggtcgacggcctggtcgctgctcttcttcacgttctcccagctcagccgcggcttcaggtaccccggcacctcccgcaccttcatcccccggatctcgctgatcagggctcgcagcgccatggatggatctctccgatctcgatctctcctcttccccttcctcgcaacgtcagggctcgcggctagggtttggtggcttccgagacgggaggaggaggaggaagggtgggtgggtggtcaagggatggatttgttcgctacggggtgggatgggttgggctgggctaggctgggccgacctgggcttgtgtgacagacatgtgtagaggctcactgtttcggaaaaggaaaatgtataccgaaggtccctcaacttgtcattgagttataaaatcgtccctcgaccttaaaaccggatacaacgcatctctcaacttacaaatccagtgcaagttccctcggtggtttttgactccgattttattcgacgtgtcagctgactcagatggtcggtaggatgtcctccttccttcaggcgaggaatgcattgacctcaagcataggatggcgaggtcgggctcggcctcctcctcaggcagcattgaaaatattgctgaagaccgaatttcaacgcagaaatatcataaccgccaaattcggtctcagtctcggtctcggtcctaaccgaaatttagcaacattttcattaatgaaatttttcggttctaatatttttgcgttgaaattcggtcttcacctttcaaaaaccgaaatgaccgaaagaccgaagaccgagaccacaaatttcggtctaaccaaatgcccacccctacttgtcgaagctcttgctaccggcaaggagaggagtagggtgcggggactagggttacgacggctgtggggtggcttcactgatgaagataaaactagcatgtggagagagatgggaaagaaagaagatgggagaacggaggaagaagatggaactaaaatgtgggtcccacgtctagtcgtctaggggtattttggtctgtatgataaccgaaaatgtgacggtgatggtatgattttaattttgtgcgaattcgaatgacatgaatacgactagatgaattaaaataaaatttacctgagtgggcatatttccaatcaacccaaaaataaaattgcaaacacgcggattgcgagcgcgcgcacgagctaggaaagggagggagttggggagcttagctcgcgcgcggcgcggtggatcgcatgcgcgggcgggctaaaattagcgggagagggaggagttgatcggaaaaagggaggccgcgtcgcattgcgtcgtcgtcgtcgtcgttgtcgtccgtagcgggagggagggagagagtacgtgcgggcgtccggaggtctcagcgcacgcccgcggccgggccgtcgcgc

SEQ ID NO: 29567 - DNA, 486 bp, Oryza sativa
tcctgcagcccgcatttaatagtaactagttcatggtagagtgaaatattgccgcaatgcctcgtttgttcacaatatttatccgcggtacaatgtgtacataaaatttgggcaattaatacatgatgtactttacccgcacaaagtattcaattagatatatagagagataacacttcgataaaccaaaaactccgaggatttgccaatccgttctaccattaattaatcctttcatatgcgtatgacgtgggttttggtcgcgtgttattataaacaacaaatgctagatttcatcttcaactactactacgtacaagggagagtggaatgtcaaatcataaaaatccctgcaataaccacattctcctatgttgttttgtgcacaaacacaatggatcaatattgccatgtgaaagaatatctgggcagtcaataaaaaaaatgtatacactactatagcacatcagatgatctgaccaagag

SEQ ID NO: 29568 - DNA, 1501 bp, Oryza sativa
ccattgacaccaagcccttccttggtgtccatctttaagctggacccaagtcttgatctgatctggttacaatacattgttagaactgaatcctggacatcatcctggtcttagacttcagagctgaaattcttagggataaactattctcagtagttttgtcctggtaattttgaatctattttagtattatatactacatcacataatctatgaaggattcacctgtatgggttctgccatcacaagtacagtaattgttgaaaatttactcagtatgaaacatggcatatgttcttagacacctcattatttatttttagtaaaccttgtttttgtccatgaattaacattttttaggggttgcttaaatatcagagcctatattttgtcaaatatgtaattgcttaccgcattttagagtaaacacaatgaaataatctttggattttcctatttacctaattccttcttattttcttttagatgtacacgatcttttcaagtactgtactttatgtggctgatgttatgtttccttacgtgttttcatttcatatggcaatcatgtgcagtccacatgttggcacactagaatttctttacttttcttagaacaaaggacaaagcatccaatacgaccaaatcagaccttttgggggcaagaagactgatggaatagatttaagtctttaagcttcatctgttgaatggatacagaacaaattctttcaaatgctttacacagatgctctatattggcatatagtctctatggagactaggttaaatatgaccagtagatttgcatatcatttcgttttccattctgtgatgagtggatataacaacttcccgcaaaactcttatcttcattatttgcagggtagcatttacattttggatatgcactgctgatggactcatcaatcctgatgctacgatattgttgataggcctgttgttcaaaatacagtgaattattccacaaaatatttgtgttgtaaatctgtttcttagctcgacaatgaatattttctgaacaaagttactgttagggggatgtgcatgcaaaaaagtaaaatattcaaaccatcattctgtatcatcaaggtttgttcatggatgagtagctagaaagactcggtgtattagtgaacttgaattgtttgaatgcattgttcctattaagaggctcatcttcctttattagtgttttagttttgtacgccttcaaattttagacaggtagctattgctactgggtgacaactgatgttccttgcaactgaagaacaatggtagacaggaacaggtgtagatgttccttgctgcccccttattgtatcagcatcacagaaatgtgaaagataaaatagcttgtttcctatactatgcccacctgagaggcgagttaatgcgtcctggtagctcatttcctttattttacagtgtgtgactaagaagattaacatatcatgttctcgttttcatgtatagg

SEQ ID NO: 29569 - DNA, 1501 bp, Oryza sativa
tgttcagtagatcttgtctttaacttcttcaatacaccaagcttattgggctaattttgtgttccagaacaaaatgtcagactttaccttcaagaaaaagggaaagaaaacactgtttgtagggagacaaatattagcatattatttagtaaccaaagacgtgattctagtagtttctaatactacttccgtcctttaatatatgacattgattatttcaaaattgaactaaccaacgtcatacataaaagaacagagggagtatcaattaggatagcaaaaataggctttcaaacccatatttcataagagtaaccgcttgcaactgtatatgcatagttacagatattaagatggaataaattactctgagtaaaatggaacaggtaaacctcttctcgcatatagcattgtatctctctaaaacagacttgcagtacattatgagtttatgaccaaatcatctcaccgattcaattttgtaaaatttaatgctctaattggatctaacgccaataaaacttatgcaaaaaatatttcatgtattgactgttcagttctagaattcccctatttccctcctatcaaaaacaagtcaatttttttcaattcaaagtcaacaaatgccgctttgaccactgaaattgtttacttgaaaagagattttaaaatgtagtttgattgaaatttttactcatatcttttcatttcatgcttcgaaaccatatattcaagacaatatattaaagtagaggcttaacaacaataatgcccacatcctgaaatggcatgaggtgcaatattcaaggtacaattttagggtagtcaagcaaaagtacatcactagtgatcagttgctgagaacatattagctttctaactgaattcgaactcttgaaagcagtgcatgtccaacatgctgaaactcacagatcaaagaaagcataagtgtgcgtgcgttgtgagtgtcagcattgtactgtgtaattctcaaaaaaaaaagcatatatttcatcagaaggcagcctaatgaaaagcacatactgaaatatcattgcattcggggtgctaattctttgttctgcatttttcactaacctgtataatcttttcagaacagactgttatttgccacaatcgcagtagagaataaatccttcagcacttcatttacattcacataagctatatggaatccaaagcactctttgattcttctgtcattgttgtccagtaagttcaccactaactctttgatgctgattgcttttgttctacagcagagattatatgtacgaacatcacaagtataagttggagaggagaatatttttttccctatataaatggacaaacatcagtacattgatgcaaataaggaagcacccaatacatgctgtttagctccacacaaatagttagaaaatgaatcattgtcttgtagtatcccacaaaaaactccaaactttccgcacatttgcagctagcaagttctcttctt

SEQ ID NO: 29570 - DNA, 1501 bp, Oryza sativa
aattcagaaggcaagctcaaccagatcagaaaaaaatagttccaaattccaccacatttatacttcgtagtttcagactttcagtctcttagctagtcagttctattacaggaatagggaagagtgcatgacacttcgacacgaggactctgaaaaactcaagtccgttcacttggacacatcacgtttcaaacgtagctgagctgacatagaagtaggaccagtagtttcacttggacatgccgccgttggggtggttgtcccagccccaggcgtcaaccacctcgccgccgggcatctgcaactgctccggctgggacagcccggccgtgaaggggtcgtcgccggcgtagtccaggccggcgagcacgtcggggacgcggcacgcctgccgggggttcagcgccggcgacagcccgcccaggtggccgagcccgcacgacagcgccccccgcgccaccatgtcctccgccatcttcacctgcacttacaaacggggacgaattcagagctcagaaaccggccgaaaatgcaggacggatttgacgatggctacagtgatgagcaatgcaatgtgcagatgaagatggagatgaatgatcaccttgacccggagggcctcaacgtctgatttgaggattctgttgtccgtgacagaagttgtgaattgctggttggcatccgtcaactgcttgaaaagcgatgcgttttcgccccggagctggtcaacctgacaaacaagagcatgatttgagctatggaaatctgaaagaaccggcactagcatttcgcattttgactcagaattacagctaccaattggcacatgatttgttagtcgaatcaatctgttactgtttgaattgaacaatggcaaatgttcggcaggtacaaaacttcagatcatatcagtttacctgtgactcgagatcagctaagtgagcttgctttctcttcctcgatcgccgagcagactcccgattggacaccatcctgtaatttgaagcccccaaccgtttcatgcaagttctttgtcaaacattccttctgaaaagcaatgttcaacttctactactagcgaatatgcccataatttttcacgcagtgacagacaaaatgcttgacatagtcgcttatgttcttggaataccttctcactctcttcacgtccaacgggttcgtgctttgttcgcatggaccaccctctatatccaacagcgattcactttcagaatccgaaccacttgtgcctcccagagtttggctctccttcatgttcagattggtagctgatgtgggacttgctgctgctgattacagaaaattgaacagagagtgagcaagaacaattaaataaactgaacattgtttgtgcctcatcaataaacacaattttgatgcagtacatgacacagtaacagcactggtactgtccatggatgtccatcgctgaaatctccatgagttgaaaaatccaagttgcatgtgcttttcagtgtgc

SEQ ID NO: 29571 - DNA, 1501 bp, Oryza sativa
acaaaataaattatagatttcgtttgcaaagtgtgagatgaatctattaagcctaattaatctgttattagtaaatatttactgtagcaccacattgtcaaatcatggcgtaattaggcttaaaagatttgtctcgcaatttacatgtaaattgtgcaattggttttttttctacatttaatactccatttgatgtgacaggaaagttggaagttgaagggaactaaacacaggccgagtttagttgtaaactttttctttaaacttctaacttttctatcacatcaaaactttcttgcagacataaactttcaactttttcatcacatcgttttaatttcaacggaacttttaattttagcgtgaactaaaacacacccacagtaaaagaatcaaataagcccatagcactaaaaagttgcagttaggtggagttgaaggtcgccgggggcgggagggagggaccaggtcaggtgcgacgctccctcctgctgggccgcgtggccgtgctcaccgtgtcgctcactcacgcgcgtacgcagttgaagccgcctctctcgccgtctcgcgtacgatcgctacgagaggccaccacgaggccttttttttttcctatctgcttcactccctcttgttcctcatgttaaatacttcattcgtttcgtttcataatgtaagtcattctagcatttcccacatttatattggtgttaatgaatctaaatagatatccgatatgaatgtgaaaaatgctagaatgacttacattgtggaacggagggagtatgtctcattttgtattaggcctagtttttttttcaacttaaaacttcaatttcgatttttgttagtatgttttttaaaatgctaaatgatatgtctgttacaaaagtttctatatagaagttatttatgaaaataaaataaatttattttttaaatttataataataatgcttaattaaacatgtgttagtcatctttctcgtttcacgtacgctaaaaatttctctccaacacgacagaacgaacgtagccttagggtttattcggtttggagataaagtaaaggattttaatttttatggattagtttctacaagtaccatttgggatttgtatgaataagatataggaaaatcaaatgaaaatgttcctttcttacaagtcgtagagagaaaatatataaaaatattcatccactcaaaaaaatttctatggattaatgggttcgtgtattactatttctccacttttttttattttcatgggttgaaattctctcaaaccaaataagccattgagttgtaatattttaggagggaggtagcacgtgctatcggctcaaaagcgatcggcaagacatgaggacagcattccttgatcattggctcttcccattcaagctaacacgactggggggtacacactgttgttagtgctaacaatactgtccatacaagtggtaagcccagtacattgagataccaactaacaccaa

SEQ ID NO: 29572 - DNA, 1285 bp, Oryza sativa
tcgctcttccaagtagccgaggtcagggagcgtcggcttccttctttttgtcgctcgcaggcctcctctttcgggtggccagcgaaatgccttcgacggcgaggacatgaccctcgtcgtcggaatgggccgacctcttcttcctcctcctgtcccgccgccctgaccgagcggcggacccgggggcggccgaagctgccacaccggaaccggaggggttccaagtccaggcctcctccttgcgagccactcggtccgcgagctgaaaaagctccgcggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggccccccacgcagatcttcctgggtcggaggcgctgacgaaggagtggcggccgaatggcgagcaacagccgccgctcgccgcgccctccgccttgacgacacggagccggtggtagcagcgccagaggtcttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagcttggagcgcgccctggggcgtgctgccgtcgccgtagacgaggagacgacgctccccatctcgccgcacttccccatcacccgtggatgtcgaagtcgcagatccttcgaccct

SEQ ID NO: 29573 - DNA, 1501 bp, Oryza sativa
ctagtgtcatgtgaaaagtacacctgaatggtggtttattcacaagtggtaattgttttttttgttaattgggatggttggcgacgagaaagatcggaatggaaggggattgggtggatatgttagagaaatttgtcatgtgtgtcatattttgttagatagacacaaggttcagtttgatttagggaaatgatcagatcatgttgcccgggagtacatattttaggtgttaaaagttaggaaaagtctatacgtactcactttttcttactaaatttttactaacactgacatatcatgctataagtgtatctagattttttttataactttcatctacttgaattaaacggttgagatgattgttagtacaaatttagtaagaaaaatttagtacgtgtagcggtgctctaaaagttacgtcagttagatgagggattaactcttgcgccgactgcccattggtcagcttccgtacgacaattgttctgcgtataatagaagatataattatacttattagctaaaatttaaattttaaaccttatatttagaaatttttttaggttttacttcatcgtagtttattttttaacctttacttttagattattaagaacacatataaaaaagttttattcataaattattttttatttacaaataagtcgttttgcttttttctctaatatgccaaatgatgggacttttaaatttagaacaatttgtagggcatcatattacttgtgctaattgcagctgttttccttgttgagataatgagttaaaacccgatctctactttgtaaatggattacacggccaaaagtttatacaagagtgcttaagagttaagactcaaccccttacacgaagaacatgtctcaaacaaaagttaaccaaccaaaaaaaaaatacaaagttaagtttctaatctcctcccgatgttcctgttgaagaaacactttttctttaacacaatgtcatcctccaatttaagcaacatagaccaaaactgcgcccaatgaatctccctaaaagttacctatatattttttttaaacaataaagttttaacacaccattaaaaaccacatcgttcctgtttgaccatatcgctagccaacacttgatattttaccttaggttgaacaccattatccttcccttggccaacacagctccgagagtaagctacatagaagttagaatgttacaatgtgattataatattatagttatagctcaattaaatatagttatactctaagttatatatgaaaaataattcaataaaaaactgtgacttcagctgagtttagttccaaaaaactttcatacacatacaaacttccaacttttccgtcacatcgttttaatttcaaccaaactttaaattttagcgcgaaataaacacacctgaatctttaaaaaaagaactttgtaaaaaaaaaaccatgttggagtggagtatttagtagtacaaacgagcgggaaaagg

SEQ ID NO: 29574 - DNA, 412 bp, Oryza sativa
  unsure (1)..(412): unsure at all n locations
ttaaaaaaaatcataaaataaaactatacattacaaagttttggtggagaccgctggattatactcttacggttttttgaggcgcttgccaagtaaaaaaagggaagggnagcgagagcgggaagttccaaaagccgggattcaaataatctaaattctatgcaaaatttaagaattttcggatgcacttaaagaaggacaagtccttgattctcataagataaataatcgatattgtggaatattctccactaaatatcaagaaataaaaacctccacagaaagagctcccacatgtgcaacaccactaaataatttaatccctaacaaacccaaattcccagctcccactcacccatttgctcctttaaaatgttgccaccaccttctccttccctcctctctctctctc

SEQ ID NO: 29575 - DNA, 517 bp, Oryza sativa
tcaaaatatatccttggggttttgtgaaattttgatcgtaatacctaagattttgtaggttttgttttagaaaaaactaaggtcttatagaatttacttaaaaaaagcatatacaacagactatgctttttggtacgtagtgtgtcttgatgagctcaaccttagtctctcgcaatctatactacaggaatgagcatcctatgctgttgagatctctctatattttctcttgttgagttttgagacacgctgcttatctagtattaattgctaggggactgcatggtactagctatagcaagtgcggttacttataaaaaaactagaatattagggaaggacctaatatcaaataattagaaggggtgaggttttgaacccagatcgtctagcccaccaccttgtgaagctagctggaagacccctggtcatttctcaagtgcggttacttataaagagaacaagacactatagagccttaattttcaacacacactatcatattttttgcattaga

SEQ ID NO: 29576 - DNA, 561 bp, Oryza sativa
ctagtccacatcgatcttttcttcaaaatatattttattcaatccatccttactctctccgttctaaaatacaaatacaagaacctaaaatcggttctaaaatacaaatacaagaacctaaaatcggatagaacaattctctgtctaggaaatgtctcgtccagttctagattcttatattttaagacggaggaaatataatttatcttaaaatataatgacgtctcgatcaatgttatcttttcaaccaaacataacttttcaccattcgattttctcgtaggcttctacttatcgaccactcacaatattttcttattgaattttaaatattttattaatactcgtgtcaacgctaaaagtttatattatagcacgatggaggtagtacttgacttcaagttccatggtggaaaactcttgcagtaaaattaattaagaatccaacttgttggtcaagtggtagctagctagctagaaaaaaaaaccagcataatagcgatttgtaattgatcatgagtttgttttgtttcttcccattgtgatcgatttggtgatgca

SEQ ID NO: 29577 - DNA, 1501 bp, Oryza sativa
ggttgaaagaacgatggatgtagagctgtttgtttggttggaagatgtgctctgattttctttttttatgcggcacacgaacctccctagttatcctcaagtcatggtagatcagtccgaaaacgggacgggatgggccaacccgtcacctataccctctgccccaatttagatgggaaccacttggaaaccagggagaaaaattggcccgtccctcttgcagtggaactggctggccccattaggttctgcaggactgtgcactagttcaggctgcagcgcatgcaaagtgcacactaagcatcacacagaaattcagactgacaagttgataatagaaattgacagattgatagctgaataattcagaacagaaacagaaagcgtgccagattgaattaaaaccagaaaatagaaatttcaatccagaaatttaacaaagatacatactccctccatactcgtaaaggaagtcatttaagacagcgacacggtctccaaaacacaactttgacttcttgtttctataaaaatatttattgaaaagtgatatatgtatacttttacgaaagtatttttcaagacaaatctatacatataatttttatattttcaaactcaacaacttgagagttattcatgatttatattcccaaagtttgacttaaacattgtcctaaacgacttcctttatgagtacggagggagtacaactccattaattttctgagatgttcagatcagaaactgtgattcctttacgcatatcactagcacaactgccaaaaatcgaattgaacatcagaaaaatccatggattgtgataaaatgaaattcaatatttcagagtaaaagaagagtttgaatgggaagcacacacttgaatctgccatgctgctcaagatgcaagaacaagaagtgttcccattccttgctcactattctgactggtacatcagtatgggctgaagaggaaagggcatcttcagcttaatcttgtaaaaaatatttgaaacttgacaactcagctgttcacatcaaggttctctatgtggactatgctttacttgaattggagcttcagaagagcattgaggaactattgtatccctctttgagtggggaaaacaaagacaatgacccagtggtctaaatgtcatgcgttgcccctagccggtctgtcctggattggcttctgcctgtctcttgttaggcctgcgtaatcagttacggtatgtagctgctggtctgtcggctgagtagggagtagcacccagcgtcttgcgctaattagggcttcaacacatcagtttggtgttctattgctgcagataattgcaaaacaaacttgatttgttacagacattgtactgacctgactagtatttgttttcttctgattttcttcatgatgattattcatggtattcagttccaagtggtgcctccatatacatcttgtctatactcttttatatactattaatggattgtttctaaa

SEQ ID NO: 29578 - DNA, 1501 bp, Oryza sativa
aagtgtttaatgcaggcttcaaaggaaaggctgttgtttttgcaattgattttatttaaactcctttttgaaacaactaagtgagtgcttctcaaacgacacggatgggacagtgcgtctcgtccggtcggagtatgtgcaatgtatcagtctttgaattgatcagggttggcacccggccaacagctttcaaacggccacccgagcctggctgatcccatcaaccgcagattttttcaaacatcgaacccattccacagcagcaatttcacaaagcagtagtcaaacaaaactacgctaggaatcacctcacatccgcccatgaccgtgggcacggctgttcaaacagtttaataacctctgcatagggggtacactttacccacacgacattactaacccagatcttccagcccgtgcagaacggccacgtctagagaccttaaggctttcatgacaaggcatttcgaaagccgacacaggttcaccatatgccaacgagaggggtcccagaccaacaacagattaggtcccagaccatactgtgccaggaaacccgggggttctccccggcaccaccccgttgaatccacatgtctcttggcatcatggcacccccgattagctagttactcagccaggggtgtcccattccacccatgtggtcgcacttgtcttatgttcggatgaaattccaaggaaacagtccttaagtgcaagagcgggaaaccgtactcccggtacgttccccggtccgcgattttggaaattcatttagttcgcaagcaccgacccaggtgtcgggttttccaagtcttttgtaaaacccaagttttacccatcgttggatattttaaattttgagggggggtgttccgatgcgcgtacccgaaggcccatgcatcgaagcacaatagttggcaagggaggtttaagtgttcaataattcacggagggtaattgcagcaattaggattgggggccagcaggctatctcacaagccgcggccaaattacttgtgtagatcctattcatgcaatatttgcggaaaagaaatacttagatttaaattataggtgcaagatgatcaaaggtgtcttgccttgctcgagaccttgagcttgatcctcgaaatcctcgcactgcgggtcttcgggctccgaaactacacgcgagacgggacaactcaacaaacggtgaaaataaagccctattatggacctctaagcgtgccattagatagatctcgagatttgaggaattttagaagttgaacggagtcaaacggacttacggttgggaagatattgaatttctaagattattggatttttgatctaaaggaaaaaggatttatttaaaacctttttgagaaaagaaaagaaaagaaagagggaggggaattagacttccgtcgggcagctagggcgcggcccgagagaaaggggcggctcggccgagcttaatgggccggccggcccgagaaggcggcccaaggcg

SEQ ID NO: 29579 - DNA, 1501 bp, Oryza sativa
cagtttcaacgcataacattaccatatcatggcatagttaaagatccaggtcaatctgcatcagttgtacatgacacttaattgttcatgtcagcagcatattacaataatcaatctggacatggcccgggctatctcattccgcatcctctatctcggtatcctctggaacgcctcggagatacaaaacgttgttgcacctgtacagttcacaaatgaaacaaataagaattatacatcagacaattgaatatgttttgtgggcaaccacaatgttgaacaaaagcaggtaacaagcaattaatataggcttataaccaggtaagaagcattgtgggtagagacaataactactaccgggccattgtgctactgccggtaacaagagaataaagaacaatattttctgtagatatgggaatctttttgtacgagcatggctataggagatagttttacaatgattctttttaaggtggaccccaccttaatttgcagaataggcatagcacattgtgagctttgtaataactgttaccacctgaaccccaggcccacgttattatccactttggtagtatacattgcggttgctctttaacgatttagtcagcaaaagacttcccaagttataagcgctgctacttgttatacttctgcatttgagtaaattccatatactctgaactctatcattctatctctccacattttaccatactatcattctatctcttaatattaccagtcagactgaaaacagggtaatagcatgcaagtaaccaacagatcacctatgagtacataagtaccagcggtaagccaataactacagatgaatctggtccaggactgaagggcgatatatagagttaccttatcagtatctcacccaagtttccagagaaatgcccatcaatatactcctctgtattagccagctgaaagcagtagacaattaggtaaattgcagcaaaagaagatgacacgtcgatccatattggtaaatgaacgaatttaactgatacaaaatacaaaataatacctgcagattcatataagagtcgacagaaacaagatatcctgaaaggggggtacaaaaagagtatcgtcagcataatcgataataaggcacagtctgaaaactaaattacaacaagaggacccattttaacacatgatttccattgaagttccattgtaaaaccaatgaaagtggatgttcttgataagtgccatgaagtaattgtccatggaagcaagaaatttcatgtaaaaactggacaaatttcaatgttcctgaaacctcagagatttcattctgaaatttcaatcactagcctaagcatatcagtgaataaaatgtgacgggtaaaagtatagattacctttgtattccataccccacttaagtttgacaatgacaggcttccctgtcaggttgttcaagaaaggcttcgggttaactggcacagtctgcatttagaaacaatccattaat

SEQ ID NO: 29580 - DNA, 1501 bp, Oryza sativa
atccattagcatataattaattaagtattagctaattattttttaaacatgatcaatatgatttttttaatcaactttcgtacaaaaacttcttaaaaaaacgcaccgtttagccgtttaaaaagcgtgcgcgcggaaaacattgaagatgagttgagatacctagggtaagaacacggccttagtattggatgtttccttcccttatatagtttcttacgtagtgtccgtttcctgtccgtttcgtaaatattttttttatatctaccaatggtagtgtccgttttgtaaatattttttttataattaccaatggtctttgagaaactctaatatatttcacaaaagatatacctatgtacaaattttctctgaatcgtttctcgttagttttatactccctctaattcatattataagtcgtttgactattttcctgattaaattttattagatttgatcaagtttacagaaatatttagcaacatctaaaatatcacattattatttttattaaatctcacataatatgtttattttgtcttgaaagtactattattttttctataaacaacttataaaaggaaacagagggagtagtaactgtttttgttgttatcgtcaaacttaaatttatttggtattaacacatgcaatgagggaaaaatgtcttattctaaattgggaaaaaaacaattatagccaaaagcttgaggataaagacactccctcatacacgatgtgtcataggtaaacaacaaatatatgaaaccgtcaattctttaggataaaaaatcatactcttgtaaaccaattctaaaaattcagcttgccacatatacacacaaaatgacatacaaaaccaaaatgtcacatcacatatatagaaaacaaatacctaaaaacttggatattccaaccacaccaaacttcttcgccaacagcttccatattttagacatgacatatatgccgtgcaaacgaaaaagatttactctacagcaggcaaggagaaaaggggagatacacgagataaaagtcagtggcctgagagagtgaaaggctgaaactcgagcacaacccaacactgccagcagaaaaaactgaaaaaaccagaaaagccaatggtcaccaaccccaacaaaaaagcgagcgaccaatgcgatgggggttccgtaaaatcccatccccttcccaccctacccaaacacccgctggtataatggggttggtaaacgacgttgacgtggcacccctgccccagtcaacgaaccccccctccctctcaccaacccaatgctcctctcgcttacaggtgggtcccacacgtcatcctctccgggccccgctcaccaactccccccaactcccttctccctcccgctcccgccagtatttaacccctcccaccttccattcctcccctctccaggagacctcgccgccgatcgatcaatcgccgccgccgtctcctcgtgtaaccctagcttagtggattagt

SEQ ID NO: 29581 - DNA, 740 bp, Oryza sativa
acttttcgaccaacgtttgaccattcgttttatttaaaatttttatcatgcttaaagaacatttgatgataaatcaagtcacattaaaataaatgataattacataaattttttaaataagacgaatgatcaaacgttggtcgaaaagttaacggtgtcatatattaaaatatggagggagtattatatatcttggaggcttaagaacggtcatatataccaccacccatgcgggggagctaattgtactcgatccatcggctaattgataagaaaacaaaatcaggtaattaactaagtgtaaaacaaaataatacctagctatacactcagctgaacccaggccacaaaggcaggcagaagttctccctggaatgcatatgtctctcctcctgtatatatcgatcgtgtcctcccttcgtcttatattacccttcgtctcataatataagaaattttgagtttttatttacactttttatcactcgtttaattcaaaaaattttaaaataattatttattttttttgacttgatttattatccaaagtactttaagcataacttttcgttttttatatttgtataaattttttttgataagacgagtgctaaaacggtgtaagcaaaaacttaaaatccggaacggagggagtacgttctagctaattaagctactctcactatcacacatcacggaagaataatccatatatccctctgaaaaaaactggctgcagg

SEQ ID NO: 29582 - DNA, 277 bp, Oryza sativa
tttcttgctcgtctcatcggctactttcataatatcgtcttaaaccaatctattaaaccccatagacagtattacaaccgattgggcgtgtttagggtttattattccttgatatatccagcacatagcatatttggtctaactccatcggctgagactatcaactatacactatcggctaatcaactatcgaacgactaattctgcttatattctttcttgctgattgtaggatcaaatcagttgggacgcccttgacacactcgtggctagcagt

SEQ ID NO: 29583 - DNA, 1501 bp, Oryza sativa
aattttttacgttcggtcgtgcatttttaaatccaacattagttttcatgtttccactgtacacgtgatttgcattatatattttcccgtgaatcaatacatctaaagcaactactaaaccgatttttacgtgccatgtgaaaaacaggtgttgtacataggtccctgaattaattccactcgagaactccatgggagggttctcatataaagtgataccaagacaaccatgtgaaagaaatagagaatcgtgtcaggattatcaccccacgaaatcgatgtattgttagaggagaggctgatatattggttgtgcgaccgggataagtaaatcgtccgtcggagactggataggagggtgttccccaagcagttgttactattttcgagttcctgggagttcataccatgttctcaggaataatacacaaatgtcccaataggaatctcgtttgttgtatagtgatgacgtatatgttagacatggaaggcatcatgaattctaggtggccacatttccagagatctagttgataatttccaaagtaggattaatgatcgacaaggtagtcaaaagtgaccatgctatctagctcagtgatataatcaacgtgattttagaaacatttttttagtagatcatattattcacagaagttgggggtttatctcatctcgcatttttttaaagctcttctatgtttatttctaaactttttggctgtgtacctacgggtagatgccggagatgtaatccatttctattattaaaaaaaaaatctagctcagtgagcttgaggcacttcactgggcggctagatggatgaaatgaagctgcaaagaaatatcttggcgcgatatagcaaatgagcaaaaaattgtttttcttgttaaaaaaaattgtatgcgggaatttagttaatagtatttagtaacaccatgcatcatgcttgaagtctttatatatgcaatttgatttggttgccgaagtagtattggctgcacctagcataagacaatatgatagtatcgaccggcatgtagtaaaataaaatactatgcccaagtttttttaaaattcaagatgcaaatctggtgctctctctgttttttaaacctggggtgatcttatttgacaaagggattaagaatgataaagttttttcgcgtgtgaataacagcacaactggaataaccgcgggttcaatatgcagtaccatttctatattcagtaaaagaaaatcatagtgtgccgtgtgcgcatatatatacatctcgttgattctctttccaaaagcggagctcaaaagctcaagcccagtttcccatctcatatatatagtttatgttttactccagtacaagaacaacattggtgctcctcagacaaaattatcatctctgctgagagtaatttcgttgtgagttttggggaagtcatatcatggcctgaatcgaatttgcatatatgaatatcgggggcggagatatatgctattgc

SEQ ID NO: 29584 - DNA, 165 bp, Oryza sativa
gaggccgccgcctacttctccacttcctgccccacttttgtccaaaaggtcggcgtcggtttgaacccctcatgctgaacatcaccaccccacgtcgtcggccgattccgtctcacccgacctcgattccacactcttgcgcccatgaaaagcatcccccgacca

SEQ ID NO: 29585 - DNA, 887 bp, Oryza sativa
attcgtactttttcatttctaataatttgttttggccaaaccggagaggtactgtcacgcccggaaattcactagtaatttccgaacttatttgtgcataaaatcctcgtccaggaatcagccgaggtacacaaactgacaatttaatatacagattcatcaaattaactaaaatgataaatacttacttaagaggcacttagtcctcaccaagaagaaaactgcagcggaaaataaaatctagcgaagctccggctccactcccacaggcagctcaactggggtataagccaaacgtcttctccttcgagatcctttttattcaactgagattgattgattattgcaaggtgagcatatgacatactcagcaagccacacagcaaatatgcaagtgcacaaggataccaaaggatggcataatattggctcatttgcaaaagcagcatttagcaaaacatttaagagaagtaaaacagtggagtaattaatcaggaattttaatcaacactgaacagcacacccatgctgcacaggcccaaccattctgaacaaccatacccggctgaacagatctaactccaaaccaggagctaagcaaattattaccaggtataacatccataattattgtgagaggtgtgggactaatcacgaaaaacattgctcaactcgcccataaccgcgggcacggctattcgaatagttttactctgatcagaggtgtaccactgtacccacaagacacagcctcaacatcatgtctaccatacgtcgcgatactggaaagtacccgaatagaggctgtgacaataccctctacataacacaactcaccacagtgcaccattcctagatcataatcaccccctcaaaaacaagaggca

SEQ ID NO: 29586 - DNA, 642 bp, Oryza sativa
caacggctttaccttttgtatagcatggttcattggagagcaccagactgagaagtggcggagataagctcacgggggtcgctggggagtccatgcctcttgtttttgagggggtgattatgatctaggaatggtgcactgtggtgagttgtgttatgtagagggtattgtcacagcctctattcgggtactttccagtatcgcgacgtatggtagacatgatgttgaggctgtgtcttgtgggtacagtggtacacctctgatcagagtaaaactattcgaatagccgtgcccgcggttatgggcgagttgagcaatgtttttcgtgattagtcccacacctctcacaataattatggatgttatacctggtaataatttgcttagctcctggtttggagttagatctgttcagccgggtatggttgttcagaatggttgggcctgtgcagcatgggtgtgctgttcagtgttgattaaaattcctgattaattactccactgttttacttctcttaaatgttttgctaaatgctgcttttgcaaatgagccaatattatgccatcctttggtatccttgtgcacttgcatatttgctgtgtggcttgctgagtatgtcatatgctcaccttgcaataatc

SEQ ID NO: 29587 - DNA, 257 bp, Oryza sativa
ggcgcgcgagcagtacacggcggcgctggacctcatcaccttcaattcgaagtgttcgtagccaccaactgcagatcggggttcccaatctccacggtaaaaagaccctaaaccttggatgaggatttcgttttcagatctgtgcatatctgtttttgttgaagaatgtgtgaaatccctttatcaattgcttgacagtagatgttgtccatgtgtttttttttgttgtattgtagatggacaagaggaccaagctt

SEQ ID NO: 29588 - DNA, 492 bp, Oryza sativa
gtatcagagcttccttgaccctaggttatgccaaatggttacccatagaagccctctaaaaatgttggaaaaatagaactgttctcctccctttctcttttaattaaaccaaactaatagcacatgcacttcataatctgttttaatggttctcgttcaaaaatttattccagtgttattagtactgtacatctattactgtactaatggctcattttaccagcaaaagttttacaatattgttttatttaatcttgctgcaataaaataaatttaacatgttgattttataactttcttttatttcttttggaacctgatgttcaaaagtacaaaattcatttccaactgtttcaacttatcttgcaagcttggtttactttatttaattaccttttactttgatcttctaaactttattcaaattaatcccaaaacttgtgctattaattggataaatgtcttaactccctcttttcacttgtctttaga

SEQ ID NO: 29589 - DNA, 351 bp, Oryza sativa
tagccacatatctccttgtatagagatgatttcttacataaaaaatagtgtattcatctttttacctatcttcttgttaactcttttagcgctagtggcgaagctatgttatattggaggtgcacatgaacccccaaattcctaatttctcacttaaaaacactagaatgtacagtgttgtactgaaattttctagattctcaatggtagtgcattccccttgttttgatgctagcttcgcccctgtttagcgcttcaaaattttacatatgtgacagtgtatttaatactatggacactaactgaggtagggggttgggattgcccttattccaccttctcgatcttagt

SEQ ID NO: 29590 - DNA, 1501 bp, Oryza sativa
taaaatagacttactccaatgagaaaaaaaacatagatccatccagccctacccactcttcattcgaaatgggcccagccgacttcacccatgaaatgggcctcgatacggcccaccaaacacgtttcccttttcttttctttctttatttcttcttctcgtctcttctcgccgccgccgccgcaatgctccgcgccgctcgcccccgccgagccggcgcgctcctcctcgccgccgcggccgccgcctcctcctcaggagcgctcgcgtacgaccgccgcggcggcgacggcgacggcgacggtgacggtgaagccttctccaccaccaccaccgcagtccgcatctcggcgtcctcgccgctccgccgcgcgctgtcctccgcggcctcggggatcctcccggggggcagtgcacacctcctcccgtcgccgctccctctcggtgaaggtacttcggtttccttccgttttctctttcagactagctcctgccatttttcggcgtcgtcgttcgtcggggtgacgtgtacggttctcgcaacggtggattgattcattgtttttttttcctactgtgattgctcgacgtagatgcgtgatctgctttcctgggcgagttcaatgtattttgccaactatgtatgaacatagtgtgatattgagctataaatttgtggccgccttgtcatatgcatacattctagcgtgtggtgtgtagctacggtgttgtgcatcaatgtgctggagttattctagtttaaccaccattgtgatttccggaaatggtggttcgatgtggaaatgaacaatgcttctgaatttttagtaggtgggtgagagatcctgtgcgtgggagtttttctttgtttatctgtgcagttgctttcttgatgggtagttaatttaaattcagtcattcctaaaataaaaaagttaaattgagcgtgtgcccccactatgttatattatatgtactctattgtgctgtgtaccaaaaggactggttgaggaccaatctgatggcatgttgtgtgtggagatgagaacatagtatgttatcccattacattgcagaatctgcgtatatctgaccatgtaagtatgtgctagatttcagctgttaacagttagctttgactttcgcttgttctgtagaaggtatgaaattgcctctacactgtataaatgccttttatgagtatttgagctgaacagcttctgtgattgtcaataaaatgttatgagaatattcacgatgtgtaacttaacaacatattcactatataagagaagcactcaagagaatttatttatttatttatttttgctgaaaacaatagtagccaccatatcttcttgattaatctctcgtatttttttccttgaagatcttaatgtgtacagtttacgtgcagggttttccttcctaaatttcttcacatctgcatcaaattggagtgcagggtttcccacccaaaattccttcgcatctgcgtcag

SEQ ID NO: 29591 - DNA, 987 bp, Oryza sativa
gtgggatggccttgctccggatggcgtgcacaatgtttgacgccattgacttcttagcacatgtttaaccgttcgttttatttaaaaaattaagtaattattaattcttttcatatcatttgattcattgttaaatatatctttatgtaggcatataattttatatatttcacaaaagtttttgaataagacgaacggtcaaacatctgctaaaaagtcaacggtgtcaaacatttcgaaacggaggagcgagtatattcctgtgaaaccgatgaaaaaaaatatttttttaattgatttcataagtcatcactctagaaagcatgagtcttctcaagtgaaggcggcgatagtggcagcacgtattgtatattagggttcaggattggggtagagataataacgggttggcagaggaggaataacaaaaagacgctgttagtgacgtaggagacaccatgatagaagcggatgcacacatatgcatcgatggcccgtgcaacactaccaaaaaaaaccattaacactagcagttcagaaaccctatcatatcacagctattgttttatcggacattaatattaggctagcaacctattcaagaatcgtactaatgcccattttagggctaaaaattgtaaatttctataaattgatagtgatacttgagattagatactacaattatctaaaaaatacaattactaaatttcatgatctcaaattcctattacaattaatttcagaatctcaaaaatcaacagatcacaaattcatgcgtacaaattcaacaaatccacacataatcacacaaatcacattcatgaggaacaattaggatcggtcgactaggggaggtaggaaaatcgatcgctcccctccccccaccactaccagagagtgggagactaccgtgtacctcagttggttaccgagagtgttatatggaacacggtaacgtttaaagcataccgtgtgtgtacaagg

SEQ ID NO: 29592 - DNA, 1501 bp, Oryza sativa
ccgcgtgcaggcagctccgccgtgccatctctggcgagggcctccgccgcgagctccgccttcgcaacgccggcggcttcgtcccggtcctcctccggggcttctactaccagcctctccacggagcccacggtttcctccaagagccggtccgctttttcgccgacggcgccggcgccggcgaccaccatggccagctcccggcgggcgacgacgccgttgagtcgctggccctcgggttcgaacccgtggaggcgcgcggcggcttcgtcgtcgctcggactggcaggtcctccggcgaagtgtgcaaccccatgacgggctacgtgctccccatccctctgccgaggaaggatttggtgacgtcatacctgctgctcaccgccgacgatggcgtcggactcggaccgagctccgacgacgactccgagctccaccggttcaggctcctcgccgtgcagctctgccagccgacgaaccaggggcggcggcttcgactgaagatgcaggcgttaaccccggtcactggcagatggggccccaccaccaagattcccgtccatggcgtcggcggcgacatccaccaacacccgggcgccgagctactcggccggcatcccgtcgtcgtcaatggcgccgcctacttcctcgtcgtgtcccactccttcgaccgccagcgcccgcacccgccgtctcactacttcatcctccgcgtcgacgtctccgaccacggcggcggcgacggtagaaacgggacgacgaaggccgcgacgatcatcccggcgccggaggggctgaagccgccgtcgtgctcgcgctgcaccagcagcgaggcggcggcggcggtcgtcacgtcgaagcagctcctgctgacgccgtcgcgcgacaggaggtcggtggcgctgctcgtctgccggaccaccagggtggagatccacacgctggacatgctcgcggcgccgtcggcgtgggcgcgcgcgacggaggtggtggacacggcggcggttcgccggaggccgtgcgacctgtcggagtcggaggtggagctgcattggtccggcgaggcgagcggcgccgtggtgctccggctcggcggcacggtgtgccagctggaccgagcgaccatggcgatccgcacgatcgacgaggagttccccgagtttcgctacaggagtcgccatatgttgctgccatacgaaatgggtttgtccagttgggttccttcgatatctacatctgcataaaaaattttggaacaaaatgtataaatatatacagttattttcaccgattttatacaaatatctaccatcattgcagagcatatgatgcgagttcgcgatggtgcgtgtgttcgctcggttggtttggtttgtagaatgaaaatagctcgaaaactaatgaaaaccacctatactgttatcattttctttcagaatcgaaatcggaaacctgcaaacgaagctaacacaaatcggagcaaatatcaaaagatatttat

SEQ ID NO: 29593 - DNA, 220 bp, Oryza sativa
ttgaaaaggtgtcaatgaaaaagttatggcagggaaatcatcagaagcatcaatgcattcttctaaggttgtccatttagtgaatgagatcatcaaagggttcgtaactggcctatatgttcagtttgcatatctgacagagaaggagtcaaagtagtaaaccttcccttcctgtagaagagtcctaagcttaatcatggcaggtggatagatttgaaca

SEQ ID NO: 29594 - DNA, 1501 bp, Oryza sativa
aagacgtaattcacggttaaatttattttgttataaaattgtataagtcgaattttaacttacatgtttgtggaaagatatattatatactccctccataaaaaaacgaatctaagactagatgtgatatattctagtataacgaatctgaacagaggcatatctagattcgttatatcaggagatatcatattcagtattagattggtttttatgggacggagggagtagatgacattttaaatgccttacacaaaataaaggatgtcctggcacacacaaaaatccgaaaatgctcacacccgggcgaccggcaggggtggagaaaaatcgagcgctgcttttgtgcctgccagtgtacgtctgcatgcaaagaattttttctcacatgcaaccatctcttatttcttcaaaagatttttttctcataaactatttatctaatctacgatctgattgcatcactaaattcattacaattaaatctttacaacaagaccacacatgattatatttcgacaaaaatattctagattttttattattttttttaatattgcatatggtctcttttgatgtttcaaccagtagttttacaatgtttcaactagtatacttatgatgtttcactatgtacggatcaaatgttgcagtggattttgatattatggaacgcgccgttgcaacaaatcacccatatattttagaaaccctctattaagggaatttggtttattttttgttccaccaaaaatgtttcacctagtatactcacaatatttcactatatatagatttaatgttgcagtgaactgaaatatttcattgcaacaaaaaacccacatattttggaaacctcctattaagggaattcgtttcttttttttcaccaaaaaatgtttgacttaatgtacttataatgtttcactatgtataaatctaatgttgcagtgaactgaaacattctttcgctatttgctgaaacattgttttcatataagttgaaacaacacccgatttaaacgagtgaaatatttttgatctacttagtgaaacaattccgatatacctggtgaaacatcatgcaacatttaaaaataattcaataataagcttttttttcatcggaatatatccatgtgtggtcttattttgaaattttaattacaacgaatttaatggtgtaattggatcattaattagataagtaatttaagagaaaaatcagtttaaagtagttttacacgtaaatcgggtgctgacgtcagttcagcatctgatttttccccaaaggatcgaacatccgacctgtaggcttttccacaaaaatctacttcccacttattcttttctgatacgtttatttcagttttcccgtttgggtcttggactcctacagtcctagtactagttttgacttactaagacgtaacaaagtcccattgtgtttggcattatttatctcacgtttaatttctcttccgtcgagagaaatcagaga

SEQ ID NO: 29595 - DNA, 434 bp, Oryza sativa
gcatacatgtgcatgttccttttttattcacgtgaatggtaatatctcaatgttttttttttcttgatagctttttttcatcgtatacgtacgttagttgttttttttttcaaacgaacagtaccgataggtatatctttgtacgttcgtacttaatttctggtaatctgattctcttagtatatgtaggaagtacaaaacaatgcatataatctaacggtctaaaataatgggtctaccaatttaagtgaaaatcgacggtaggattgtagaatgacacatggcggtctaggagtatttctaggagtgccacatggcagcgtaggagcgtttgtaggaagtttcatagatttttagtatataataatagatagataatagatagatagatagatagatgacagttgggtgaacatgaccattccgatcacagc

SEQ ID NO: 29596 - DNA, 152 bp, Oryza sativa
gggaactttcaacgccacaagtgcagtgcttcgaactttgaagcagccaagagagcccccccaatgctgtccattccctccatatttaaacgcaccccccgacgtggtacacacatgacactgacggtgggcccatacctaaccgccgcaga

SEQ ID NO: 29597 - DNA, 169 bp, Oryza sativa
tcaaagggctctgattgtgggaaatatgtggcgagatgtttgatatgacaaatttgataaaattttattgataaataattactacaggtccttctatctcttaacaaaattcagagttaagagcataggaggaagacaagaacaagtcggcaggaggcggacagcagca

SEQ ID NO: 29598 - DNA, 293 bp, Oryza sativa
gattctttttttttttgaagacacatgacaaagattgctccttgattattcgacttgagtcgtaacatggctaatcagctactgtactagctagagatgtactcctcgatgcttgtccagtttcatctctagaattatattttaggggacaaagagaggatatgctcgtagattataatattattggtagaaagcaactgaagcattttatagtgattggctactctagtatagctagtagtaattgtatgtcttgtgtcgaagaaatgcgtggtcgctgttatggtgtgaca

SEQ ID NO: 29599 - DNA, 533 bp, Oryza sativa
caaagttgcatgcgataattcacgacttcaacagcctgaagcataagaggtgaagagggttcaatcaactatttcatccaagatagatgagcgatgagcgcgatttatttccccaatcaaatgggatgaaagcggttatataattcaatcaatcaactatttaacgagggaatcatagtcacatccgcttatcgatctctccgcattaagctcgggtcacagcgacacatatccaaccagcacacagagaacacaaacatgcatagaagacagagcagattaaaaaggaagaggctcttcagatgcgttaacgtttactgaatttcatcgcaacagataaaaggaagcaacaatcttttgcaagttcatgatgttcttagccaaaattctacgacatcataaaagacagttgtgtctggaggattgtgtcccgtcgatccaatactaaaaaaacatgccttgcattagcgcaactgattactgatggcgttcatgacgatccaaatcagtccacaagggtgcccaagatgtca

SEQ ID NO: 29600 - DNA, 1501 bp, Oryza sativa
gctccacaaatatttgcgtcattattgttatacgactatcgaggtagttcgcttagccatgcttatgttgtattgtcgggtgggaaacctgggttattccaattatatgcttaaaaatctggtgcgttgtaccgacgtgttgtgaaataaaatgtgttgtgaaatggtgatgatgcaaggtcatatctttgtggtttggccatgtattgtcgataagcatcgtttgctttgggaaatccatccaaacacattacagtgcgaccacacgggtgtttatgggatacctctggctaaataattagttatcatataggggttggtgtgccaatggttgtggggtgccgaggatgaggagacgaagtttatttagccctattgggtgtctctttttattgcctctattgtggcacgcgatatcagtaggagacatcgtcggtatttcttgagtggatgatggctgaccttgcctgatactcggctaagagacttagcccaactagggggcatgcgattttcatgggttagctttggaaaggccttaccatgaacttccgttaccgataggtatcggtaaccggtgatagtttcatggggtaaagcatgtaacctctgcagagattaatgaattgttcgaacacccgtggcacggtcaagtgtcacaccccaatctgataccgccgtacaacggcacctgacaggagcgtgtcgtagggaaacggcgctcaggtcgggtttttcacaattcattttattttcaaacacaccgacaccacaggtcgggttttggaggcttcacaaacccatttcccaagttttcgacaagcaatggtgtatgtgggatatttggtatacgcgctcagagagcacgaataccgaggtaccacaagggtggagcgacaaggaatcagggatgtacgacctacggaaattagtgcgactactgggtaggtccgtcggtttggcacgcaaaccgaggccaagcaagttaagtgtgtgattctaataatgcaagttacaaacaaaataataatgatttttcaattataggagcaattgatcaaagggtgacttgccttgctcaaggtcttcacgaagcttcacgaatcttcgagaaaacctgcgatcgacgaaaatccgataaccgcaactatacgcaaacaatcgaaaacctaaacaaaagaccaaaagaaagatcctatttagactaattagtagtgccattaaatagatctcaattttacggaattactggaagtggaacggagtcaatcggatgagcggttgagaagatatgaattttggaagtttaattggagtttctggaataggagaaatggtttatgaaattttatagaaataatattctcaagaatattattgacagtcactgacgcgcgggaccaaaggaaatgatttgtggaattttggaataaggaattgatttatgggacaaaggaaaaaggatttattaaatccctggaaaaagaaaaggatagaggga

SEQ ID NO: 29601 - DNA, 224 bp, Oryza sativa
aaaaggtgggatttcctctttatatatttcactttgtttcacaaaactacctgctgagtataatatggaagtttcaaaaagattgtttaatatcatgtgtcggttatatgaataagtaaaccagtaaggaataaatcaaagatctccttggatgcgatttgtcataaaagtctgctgttatgcggttaagaactttggtaagagattttaaatatttggcaaaa

SEQ ID NO: 29602 - DNA, 480 bp, Oryza sativa
catcggttttttacttaaacatcaacacattattttagatcatcaaatcaatcaatatttttctaaaaaaaagaaacatctcaacccttcctccatccccgttcacttgcagtgtgcagcattacttttcacagcttttatatctctatgataattaaaatttaaattatttttatgagcaaagaaaagaccacaaactaatctccacctattaggtctagccaactattatttttctaagtgaaaacaataacttaatgcccatattgactatattaactggtaacaaaaaattacattatgaacccacatccatattgaagcctcttctcaataaaggtaaaatttacaataggacatcccaaaaaaagtataattagctaagagacactgcaagaacgtatatctgctatgggacaccgcaaaaaactggtaattagctactagatacccgtggtattattttgttatatccaaagg

SEQ ID NO: 29603 - DNA, 721 bp, Oryza sativa
ttgcacaataattcgataataattctagaaattcatttatgttgctcaaaaattcttacattcataataaattcattcgaactccaaattgagcaactcaacttgcaaaattcatctaaaattgagctctacatgtttgtttacattttatgtattgtttgcttggtttttatttgagtttttcctcgttttgcatgtcagcgagtagattccgccatttcggaagtccgcggtcacgaggaaaagagtccagaagatttgtttgaagaagcaaggaaagtcacacattccccttgagcatttgtatcctaatttacaaatgttttatcatttgcaaataaatatgcatgttttgctaattacatgggattagagtttacctatctgcttgcttgtgtcatatttacttgatgtctgtcctttgtcaaccttgggtaacttagttgatgggataattacagtattagacctcttagtatctagacgagctgcgtgctcgggacatccggccatgtttcattggtcataattatccaactaaaatgtgactgaatggtaggctgtgggtgcatggttttgctggtcacacccagggcaattggaccgattcgtgggaaaccctggaagacatacaatgcttgccacaagcgggaataggtaactgcctgacttgaagtatagctttcctctggctgacgcatccaggcaagggtgcgcgtga

SEQ ID NO: 29604 - DNA, 796 bp, Oryza sativa
cacatatatctctgtatgacatatgcaatttcggatgggaaaattgaacttatattagaacgtggtatgattttgagaaagctcccaaagaaaacatatgtatggaaaacatatgtagcatgagcctgatcctcctccagcaaaacataaactttataagacggtagtactgacaagaccgttcctcacatggccatataagtgtatatttattttctgaaaatcctcacatgggattcctcactgaaattcatgtttgtgtcgcccgttttattaagggtgagactaatcacggtgaatctggtcgatcgcccataaccacgggcatggctattctaatagttttactctggccagaggtgcacaactgtacccacaagacacaacccaccgccatgtcacgcgcctagccggacacgtcaccatgctgagtgattgtgacaagacccttcatataaccccctctgaccaagcacaccacacctcaggtttcaccccccactcctcaacaggcagtgggcagtcccctctcgtgcctaggtgaatccggaagcgacaaaggccgtcgcagagcccatcccgctccatcacgcgcacccttgcctggatgcgtcagccagaggaaagctatacttcaagtcaggcagttacctattcccgcttgtggcaagcattgtatgtcttccagggtttcccacgaatcggtccaattgccctgggtgtgaccagcaaaaccatgcacccacagcctaccattcagtcacattttagttggataattatgaccaatgaaaca

SEQ ID NO: 29605 - DNA, 1501 bp, Oryza sativa
caatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtcttcttttggctttgggccgaaagtcggcccaaaaccgttctctctctcctcggcccagccggcccagtccgcagccgcgcgcgcgcgttcggtcgctgacaggtggggcccacctgtcagtcgtcgtcaaccttcggccgccgccgcccgaaaccctagtttcgcgccgccgccgtttcctttccaaatccggccgttcctttccttctccggtcgatttgttagaggggaaatgatctccgggatctcctctaccttttctcctttggaatctttggttaaatcgctttggaaagcgtcggagacgagttcgattcggatcggttttccctctctccaagccgcgagtttccttcgccgttgccgtcgccgtgggccttcgccgccgcctccgagccccttttaaaggatccccgtgctcttctcttctcgccgccaccctcgccttcacctctcgtcgccggaagagctctagcgccgtgtgccctagcttcgccgtcgccgccgccgcttcagccgtgctccgccgtcgcttcagctgtcgccgccgctcgggaagaccgccgtcgtcatcgccaagtcgccgccgtcctcgtccgccccttcgcagccgtcggaacccgccggagcttcgtcgccgtcgacaacccgaaggtagccgccgcttccttctcgtcgccgtcgtcgtccgttccttttccgccgccgttttggtcaccggtgtgttcgccgcgttgtcctctacgtgctggtgccctccgttggtgccgtggtgccgccgttcgccggcgagtgtccgccgcctgagccgtcttcttcgccgagccgccgccgtcgtcggtgatgtcatcgttgacgtcatcgggatcctctcccgtgagccggtcgtggaccgatcgatctcggccatccgatttggatcggatcaatctcggccgtccgttcatgtgaaccgccgcccatgcgccggtccacccaaaccctagccgctgacgcaataaatccccttttccttttcaaaaataattcattattgcgtcataattcaattttaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagaattccaaggccagcaaggcaagtcacacagatcccaaacaaccctttgagcatgtt

SEQ ID NO: 29606 - DNA, 1501 bp, Oryza sativa
tgtatcggctaatactccgatacaactctatatcaggatattaaagtaggtataatatatcaaacaaaggcttaatatatttagatacggcaatatcttgatataaagtgcagatttaacatatcaatgaaacatatagaataaatatagttaaatcacatacgatcggctgaaactccgatgctattctaatcggcaactagaaggcaggctagagatcgatgttctaagcacgacttaatagatcaaactcaactgaagcagcattaagtatgaaaagaagaacgatatctagacaatcaagtcgctagaagtttcatagaatggtagatatcttatataatctagatcaacgacgagatttaacctaatcggctgccctctatcaacagatgttagacgacagtaggttacatgatgatattgctagagattatgtaagatatatgataactcgacgaattacatacacaagattagagtatcataaagatggaagtactaatcctaagaacgcaatctatcataatgaattttacctcttgctgaagatcgaaatcgatgcagctcaacccgaaagcaacaactagtcgaaacaaaactaaagcaaaaaagggtggcgatgcgccgagattgtattgaacgtgtgtgttaaaattacatagggctcagggtctatttatacccgagaattacatgatatgcccataccggacatgatcattatctctaacaaactctaagatactataagtctttgcggcagacttttgcccacatttatctataaggaatttacataagatatcctaattaatagatacaattgccttcccaagactctctccgtgcgtggcaatcatcttgaaatacattaacttgaacccgatgtcgcgtacaagttgtattgtcagaatcggctatatcggcttatttagcccgactcagatacaaccgatcctaaccgtagccgatcttgattccagccgattcctgctctgcttccgaactcgatctccgcctccgactccgctttgattaaatcctccttcctaacacagatgttaccaaatttgcttgttaacacatgccccccaagtccgggatattcgataatgttccggatttgccgtatgccgactccgagcgagtttcgcactctgccgcttttgaccattattccagcactttaaatactaacccttacccccgagaaatctcacgccgtgacttccgttttctctctctcttcttcggcgattcctctggcgcaaaggcgattcctaggcgatttcctccccgacgagatctccgcccgcaccaatgtcatcttctgccagcccatctggtgcaccatcggccgaatacgctgaggtaagttctcatcggctaaatccccttctttagcagcagatcgatcttctcttatctcatatcgctttccttcttttggttgcttcgaatttgtagcatctttctcaccaagtcgcaattcccagtc

SEQ ID NO: 29607 - DNA, 1501 bp, Oryza sativa
tccatccaccgtgtgccatctcgtattcaacttcgtcacctggtatccatgaccgtttggacctcaactcctccctgagtttagtcccgatccctaccgttgaccgaagttgacctccaagaatcataactctagtcaccttctcacatggtatcccgaccgcactagacctctgctccttcctgagcatagtcccggtcctcaccattgaccaaggctgacctcaagtcacctgcacacaatcagacaaaacaaccgtttctggacacagatattacaacctgacccacattagtcacacgcactcacaccaacatccacacgtcttttcaaaccaattcgttgattaaatcattttgcacagccaattgttcatcacaaatattaatcatgacaatgatttcacaatcttccccttgatgaacacattggcaatatctccaaaatgcaaatttgtgtttttgaaaaataaaaacaaaaatcacaaaatgaaaaagaaaatctctccccctttttaaaagaaagaatttctcccatcaatttgcaatcaaagcacaaaatcgactattttttaaaatcgaaacaaagttcaattctccccctttcaagaagtatgcattttgtatatttctccccctttgacaatgatttcatcaagaatgtaaaagagaaaaaataacaataaagtacaaatgcaatgatgtcatgattgcacttggaataaccattttttattttttatattttctcaatttttttcgagagctttgaaatgtaccaaaagcaattcaagatcatgttttgcaatataagttagataaattcatcaactagttaacaagcatgcttcatagtataaacatgaatcaaaaatattacgattaagctcaaatcaacaataagaattcatgatttcaaatgatttataatgcaatatattcacaagcacataggttgaaaaataaacactatacatatatacctattgcatttatcactctttctcaaattagctttagcacaaaacaatcaagataatttttttactttttcttgagcctttttgctcatatttgtttcttttattccgggtacgtccctgtcgtcaagactgtttccagggattcggcaccctttttttgctcacatcgaatacgtccttgtcgtaaagactgtttccaaggattcggtagtcatttttttcacatttttattctcttttcacaatgagcaattacaaagcatatacataagcatttataaatcaaaccatatgctagcatcaatattgcatattttcttaattcaagtaaaagaattagtgtcatgcatcatctcacttaaaagcaatatctaagccccatataaagactaaaatgcatacaagctaaaatagcaacaaatatacctcaattattttgctagcatgcacaagaatatattaaaggtataaaacaaagctcttctttttcttatttttatttattttcagatttagaaa

SEQ ID NO: 29608 - DNA, 1501 bp, Oryza sativa
aaagcagcatttagcaaacatttgagaatttaacaaaacagttaagtaataattaaacaatattaatccaacgctatacaacataccctgttgtataggcccaaccattctgaacaaccaccccggctgcacagttctatctccaaaccaggaatgtaccattccaaaccaggagctaatcaaattattaccagttatagcatctcttacaatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattaactaatcacgattgaccatcgtgaactatcaataagccatcatgaaataatagtgagtcattagttatcccataagtgtactaaagtttctaagcagggctaagcaattatatctaatatctagttgaaccaatataaataaaactcaactagtcaaattaatataacccaaggtatcaaggaatatggtaatcaagtacgaaagggccataacaaagaataggtcaattccacccaatgacattcaaaaatagatgcaatagttgaatagaaacaatagctttaaataggatcaacatgctcaaagggttgtttgggatctgtgtgacttgccttgctggccttggaattcttcaaactcttcttctgcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggttaaaattgaattatgacgcaataatgaattatttttgaaaaggaaaaggggatttattgcgtcagcggctagggtttgggtggaccggcgcatgggcggcggttcacatgaacggacggccgagattgatccgatccaaatcggatggccgagatcgatcggtccacgaccggctcacgggagaggatcccgatgacgtcaacgatgacatcac

SEQ ID NO: 29609 - DNA, 1501 bp, Oryza sativa
gatgctttagagcgtgttaaacacatggaagagattgttaaacaagataaggtgttttcttgctcaacttgtagaaaacaaaaaggtcttttggatgcttgcaaaaattgtgctattcttactcaggaggtttcttatttgaaaagttctttgcaaagattttctgatggtaaaaagaacctcaacatgattcttgatcaatgcaaggttagcatacataatcgtggtttaggttttgattcttatgcttatcatactagacatcctcctactattttgggtgttgctaggagagatgaaattttgattgaaactgagcctaagaacactatgtttaaatctgctggcatcatgtcttctttgaatgcatcttcttcgaaatcaaatgttgtgaatgcaaaaacttctattgatgcaaaaccatcaatttcaaaaccatctacttcacaaactagtcgtgagaagtacacttgttcttttttggaaaagacggacatttggttggtttttgttttagacttgcccataaacagaaaaaagaaagagaaatagcttttgcaaaacgacgttggcaaaaatcgggttttaattcgaggatcacggttagaccgacactgaccagtcggtcagaccggctagcggtcagaccgcagttgaaccggcggtcagaccggttgccaggcccagtcagaccgcaggtacagaggcggtcagacctgtttcagggcaattttgcgcgtaattcaaatcggacttttgtgaagcgaaaaggtaatttttcaggtaagtctgattctgattttgtcagtgcttttgtatcacaccctaaaaatcccaaatatataaattgttgtttaattggaattattagaaaagattttaaaagcctagaagaaagggtctaattataaataataaattccaatataaaagtggaccagataaaattttattaaatactttgcttaattctataattcctagattttttttctaggacttatttgagctaaggaagtatttttaataaatggaattgcatttaatgaataatttaaattgaaaaaggtttttaaaatcctcttttggctttgggccgaaagtcggcccaaaaccttctctctctctccccggcccaagccggcccagtccgcccgcagccgccgcgtgcgagcgccctcggacgctgacaggtggggcctgcctgtcaggtcgtcgtctacctccggccgcccgccgcccgagccctagcgctgcgccgccgccatctccttccaaatccggccgcccctttccgtttccgatgaaattaatagaggggaaatgatccccgggatcccctctatcttttctcttatggaatcgtcggctattttcgtttggaaatccgtggattcgatctcgaatctgattcgtctctctccccgaaccctagaccttccttcgccgtcgtcgtcgccatgggcctccgacgccgcctcctagccgctataaattgacc

SEQ ID NO: 29610 - DNA, 1501 bp, Oryza sativa
ggtatatatgtatagtgtttatttttcaacctatgtgcttgtgaatatattgcattataaatcatttgaaatcatgaattcttattgttgatttgagcttaatcgtaatatttttgattcatgtttatactatgaagcatgcttgttaactagttgatgaatttatctaacttatattgcaaaacatgatcttgaattgcttttggtacatttcaaagctctcgaaaaaaattgagaaaatataaaaaataaaaaatggttattccaagtgcaatcatgacatcattgcatttgtactttattgttattttttctcttttacattcttgatgaaatcattgtcaaagggggagaaatatacaaaatgcatacttcttgaaagggggagaattgaactttgtttcgattttaaaaaatagtcgattttgtgctttgattgcaaattgatgggagaaattctttcttttaaaaagggggagagattttctttttcattttgtgatttttgtttttatttttcaaaaacacaaatttgcattttggagatattgccaatgtgttcatcaaggggaagattgtgaaatcattgtcatgattaatatttgtgatgaacaattggctgtgcaaaatgatttaatcaacgaattggtttgaaaagacgtgtggatgttggtgtgagtgcgtgtgactaatgtgggtcaggttgtaatatctgtgtccagaaacggttgttttgtctgattgtgtgcaggtgacttgaggtcagccttggtcaatggtgaggaccgggactatgctcaggaaggagcagaggtctagtgcggtcgggataccatgtgagaaggtgactagagttatgattcttggaggtcaacttcggtcaacggtagggatcgggactaaactcagggaggagttgaggtccaaacggtcatggataccaggtgacgaagttgaatacgagatggcacacggtggatggataccgtgtgggagagatcttcgcaacgggcttcacgaggtgtgcgtgcaagcgtcggtgttcacgaggaggaacgagagaagatagagatgttcatgtacggtggagtacatggttgctacagtactcgatgtactgtagcgtgtagtttgcatgtacgtgatgtacatgtgtgcaggtagcatgcatgtgtgcatggtgtatgcatgccgtgacttggactgggaggagcagcagcggctcggttggatggcaggccgagaccgagctggcgaaggatcggtacgaaggagtccgaccccgagcaggaaatggcaggcgcacgggttggttgctgctgtgtgttttggaaattttggattgagtcccattagaaataggagttctacacctactttaattatgggttttttttataaatagagagagagagcgtgaggtttccggtatcgcttttcagagcgtggagttgatagtttagttagggtttcgagattagtcgagatttttgtaaggagt

SEQ ID NO: 29611 - DNA, 427 bp, Oryza sativa
tttggaacgagcgcgtcacgccgcatgtaacgcagtgcagcgcgctcgtttatccggtctgtgaccggtcacagaccggtcagattgcgggttaggtggcaacaggcgatctgacacacgcctcgccccatcccgttaggatgagagcctctaggcactcgtccctagccggagccagcgtgctagctcctggagatggcacgttggtcccggtcagatatataccaggcttcatcccaaccattgcaagaaagacattgtatgaagaagggcagacatgcagtttgctaagctgacgcgtggaggacaaaaatgactggtttgtcaccgatctgacactggtcatgtcatcggtagacaaccgcgttcccacgttgaacctgcttccggcggagtggaggtaggtatgggccgtcccatcagaagg

SEQ ID NO: 29612 - DNA, 1501 bp, Oryza sativa
tatcgagtgatcggcgtcccccagccgggctccgttcggctggccactgtcacgaccggaaataacccaacgggcattccttacgtgcgtgcattaatccttgtcccaggaggcaaggtacaccaaaagttgatacaaatcagagtttaacaagccgaagcgtaaatagttaacttattacatgggcagcgaaggcccagcacacacaaagacaaacgaaaaacagcggaagactagggcgacgaccacaggcgcttgacggcaggcacgagctagacaccaaagccttcatcttcatggagctcctcttctgggcttgggaaaaattgagcaagactgagtacaaccaccgtactcaacaagacacacccacaaatgcagaataaatgcaagggagtacaagggaattataatataaagggttagggttgcagtaaacagcatttaaagacatttagttgctcaaagctattttgtaaacccgatcctagaactatacaatgttattaatcaaggtcgtgaacccacacgaacctgccttaacccaaggcctatgatgattcagaccgaactggcaacccgaccctgggtcccagctcgtcccaagccaacccaggccaaccattccacattttagttgttaagaaggttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacagacgaaagacgtgacatagtttccaacccatcctagccatagacaagagtaccgacccaatcccgcctacggccggaacccccgggacaggcaggcaagactgagcccccagcagcagggcaccaaccctctgccatgacatctcgactaccgggccgcagctcgtgtagccttcatttgccctggagaatgtccatcgatccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccatttttggggattttgaatagagggggaggtgtgaaaccaattccacaataaaccaacaattccagggtgtccaggtgatgagaatatcccaaagtctagagttgtaaaaccacctaatgttgtctaatttaattgcgaagcatctacctaaatttaaactagggataccacgagtagagtgtccactagttgaggttttgtttagtctagggtgaacaaggtaataataataacaataacaataataatatggtcataacaaaggtaaataggcatggctaaataaaacagtgataacgcggg

SEQ ID NO: 29613 - DNA, 1501 bp, Oryza sativa
gcattccatcaaacaaccattcagtacttaaaccatgctctgaccatccactctggcatggtgtcgaaacaagatttcggcaataataaaaggggtggctatcaagctaggaaagtggatgggtttggagacaaggaattttatacaggttcagaccttcttattcaagaagtaataccctactcctgtccggagatgattccgccgagtgtgttattgattgtatgattgggagaaaaagaatcgtcctgagaggaacccggacccctccttatataggggaagggatccgtattacaaaatacagtccatatcctaacggaacatgggattacagataaaatacaatcataaccgactaggatcccgggtattttcttgtcatacaagtttagaatctaacccgagtcctcataaagatattctatctatatttggtaccatatatccagctggaatgtaaccgccatgtagatatggggtaaccataatctccacagtagcctccgagaccttcacagttgaccaaaatagtcttctcgaaacaaaaaacaataatccgagtgcttcaattcaacttgcttcggcttgccgagtgctaaaagactgtgaagggcgaaaataaaacatggtgcatcgagtagatgcacctaattaggtgtagcccccgactatgtgattagttaaaaaactaaacatatagtcaaggaccgggtgattttatttcgaagcatgcatggtactcaataaaatacccagccgactgcttctcacttgaatatatcaaggataaaaaatatgaaaagggccgaatgataaacactcaaaaggtccaaaaatagatatatttggtaggaatccgagtaagaaactcttaaaatgatctaccaaatatgataaagatcatggtaattaagaagttcattagcttaggctataacccttaccataatcaaaataagcatataacatgctaggagaatgactactaataaaccagtcatctcaaattaacccaacatcttttgtagcctaaaaaagcttacaaaaatggtataacacctttctgtcgggcaccttctcatgtgaatcataataattccaaagaattattgaatcgcgttaaaaaggattttaacagcatcggaccgcatcattgtgagcacatattgccaaagcaaaaagcgcctaagttcctaaggatcacaacgggccacgctgaaaacataattgggctgaagtactgtacaggcccaggcccattagtactcccgataccctaaagacaccgaagtccaaacgtcgtttcgtcttccccaccgagactctcgccattccccattccgtgctacagtacagaaccgcaccgacgaagctagggtttatcaatctgctccaaccctcaaaaacttcacgaaatttctccccgcgtccaccactccgattcccattcctctccagccatatctcggaccaaatcaaaccatccagttcacattca

SEQ ID NO: 29614 - DNA, 379 bp, Oryza sativa
gttttagacgttggagtctgactgatttctagcttaaattggatcaaaagcatgaggcggctaaagatttgtttgtcattattaggtcatttaggaaggataagaatattattgcctttggcgttgttcatgtcagcaaaagacaacagatttgacatgtacaacccacacaatgagctatgttttgagttgtttctccagggaaagtgttttatactctactccagaaaataaagtcaaaactcaacttacacatacactagctaaaaaataaaaaaaaacaaatctaacacattgagaaataaaaaaaaacaaatctaacatatgaatagcgttggtactattatgtgtgaattttcctttttcgtttctcaatatg

SEQ ID NO: 29615 - DNA, 1501 bp, Oryza sativa
ggatgcatcaccgacagcgtagttcaagagagacatatgtatatcgatcgatcgatcaatctcttgtgtttcaagaatccctgcacagctagcttccctgaaacgctactccctcacacaagttttagcaaagctctggctagctagctgatgcgtgattaattagtgtgtgtagattttacaattaacagtgatcgtttggtactatctccagccagctagctagctaaagtatgtcaaagattcaagaaaaactaagatcccctggctgagtgcaaacgacgccatcatcaatatgataacccttttatatagctaattaatgaatatattattctctacctgatctcgctgttaatttgatcatcccgtaattatatattctgcttaactatttgttgtcgaaagtacccctccgtaaaaaaaataatactctctccatcccaaaatataaggcgcctatgcatttcaagatttcaccttcaaagcattttgactaacatttagtacattataaatttaattttacttgctaaaaattatatcattggattgacatttgaatttcctttcatatggttataattttgttattacaaaccttataatatatgagaaattataagatagtagtaaagattagtcttgtagaccgtgtcaagtttgaccatgctttatattataggatagaggaagtatctattatagtatccagaagataaattagtatggaaaaaacttcgatgccgcttattaaatgagtggtcgttgtgagcgacaaggtgatttatggtaagatgaggaaaaattaaatttaatttcagtgacgggtggttggagaaaaaaatagtactataaacttaaatgcaacaactgtattttttaaggtcgagattgtaatcgatttcattatttctccgctcaaagaattactagtcatcagggtctgaaaataaaatagtaaccgcgcaataaccatgttcaccggcatattgagtcttcacgaatcgagaaatcaaaaaaaaaagtgagatccaaaattttcaacaaaaagttgtttgaatttcacccattttcatcagtaatcgagattgaacggtaaatttgacaaatctaaacgatttgtcaaacccctgctgtggtacttaccgtcctagtaaatcaaatcaaattaaccgcgccctttttggcagtagaggacaaggaactttatttggagtatattggtcgtttcttcctttcacacccacacacagacacagtacgtgacgagacgacggggggcatagtcgtcattgtcaatgtcaaatggtgcaacgcagaggcaagcagcgtgtgtgcgcctcttgccctttgtgtgtgggtgagtgactcagccagccgagccaccggaggctttacatacacactcactgttggggttggagaggagaggagaggtggggaaagagagagaggggggggagactactcgtcggctaggtcaggaggcggccggcga

SEQ ID NO: 29616 - DNA, 625 bp, Oryza sativa
attagtttgtgccctgtcgatatcccaactttgatgaaaatgatggtgcccatgctttatcatatagttgaatccttttatttggctgttggtgtaataattgtgaataaatgtcattgatattactttcatctcatttcttctccagatgaatctatctacctttgatttgctagattggaacttaaatttttgagtttatgatgatccagttagaattgcagggtttgttctataattgctgcagaatttcattttctatatgagtagttcatatgcttctggtcctgtctgattgccaatatgcacattgaaatttaagctgttcaccaatttttggcgtgggttagaatttcgtgctctctaggtcatgaagtctttcatgagcgctcccctgtaaacatctgtcgttgagtggagcttttctcctttttctgtcttaatacaagtaatagagttctcctgagtattctctaaaggaaaaaaaaaggtattagtgtccagtcagtattttcatgctgtttaaaagaacatgtgtttcaaatagttataaacataaattttcactgttcccattatattatctaacatagtcatttttcaggatgttggataatttacaaga

SEQ ID NO: 29617 - DNA, 202 bp, Oryza sativa
ttttcaagttcattgatttggaacaaaggtgtcaattctagtgataactttgagctcaaattatgggattgcctgtgatttactggtggtttacattttgggttgatatactttcatgatgcttacagaacactgtacttttcatagaaagacctacgatggaactcatatgtgctcatcttgtgatgatgatgcttttgtt

SEQ ID NO: 29618 - DNA, 1501 bp, Oryza sativa
gatcgagaagaaaatactttaatgttccttgttaagtaagggatgtttgggtgagatgatggttaaaagtaggatagaaaattttttgaatagaacctaattgaagagagtagtaatagtctgaaactctaaatagtgctagaagtgcttaaggccgcgttcggtagataaggattaggataaaaacaccctcattcaaatgcgcgggtattttccagccttaacctttgtcaatcaaagttggtataataagtcataggctatatatgaatatatctctgtgagaaaaagggaaatagaagcaatcaagtccgagttggtacatattatagggaatctatctccaaactatctgatgcactaacattggcagcaccgaaactttagttggaccacataacaggattttctacaagtttgaagaaaaaaagatatactatataatattgtcgttttctatatgggctgctcatcttcgtatcaacaagtcttattattgtaatatttctaaatgttttacaatatagtcataaacatatctgataattagttatccagggtttgcctctttaaacctgcgtacagatacatatggctccttacgattttcctcaccgtggcaactttatgacttaagcatgactataatcatgctatcggtgataacgtctaactattccttaggcacaagtttgaaggtacatatattttatggacttacactaattcttatttatcatggtgattgctactctcataatccacaataaatcgattttcttatgtagatgatttgttctaagtgtacactatacaaaactaatgtcacacttttatgtgcaatatttcaatgatagacaatgcttataccccgtaaaattcaaaaaaagaaccttttgttcttccctgtcattagaacattctaaacagttaacgaaggtatgatggatttatgcgccacgcttttggaatcatgctttatttaaaaactgtctgtaccaatattgttggataacatttttccctttatattgttagctttatattatttaatttaattcatccacataagtaattattttatatttttctactccataatctaatcgtttcgttgagttacaacgcactctttgttacgtcaccgattttcctagtagactagcaccacacaagaggatccggctcctctgcctttaggggccaaaggcagaggcaaacaataaattgagtctgctgctgcagtgcaaaacagtgaaacacagttatttacagtagaaaacagtaaaacagaaattttgtactgtagcaaggtagtgttcatgatgtactatagcgttttgtagcagttgatatcgtctgttcattacagatcaaacggttaaaaatagcccaaaggcacagcactgtgcgcctctacctttaggtccttcacaatgcggtgagatggcattcagcctcaccatcccacgtcgacgcagagaggaattttgatgccacg

SEQ ID NO: 29619 - DNA, 1501 bp, Oryza sativa
aattaggcaaatagcagagtatacaaacaaaggcctaataaaagtactgaaaaattagcccatttggaagcaatcacatatattgactttgctgcaactatatgaacaaaagataagctgctgatagaacgtcaaacaaatcaccactagattattttcaacacaatctgctacagaacaacaaaaaataaaaatgggggcgctaggagtagtaagtttacctcatattagtattccctagccttttacccatccttattagcgtcatgcctatgcatctcctgttctcgaaaagcatccactggaaggaatataataacaaaacaaagtcaagctagggagggtatagcaagaaataacaaaggggtttattcacagctcacattagaactttgctgttgtagatctaacagttaaatttaccaacagatctagggtgcatcaacagatcaacttgcactgaaaaaagaaaaaacaagaacatagaactcaccagattcaaagaaaaatgacagtaaaagagagtaacttaccccaggtagttcttggttttgatggagtagattcagcctcgaacaggaaaaggccgcaggagatgctcgagcttggcagagactgcaacttcagatctgaacggagagggagacatgaagtccaccgttggaacgggattcagattaggtgacacagtgtatgcatgtcacaaagtgacatatagtcgatctcagccctctaaaacaaatccaatgactccattgcttgggcccgcctgcatgtccaaaataatccccaatccatccattcccgtgggagacggcgccccaatccatttcgcgcgcttcgcatcgccctcgttcggctgccgccatgagccaactgggaggtgcaccgttgccatgaccggagaggcgccaggccaccgggctcgccgcgagtggggaggggaccgggcgaccgccgcgcgaggcacctgagctcgcctcgcccgcgtccggccattgccgcgagccagctaggaggctcgtcgccgccatgaccggagaggcgccaggctgctgggctcctcgcgagtggggaggggaccaagtgaccacgcccaaggtcgaggctggggccctgtcgtgccaccacgggcggaggcgcgtggaggcggccggccgctaggcctgacgtgtgcttcaacaatacgatatcattagtgattttacccagcttgtgacaccaccaagttgtgatgatgatattctctgtgatcaagatctgtactaatctttgcaagatggttacatggcttttggacaggatggttaggtagcttttgtacatgatggtttgattgcttttggacaggaatgattaaatgccttttcgacaggactaactatagtattttgtggtctctgtttagtattttggacagggccgacggtaatattttgtggccaaattgtacaagtgaacatggcctacccttagaatagttgttctgtatgctccaaat

SEQ ID NO: 29620 - DNA, 1368 bp, Oryza sativa
gcgcctcgcgcgcgatccgcggcggaagtcccggcgatccggcactgatttcggggtgccgccgcggcgacctggggaggtgagccgcgattcggggcctgctggggcgggtttgcgggggttttggtaggaatttggccgggggtggagtggggtggggtgggctacgcgagcgtgtgcttagggcggagattcggatttcgggggaggtggctgcggctgtttggagcggaggggtttaatagctacaggtgagcttgtgcgagagaaacggatggttgtgtctacgtgatccgacgacgagctaggtatagcttgtctgtatgcatgctgtagttcaagatgattagctaggttaaatacagtggtttgatatagagagtaaaccgagaagaaatttcagagacccgccgcggcaataggtgtacgagctgaagcttggggggtgtttggactaacagcagcatgtcatagtggaatcatgtgcgcggtgtgctagtttttggactttgaagcaatgaaacatttgaatgatgttagggttggaagtaaagtagcaaggatgtatctagtgcaggctaattgtgttggtggttacaaagggagggtttgttttacttttcataatgtggttgggttgtccatttgcatgcttccttcatatgacaaagtttaatttgagtatgagtgacaaaatgacaacaggatattgtctgttatgttctgtttaccccagttttttgttgtttagcttgtttactggggtttcatgataatagaaatgcttttctgtttgttttgtaccgctctctgaatttcggcctgtaaagttgtatgcgtgcatgttctgttctatgatatatggtgcaagggagtattaaatgcaacattgaaacgggtagcagtcaataatcgaagtgtaacgtgttgcaccacgcatgtctgttttatctgttagagagtgcttatcaccagattgtatgctcatggaaacagatggtaaccttcagttaaagtagaactgttcatcaactaatgcatcattttggtgtaagtacataatacgaataattccgagtatattcatatacctgaagtgcttaattttattgacacatatcacagtacaatctaatccttgattgaactctgtctgatttcttgttagaaacttagaatcgaactctgtatcatatgactataatgatatgaagattaatctattcaattaagggttgcctattttccgattttgaactaccaactaaggaaattctcttctgttgctagcagcatgtgacgttgatactctaatgatgaaggagcggagctctttatgtgaaagtgcggcagatggaagttgggttt

SEQ ID NO: 29621 - DNA, 1501 bp, Oryza sativa
gaatttaactatttgccacttttacatttgtcaattaaccagatacccttcttaggattgtacttaagaatttgccatatacccttcttaggattgtacttaagaatttgccattgtagagagaaggttttgtaattttttgccactttttacactgtgaagtgccacatgtgcatgccaacatggaccaatgtgaaaaaagaccaatctacccctgctagctagtagtatgtttctcagttgctaaagcctgaacgcatggaatcttagttataattcattcaccggaaagatactcggcaacatgctcattcttcctattttaaatttataagccaacaacatcaatggcaccattgttacagtcaattcattaattttttttaggctgcatttggatctcttttttctaacttctactccctgatttttttcgcacacatttctttagtaactttttaattaaaattaagttactttataaacatatattaatctattttttattttttaaagctcaaactaaattagtcatgcactaattctttgctcaattttacgtgaagagataaatgtttccaaaccatgctattgtacaccttaatcgagctcacactaggtggcaccatcccaacaatactagccaaaatgtaatactgtttagcagttcactggtggagaaaccatctttcgtacaatagtctcggttgcaacaaaaaccgggactaaagatgatctttagtcccggttcaaatgttgtcagggcctgtcaggccccccgggatctttagttccggttaataactccaaccgggactaaatatcgtaactttagtcccggttagtaacaccaaccgggactaaagatcccggcgatctttagccccggttcataacaccaaccgggactaaagtcccacccctatatatatgtcttcttcctcctccagcccgagcaagcttcaaaatttcttcaaaaaaaggggaggtcatgccaaaatttctagtgaatttattgtgttgattatatacaaatcggaggtgcctaaaaggttagcaacttcatcctccaatgtttttttttcatattacatttggagctatgttttgcacacttttttgtctccaaaattttgttgttagttgatgagagagaaaatttgtgtggagaagaaagaatagatagaaatttagtttatttgctaaagaaggttttataaaaaagttgagaaggaaaatatagtgaaagttaatcttgaataatagaaaacaaagtataatgaaaaattaaaataagtacaacatattaatattagtttaaaactttataaatagtaaatatataatttatatggtgtaatatttcataatatttgtatgaataatgatgtcattattgtgtgactgttgaaagagtttgtaattattttataattattgtatgactatcattattgtacgaataattatgtgtgtatgattttttttcatgtcatgtaga

SEQ ID NO: 29622 - DNA, 1501 bp, Oryza sativa
cttgttgtatcttgcgtgtcatagtttagcaattctaccataagtttattacctatattttaggaataatagcatgcaaccatcatttctttttgcaaagttctaatactaatatttttttatagcttattctatactgctttctcatattacacaatatgtaattgatggcctttgaattggactaccttttatggttgtttttctgtcttcaagttttactctggtgctgttgtatgctgtggagggaaaatatatctttcgacatacaatcaatctacatatcccataaatgagttagactatccttttttatcaccatttatcttcacattacaggcttactgtatgggtattatggtagtggtgcaacctttttctgtcttggtgtgtctgacctatcaccactgccatgaattgctttttaatacttttattttacaaagataaacttacttgatcatttttttgtttcatcatctggtataaagatttttccatgtcagcttcttctgatcacttctctttggttgctacgacaatcagccttcaccacttttttatgtgcatagtgtcttacctccttcaattcctattgcatgatgaacaccttattggtattcacagctaccaaatgtcctaattctcttaaaagaaaaatgccctaattctctgacatacttgtgttcagaatgctgttcatataactgaaaaggagcatggtggtgcaggagacaaaataacaactcagggggatctgcaggtttgctctaacaactaatctgctagtgtttattgtagatggtggtctgtggagtactgtagttgcatcaagccactagcttatctatataaattgctttttcatcccattaatttgcctttgttctgtctcatttctgagttatctgactattgcaaaacattgttctttgcttaggttgatcgcatcctaggctgtcgacttcagacaagccaaatcatttcacctgcccatgcttcatcagagcagattgatatggcccctcctagtgcatccggtgcaccagaacctagtcaagcccttttaaaaggacttcatgaagaaattcagtcttctaatagtgatactaatgtgacagaggatgcatgtgctgatgaattagcaaacgatggtggggaaaataatttggattgttctgatgctcaaaaggagagtaatgttagatcccatggacacaaggaatcacttaacgcaaaagaaatcatgaatacagcatcagcatgttccgctgatcaaatcgtcactgttaaggatgctggagcagtacagacatatgtaacagcttcagtaaatggtgaatatgagacagtaactgatattccagaagaaaagaatgacaccaaacatccagtttccaaagctgacacagaagtccacactaaacaagaacatacacctgatagtaaattgcatgggaaaatacaagaaactgaattgaaggagcacgacggaactact

SEQ ID NO: 29623 - DNA, 1501 bp, Oryza sativa
taaagatcccggggggcctgacaggccctgacaacatttgaaccgggactaaagatcatctttagtcccggtttttgttgcaaccgagactattgtacgaaagatggtttctccaccagtgaactgctaaacagtattacattttggctagtattgttgggatggtgccacctagtgtgagctcgattaaggtgtacaatagcatggtttggaaacatttatctcttcacgtaaaattgagcaaagaattagtgcatgactaatttagtttgagctttaaaaaataaaaaatagattaatatatgtttataaagtaacttaattttaattaaaaagttactaaagaaatgtgtgcgaaaaaaatcagggagtagaagttagaaaaaagagatccaaatgcagcctaaaaaaaattaatgaattgactgtaacaatggtgccattgatgttgttggcttataaatttaaaataggaagaatgagcatgttgccgagtatctttccggtgaatgaattataactaagattccatgcgttcaggctttagcaactgagaaacatactactagctagcaggggtagattggtcttttttcacattggtccatgttggcatgcacatgtggcacttcacagtgtaaaaagtggcaaaaaattacaaaaccttctctctacaatggcaaattcttaagtacaatcctaagaagggtatatggcaaattcttaagtacaatcctaagaagggtatctggttaattgacaaatgtaaaagtggcaaatagttaaattcccccattttaactgccaccaaagaccgagggcaacaactaaaatgaaatgcaacgattggccatatggcaaattaacttgatcccctgcctataactcaatgaaagaatggatcaactttctggcataaactaataagaatttaatcgccacatctaccaaatttgtcacgctacatgttcccctctatatatatatatatatatatatatatatatatatatatatatatatatatatatatgtccaattcgttccgtctgaaatatctttcaccatttaattttccttcctagctcgaacaagaaattcgccctctaataagcaatctcgctagtgaactatgaatgatcggcatcaggcattgatacatcatactgaactgaaacagttctgtgtatctgtttgctttcccaagattatcaaggagctgccggaaggctggaagctaccagcagttggaaaacccagccaaaaggagatggatcaacactgtgatgggacataaatcaataagactgtcagtgattttcttcatcacaacaaactatcaggaactacctgcaaacatatattgcttgttggagaactattttagggctcattttcttgaattttttttatttataattttttttattaaaagttttacaaaaataatttttaaaaatcgccctcccagagggcggcgaaaatgacgtggcagacggcc

SEQ ID NO: 29624 - DNA, 660 bp, Oryza sativa
ttttttcttgtttacttcgtaactttacatgccagaaaataaacatgatggacgaataaatactccaagcctagaatttaagaaactgaataagttaagacacgccacatctcagcttatgaaatttcatttctcttagtcttttccagtggattcaaatttgtggtagcacaaatccctacttttgggaggcgcatgatgcactacttagagtcatgcgaaacaaatgtggacaagtgccttctgttcaccaaaacctcatctgacctttcaaaaatttccacagccaccatttcttgtttctacttaaacactaccatcattctttttctgatgtttaggtctttaggacatcgatccggctccaacacaaatgtttgatcattgtcttttttaatcatatattcataaaagatattgaaaatataaccacatgaaattattttcatgaaaaatctactcatatgagtcacatatcaaatcttaatatttttggatttattagcgagttaagatttcaaggtttgactgcagcacgccttctaaaacatcatctaatttagaacagatggagtagaaggtgaggccacgaaatgcaatcatagtagctttactggttgcagctaactctctctctctctctctctctctcatctcaga

SEQ ID NO: 29625 - DNA, 1501 bp, Oryza sativa
ctgcgaccaaccccgtagggtgcgctgtccaccactggtcgccctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggttctagtgaacatcacccacccgaacaaccacaacaggtacgcctcaagggagcgtcggaccgagtaatcatcagcgtcaggttgcagacggtccgcctacaattaagaatgaaatgttagtacaaaaaactcatccggtcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgatgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactaatacaacaatagtctgaggtactcattacaacaacattgaattgaaattacacgatagaagtatttagtccgaacactcattacatcacaacatcattttattttctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgctgcttggaacttctgcattcttcgggcatttcttgtaagtatggccgcg

SEQ ID NO: 29626 - DNA, 274 bp, Oryza sativa
ttgtgttaacatagttcaaaaaataattttgcaataaattactctttattatgggctctttgatgaattactactaaataatttcattttgtgggatttatcctatgtaattctacagacacatgataacatgtgaattcctgtgaccctgcaggactcacttttcttatttatgtacgattttggaaaatcggctagttagggctattcaagggggatatgattttggtagtgttgttctttagagcttgacaaagcatgttaatagctgtaa

SEQ ID NO: 29627 - DNA, 1501 bp, Oryza sativa
tggcacagaattgattggacgttgatataggggagaaccctgtagaccttagaacgatatatacaacgagtgagcaatagtagatatgagcataaatcaaataaaccttattttccctcaaactcgaccggttcttttatttgctaacgatgtatcccgagatcgattgaagttacgaggggcaattattgcagttcaatttagtggcttccttcacggatatatttttttctaaggtataccttagcttctggaccatccatttcatctgatgtaacgcaccataatcaattataccatagaactagtagtataggtagtagaattggtggagggggcgatttgggaaaaaacggtatataataaaaaaaatttcctttgtattttccggattaatcacctattttccccggatctcacacagatgcatgcatgtgaaagctattgcattatttctggatttcttgcttgatctgttaattattaactaggaaggtagcccgcgcattcacgcgggcatgtaccgtaggctgcatttgagatacctgtaagtaataggctgattatgttaaaatgtcgtatttgttatatagcaaactatatataggcatatggatcttatatcgttggtttgattataaacagagcaatagtcagattagaaatcagacgtgaaacttataattatagattatttatcttttagttaaataggaacgtgagaggaatgaaaagcgtagagcttgagccagagaggggaaggagtgggtgtgtagtgatgggcgcatatggagcggctttttttttgtattttttctaagtaatttaagtaaaagcagattatcatatgttaatttcctaagatttgcaagtttttttttcaagatgtgacatgtcactgatttgatagatttttttttctaaaagtagatttgatagttgaaaataatattaatagttcatcgatctaagcaaaaaccgttgggtagatgttttattttttctctgaatttataagttttactaatttttaaaatgtgatacttggtagtttaacttggctctaaaaggtcatacatggtgactttatatttttctaatttttattatgtagaatgattaagataacataatacataatacataatacatgttgtcacttttttaatgtttcagtgttctttgcttcttggtctatgttcaaattacgtattttaaattttacatagtaaaatatgagcaatataatcaacagtgtaaataaattaaaaatcggatgttatttgggttatcatgtaaagaataggtggcagttcaaataacatattttatttttatagtaaaatattggtaatattgattttaaattatttagctgtctaattatgaaatagctgttcaaataaactaaacaaaaatggatatactacctccgtttcatattataagtcattttgactttttctagtcaattttttacatttgaccaagttgaaaaatg

SEQ ID NO: 29628 - DNA, 1501 bp, Oryza sativa
caggattcgaagagttcgagtcggacaaggttggccgattaagccgattccgacaatatgactcggtacacattgtcgggttgagttaatgtgcttgatgaggattgccttgcatggattgagtcctgaaaaggcaattgtatctattaattaggatatttcatgtaatttccttagagataagtttgggcaaaagtctgccgcaaagacttatggtatcttagagtttgttaaagataagagtcgtgtccgatatggacatattttgtaatctcgggtataaatagatcccgagccgaatgtaatacaacaacacacgttcaaatacaatctcggcgcatcgccacccttttactttcgttttctttcgacgagttattgctttcgggttgagctgcatcggtttcaatcttcaactagaggtaaaacttgttatggcggcttgcgttctcgggattagtgcttccatcattatgatactctaattttgtttacgtaagttgtcgagttatcatatatcctatataatctctggcaatattgttatttaaccttcaatcggctaacatctgacgctagaaggcagccgatcaggttaaataccaacgttgacttagattatatagggtgtccaccactctatgaaacatccaacagcttgattgtctagatattgtccttcttttcatacttaatgctgcatcagttaagtttgatctattaagtcgtacttagaatctcaatctctagcctgcttttggttgccgattagggtggtatcggggttttagccgatcttacctgatttagccttatgtttcatttgcttaattgatatgctagatctgccctttatgttaagatcttattacaacaaagtatattaggcttctgtttggtatattttacttgctttaatatcttaatatagagtagtgtcggagtattagccgatacatgctagatctatctgatcggctatactgtaagcgtttataatctcattgttaatatatatatcgatctaagtgatttatactgtctcggcatggcgaccgatctatcccaatcacttgatttaagtatatatcgacataaggattgtatgtcgttaatatctacagccgatcgaataggtttagttctttcttacttatgcatgactgccgatcgattcaaatatgacattggcttaaagataaatgatatgtcatcggcggctggctgatcggctatcatttatggatttaaccgctattttcttgtctttgtttcttgttgattgtaggatcaaatcaactggcacgctcacgaacctaaaagcaagatttttggacctgcactgaagttaagtagatcttctaggcatcgtattttcgcatcaacaccgccacagatgagtataataaaaaaattattttttggctagtctcaagcctttgctagccatgacgtcccgcctctatcaggctgggctagtcttttttgtcctcacttgagt

SEQ ID NO: 29629 - DNA, 1501 bp, Oryza sativa
acacaagcagtagctactcattctcatgatataatatctaagctaagtagaaagaataaaaaaaggaaatctattcctatacttctagtatacataatatacatacattctagatatctgatatactagctaataccttctatccgatgctctcatggtacttcgaaaagccactcctgactgccgagcttcttacgacagcccgtcatgaccatacaaccggggctaaatacggaggaataccctccccagggaattaacttaggattatatacacgcgcggaggaatacccatactgagctgtcaccatcggcggcccacctctcatccgcagcatataactccagataatgatatatcgtaatctagacaccacgtctaaactaccaaatactactccaatatcatcgtcatgacatagagtaattgcataagcaaacattatacccgcatctaagcatctcccagataagctagcaacatattcagtataacatgaacataatgtaaagttggcatttatatactcgaaaagtatttcaataccataaatgtatatagaagaatattctaataaaagtacaaagcttacaaaagagaaaaggaaaactactagagatgtacccgaactcttctgaaggcttccgaacgcctgatttctacactaattctattctactaaactaaacttgagagaatatgagagagctttgcttgaggtgtgtgtgtgaagtgagaagatgagctccttttataggcaggtaatgacggttatgacggttggaatggtcggtattaccctcgaaccgtcattggggatcaatcctagccgtccatccaaaccctgcatccaccggtgccacgggagattcggccgaaccccctggttcggccgaaccaggggccagcccaaccagcccacctttcggctggcggcctcctctattcctcctttatgtagacttgtgaattttgacccagtttgtcgtgacaattctgagttcttggcccattcatacataagtctgattctcgacatcgcctgattgatttatcgtttgtgttgatgtcgattctcctccactttacggtcaatctctgcaaaggttagtatacctaatactagtggaatattattattctaacatatatatgcaatgcaattattactagttctcctctattttggtaatattgacggtcgaaactgatcgataacgaccgtcaacagcggcttaggaacgtttgtaagaagtttaatggacttttaatatataatggatttgggctaactagagtattccaacttaaatgaatgcatgatgtgcatgtgatccgtttggcatacgtatcaacgtcgtcaccgctaaagaaaaagatacaagcatgcaatgccaaacgccttcatttctatatatgaaatttatttgtaatgatcgatggccaagttagggcggccggtgcctgcagatgtaacggcccggacctggtcatggtaca

SEQ ID NO: 29630 - DNA, 421 bp, Oryza sativa
gtgggggagggcgatttttgccccccccccccccctataaagcccagtccctcctctgtgaaatttcattatattcactaaaaatccaaaaaaaaacgaaagagagagaggggagggcagcaaaaggggagcggcgaagccctgctggttcgctcacttcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaatattgtagagaatgtaacttagggcgtagtacagaaatgcgaggttaacgcagttattgttttcatcaggcacaa

SEQ ID NO: 29631 - DNA, 1501 bp, Oryza sativa
aaataatgcaatagctttcacatgcatgcatctgtgtgagatccggggaaaataggtgattaatccggaaaatacaaaggaaattttttttattatataccgttttttcccaaatcgccccctccaccaattctactacctatactactagttctatggtataattgattatggtgcgttacatcagatgaaatggatggtccagaagctaaggtataccttagaaaaaaatatatccgtgaaggaagccactaaattgaactgcaataattgcccctcgtaacttcaatcgatctcgggatacatcgttagcaaataaaagaaccggtcgagtttgagggaaaataaggtttatttgatttatgctcatatctactattgctcactcgttgtatatatcgttctaaggtctacagggttctcccctatatcaacgtccaatcaattctgtgccagattatctcttccattgtccaacttagcttgataaaacaattcgtcaagatgtaaacaaaagtgaactatttgaagtaggaatgattagcatcaggtattgatacaactggtcaacctcaaacagatgcccatgtatgtttatttcctcaactgtatatcccaatcagagacgaagcttctatatagttgccggggtctaatgacccgataaaagtttctaaacaccacagcaatcacgaattatcatcagaagagagtaatacatggtgcaatgagctaccctagtggttttctcctgtaggacgcccctgatcccaatcagtgtgggaagcaccagcaacgggagaacatgtgatctaagggaagacgaatcaacattgtaatgggaaacagatcaatgcgtatccatgttttgtttttgtgtcctcgttttcttagtcgaattcagtagggaataatgacagatttagctgtacacatttgatctgctaaagcatagcaggtaggggaactattttgggacatatttgtgttagggaaatagatacacgacaagacatgagtttttacatgcaaaaccttttcgagaaaatacaagggacacgtaccggcaatgatcaatattgagatgttagttgtaatgaaggaaacgacaataagctaactatcagatatttcccatgtagtttacaagaagatatataaaggaaaaatctagaagtaggagttctaatatagaaagaccagaagttctaggaaactataatcaaatacattgcacgatgaaattcggatcatatattttattctttggaagatcacataagtgattacacgagtgttgtatctacacaagaggttacctatttttctgtcttgtgttccaaattaaagcttcttttcggagctttggcccattagtacagatccttccatctgtggcagcctctaacatgtctaaaaatagcgggccgtcacaaggaagtcatctcaatcgggccgaaaatgtgtccgattgagatatggtcgcacagacatgttagat

SEQ ID NO: 29632 - DNA, 1501 bp, Oryza sativa
ggggttgccgtccgattgagatagtggttaccgttctagtggccgtttggtgctcgagaacctatgaaattaagcccatgcaaataaaggaaaatttagttaaacttttcatagtgtaactgtggactgttaataaatcatcaaaccttcctacccgtttagtacatgttcagtaccgctacgtcaatcaatgacttcaatgaaaacagctcggctgcaataatatagctgtattatagcatcgcactttttcgctctatatattagtatgttttgttcactcatctttctaaatcattcattattttatctatagctgtattatagcatcacccatcagattagtattttgagctgctctaacatgaagacttcagagtaaccctgttgaagtcttatttcagaagatcttcaaagaaagaaacgaccatatattacatatttagtacagattcgacaatcatgaccccagacgacctaaagtatattaaagcagctcctcgatcaagcagcacaactctatctaagtttggaaggcatcaggaatcgttgatgggcgagagaaatggaagctgttatgcctgcatatacagcccttattgcgcacacaagcagacgcacggccattaatgggtaccctaccaccggtcagcctttgatggcttgtgccgacgagaagccacggctaagcgatgacctaaataatataatatgattacatagttattgtcatatagatagcacaacagcctgattaatatgtacccttcagaggtgtaggaattatgctataataggctatgacaagatacaaaaccctaaattacaaaaatctgacaaaacaaatacaaaacaaatagaagataggctatgatctaaataatatgattttatagttattatcatgtagagagcgcattagcctgattaatatataccaaaattatcaaaatctgatagaaacaaaacgaaaagtacaaaactaaaaaaaagtatacaaagaaagtattagctaagaaaactaattaatgtttagtagctgactaaactacaaaagtaacaaatcatgtttaatacctaacaaaactaaaaaaatttagaaaaccaaaactacgaaaataaaaaaaaatctacaaactaagttatgtttagtagatgaaagaactacacaaactaattaagttatgttcactagaaatattaatctctatacaaaatgaagaagccagaagaggacctggtcagagtgcaggctaaaagctgcgtccacaaaacgaaagcacaatacgttcgaatttcagtggaacaataagaagactgagtgatatatcaaggggaaattttgctacaggacactttgatttcgtggttttagcggtaagacaccgctcgaactcacttttggggaaaaacactccataaacatagtaatttgccagtggacaccacgccgattaaaatactaatttctggttgaagagaagagacaaatcgcgtgaaa

SEQ ID NO: 29633 - DNA, 1501 bp, Oryza sativa
tatgaatgggccaagaactcagaattgtcacgacaaactgggtcaaaattcacaagtctacataaaggaggaatagaggaggccgccagccgaaaggtgggctggttgggctggcccctggttcggccgaaccagggggttcggccgaatctcccgtggcaccggtggatgcagggtttggatggacggctaggattgatccccaatgacggttcgagggtaataccgaccattccaaccgtcataaccgtcattacctgcctataaaaggagctcatcttctcacttcacacacacacctcaagcaaagctctctcatattctctcaagtttagtttagtagaatagaattagtgtagaaatcaggcgttcggaagccttcagaagagttcgggtacatctctagtagttttccttttctcttttgtaagctttgtacttttattagaatattcttctatatacatttatggtattgaaatacttttcgagtatataaatgccaactttacattatgttcatgttatactgaatatgttgctagcttatctgggagatgcttagatgcgggtataatgtttgcttatgcaattactctatgtcatgacgatgatattggagtagtatttggtagtttagacgtggtgtctagattacgatatatcattatctggagttatatgctgcggatgagaggtgggccgccgatggtgacagctcagtatgggtattcctccgcgcgtgtatataatcctaagttaattccctggggagggtattcctccgtatttagccccggttgtatggtcatgacgggctgtcgtaagaagctcggcagtcaggagtggcttttcgaagtaccatgagagcatcggatagaaggtattagctagtatatcagatatctagaatgtatgtatattatgtatactagaagtataggaatagatttcctttttttattctttctacttagcttagatattatatcatgagaatgagtagctactgcttgtgtgtcactctacccctggattatcttaatccctgcttaggatatgatcatcacaagtaacaaataaattattagtcaagttctctctacatgatcttcccacgggataaaataaatacgatacccttggaatactatcgggtgaaatgctacaatggtatatccgtgcgcttgcggataaactctgtaaccataatataccaggagtatttctgcgttattgctgggaattatatttctagtaatgtcgttaagaaatattaacaagcatttctggcgccgttaccggggaagattcataatagagattacctgaactaatactttatatttacctctatataatcagtttcctttccaagctaaccttggttgttttcacttctgttctaaaaaaagggtagtgcatgactggtttcaacttgccgaaaaacttcaatgaaaatccagaagctttctttcggagcgtcaggccgtgagtcgtt

SEQ ID NO: 29634 - DNA, 1501 bp, Oryza sativa
caaaattagatttgctattctgtttagtcatagtccgcacgcacctatacaagtttgtgcaccaaaacgagagagtttttcaagtttttacactaaattgcacccacctaacaagtttgtgtaccgcggacgcaatttactcttctctgttataacttctcccttgtatattctcatatcattccttcttaatatcattgttataattcatttcttctttcgcgggaaagataatatgcaaataaacaatgcagttaaaaaaaaagttgatcaacacaatgcagtaggaataagtggtattaggaaaaaaatgtataacggtattggcgttaatgtggcctcgtgccgtctgttcattgtaatcgtgctcactgaaatatgacactctatggatgcatgttgcagtggaaaaaatgttatcaggctaacaaactcaaaaataaattaatcttagaaaagaaacatttgtatagagtattgtacatatatagatttatattgaaatggcgaaatatcatataaaacttctgtcgtaagccttcttttagaaaaggaagggtgaggagaggttatttttaaggtggggtttgatggtctacatagtagtggccgagtcttttaagtatgctcctaatcacctaaccacgccaaaacaaccactacattgagggtttcctacagaatacctcccgggacaagcaagaggttgctgttctttcctgctgcagggaagagagggagaggggagagaatagagggaggagaggtgtagacgtgtagtcatcttcttatgctgctattgtgttgttcttctgctttgctgctgcagtaggatgacgtggggatcaatcttgagaacagaaaggaaggaggagtaatccctggctttaatttgtttctttgattcagaatggttgcaccaaagaggagaatgcatagtactatttaaagacctggagatatatgaagagaaactatatgtgtgtccgtgcatggcaacacattgtgatgatcattgcatcaaaccgaaaaaatatattcgaaaaataaatcatattaaaatatttgaaattccggatgcatgtttggatttcggttgtgctgaaagctaggtatatttgtggattttattttgtagtttggtgtatgataagataccaaataattaggcccatgcatagaaagggaatttaattaaacttgtcatagtgaaagtttgaacttatgttaagagaccggtgtgctcattgtgccagcaaaacgacgaaaaccttatgttaagagtaacatgttggagtgatctttcagaaaacctccaataaagaagtaaacaagtcacaccatttagtacacatactccctccattctcatttatttgccgttggttagttcaaaattaaagtaaccaatgtaaataaaaacataggtataaatcaactttgacaatcctagacgacctcaagaatattaattcagctcctaaaggaccacacacttctc

SEQ ID NO: 29635 - DNA, 1501 bp, Oryza sativa
caaaaaatcagtcgaaatgtctccaaccatgatgatcgaaataactttcaaaaaaaaaaaattctgaagaacatgagccaggaaggctgtaccagtgacgcttccgatgcaacccattgccttctcgatcttcctgatgcaacccatgcagcggcactgcatgtcgatttggagcctgaattgcttcactccatcctgggaagaaccaaagctatcttgttaactctgatggaaacaacagaaaacatggtcatggctcaaagaagaacaagggaaatctgctcaccatctccatggccgagtttatccgtgaccctgtttgcactagcacagattacagtctaggtgtgtggtttaggagaaggccaaggtgagtttaagtacatttttcaagtcattaggtagttaatgagcagcatttcttggttcaccgccaattaataggatggaccaaaattctacgcaaattaacagtgcgttgaatgggaatgagaagagtcactgttacccgttcacattagtcgctgttccagtcttcgaaatatacactatattatccttttttttgtgagagaaagtatacacaaaaaataatactagtgtgtagaactactactgtactttctctgacaaaaaaataaaaaacatacctattaaattattctttttagagagtatatataggtaggagtaattctttgtgagaaaattagggtattagggcaagtgctatgatagatgtgactaccacctctaaatttatctattttattcactcatgaactaagagacaacccatacaatgtatcacctctagtacacaaataccaatatatttaatactcttacatccttcttgaaatttgtgtggaggttgcctcttaatttaggggtggctcatcatctctctcctcacttctctcctccacatcatcactcaatccaatgtggcattcttaggggcaacatatgggccattatagtacttgcccttatggtctttaggggcaaattttgatggtcaacgtatcctcagcaaccttgcggacatatttgcaaacgaaaaataatttataaataaaaattttatatatgtgttcttagcgatctaaaagcaaaggctgaaaaataaacttcgatgaaaaaaaaaccttaaaatcaactctaaatttaaagttgaaaatttaaattttaactgataagtataaacataagcgaaaagatgaggccccaagtttgtaatacaagatggcatagcgacaagcactgattctgtggttcagaatctgccaagcacaagaaatacggtttcagcgagtggcaaaaagaaatatttcccccgaaattaaagctaacatctagtagcacttgtggcccaagacccatttacatttcgcagcaaagccatcgtgtattcaattcggcccaacagaggacgtagggcctaaaatggcaatggcatccaaacgaggggaaaagaaaccgcaggccagaatgtctc

SEQ ID NO: 29636 - DNA, 591 bp, Oryza sativa
atgaagagataaggtcagtggaggaaaagttgaagagataaggctgccagtctcctcctccttgatctcgcagatggcaggtgcctcgtactctccgccacgatattttgttttggttggtattaccaaccgggacttaaaaatagatctttagtcccggttggtgaaaccaaccgggactaaagatagtgggcatcttttttcccggttggtgttaccaacagggactagaaatagatcacaccaactgggactaaagattaaaaagcagctctaaacttttaaaccgggactaaagataatctttaatcctggtttttattgcaaccgggactattgtggattttggctaaccgagtaaagatggtttctccaccagtgtcatgaatcctggaaggaatgcttgggatgaggagattgtcaaggtagcttacaacgatgatattgcaacagaagttttgctggttcctatatgccgtcatgggggagaggattttgtttcttggccacatgacaagaggggttgtttattgttcgctctgcttacaacttagtgacatcaaatttatttgtggtggcccagagctccaa

SEQ ID NO: 29637 - DNA, 1501 bp, Oryza sativa
caaatgcattgcaagagatcttttgcccacaagtttcatacaataaagatttatttttatgcaatttgctgctagagaaaaccaaatatttgtgtgtacaacaagggttttcttgttcttataaataaaaatagatcaatgccaaggtagtgggaagatactagaactcccagataattgtcacggaatctgtggttttccgtccaatgaatagagaggacaaattttatttggccctactctacacaagtacacagctatactggaacgatggaatctccaattagtacaccgcccctgatcccctctatgcacttatgcagtcaccaatgtggttagacctgtggcctgcattttagtagtctactatgtggcctcatgcccagcatgtgatgtgtaaaactacaatcaaacaaataaagaaaaaactgtactctgataacatagtggcagcaataggtgatttagttctgtaattctgtcaaaaacgaccctccctagtttgcccccacttcgcaattacccatggtattgcaagggaggatttcatacggaggaatccgtctcaagcaacataattaccatcaagttgactttaaaaatggaagtgggtatggctggattcctgtgtggtgctgggtccctcagtgagagggaaagattctaacaaataaagaaaagaacaatgcagcggtggccccataagctttgttcttacgacaaaaccagacaaacaaaggcaaaaccaaagcaaggacaggccaagcatagacaattttgctttccatcctacagcagcaagattcatcagatgcctttggaatgaatggtgggaggtgttctggtggagcactaaaccttttctagagctactacttgttggaggctaacaccgagctaggaagaagaaaggagactttttcatgaggagaagggaggcatacgattaccagtgagctactactctatcaatctctttctttgcttcctttctgtagaaaatgatgtgttcttccctactacccacaccctgcaatccaaacgcaggcaaatctagcacaaaattcatcccaggactcccagtctcctgtactccccttgcccaagatgtgcagcgagctttacttcttgattccgaacaggagagaagtattacgacttgcatgctccttgcccaagttcttgtcatcatttccaagagcaaaaccatcttgttggctttaatactgatgcagtaactatggtgtcaaattctgtgaccagattctgaaggaaaccttacctgcatggaagagggagacccccagcccagcatctccttggcacgcactccgtcggaaggcgcggcggcggcagtcgacttggatctccttgagcagcttctctcagccgacaacgcctggcttgaagtggcagcaaacacttcacgctcacccaacttctttgctaccccctccaactgcttgacagatgcttcggtcgccaccaccacacctgcaaa

SEQ ID NO: 29638 - DNA, 1501 bp, Oryza sativa
acggcggctggagcggcggccggaggtggagagagagggagctcgcggggagagcgattccggcgatggcggaagacgggacttgagaggataggtagaggacgactagggggtcatttatatagccatgggagcccgggatcgagtccacatcgacgggaaaaactctggaaagtttgggatcttcgccggaaaaaggaaagattgaaccgtgaaattggaaaggatttccatagaaacttttggggatttcttggggaaattgtagaggagattgagaggattccgttctcgcaactaatttggaaaaaggagcaacggggaggccagattcggaaggggatcggcacggctgcagcttgggacggctcgggctctgtccagatgttgaagacaacaatgtagcgagagggaggacaaacagacttctatgcgggctgagaggaagggagagagaagagaagggaatgggctgaaaagggcccaagcggaggaggaagattttattacttttccaaataaattaaccaatgagatgatctttcaattgttaaaaatatttccaatgctcaaatagttccaagaaaattcttgaacatacttggacactcaaagtatttaacaaaactgtaaccagctcatttaatgattaatttaatatgtgaataattactgaaatgttctttgtattattaaaattagtaattgagctccgaaaaatccgagaaaattccagagagtataattaatcatggagaatttaataaaaattaaatccaaccatgatttatatttaggagtttttacttcccacatttaacttcacttgtaaattaatgaacatttaatataaattctaatattaatttactaaataatttataaatcctgagacagaaattcaggctgtgacattaacagtcttgaccgaaacactggtatataaaagctgctatggaatagagagcattctcatgagccttaaaatttggtggggattgttagatttaattggttaattgatccatttaaatcaattaaattaaataaattccaaggctcattatgctaggaattcatgtgtattcattctctaatgggatatcaatgggacgaggagttttgagaattaatccatttgattagtgaattggtaacttatatcaattactcctaattgatggatggttgatggttgtatagtggaggatggttcatcactagttgatgataattagttgctctattcctctttctgttctattggtaacctacatcaattactcctaattgatggttggttgatggttgtgtagtggaggatggttcatggctaattgatgagaattagttactctattcctctttctattccatgactcttactcttcatcttccatttctcatataaaatgagaatggatttgatctccctaagaagaagtgagacacactttcatccatttccaaggctgttgctgctacggtaatcccatcccga

SEQ ID NO: 29639 - DNA, 1008 bp, Oryza sativa
tgtgggttgtcaccagcaggcatgatgccccgcactaagcgcctggattgaaatttccaatcatcagtgataaatttgcaaaatagtaacatgttgaatattagaaaccagccaatacattagtaacgacttgccaaatcatttgtagcattcaagttatgtaattccatatctggctttagtttcgagttataatctgatgtggtattacacaatcccaggccattgcagtatgctaacattttcctttctagaaaactcaccaaaatatagagtactacagagctaaaaataataaaacatcaacaggaagcaaatgcttgtttcatctacttgaggtaggaatttcaatctatcaaccaaataaaccttgcaagccagttaaagtgaactgatgagactacaacaacataccaagcggcgactcaagtagtaaaaaagtaacagcaaaagaaaagaattacacttgtaccaaaattgtagtgcaaagttgcatgccttccataacttatggtagacaaaaatttaaaatccataaaagcaatggccctgagcccctgacagcctgactagtcacaaccttaacactgaccagggctatcagcaatttcaacacaaggccatgaatccaacttgttatatactttcagttttcagacattatattttcattcaaaaaaatgtggttatgattcacattactgcaaaaaggtcacgaatagcataagttatcccctacaacactctgtggtcaggttaatttctgcagtagcacatacaaaactcactaacatcaaagatacatagcaaaaaggggaaaagaaaattttatcaacacctctaagagcgcataatctactccaggtgatagcattttccaaatcataattaaggaatagttgaccaagaaccacagacccactagccacacaaccgtgggggatcggattagaccattgaaatataacctagaaccctaaatcaaaggtcccgtggcataaggccaga

SEQ ID NO: 29640 - DNA, 1501 bp, Oryza sativa
cttgaacatacttggacactcaaagtatttaacaaaactgtaaccagctcatttaatgattaatttaatatgtgaataattactgaaatgttctttgtattattaaaattattaaaaatccgagaaaattccagagagtacaattaatcatggagaatttaataaaaattaaatccaaccatgctttatatttaggaatttttacttcccacatttaacttcacttgtaaattaatgaacatttaatataaattctaatattaatttattaaataatttataaatcctgagacaggaaattcaggctgtgacattaacagtcttcaccgaaacagtggtatataaaagctgctatggaatagggagcattctcaagagccttaaaatttggtggggattgttagatttaattggttaattgatccatttaaatcaattaaattaaataaattccaaggctcattatgctaagaattcatgtgtattcattctcttgtgggatatcaatgagacgaggagttttgagaattaatccatttgattagggaaatggtaacttatatcaattactcctaattgatggatggttgatagttgtatagtggaggatggttcatcactagttgatgacaattagttgctctatttctctttctattccattggtaacctacatcaattactcctaattgatggttggttgatggttgtgtagtggaggatggttcatggctaattgatgagaattagttactctattcctctttctattccatgactcttactcttcatcttccattcctcatataaaatgagaatggatttgatctccgtaagaagaagtgagacacactttcatccatttccaaggctgttgctgctatgataatcccatcccgtcgagtgtgtgctcacgcgttgggagagtaggcctccgaaaccacgcactgctgtgacgtttgcacggacaggcgggcgattaggtttttggggagcgcaatgcgcgactactcactattcgtcaacgtctacttcgtcttcaccaatatgtcgaacactggagacaacggcaacactggagacaagtagaaggaggttcctgtcaacaacaatagaggcaatacttcctcaaactccagcggaggaccattcttggggtataaccttcttacattatttcaattagaagttttactactaatgttcatcgcagtgtcaacattgcgttattatgtgattgttgatgcttcttctacgttaagcatgctcatgttgattacattcaccactatcactggatcaaatcccattgtaaatatcatggtaattatcttgttattttggattaaaatatgccgaattatgaccaaatttccaataaaccaaaaacctaattggtcattttcggtagttggctttgctacaacactgaaaccacatgcttttgatggttctaattataagagatggaaagcacatgcactactgtgtttgacagcga

SEQ ID NO: 29641 - DNA, 340 bp, Oryza sativa
tattcaaaaaatttacgtaattataatttattttgttacgagttgttttatcactcatagtactttaagtgtgatttatatcttatacatttgcattaattttttgaataaaacgaatggtcaaacatgtgagaaaaagtcaacggcgtcatctattaaaaaacggagggagtagtaattttgctgatctatggcacctttagttagggtttaggagacatggcaatttagcgttcacttattatacaaatctagctttcgtcttactgtaacgatgagctatttcttgcctcttgattgccaggttgatagatttccatagcgtgcctgataggggaga

SEQ ID NO: 29642 - DNA, 1501 bp, Oryza sativa
gcgacgccggcgagcggcgagaggacgaggagaaggcgaggcgccgacgagtggcgagagggacaaggcggcgtcggcgagcggcgaggacgaggcggcgcatccccctccgcgcccgtcttcgccggcggcggctgctcctgctccccgcgcgcgccgtgtcgccgttgccgctgaataccgccgccgctgctgctcctcctgcttcccgcgtgcaccgtgtcgccgccgccgccgccgccgctcctcccgctccccatgcacgccggagtgctgttgtctccgccaccatcgccgggtttcgctgctgctgctgctcgatgtgagttatctgctagtgacgccggcgtgaggatgacgacgtgagggaggaggatggaagcagtgacgggagtggcatggttcaaattttcaaaatttccagtggcatggttccaaatacgtgaattgtaatggtatttttctaatatgccatatttgtaatggtatggatccaattaacccttttctcaaaccattttttagaaatggcgcatttcttttaaaagattttttcctagcatgtttttttgcttttctttactgacgaagaaaaccatatttttctcttttttgcttttcttttctcgtgtgttttttttcatgttttctcgcacgttgtttttgcttgtttttttcgaatgttttttttgtttttttccaatacatgagaatatatgacgaaataaagccatgtagtagatggcaaaaaatgatggaccctatccgactcaagcgtctatcaatttagctttttcctgacaattttttcagaacgatttgttttttaatagatggtgtttttttttcttgcgtggttttttaaaaccatttttttagaaatggcacgtttttttgacagttttttcctcgcatgtttttttaaaatattttaccaacgatggaaataattgttctcgtgcgtttttttatttattgaagatggaaaacctttttagcgtgtttttttgcgcttttttctgacttttgcctcacgcggttatttgacccatttttattttctcgtgtattttctctttttaaattgttagattggattagagatagagaagagatatatactggttagaaatcagattttgtttcgccactttcttagggaatcggacgaactttttttagatatttttttagatttttttcgcctttataggaatcagactttttttccgtttttgaaggaatcggatctagcgtttttatttcaccactttttttgccttttatatgaatcagatttttttctcgttcgaatctacagtttttttggccacttaggggaaaaagacttttgttgttgttgttttttctttattttcttttttgtacggcttttctttttctttttatgcacctttctccctttgttctatctcttttattattatttttaacaaaaacgacctcaagtaccttattgcaagattatagggactcaaat

SEQ ID NO: 29643 - DNA, 1501 bp, Oryza sativa
ggttaattggcaatatggcacctctgtatagtggttcttatttttaagtcctcgcgcaggaggcaactatagccgcgaagggcaactttaaccattaccatgtacaggtaaaatggtttgtgatactcgagtataaactatatggtatatttctaaaccctgatcgagatgacgtggtgtcaaacgatcagttccccttaaatacctcgggaacgccagaactcctcttgctgctattaacattacgttcagagcatatgaggatataagttcatggaacaggtgccataatttgtaatgacttaatactgggccatgactaaagccaatgattatcagcaagtcgtggactgcgggtaaagcgtacatctgctgcagtagaatatctttgaaactattcgaatagctgtactcatggagttgagtaccgggaatcatatggtaccctggttagaaatctaaagtttatatgttttataaattcctgctataacttttttagattgtctaatactgctttttgcaaagaaccctattatatgtcaatgcataacatattcccgtgataacttgctaagtattgtaaatactcacccttgctcttataaaccctttttcagatctgggtcaagaggaggacccttatgactattactacgaagaccccaataacatagaaaatccctgaaggttatacctcactagtcagaatgtatagaaacttccgctgtgtattaattagataggtgagtacctattattgtaaaattcttagtattgtaagactttaacatatgcaatgaagaaccagttatattgtatgtatcaatatttactgatccagggattgatacattaatcttagttggatccaagttgttagttttgagacccgacactttgttatggccaatttgcattgattactctattccttgataccttgggttattataatttgactagttgagctttatatattggttcagctagatatattagatctaattgcttagccatgcttagaaacattagcacatgattgggataactaatgtttcactatcacttaatgatggatatttaattgtagctcacggtggttaatagtgattggttaattaattaatttgccaactaaaacttgataatggtgggttgtgagcacatggttttgatggtcatgctcatgacaattaaggaccggttcacgagtttcggttgtgaaacattaaccgtgccaaccacatgcccgcatgggcaacggttttaccttttgtatagcatggttcattgcggggcaccagactgagaagtggcggagataagcccacgggggtcgctggggagtccatgccttgtttataagggggtgattatgatcaaggaatggtgcgttgtggtggattgtgttatgcgaggggtactgtcacagctcctttccgaggtaccgtggtggtattgcggcgcatggtgacatattgtggggctgtgtcttgtg

SEQ ID NO: 29644 - DNA, 1501 bp, Oryza sativa
acattacgaagttttatattgacatagcatgaaaaagaaattacaagatgaaatggaggaagtaaataccagtggtgataagaggatggctagaaagctaaggatcaagccatccccaggcttgtgaagcaagatctgggacaaacggttgatgtagaacaccggaaccgggacgccccaagcgtacaagtccggcacgatccatcgcttcgtgcgtagcactatcgtgcacggatgcgacgcccctgcatatacaaacacacgcgtaaaacacaaggtcattttcgctctcgatcatggaagcagaaattgcgaaagctggccggctagcttgatggatcgtcgatcgagagcttagcaccattggcgtctgcgcactcggcggcgatgtcgacggcggatttctggtagccgacgacggcgacgcgcttgcccttgacgagctgagccgccttcgcggcgcccatgttggagtagtccatggagtggatcgccgtgccggcgaacgcctctggccctttgtccggtggaaatctcggcatgttggggaagccgctgaaccgtccgatgcacagcaccacgaaatccgcgacgtgcagctgaagcacaatgataatctttagcttattatggatggattaatgcaacattaaccggcactattattaacacgatgtttcatactaaaaatatattaatcacttgcagctactcccttcaattttatattatactccctccggctgataatacttgtcgttttagacaatgatgaggtcaaactttagaatatttaattataaatcatttttaaaatatttgtctttcaaatatagtgactacatatataaattagtcttaaaaagtactatatttgttacacttttatacatattataataaaaaataatagtcaaagttgtttttttagagaccgtgccattgttcaaaacgataagtattatcaacccgagagagtaggtcattttgattttttttcttggtcaaacttatttaagtttgataaaatttattgaaaaatatagtaaactgttaacacaaaacaaacatatatcattaaagtatatttaatgaaactaatttggtattttagatgttactaaatttttctatagatttagtcaaattttaaaaattgactaaaaaaataaagtgacttgagtacataatatgaaaccgagtaggagtagttatttgtgcttgcctcaatgttgtggccgctctgcacagtgagccgccactcgccgcggccggtgccgaacgcctcgccattgccggcccagtgctcccaggccatgacctcctcctccccgccggcggcggcgtactccatgccggcgacgcggcagccgaagcggacgcactccagcacgccgaagcgctccgcgtacgagcgcaggtaggccgtcacctggtcgtggtccgggtacaggtcggtgacgcccggcggccacgggaagtcggagtactcgaagtaggg

SEQ ID NO: 29645 - DNA, 1486 bp, Oryza sativa
gttagattcgtctcgcaaatagcccaggggttatggaatgggttttatcagtagggctatttaatagcaagattccgaaggactatttaatagaccggaggatccaaatagggccaaggtcacaaagagaaggcgtgcgaagaaaaagaacgtgaacattaggtaatgacctaatatcaaatataaatagaatgagtgagacttcgaactcagaccggctagcccaccaccttatgaagctaatcagaagacccctggacatttctcaagatgcacgtagaagaaaataaggttattgttcatgcatggatcttaatgcaatcctagccatccacaaattaattgaaatcaggggctgtccgtcaaaagtccaataacatagatgcgatcgaacgatgtacgcagtagtatacatcaagagatctatggtagatttgactgaaaacgttgggcatatctttgaagaacacgttagtccatgattgttaaccatttgtgtgcagtgttgggttcagggtactgtacatgacgtataaattaattggaaactataggagcgcaaaaaaaggaatcaccatatatgggactatatatagtacctcataatgttgtatcagatcggtacatatatataagatgctaatgagctaggatcgtattagagtgaattgctcattagcaagtagtgctaaaacacagttagctagctaagtagttagggattgttgagccggaatagtatcatccaggtacttttgagtttcagtcagtgatctgatctatggcacacgatcaagaaattcagctaatgataaaaggtactccttcagaatcgaacccttcctgattggttcaggttgtactacttcaacttatgcgtgggtcctcttatataccttagtaagtactctctccgtcccgatataagagctatctatattcgtagtagttagacttatattgagacgggagagtagcaaactagtacatgctgtcatgattcatttctgcactttcagactcgaacctcgtaatatttgatagatcaacggtaagcatgttatttttttttaaaaaaaagtactattggaattacacattttaatgattttttccaatagttccattgttgagatttttgtttaattatgctaaacgaaagactaaatgcgttttagcttcaatggaaatgtaacctcttacaaaaacagtagtatgaatgccctgcaaattctagccacacgattggttctcttcaatttgattgtcaaattaaagcaacgggtagtacactagtagtagcagttcacggcaaccttagctgcgcagtgcgtacgtacgcatgtctcactgcgtacatcctttaatttgtctgcgttaagaacaggctcagacaataattaaacttcactggttcgatcacacttacaccacgtacgctaaattactgtaactttctttctgccaagatactcccggacaggag

SEQ ID NO: 29646 - DNA, 1501 bp, Oryza sativa
agtagcaagcccaccgaaggaatcgagctgaggcgttgtcgttgaggagatcgagcctttcttcctcaagtccgaccgccggccatcttcgtcgattcttctttttccagtgagctaggctatgattcctcacacatgtagcttccctatagcatttataattcattcctcttctctccttggtagcccgaaggccggaggaacccgacgcgctgtcgtcctgtcgatttccaatgccgccggagcatttctcagttcgccgccgtagtccgctcgcctcgtcctcgccgcttgccggcactgcctcgcgttctccccgtcctccagcaccgcctcgtcctcgccgctcgccggcgccacctcgttctctcgctgttcgccggcgccggcgctagctcgccttctccccgcgcgcgcacgtgacagattgacggggagggtgacgacgtgaaagaggaggatggaagagtgacgggagtggcatggaaccaaatacgtgaattgtaatggtatttttctaatatgtcatatttgtaatggcatggatccaattaacccttgagaaaatcgcgcaaggaaaaaaactgtttataaaaaaacaagccgctcattaaaatagaaacattgtcattgacatgattatgcatgaaaaacgtatattatcattataatttctttacccattgcaacgcacgggcatttttctagtatatatatacacacatggaactatagttcttctccatgctcccaggaagtactagaatgttgatttccaaacaaacgaaagaagtgcagagaagcttgtccggttgtcccctccgggtcgactgggctgacccaagtcaaattgttggacctgacgaggcgaagacgtacaaatcgcatctgaacttctgcttgcttgcccgtgagatgaaaaatgaacgtagatgcataaatccgttagaggatccggtgttggaacgagataaatatgtatataaccatcatgatttttgcagttagaggcaccgacgaaacacacacgaccgtttcgatctgcaaacaagagcgtgcatgcatgctatgcgctcgcgctaggggattggagcagtgagcagtcagtcgtcgcacggatccaccaggcatctctattagcatctcacttttatgttaaaaacataatcacaagtttgaatacgaatatatataataatatcaaatatgtgtcataaaaatatattttttgatagagtagttgttagttcaattcttgtcctaatagaacctcatgcatgcgccttaagttttttagcgaaggattgataagtccattttatttttgggtcatgtgttttgttttttctttgataaatatagttgagcatgtttcttcttttatttgcaaataaaagatgcatttcattaagttagcatataataaatattcgtgcatggaattggtaaaagttaacaaaatttacttgaataaataaaatgtatggagtgaagaaggtat

SEQ ID NO: 29647 - DNA, 491 bp, Oryza sativa
catcaaacaattatcagttagcaatatatgtttgatgcaatgtaatgcatctcaatctgatacaattgggagctttaagtgttcatctatcaaattgttgcggttcaattcagaattaagaccatgggctaatgtgacatgtttcaaaaatgtggtgctctttggtttcaaagtggtgcgtaccaaatgcccctataggtttcaccttgctccaatcgacttttaagaaacctttttgttaccatgcttttaggaacatgctttacaaacattctattgatttcgtcagttagaaaaatataaatcatgcggtactccaacttttaacttaatatcaatccagaatggcaatatttgaatgccaccaaatctgatttggccctccaatggtggcgtagaacatcacaagatttgaaccttaactgggcttctaggaggctaggcagggtcggaatacacttggttgatcactatccccaccaccttgcagt

SEQ ID NO: 29648 - DNA, 526 bp, Oryza sativa
cactagtgtatagaaggctattaggctaattaggccgaacttcaaaaacccgaaaagaagcctgtaagttgtacactagagaaccccaaacaggcatatgatatttggtttttgacgaatcttaccacattctgttgcaacgcacccacattcaactagttgcttcatatatcttgaggtctttgatatcagcgctaaacatatgtttaatactaggcttacacaatactaaaatggtcttaaaggttgtttggttcactgattacttcttctagttcaatcttacccaagaaaatggaattttttttatttataattttttttattaaaagttttacaaaaataattttccattttgaaaattgacggaagtagtcgcctaccgccctctgggacctcccagagggcggcgaaaatgacgtggcagacggccgttcgctctcgggcgacgaccgtcaacgaaatttgcaggcggcccccttgccgccctccgctagggtgattttatactgtgcagggggccgcc

SEQ ID NO: 29649 - DNA, 1501 bp, Oryza sativa
ggctgcgttcggatgaggaggttcccaacccctctccctcatattccgcgcgcacgcttttcaaattactaaacggtgagtttttgcaaaaagtttctatacaaaagttgtttaaaaaaatcatattgatttatttttttaaaaaatagctaatacttaattaatcacgccataatggaccgctccgttttccgtgcttgggagatggttcccaacacccacctccgaacacacccatagtcaatttaatagccaattcatacaatagatagatataaacatatactatataattaatgtttggtctcacatgtcatacacatatgtatcttggagctcgcgctgcagctgtctacaaatctatagcccgctactcttatttttcctcttttatctacttaaaatatatttatagctggcttatagtctgctattgtacctgctctcagatgcgtcgaaagagagtttaagcagtttaaaattcgaaaattaacacctaaagtgacttaaaataaatacctaatattattaatttattgaacaatctagaatttttgttttccaaacaacctagaattttagaaaaagaggcaataaaatgttactaccgtactagcacaatctatcatgcatgtgtctgtctgtctgtctctctctctctctctcagagagaggagttgagtggatctccatggatggcttgccgacacatcacagatggatgaacaaaaatcagatcctgtagcttttggaccttttgtcagtgtcatcaccttgtagtggaaggaaagtgaaagacaaaggtgacgccgaatgattttgggtcaacttaattggagaaacaccttggggcatgtttagttaaaaaaagcttttcccaaacatcgcatcgaatctttcgacacatatatgaagcattaaatatagataaaaagaaaaactaattgcatagtttgcatgtaaatcttgagacgaatcttttaagtctaattaggccatgattagccataagtgctataataacccacatatgctaatgacggattaattaggctcaaaacattcgtctcgcggtttccaggcgagttaatccgagatgaaaaaacaggccccaaatggcacaaccgcacaaggaacagggaatagagtaggtataaacagtcttcgcggaaacgtattgtaatcgtatctatgctacgcttttgtgatagtggacttttggatatatgtttttccaatatatgtttaaccatctatcttatttaaaatttcatatagacataagaaaataaaatataaaaaatatccttagagtatttttaattataagccaaagtcataacaaaataaaaattattcatatatttttaaataaataaatagataaatatatgttcaaacgtcaacagcgttatctattcaagactttaccaaacctaatttcctaatttcagatgagaaacatgtaaaaaagaactgaacaaaacccaaaaaagttgaa

SEQ ID NO: 29650 - DNA, 1501 bp, Oryza sativa
gaggatagtgtacgtatgtgctcccagttctttgacatcatgttccacaatgaaatcatatctacccccagatctgattgactcaacaggggccttagatgtatccaaaagaagtatcctctgtctctcggtttgtatttctgcctaatgtaaataaacttccggttaaaacttatgacataatatgaagaaatgaaggcttcaaggacagctaagtcctgcatgcatgccaccaaaggggtgtctaaagtatcaaatttgtcatagagcaacatgcaacccatcgacagaactagccaataagaactacagataaagtcaaggtcaattataattatttgcatcaaagctacttattagcttataatacctcataatttcttgcatgccttaataacaccttgttacatttttttcttaatgaggctctaatagaattggtctaatcactgaacacaccacattggtcaacaaatgtaaaaaaagatgaacaagcaactattccagtaattccacagcagagagtcaatcgagtaatcgaatttaacatcagttcatgactgcaacaataagaacttggtgatgtgagattctaacactgaaaaaaagaagaagagaaaaacatcaacctagcacactctaaccagatgcactgaaacaacagcatcaatgacaaactgggtgcaataataccgttctccagaaaacatccagaataatattttatggtaaacgatccagaatttcaaataatgttttccaactaatgcgatataatagaagaggatggtaatcatgcgatggttcgagaaccttaatggcgacgtccctggcctcgaagctggagctattgttgatgctgatgtagctgcagaaggtctcccccaaatagatcgccctatcgatgcgtccccgcacgatcacatcaacacaatcattcgctgcaatctactactggaatggaagcgagagagagagagagacgaacccgaaggattgcgggaggacgaggaggccggggagcgcgagggcgtcgacggggtcgcggaggaggaagcggtcgcggaaggtgaagtcgccggggacggtggtggccggcgagtcgagcgggtggaggaggccctggaggaaggcggcggcgtcggcggcggaggaggcggaggggtcgggccccgtgagggcgtcctcggggaggaagacgtcgcgcgggtcgaagcggagcgcggcggcctggtcgggctgcagcgaggggcgggacagccgcatcacgcggaacgccagcgagtggttctgctgcagcagcgcctgcgccggcggcggcggctggtgcgcccccgccggatacggcggctgcgcgccggtgtagggcgacgccatcgccggagaacgagggagatctggggggctcgctctcgcgggcagtcgagtcgagactagttgtagttcagtttgccggttaagtttgagcaatttttgtatatgtatttgggacatttaatcg

SEQ ID NO: 29651 - DNA, 1501 bp, Oryza sativa
agccataacccagttcaatacctccccacgctcggcctatatctctttggcccaacacacaaacaggcccaagccacaagcataagtggagtcataggcccaacttacatagcctactgcgatcttcaaccttcggaagatatcctatgcatgcatgatgccggagccggtcctcgtcatcaaatccaaccaatctttcttgatttggttgagggcttttgatccactcgatctcttctccccgtttccccaatatcagagagaattcacaaaaaaacgggacaaaaaggcaaagctcggtcagccatcttcgatggagattaaatccaacaaattaaaaccaaattgaaagagaaaattatggagaaaataatgagttagaagtagggaatcgatttttgcaataaataataggaggaaacgtacagggaggcagatcgcggcggtgctagggtttggcccgggccctaagagcggtaaaaaaaggagattggatcggactgagtggaaaaatacggtgataaaaaaaccagatgatgaaaaaaaaagaagcctaatcggacataaaaaactggcgagaaaaatagacggacaaaaaaaacatattcaattaaaaccgattcctcaattaaaactgaaaaccgatttaaacacggatgacttactaaaatctcagcaaaaatatcttcaatttttacaatagtagagatttagacaaagaacaataatatcatattgcatgaaaataataattcatgaccgtcaaaaattatatataatcacttcaatatacaatatctcaatataatatacaagatatgagggcaatatatgtctgcaaaaaaaacaatgatccaaagttatttgattaacttgttgggggtataaaggcgggaaacgtgcgtgtggaaaatgagggagagagaagttgggaataagtagtataggacgccctaataatgttacctcgccaagcttttttttttccccattttgtttaaaaaacaacaaactagtctcgaatacatgtcatagatacatatgaacccacatgcagtggcgaacccagaacaaaaattaccggggatgcttgatatgtttataggtttatttttgagtaatataatgcttaatatgacctaaaacacgtccgtggacaccgggtagatacacataggtacgcccctgcccacatgttatagacaacgattgataaatcattagttaacttatcttaaaagtgacaaacaattaaatgtcccaaatacatatacaaaaattgctcaaacttaaccggcaaactgaactacaactagtctcgattaaatgtcccaaatacatatacaaaaattgctcaaacttaaccggcaaactgaactacaactagtctcgactcgactgcccgcgagagcgagccccccagatctccctcgttctccggcgatggcgtcgccctacaccggcgcgcagccgccgtatccggcgggggcgcaccagccgc

SEQ ID NO: 29652 - DNA, 820 bp, Oryza sativa
actatatgtatgctaagctcttatatattaatgaccatactttctatgcttgatgaaatcattgtcaaaaggggaagaagagatgagttttttggagaagcaaggtgaaaattttcgagttgttgagacggtgaaattgggaatttctctctttttaaaaagggggagaagttttcttttgaattttttagcacgatgtgtacgtttgtacgaagtgtattttttaccacttttgtttttatttttccaaacactaaaacatttttgatgggtttgccaatgtgttcatcaagggggagattgtaaaatcaaaggtgtttttgattattattctgtgatgaacaattggcatcggagataattggttttgttatttggaattaattcacgaagtagttttggagatgattggatttacaggtgaatctacaggtactgctgttatttcatgtgaccggtcagaccgggtagtgtgtgccggtcagaccggcggtatgcgcgcggtcagaccggccagcccgcggtctgaccggccgactctgtgtcggtttcggtttccgattgtttgtttagatatccgtgattatttcaggattatgacttctagatggatactatacatatgtaattctgttgtttgctactaatgagacaagttggagatagcttggtctcggaatatggtttctttgtttatttcatgagtaggtgactcgatgtctcgggagagtatttgcggtgatggaccgggagtcggcttggggataagacgacgtcggtggtggtcagagatcatgcgggatacttaggctagagttga

SEQ ID NO: 29653 - DNA, 1501 bp, Oryza sativa
aatatgtctattcaaataaatactaatataatttatctattcttatccatgccatttaaatttttataaaattgaaactataccatcgcagttatattttcgatcttctttctttcgtcctctcattttcttaattccccatctctccgtcacggcaaggagcgtgggcatgacaggaggccggtcggcggcgccgtacaacgtggccctgcaaggtcactcagtttcttgcatggtcaggaaaatccagcgcaagcacgtgtgccctgttgccggtgccggagcaacagcacaccaagaagcggtggaccttgccgtgctcctccatggtcgacatgtttttgcatatatggtgcgtgcgatgcagatggcggtgagcgcggcgttgaacattctttttttagacaaaaggtccttagggacctagctttttactgaaagccaaagtggtagcgctgaggaaaccagcttacaatgtagtacaagttcagatggccacaccccggcctgggaaggaggatagcacaacttaaaagggaaatcaacagaaaaactaattcagcctactccagttcttctcggtttcatattagaggtcagctccttcatcttttcagcaaattgttccagtttcccttcttcctcagcacgacagagtttcctccactgcaacaacaaagaaataatttgaaacggcaaagttagtggtgagtaaagtagagtttttctgaaaaccatgttgtttcttgtcagccacaaacaccagcaaatggcagctagcaacataatatgtaatctatcattaataaatgcagagctatggttgcataagagaaaaaactcatcaagatttttaggagggtaaggctagttcagaacatctctacaccaacatcacacaaagcgagccatagggcatacaaaaaggatgtgattagtagactcaaaatctccacacaggctacaattaacatctcccctccccatcctttcttttgcaattgttcagcatattgaatacgatctctatgagccagccataagaaatgtttgattttcattggacatggcgctttccaaattttctccatctccttatcaacaatccctctgaaacacatagctctatacatagatttcgtagtaaaactcttgtttgaattgagacccccaacagagcagatcttgcctatcttccaacttagtatttaaaataacagttttcaactcattccactcctctacttcatctggaccaaaagatcttctaaaggataagcagttatatccttcctttaacaccactctaaccagaatgtcttgttagttactgatctcaaagatcctataaaatctcactgtcagaggacatgacccaacccaaaaatcatgccagaaagaaatatggtcacctctacctaacttccactcagcccccaacatgaaccattttctggaattgagaacccccttccaaaattgagagcaatcccctagagta

SEQ ID NO: 29654 - DNA, 1501 bp, Oryza sativa
aatgtgattatggtaactgatgatttgtggttgtgttttgtcaggcaatgcatccatcctaggatcccacagctggcgatcatcggctacgctgaaagctggtcgaacctctgcgtgtccgagctactgtccaagtggctggcacatttcctccatggaagcttcagattgccaagcgtaaaggagatggaggaggacatagatgaatgggacaagtacatgaaacggtattcccccggccgtttccgtcgatcttgcattgggccggtgagcgtgctgtgcagtgatcggctgtgccaagacatgggggttcaacgacggaggaagaagtggttgctggcagattggttggtaccctacggaccagccgattacgctgatatcaacttgaacagctgaaatggtgatggaatctgaatcttgagggcaccggtaatctttcttaaaaaaaaaaatcttatcttgagggtagtttgccagtgactccatttttatatttaggggtgcaaaatgaatgcaagtttttacatttattaggattcaggaccaaaataagattacgagaagcagcgggtgagaagttagcttgtgagaatcccagcttctaacttctagttcattttctggattctacaactatagtttctcagaagttgtgtgaaaaatattggcttgttggggagcttaaaattgtgatagacagctagctggtagtcagcttttgagaatctaggttttccagtttctggctttcagttcattttttggattctacaatcacaacttgtcagaatttggaccaaaagctgaactgtttggaaagtttatgacagctgaaaattctaggagaagctgcaattgctagaagctcccccagacatactctaagaataattcatttgatctgtgcagatgccacagccagccgccgcatgcaccctcccctctcgcgccgccgctcgccggccgtcgaggtagtgctggtacacgtacgagagaaacccccacacggccatgagcatggctaccaccttggtgcccgtcatcttgtccccgaacagcgccaccgccagcaccggcaccatcggcagcgccagggtgcccgtcacgttcgcgaacagcgacgacaccctcgcgatcagcctcacggcgcccagcgtcgccgcctgccaccccacggcgacccccaccacggtcgccgcgtacgccgccttcccgcccttgaacgccgccatctcgccgccgatcgtcctccactcccccgacgcgaacagcgccgtcgccgacaccgtcgcggccaccgcgttcgtggagatctgcatcttgagcacccaccgcggcgtcgctgctccgatcaccttgtcgaaggtggcctcgaacagggacaggatgagcgcgtagacggcggacgcggacagggtgaggacgacgccggcggcgtgcttgccacgctgaacggcgtcgccgccggcgccgccgccgacggaggaggaggggtcgt

SEQ ID NO: 29655 - DNA, 171 bp, Oryza sativa
cagtataaaatcgccctcccccagggcggcaagggggccgcctgcaaaattccatgccccctcgccgcccatttgcaggcggccccccacacagtacaaaatcgccctagcggagggcggcaaggggcccgcctgcaaaattcatgccccccctcgccgcccatttgcagg

SEQ ID NO: 29656 - DNA, 1501 bp, Oryza sativa
attcttgttcagggtgaggatgctgttctattttcattgctagataatgtcttttctcacatgttactccattcctatgcaccagtgtgaatttgataaatatgcaaggtgaatgcacatacctcaatgttaccaattttcaagtccttcacggtgaggcgccacaccccatctttctgagcaccaaatgcctcaccattgccagaccagtgctcccactgcattatctctccctcggttgcaccaaggtattcaactccaagcacctggctattgaacctgatgcacttgaggagatcaaactcgctggcatatgacctcaggtactccatgaccttcctatggcttgggtacttctctgtcacagttgctggccatgccaggtctgagaacctgaatgccgtggttggtgcctggagccttgttgactccaaggtgtgtgcccagacgccaccgatggtgtcgtctgcttcgaacacgattgggttgaatcctttgtccagtgagtgcttgcatgctgctaggccgctcacaccggcgccgatgatgccaaccctcttcctgtccattttcttgctctgcgtccaggttcttgggaggaaggaagaagatgggggtagatgttatagaatgttgctgattgattgattctttggataagttaaattagatttttttggagttggtggatcttttccggggattggatgggggccaaaccaccaccacttgcttgcttggcgtcttcactgtttgctggttctagccctgtcagcctctggtagtttgtccctttttttccgctgtgagtttttctttttgtgtgtttgtgttcagtgggaggttgggagtggtaattttataaatggatgatggatgtgttttgagtgcttaatgaggtgaggtgaggtgaggtctctttcaaagttgagcaaatatcatggcatctcaatgggataaaatctgaatttatacgcatatatcaagagggcatcccaatgggctagattctggattggccaacaaggcctcgaatcgatccaacatgcttggcaacgacgtcagcgaacgtcttccggccgatgatggaggtggtaaagccgcatttggtccctatcaaagtttgtggtctaaagcgagaagaaatgtttaccaaaatcaggcccaatatggtgcccaaattagccaattctagcggaaggcccactaacgaaggccgttataattagtggaggcccaataataagagaaaccttgactaggcctgttccctctccactctcaattcgccgccttcccccgcccagcacgcatatgatccaagcccaggataggtcaatctgcagaattttttttatttttaattttttttattaaaagttttacaaaaataattttccattttgaaaattgacggaagtagtcgcctaccggcctctgggaaggcgatttttaaaaatcgccctcccagagggcggcgaaaatgacgtggcagacgacc

SEQ ID NO: 29657 - DNA, 423 bp, Oryza sativa
  unsure (1)..(423): unsure at all n locations
ctaattgtcatcaactagtaatgatccattcttcactatacaaccatcaaccatccattaattaggagtaattgatataagttaccaattcccttatcaattggattaattctcaaaactcctcgtcccattgatatcccattagagaatgaatacacatgaattcgtagcataatgagccttggaatttatttaatttaattgatttcaatggatcaattaaccaattaaatctatcaatcccccccaaattttaaggctcatgagaatgctctctattccatagcagcttttatataccagtgtttcggtcaanactgtcgtcatctattaaaaaaacggaggtagtagtaaatatgttttgaccacctgccaaaatgtctcgactaacttttttagaaaatgaaaatgtctcgactgatg

SEQ ID NO: 29658 - DNA, 1501 bp, Oryza sativa
tcttaaatagtaagattccgaagggttatttaataccctggggatccaaacaagacgcttgtttggtagagcgagcgagcttgctccccacctctcctccgatcctcaagccaagcgtagacgctggcccactgccagcctccatccatacggttccgtcgacgctccagggaaagccccctctccccgacctaaactggttgggggtgttgatgcctcgctagagctgccatgactcgttgaagctaaaggaggttggcacggattaatagtccaaattttgatagaaatgctcatatttttttgtggaatgaaggatagcaattccgctaatttatgcttcatgtgcagaacccaacacatagggttaacaatcatggatcaacatttttcttgaaagctatggccaaagttgaaagttctcagtcaaatctaccatacattgctcgatcgcatccatgtatggagaagctgactttagaatttagataccccaaactgctctgtacagttgacttcaaggcatccccgacgactccgaaatcagatatcgtgaaggtaagaaagtacattgcatcgaccatggtatgatctctctatacgtagaggcgacttcgatgaccggaagagctagctcgaaatgatggatctgtctgtagattgaaatacagttgacttgcaaagggtcatacagttgacttggtgattgcctgattggtgtgccacagtgccagttgaccatgacgtatgattgatgaggaggccggaggcatggagccatgcttgcagattgagaattttttttatttataattttttttattaaaagttttacaaaaataatttttcattttgaaaattgacggaaggagtcgcctaccgccttaaaaatcgccctctcagagggcggcgaaaatgacgtggcagacggccgttcgctctcgggcgacggccgtcaacgaaatttgcaggcggcccccttgccgccctccgctagggcgattttatactgtgcggggggccgcctgcaaatgggcggcgagggggcatggaattttgcaggcggcccccttgccgccctgggggagggcgatttttgcctctccccctataaagcccagtccctcctctgtgaaatttcattatattcactaaaaatccaaaaaaaacaaaagagagagaggggagggcagcagaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacatcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggc

SEQ ID NO: 29659 - DNA, 1501 bp, Oryza sativa
tgcagtactacttgtgtttgtctcgtctacatagttcttttcattcatatggtgctagaacaacttatgctcacgacaacacactttcggcgctgcacggtagtgtcagatccagtagcgcgcacagtccacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcctattcattggtaatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttgtacagtaacaatccaaatatgccctaaaaaataataaaattgtattttaccagtcttggagattttaatcttgtatagttttcaatataaaaagatttgataactattgatatttatacaaaaatatagagcacagtacaaaatcgcccttgcggagggcggcaagggggccgcctgcaaaattccatgcccccctcgccgcccatttgcaggcggccccccgcacagtacaaaatcgccctcgcggagggcggcaagggggccgcctgcaaatttcgttgacggccgtcgcccgagagcgaacggtcgtctgccacgtcattttcgccgccctctgggagggcgatttttaaaaatcgccttcccagaggccggtaggcgactacttccgtcaattttcaaaatggaaaattatttttgtaaaacttttaataaaaaaaattaaaaataaaaaaaattctgcagattgacctatcctgggcttggatcatatgcgtgctgggcgggggaaggcggcgaattgagagtggagagggaacaggcctagtcaaggtttctcttattattgggcctccactaattataacggccttcgttagtgggccttccgctagaattggctaatttgggcaccatattgggcctgattttggtaaacatttcttctcgctttagaccacaaactttgatagggaccaaatgcggctttaccacctccatcatcggccggaagacgttcgctgacgtcgttgccaagcatgttggatcgattcgaggccttgttggccaatccagaatctagcccattgggatgccctcttgatatatgcgtataaattcagattttatcccattgagatgccatgatatttgctcaactttgaaagagacctcacctcacctcacctcattaagcactcaaaacacatccatcat

SEQ ID NO: 29660 - DNA, 1501 bp, Oryza sativa
taataaagctcattatccaacagtgtatactttaacaccttatatcttaatttcttgaatcaaaaccgagccgattgacttctcaccagccgataaatataacctaaacggtattcctttctgtggaggaatcaaaacaggacgagagctgagatactctttaatattatccaaagccttttgctgctctgccccccaagtaaattgctgatcggctttcaacctcaataagggtgtaaaaggttccaaccttccagacaaattagaaataaaccttctaacaaaatttatcttgccgatcatctcttgtagctctatcttattttccggaggctgaatcttcttgatcgcattaacgctcctttgggttacctcgatccccctttcatgaacaagaaatccaaaaaactggccggccgacacaccaaaagcacattttgttggattcatcttcaagccatatttcctggttctctcgaaaactttccttaaatcggatatgtgatcctccacttctttagatttgacaaccacatcatcaatataaacttcaaccagccagccgattaaatcatgatatatataattcatggccctttgatatgttgctccggcactcttcaagccaaaagtcatgacgacccattcacataagccgattgcaccagggcatctaaaagccgtcttatggatatcttcctcagccataaagatctgattatatcctgcgttcccatccataaaactcaaaattttgttccctgacgcggcatcaaccagctgatcggtcactggcattggatattcgtcctttggtatagctttattcagatctcgaaaatcaatgcacaccctgaccttgccattctttttaataactggaactatgctagaaacccattcagcatattggcagggacgaataaaaccggcatcatacaaccgtttgatctcagctttaacaggttcaagcatatcggctttacatctcctcggaggttgctagcatggtctaacccctggcttgataggtagccaatgttcaacaatcgatcggctgagtccaggcatctcataatactcccaagcgaagcaatctctaaactcttttaagagctctatcagcttggttctaaactctggagacaaattcttgctaataaatgtcggcctttgccgatcacctggacctacgtctatttcttccaactcatcggccgacatgaaaccttgaccttgcttgtcatccgtatccttggcgtagacatttgaaccctccacgacgccctcaaagtaacagcttggtttctccatcctcgattggctgtatatcagaatcagatacttttagaaaatctccatcccagacttttccagataaacaatcaaggccatccatctcccaaagggctaaatcggcactggcaacattaactgacctgtcagctggcacgatctctatcttgtcgccttgccattgaatcaagcattgatgcatagt

SEQ ID NO: 29661 - DNA, 349 bp, Oryza sativa
cgatttttaaaatctcaatgacaataaaaaggagaagcagcatgcggggtatataggagtatagttgcagagccgctgacggttggcgagacttctagaaaataaaaaatgtattccaacgataattatgtttggtttttagaatcccaatgacaataaagagtaggcgacggatggatcgtagaggagtatagtggcatcgtttgatgtgacttctaaaaattataaaaaatgaaacccaacaagacaataatttctaaaaactataaggtccaatttttaaaggttcggaacttctaaaaagtaaaaaaacaaccaatgataatcctgttcgattttaaaatctcaa

SEQ ID NO: 29662 - DNA, 855 bp, Oryza sativa
atcagatagatctagcatgtatcgactaatactccgatactactctatatcaggatattaaagcaagaataatttatcgaacaagagtctaatatactcagacacagcaatatcttgatataaagggaagatttaacatgtcaatgaagcatatagaacaaatatagttaaatcagatacgatcggctgcaactccgatgctattctaatcggcaactagaaggcaggctagagattgatattctaagcactactaaataggtcaaactcaactgatacagcattaagtataaaaagaagaacgatatctagacaatcaagccgctagaagtttcatagaatggtagatatctcatataatctagatcaacatcaagatctaacctaatcggctgctttctgtatacagatgttagccgataatagattaggtcgcgatattgctagagattatgtaagatatatgataacttgacgaattacataaacgagattagagtatcataaagatggaagcactaatcctgggaacgcaagtcgtcataacaagttttacctcttgttgaagatcgaaaccgatgcagctcaacccgaaagcaagaactcgtcgaaacaaaactaaaacaaaagggtggcgatgcgccgaaattgtattgaacgtgtgtgttgttaattacatagggctcggggtctatgtatacccgagaattacaagatatgcccatatcagacacgactatgatctctaacaaactctaagataccataagtctttgtggcagacttttgcccacatttatctataaagaatttacataagatatcctaattaatagatacaattgccttcccagg

SEQ ID NO: 29663 - DNA, 268 bp, Oryza sativa
aataaaataattaaaacacagttggctcaattagctactttagtacctgcaaatgagtctgggtggattccggggcaacccgaaccctccgttgaaaatgttaaggcgatcacaatgaggggaggtaagtccactcatgatccgccaaatcctaaccctgcagggactagcagtatcacccaggaagcatcatctggtaacaaggctgatgaataagtttagctagagaagacagtgtcgcaagaatactgtgacacacgactgttgc

SEQ ID NO: 29664 - DNA, 1070 bp, Oryza sativa
accaattggttccaaattaccatgatcggtatttttatatacttcaaaattattaagacaactttgaaagaagacatcacgtacactctggggtctagaaattttcatattaaccgaagaaaaaaaatctacacagttagatcatgaatcagacacgtgaaagagcatggactagaatttgatgtgtgctacgcaatagcaattgaaatcaaaattggattaggaaacttaatttactacacgagacaatcatgtcctgtccgtgtagctaaattagaaatcgtatataggcacaattgacacgtcctgtacaaaatcatgtgcaggggaggcaaaccagctgggcatccaaactccttcaaccacattcaagttttgcactatcgcataatctctagaggcagcagtatgcttttcttttttaaaaacaatcctaagtaacaagattccctaatagttttctacatatttacggtccatatgttatagctcatactccgatgatggggcagagctgagaagcggcgaaaattaccacattaatcataaaaagtgaaatatttaaaggatctagattttaacggtttatattgatcagtatagttttatataaataaaatacatcaaagtaatgtaaaaggaagcctctacgtttgctctcaaggttttgatcgtggtcatgcctataaagtagatggtgatggttgatagggcatctaaaaattataaacaaaacccaaatagaatcccaatgacgattaagaggaggaatgacggacaggccgttaagaagcacggtcacaacggttggcgggacttttagaaaataaaaaatgaattccaacgatagttatgttcgatttttagaatcacaatgaaataaagagtaggcagcggacgggctgtagaggagcatagtggcatcgtttgacgagacttctaaaaattataaaaaataaaacccaacaagacaataaaccctaaaaactacaaggtccaatttttaaaggttaagaacttctaaaaagtaaaaaaaacaatgataatcatgttcgattttaaaatctcaa

SEQ ID NO: 29665 - DNA, 1501 bp, Oryza sativa
attcaaattgtttctcgagctccgaaaattcgcgggaaatttcagagagtattttagggcacaaagaatattacaaaatattctcggctaatgatttttaaaggaaattttaaattccctcaataatgcactttattaaattgctttaacttttatttaatttctagaaaatacattatttaatgatttttaatcccgaacgaaaatcggggcgttacaaatctacccctccttacaggaatctcgtcccgagattctgggatggctagaaagaaggctggttgcggggtggtctgactgatctgacaaatctgcacactgcactgttccttcctgttacaaactgactgatatcattggattggaccctggaattctgacaccccacaagaccgattaactaaccaaacctgtatgagtgatctggctagattcagttctacggtcctgttgcttcccaaaactgaattgattggttctacttgaactgacgcagactaggactacggatactcacaaaacttacttatcttgggctgaactgtcaatactagcaatttgataacctgacaactcaccaagctggctggaagagggtgaaacttgcatctggcatttgtaactcattgaccctatgtccgcttgaactggtcctgactcgaacggcaagtaattccaggaaaacctgcctgacctgtctttcgtctgaactgcaactctccttgatgtttcttctctaagctgaactattgacctggcctcacgagtgtaccttagaattgaacctatcgagttgagattggggtaactctgctagcaccttgcaacttgctccttcaagtacttcccaaattgttgcactaggttgaaccttcaagggaaacggcgacgaggcgagccaaaactcatctctgcgacctaccccccttacagagagtagtcatacttttgcctaactgggaacctttgaactgttgtccgtaaaaaaaaacaccaacacttctcgaatttacagagagccctgactttgaaaactgaaaacttcgtcgatctatcaaaatggagcaatgacgaggcactttcatcccggcaagacttggaacttaacccttagctgatgataggaaattccacataaaagtgactctcacttagctcatgaacataatgacccttgactaactttccaatcagttctaactgctggtaagactatcctgcttctagcgtggttctagtaacacatgcctgaatggatggtgtagttgacattctttgaaacataccctgatcacttaacagatcaaacttgaaaggtccttctcatggtatgacatcatacttaggttatcctttgctgactcttcctggattgatgaactgttggccctgcagctatgttcccagaaatactgcaatctgaacgactgccggaaactgactttgatgttgccgatagtttctgctctttgatcataaccacttcgctttcatatcttcg

SEQ ID NO: 29666 - DNA, 1501 bp, Oryza sativa
atccgaataggagtcctaccggccttggaggcccgagtgatggatcctatatattcgtgaggggtgtgactggcggaggcattgcatcacgtgagaaacccaagccgttacttccctccccgagcaaaaccctagtcgcgcgcgggtgctagcacatctgtggtggcgttccgtccctgtacgtgtggataccggtagtggcgccgctagtttgcggtgctgattggcgtgggagtacggcgaggagaacgcacgaggaggagaaggtcgagccggtgcgatcgactacttcctctacatcgacgcgcgctacttcgcgagagttccttcgacttctcagcatcttcttccactgcacagcgcgttgagtggtaatgatctatgatctaatacttgcatggttcccggtttacgcgatagaaatttttgatttatgctatcgtagcctacgcgtatcccaacagcaacatggcaaggaatgaacgagaaggttcaacatcctcaacacccgtacagatgtatgaggctggttgggagccaactagggatgcgcccagatggacctaagctccatgccatagcattggagtctcgagccagtgagagccgatggcgggcgcctcatgacatacagtagggaggctggaacaatcagtcccctagatcaagtggtatgcctccatctcccggtgaatggcactaaagttcctctcattgggacttgagtgaaatcactaggagaatggatactcttgatatgcagatgggagagatcaaacacaaccttgaggaacacatagcacggacgcaagaatggcaacagagggctgatccgatgtccactggaactgcacgccaatgagaaaaacgagccaatgagattgactcggtttcggcataatttgattacgccgttaaggttttcacatggcgaattgtagatgagatctagcgggaccgccgtgtgcgttgccccttagatttcgcttggggttttttatatctatcttactttattgttgttgtatatttgatatgacatggtacgatagattcccatagaaaaattaagtgtaatttatgctcttccaataattgcacctattacggttgtgatcataagtgatgggtttgccatagcaaagtgtcactttttatcatgataaaataggatagatgtcagacatctatatgcggagacaaggttatcaaaacagttttggaccttggggcataggttgggttggacatggagatgtcaccccaacagcacaagagtcacatatgatgtgattagcaaggtgttgcttacctattttgatagttgtctagctgtgatgccaaagctcactagacactaataaaatgaggatcttgactcactatgttactagagggaattttgtttcacaatacatagtgggagtatcttttgttaaattgtttaatgaaaggttaaatgtaaacatggtgctgattttacatatatttctattgtaga

SEQ ID NO: 29667 - DNA, 1501 bp, Oryza sativa
gttatcacctggaccatgtgttgttcgttatgctctcgtgtttgcaaagtacgtgtgatcatctggaatagatgtgattattttgacatgggtttgaatttacatttatatatttgttaacaagtgtactatataatttacatgtatttctcaactaatttgtgaatctctttgttgtctactgctcatccatgtcccaaccaaacaagctaaagctaatacaacaattttctcgaactattaaaatatccagatgcatgcactgaaacatttaaaattcataatgcacccatccaattttttgatgcacctcccttgtcgctccttccagtgaagcgacaacgtcatcctcgagcacgccagccttctcgaacgtgagaatagaagaagagccgctgccgcctaaatttgggacctcaagacaaatcattgcatggcgccacctcaacatcatcttccccagtgccagtgaccacgccattgtcgcacgccaccctcagggccctggtttagttcccaactttttcttcaactttcaacttttacatcacatcgtttcaattttaatcaaacttctgtaaaatcaaagtgtttttgattgttattctgttatgaacaatttgcatatgagattattagttttgatatttggaatttatttacgaagtggttttggagatgattgaaatttgcaggtgaataggaactgatgtctgtgatttgggttcggtcagaccgggcagtgtgtgccggtcagaccagtggtgatcgagcgttcagaccggccagcccgcggtctgaccggccgactctgtgttggtttcggttttgggttgtttatttggatatccatgattgtttcatatttatggcttctagatggatactatgcgtatgtaatactgttatttgctactaatgagtcaagttggagatagcttggtctcgaaatatggtttctttgtttgtttcatgtgtaggtgacttgatgcttcgggagagtattgctggtgatggatcgggagtcagcttggggataagacgatgtccgtgacggtcagatattgtgcgggatacttaggctagagttcaatgcacgtggttggtgaagattccatatggcatacgatggaggtattgtgtgcgtatgggatgcggagtcgaatttggaatgagtccaaattttttttgatgtgaaacagcaggagaggctcctactgcgctatattaataatataataataaaaaaggggacaatatttacaaaatttacaaggagtccaaatttggtatgattggagtttgtaaagtttgtttcttgtacgagaaggtttcgtagatggtttaggacttctagtatgagtttggttcgtagctttagactgcctacctcatgtataaatagagagagagtgtgaggcttcccggtatcgcttttgagagcaattgagttgatagtttagttagagtttcgagtttagtcgaaatttttgtaaagagt

SEQ ID NO: 29668 - DNA, 1501 bp, Oryza sativa
gttgatgggagatgatatgcgggtatacaagtcattcgcacttagtgtagttaatagcaactttctactttctcgtgcttccacgtcacctcattttatcctagccattggatctcaatcgggtgatcaaccatgcacaccacatcacatcgccctttgtactgcactgcatcgcaccctccacccacaccacgtccactccctctcccttttcttatcctcctatccttcttttagttcagccactttgtccaatttatcctcttgcatattagttgatttaccaagcaaatgaaaattggaattttactcttgttcgtggaattatgctcggtggattcaaaataattaaatattttccactcttacgagtggttatataggatttgccacttgaccaacatatcatagacacatgagatagatacatgagggcccacacatcatacacagcgagtggcaaatcattaattggcacatcttaaaagtggcaaataattaaatgtcctagttcgattcatatacatctccacaccattatcctctccaatcgctccaatgttattgatagggaaaatagatgcaaaagagatacataattttatgtgaaaacatccctctaatatagagagaaaataaccatagaagacaaaatcaactatgatggttcagggttacatgtagaagggtggcccatatatttagacacatattgaacaagaccctaggactaaatatatttgagtcattatccaacaacctttccttgactcaaaaaccctataaactagatgataccctgcgcgttgcagcagaactttctaaatgacaaaataatttctaggaatgtaacataagattgttaactaaaagaaagaagaaaggaagcaaaacacacatgtatacatcctggcatggttgattatgtaaaagcacctagctacaaaacaaaatggtgcaacaaagagggatggattcacaatgctcagcgaaagtaaatcgataactagaataaaaaattgttcgagttaccttcttttttggagagaatcccttatatgccactagaatttgaccagttcccttgtatgccactaaaaattggcttcccccttatataccactagttcaagtttttccaacattttatgccactcccaccactatagtgttagttgactgttagtcaaaggttagtttttttcgtaaatgaccaatatgccctctcaactaaaaaatgtgtaaacttcaaaaattcataactaatttattttaaatcctttttgagtgaagaaaattttgtcagaatcagtgaaaaatgctctttatattaaaaatattattggaaaactgcatgtttcatgcttacattgaaaatttatttgtgatggtaatggctaaaattgcatgtgatgcagaaaaaaatcaattttcatatgttgtatctagtagctatattagtactaaaatacctattattggttgtatactaattctaaag

SEQ ID NO: 29669 - DNA, 1501 bp, Oryza sativa
tatggcaggagtgtcctaaaaatttaagcgcttgcataatttattctcattagagtttatgaaaaacaactaacgataatgatgatcaatgcaacgatcgaaatgaaaggattgttctacttacatatcctcttcattttgtccttcagctcaataagatgctcgctcttggttagaccaaagtagtagtcggcaaacccatcttgatagacgatatttgccgggtttgcagtgccgatggcgaggaccgcagcagggccttccgcgtgctgtgtgcacaggcggctgtcaacaacagcggcagcagctgctccaggcatggctgatggaatattggaagaacgtgtgcttttgcaactagttgagggagatggcagtatgatgtgtttattgatggatattctagcttgtggctgtgtggctttatactagtttttcgacaacctggtccaagttaacccccaactatgtttgcattagtaaatgacttaaaagaatatttaaaaaaatcatcacatgctccatataatatcatataacttaccagcagaatatcatgcttaaatctgaacaaaatcttattttaatgagaaaactaaatttatggaagttctaatttgtccacttcgtttttcgagaaatatatattttagtccagttactaattaaataatttagagctgccgatttcaagtttgagttatagagtttacagggatgccaacatatctacccatgctgttgttattgttcttcctggtttgtttgcttcagggtgggacacagggaggctcttgggtattggagtgaatactcaaaagttgtccgaaaataattcaacacatgtaggtatattacgcattacatatgtatatacttaattgggccaaatacgttattctcggtcttttttttctcaacaaatctactcctcctgacactattttgttttgttgtgatgaattttatcggcaatatataattatagagtgaatagcaagccttaaaatcataagttcattattgctttgctttactgaaaaataagattacttatttgaaaatttatttatttggtcctggtaactttctggagactgagataagtattatttgctttttcgaagtggcggtccataaaaagatagtatcaacaatatattgtaaaatggataatacaaaatatgatatcacaccttaaattttggaactactatcttgttcctaggttcaataataatagccaatatttcaagtttaaatgactgtaacttaaacatgtgttccaaactactctctcggtttttaaatatttgatgctgttaatttttaacgtgatatttgatcatttatcttattaaaaactttaatggaaatgtgcaaaagtatataatggtccaagtacatttaattattaaaaaagttcaacaccaaatataaatgttagttttatttaggaagacaaatgtaatatcgaaatgttaacaggcttatgtattta

SEQ ID NO: 29670 - DNA, 1501 bp, Oryza sativa
cgggctacccataagcgaccgtagccaacaggggtggaacttggggatggttgctgtggacgcgccatgtcgcacgccttgtgttctccggggtaacgtgggcatgcaaggggttgcatgtgctaccacgtctcccaagttgtgtatgagttcacctcacaattaatgtaaagtggtggtttaaatgtgagcatcagacccgagcagctgtccttaatggggtgaacctcttcattgattgaacggagcgtcctcgggccctgagggattaaaagcttgtaaccggttggctgccgtgtgtcgggtcaccccgtgtccatagggtgggcaagtccttggggcacccctacacactcaggcacggtgccattgccgaaagtagatttcgttggtatattggacgagcttcttgaagatatcgataaagaaggagttcatgataggcatgactttagacgagacactggtacacaccaatgcccgcttatatactttgaagtctccatattcttcttgaaaccttgaaggtgtagatcttgtagtgcttggtggggcccacagcgccatgagcacctagggggaaagggaacccttgtttccacttctccgacaggtggagctgggccaacaatttggtaaaaagtggctatagggaaatgtataaataatctgatcattcttggtgcatggactatatggaagcattgaaacgattgcgttcaacgaggctgccccaagcaatttggcttgactagttcttgtgagtgagaaggccctcctatagagtttaggcgaggccaaggggactttcattgataatcgatcccaattaagaaggctcatgattcaggttgttgggagaaccttggtgaggcactttgttcttcttttgctcgtgttttgttttttctccttttgtgttttcggattctttgtatttgcatcttacgcctccggtcttccattaatacaatgatacacaactctcatgcatattctagaagaaaaataatcttaattaggaaatattaagttgatattgattgcctctttttatcttatttttcaacagtttttcacatgcaaaataccattttcttaccgtgcggacttcatcttattcaagtattttctttaaaaatgcatctcaattgatcaaacctcgggctgaagaaaaccgtataagcaatatggtgttttaattatacatagggtattacaaattttgttacaaatccaaaaaacttaacaatcagagggcatatgaaagcaataaagagtttacttacaacatgtactagagttgagtagttgacagctcaaatatcttcacaaacattagaaaggaactccacaacatcaatacatcaccgctaggacataatcccacttaagcatgaacaattgatttactgtcatgcattaattagttaccatacactgtaataaaataccggagaagcataagattgtggccattaattttcatcaagacttcatg

SEQ ID NO: 29671 - DNA, 1501 bp, Oryza sativa
tcctggaatgcaaaaataattacgaattacagatcaatgccgtgcgcccgtgcagatgcaatggatatatatatcggccacgttgctgcttcttctaatataataaggcaatctcgttgcctactttgcacgatgtgagctaatcacacgaagtggacaacaagttcgtcatgtgatttgttgtctttctcctttgtgctttgtgcatcgaatggcatcccacaattatccaaaaaaatttacaaaaagcatttcactgagcttttgtacgtacgttatttatactacctccgtttttatgtaataaatacataagcctgttaacatttcgatattacatttgtcttcctaaataaaactaacatttatatttggtgttgaacttttttaataattaaatgtacttggaccattatatacttttgcacatttccattaaagtttttaataagataaatgatcaaatatcacgttaaaaattaacagcatcaaatatttaaaaaccgagagagtagtttggaacacatgtttaagttacagtcatttaaacttgaaatattggctattattattgaacctaggaacaagatagtagttccaaaatttaaggtgtgatatcatattttgtattatccattttacaatatattgttgatactatctttttatggaccgccacttcgaaaaagcaaataatacttatctcagtctccagaaagttaccaggaccaaataaataaattttcaaataagtaatcttatttttcagtaaagcaaagcaataatgaacttatgattttaaggcttgctattcactctataattatatattgccgataaaattcatcacaacaaaacaaaatagtgtcaggaggagtagatttgttgagaaaaaaaagaccgagaataacgtatttggcccaattaagtatatacatatgtaatgcgtaatatacctacatgtgttgaattattttcggacaacttttgagtattcactccaatacccaagagcctccctgtgtcccaccctgaagcaaacaaaccaggaagaacaataacaacagcatgggtagatatgttggcatccctgtaaactctataactcaaacttgaaatcggcagctctaaattatttaattagtaactggactaaaatatatatttctcgaaaaacgaagtggacaaattagaacttccataaatttagttttctcattaaaataagattttgttcagatttaagcatgatattctgctggtaagttatatgatattatatggagcatgtgatgatttttttaaatattcttttaagtcatttactaatgcaaacatagttgggggttaacttggaccaggttgtcgaaaaactagtataaagccacacagccacaagctagaatatccatcaataaacacatcatactgccatctccctcaactagttgcaaaagcacacgttcttccaatattccatcagccatgcctggagcagctg

SEQ ID NO: 29672 - DNA, 1501 bp, Oryza sativa
tttcattttcaaataagtgttttttgtttcagtaaagcaaagcaacaatgaactcatgattttaaggctagctattcactcaataattattgccgataaagttcatcacaacaaaacaaaatagtgtcgggaggagtagatgtgttgagaaaagaagaccgagaataaagtattaggcccaaataagtatatacgtatgtaatatgtaatatgaaaaagtatatatacatccctaaactttatattgaagtctgtctagcacattgcactttaaaatcgaacatccaaccccctgaactttgccataccatccatattaccgttaaggtggttttggatgatggttttgcatattttagaagcttaaactgttgagttgtgatccaaatttatttacacttaataaaggctagattctgccgtagtgaagcggaggcccgtcgccggtaggcttggttcagagccttttagggttccaccttttacggtacggatcgtaataccttttagggttctacctcatatatatatatatatatctcttgtaagccgccgtgcggcattgtaacctcacccaatatagtgaagatattttactggctagcgcccgtggctttttctctcctgctttgggagggttttccacgttaaatctcatgtcttctgtgattgatctgtattgttctttatcgtttatttgcctatcgtttcctaacataaatgacaattttgaataactaatgtaacatatttacgtatcatcagttataaatcatcaatttatcattatatagtgatatcatgatattattatattggtgcttgtttgttagtgagagcaaataaaaggcaaaaagaatgatttaagtcaaaatttttgtatatatgtccaaagtatatgacatgtgatcaaactcatccaacttatatacaaattagattaaaaaaaccactatgcaaaaccatcttagggggttacatcaacggtattctaaagtttagggggttgaacgtccagttttaaagttcagggtgctagacggaattccatcagaagtatagggggttattaggattggaaaaagtttacatgtgttgaattattttcggacaacttttgagtattcacttgaatacccacgaatctccctgtgtccacccctgaagcaagcaaaccaggaagaacaataccaacagcatgggtacacattttggcctccctgtaaactctataactcaaacaagaaatcggcagttctaaattattaaattagaaactgacctaatatatatatttctccaaaaatgaattggacaaattaaaacttccataaatttaattttatcattaaaatgagattttgttcagatttaagcatgataatctgcttgtaagttatatgatgttatatggaccatgtgatgattttttaaatattcttttaagtgatttactaatgcaaacatagttgggggtttccttgggctaggttgtccaaaa

SEQ ID NO: 29673 - DNA, 1501 bp, Oryza sativa
tgggatattttcttgtaaaatccaaatacagaaaaataattagtacgaattacataccaatgccatgcgctgcaggtgcaattgaaatatcatgatatggcaatatcggccacgttgcagcgtcttctaatataataagtgtttattgcctactttgcacgatcttggagctaatcacacgaagtggacaacaagttcgtcgtccagataccacattagctgctttgttatctttctttgtgtgcatcgcatggcagatctcgagacaataatcgtcttcttaaataaatctatacgagtatcatgaaagtacattaaccattatattacttatatttttcatatttacattaaaacttttcataagacaaatgatcaagcataatattaaaaattaacagcattatattaacatttcaaaacagagtgagtgagtagtttggaacgcacataagtaactagtattaattttaaacaactattaattttaaactttgaaaattattatagaaccggcgaaacaagatagtattagtaaaattaaaggcatagtatcactttttgggttatccatcttacagtacattgctgatacaattgtttttttaccgccactttgaaaaggcaattaatatttatctaaatctttggagaattatcaaaactaaaaagatcaatattcaagtaagacattaatatgtttcggtaaagcaacgccagtaacagacacgggacttcaagactagatattcactcaacaaatactgataaaattcaatagaacagaacaaaataatgtcagaagtagattctgagaaaaaagactgagaataaaatattagacccaattaagcatacacatatataatgtaaatgcatatattgaattattttcagtgaacttttgagtgtctgctccagaagcaaaggaccaggaacaacaataccaacagcattttgaccataagatgggtagatatgttggcattcctacacatttatgtaaactctataattcaaatgaccaggaacaataccaggagcattttgactgtaagatagatatatatgttagcaatcttcacattttctgtaaactctacaacgcaaactagaaatgggtcgaggccagttcagaattacaaaattagtacctgcactaaaatatatatttctccaaaaacgatttggacaagtcatacaaaaatttaattttatgatcaaatgtgattttgttcagatttaagcatgatattctgcttgtaagttatatgatattatatggagcatgttttgattttttttaaatattcttttaagtcatttactaatgcaaacatagttgggggctagcttgcgccaggttgtcgaaaaactagtataaagccacacagccagaagctagaatatccatccataaacacatcatacagccatctccttcaactagttgcaaaagcacacgttcttccagttccatcagccatgcctggaacagcta

SEQ ID NO: 29674 - DNA, 1501 bp, Oryza sativa
tcatgttggtcctctcctcactgtggttaattaatttattgtcatctggtggttgcagttttagagttaattaaagaaaaaatgcatgtacatgcagtagaactgccaaagtgtctgaagaaaagatgcagaggccatcaatcatgttgcatgaaaaaataacaccaaattattgaagagatgctatgtgtaatcatccacatgtccacatggtagtatagtgctggatttggtctaaatttctctcataatttggtctatacttatctctgaatttggtttgagcttgaccaaattctctctgaatttagtcccagtttgatcatcgcagaattcacagacctggttaagagtcaaaccaatatcattttcaggaacaatacggagattgcaattttccagtggaaactactccaagattgcaatttctagtgaagtactcatacagatgaagattgttttcaggaacaatactgagattcaaaattcacacagaccaagattcaattctctgcattaatacggtgccacaacgcgatagctaattcgcgcgcgcgttggcggcgtgcattttaggcccataaggcccacggcgctggcgcgtatgcgtgcggatgaagtcacgtccgtattttattttttccggaaaagctaacgtccgcgttttttgtttctttttgctttttttcatgatttttttattttagaagttgaatctttcgtcttcaactttagttgaaagttttcaatttgagttgaatttttgaattttgagaaaaagttttcaaaattgagttaaatgttttgaattttcagatgaaagtttttaaatctgagttgaaaatattcaaatcttgaattgaaaattttcaaatctgagttaaaagtttttaaaaaatcttaatttgaatgttttcaaatctgagtcgaaagtttttaaatctgagttgaaagttttcaaatctgagtcagaagtttttaaatctggttgaaagttttctaaatctaagttaaaagttctatttatgtattattttttaaaaaaactaatactaacaattatcatcaccgctaattaacatcatcactgctaattagcgttattagccctaaggagaggcgtgataggggcgtgtgcggctgcgcccgcgcccattaggaagccccgtgccacacacgggacagtaaagacaaacctcgttgctagacaaaacaaatacgcgccggattgcttggggctgtggcggagaagtgctcaaggcggtcctctgcgtggctgtagctgccatcgacggcccgatgcgtggctgccggggatgtcgacggactcactcgatgtgacaggggaactccgatgactatccgcaaccgccgccgccctgctccatggccacatctgtaaaatcaaaggtgtttttgattattattctgtgatgaacaattggcatcggagattattggttttgttatttgaaatttattcacgaagtggttttggaga

SEQ ID NO: 29675 - DNA, 151 bp, Oryza sativa
gttatggatttaaccgctattttcctgtctttatttcttgttgattgcatgatcaaatcaactggcacgctcacgaacctaaaggcaagatttttggacctgcactggagttaagcagatctcccaggcctcgtgtttttcacatcaacac

SEQ ID NO: 29676 - DNA, 1098 bp, Oryza sativa
agcagttcattggatgaagtccagctttgcatccacgtcgggctcttgtgtgtagaagacaacccgaacagcaggccgctcatgtcatctgttgtgtccatcttggagaatggaagcacaacatttctggcaatgccaaatcagcctgcatattttgcacaaacaacaagtgaaatggacaaaatgacagacggtagctctagaaacaccatgactatgacagttcttcagggacggtagagcaactcaaacttaatgtagatgtgtcaggacggtagagcaactcaaacctaatgtagatggctcttgttttaccagaataatgcttgggaggttggagtgcttatattaagaaattctgaaaggaaagtgcttatgactgtatctggcatcttctacattttcaggatgacttacaatcaaagacatattttaagatattccaatcagtgactatgggcagcagttaataccctagagggattatgttgagtattagatgcagataaagttagtattgttgctatggactgagtgttatttgacttgctaaagtctgcaaagaatctgaccagttgaagtatcaggttttcttgtttaaaatttgtgagtataagtcaaactgaaaaaaaaacatattttctcaagtatttatattagtaccacatatttttattacttctgatggtcctggaacgtttcatatatcaagtgcacttgcaaactcggcaattttctgttgaagtccttacaatagttgaatgcagcgaatttatcacttaatcaccagaaagtaactgcaacaatcaaataaatcaaaagcactgaatatcagtatatttctaacctttttttttgactaatgtatatttctaaccttacccagatagcttaacttgttgggtaaattcatgtgcaatccttcctcttagtttttttgcagtctggcctttgattgtggtaattaaattatgtaaaacctgaattgttcctgctgaaagaaatgatattaagcatctggcaggaggagaactgaacagcagcaagaaatatccaatcttacaaggacagtgcagaagcagtctgtgggaggtactt

SEQ ID NO: 29677 - DNA, 359 bp, Oryza sativa
actttgaccaaggctgctcagaatgacgaaaatagttttttacatcagaaacttgggcttgggccttgtttcattacagcccattaggggtccacaaaacctagggtttgctcccacctcctctcctggtcattcctccacctatataaactcctagcagccaccattttgcactttgggttttgttttgatgtaagtttagctgcagctacttccttgtactcgcgtgtgtcggctagaccacccggatacttgtattcaaaaccccattttggtttgtttaagtttcatcatttgacaagtgccgtgagctgtttccttgtcaacttgttcttgcttgttcttcgattgcttgcagg

SEQ ID NO: 29678 - DNA, 491 bp, Oryza sativa
ttaatttccggatgttttatttttcaaaataaaaactatggagttcctcatttgatataaattcctaccagagccaaaaatattccatattgattaaaccatatatattttggttacttataattccattgaactttgtcaaattcttgtgacttgtgaacatacttctcatgatctatgatcaagatcatacatccacatatatgcacatgctaaactcctacactgcgagctagcaattatccattccatttccatactaccaccaaaaataaattcgccatgcttttatgcgctttcttctcctaaaaagaaaatcctttctgaaaaaaaagagagaaaagaaggaggaaaaggcggttatgaaaataaagttatgctctctcaagaatgagcatgatattgaaaaaaaaaaagagagagaataatgtagccatgccctctccttatttataaaagaaggattttaggagtaagcacaaaggagaagc

SEQ ID NO: 29679 - DNA, 1487 bp, Oryza sativa
aattaagcagcaggagtagatgggtcatgatggctacatgcttttcgtgctactggtgttatactcctgtgaaaaagaaattaatgtagctttattaatttatttattgctgaactaaatggattttatagttaggccttgtttagtttgccaaattttttttcctaaaaacgtcgcatcgaatctttgacacatacatggaacattaaatatagataaaaaaaataattgcacagttagggggaaatcgcgagacgaatcttttgagcctaattagtccatgattagtgctacagtaacccacatgtgctaatgaaggattaattaggcttgaaagattcgtctcgcggtttccaggcgagttatgaaattagttttttcattcgtgtctgaaaaccacttccgatatccgatcaaacatccgatgtgacacccaaaaattttcttttcgcgaacttaacaaggcaatttgtatcttgccaaacaacaaatatcgatcggatgtagatatgtactactccctccgtcttaaaatataagcatttttaaattctgacacagtctccgagattctactttgaccaacaatatcaataaaaataaaatgttttaaatataaagaattgcatattatgataatttgtttaatgataaatctagtaacatcaattttatacatatgattgattttttttcttttgctactaatagttaaagctaaaaatgtttaacttgtcactgtactagaaatacttatattttaggacggaaggagcaataaatagttccgccggcaaattttttctccatcacatcgaacgtttgaacacatgtacgaaatattaaatattgaaaaaaaacaattacatagtttgcgtgtaaattgcgagacgaatcttttagacctaattgtgccatgatttgacaatgtggtgctacagtaaacatttgttgatgatggattaattaggcttaataaattcgtctcacggtttctatgctgattatgtaatttgttttgttattacttcaaatgtgtgtctgtatatgatgtgacccggtttttttttttttttttgccggtggaggctaggttagttatatacacgtacgctcacttatttcatcactaaattgaacttaaaaaatacatatatacgctcacttattgcagcgttgcagtaattaagcgaggaaatgcatgtagccgagaaatgcatgtaattatcgatctgtttgcgatctctgcttcttctaggctgctgttcggtcgcacgcaaacatccacggaattgtccaggggagggagagagggggacccacggaatttgtgtgcttggttggttggcttcatgcatggcagaacgtgtggatgggtgcacctgtgctaccggaaagatacatacaccggagcttgaaagatccatacacctagcaggctagcacggtctgtgcgtctactctacccgcggttcatgaactacaga

SEQ ID NO: 29680 - DNA, 1501 bp, Oryza sativa
ctttgggttttgttttgatgtaagtttagctgcagctacttccttgtactcgcgtgtgtcggctagaccacccggatacttgtattcagaaccccattttggtttgtttaagtttcatcatttgacaagtgccgtgagctgtttccttgtcaacttgttcttgcttgttcttcgattgcttgcaggttcaaggttgttcttggcacggcaagaacagcaacaacgtggagtcggtgtaccggttgctaaggcgcagcacccctgtggtagttgtagtcggaccgccaacgtcgtatccttccccaaatcgaagtttatcctcctctcatcgaaagatcgggaacccccgttgctgcatcaagtggtatcagagctcaagttgctcggtgagagattttatcacttctttgtttttacctacagcccaaaagaaaaaccactaaaataggtcagacccgaaatcaccaaaacatgttgagcctttgctgttctacttagtctttgcttgctgagttttcgattgcatcgattggttgagttgctggttctagtagtttagtcctttagagtttcgagttctgcccacgaattcgtcaccgcaaacacttccaccatcacttcttttatcttcatcccgctgccaccatcaccaccatattcaccacgaaatccacctccaaccccaccaaatttcgtccaccacaaccagcagcaccctcatcaccacatcagccacccccaaatgcatttattgctgcctccaccaacagccaacccttttgcaactttttgaagtgaatcagcccttcccaagaaagcatttaagtgctctcacttttgacttgttggctgaatcatgtaactagccaaccaacccatcattacttcttgttttgatttgttggctgaagcttgtgaaatttcgaaaatgtttgagaaaaggttattttgctaaggcttgttttgacttgttggctgaagctttgagcttgctgtacaaaaaaaaaaagaaagaaaaccaaaaaaaaagaaagaaaaaaaatcagaagtgaagagaaggaaaaaaaaaaaggaagggaagagaggaagttgttgttgttgctgttgtgtttgtgttattttcgtgctattttgagtggctacgcttgtgactaggctcgcgtctctaaagggttttgcctaggaccagcacaataccatcgttgaatgattattcaacttgctttgattaatgtggttctagctgtaccttgatattacttgcagccacctatagctccacaaatttttatctactatatcacaggatcgtgtttgttgtcggctccagtactactaaccgttgttgctgttcttgctgtttgccaacgccttttacataacaaagtaagaacatgtaagaactcgtttgcacaagtttggtagaagtggagatggacaacacctagctccaatagttgataggacatatttcttgtgaattgtttcttcccattaacca

SEQ ID NO: 29681 - DNA, 1501 bp, Oryza sativa
attgcatattcaggagccatgtagccactgttgagaaaatttcacattgaaaagttatgaaagttgaattgagttaatctgcatgttaagctatgaaattggcacaaagaattacgcactatgttccaacaactcttctagtattggcattctgttggttgtcaccaaatatgcgtgccataccaaagtctgctattttgggcctcatctccgagtccagcaaagcattactagttttgagatctctatgaataatcgtcaaccttgaatcatgatgtagataaacaaggcccctagcaacacctttgattattctgaaccttgctggccagtctagtgttacacctctttcactctctgcaaaagaacatatatgctatgtgtgaaatgcaaataaacattcattaaattgttctttgaacttgtgatatgctggttgaacatactgaaaatggcgacatccaagcttttatttggcaagtactcgtaaattaacaatttctcatgtccctcaacgcagcaaccgagaagtcgaaccaaatttcggtgttgtagtttagcaatcagagtgacttcatttctaaactccactattccttgatcagagtctctacttagccttttcacagcaacctcttgacaaccttgtaacatccccttttgagaaatagcagtgtcatgttaatgcacataaaaagataattagatttttatgctccttgaagaggtataatattttatagactttctagtgctaatttgtggtaacgagtcctgctcatggactctaaaaatccttaaaattatatcactggaagttaccttataaactttaccaaaaccgccctgtccaaccatgaatgatttggagaagttgtttgttgcagccacaatatcatcaaattttacaaatggaaattcatggtcatgggttgtgcttgcttcttcaagttcaagggcagtagctgtcagtactccctgaacttgtgatttcttgtgttctttcacgctccttttcttacctgccgtaaaagtttatgaccattatgttcctctgctcttgtagtgtatgtacagaagcattgaggggaaaaacaagaattctgttcttacctctgaagatgcagaaccatgaaagggaaatgcaggtgacaatcactaacactggcactgcaattttcactgcatttctctgtttccttttacctgcacagagacacactgttcatttcattttcgaccaatatttcattttaaagaatcttgcacatgatattctctcctaatttcgtgaaatgcatatggatcatacttgcatttggcactcgtatacctgaaccgttttttatcataacatgaagtatgatgctttaggcctgtacctgaatttggcatgcctgccactctaaggtagagtgtttcacggctgtcgccgccggcaccgacggtgccccagacctgcccgggacccaacctgcccgtgtcgacgagctcgccgtcg

SEQ ID NO: 29682 - DNA, 718 bp, Oryza sativa
aaaaaagacgaacggtcaaacatgtgcttaaaaagtcaatggtgtcaaagtatttagaaacggatggagtatgattattgctcgcgtagagttatgtatgcagtggcggagtcgacatcatcgtgtgagtcttgggcgattaataacattccatgatgatggctgtgtttagttcgttggccaattttttttaacgtatacggacacatatttgaagtattaaatatagactaataacaaaacaaattacataatccacctgtaaattgcgagacgaatttattaagcctaattaatctgtcattagcaaatgtttactgtagtattatattatcaaatcatggcgcaattaggctcaaaaaattcgtctcgcaatttacatgcaaactgtgtaattggtttttttccgttcacatttaaagctccatgcatatgtccaaataattgatgtgatatttttagccaaaattttttggaatctaaacacagccgatgaatcaatttttatacacattgacgctagtaggtaatggaggcggcaacggtagagcccggaccgtcacccaacctacccgagagctgcctccctcactgcatgtatgatcatttgtactgtgagcgtctgcgtttgtattttgtttaagaaaaaaaaagagaaaaaggccaatacttcaatgttaggacagttgtaactgatgcaagcttgcattctttgaca

SEQ ID NO: 29683 - DNA, 1501 bp, Oryza sativa
gacgttgggtcctttaagggagggtgtatgtgacatcctggcccaattaggatttgacctgtgtcccatgagagctgtgtgcatgtttagtaccaccttgctagtctagcaaggttggaaccaacttataaggcctcttctctgcaaccatgtcactcccgggttaacccttttatgaagcgaggacgaaagtgtaagtgggcccgcccgtcggatgggctagctatgtggttctggagggagggctgttactggttgtagtcggatcatcaacgtttgtcccaaatcgtagttaccatcaactcaccggatgagcaaatcgtagttatcatcaactcaccgaaagatcagggaaactagacccgtgtgtttacacccaaatttgacacctatggacgaaataggggaaaattgccgaagtttgaaaagtgacgggtttccttcacaaatttggcacctatggacgaaataggggaaaattgccgaagtttgaaaagtcagaccgcaggtgtgtttacacccaaaattggcacctatgaacgaaataggggaaagttgtcaaagtttggaaagtgacgggtttccttcacagggctggtcagaccgcatgtatgtgtgtgggcagtctgaccgcggcctgaactctggtctgaccgtaggtatgtggctggtcagaccgtcagggtccgagcccgagtctgttttcgtcgggtctcgggtttccttgcttgaaaaggcatgcttcgggttttctttagtttgtatcccgagttggacttggatgagggcctatagaggtcaagaccaacccctatttaagagataagactggttcaattataatccccccaaacacataatctacttaaatcgttttttctttttaattttagccatgttttctactctaccctagttttagtctatctttgtcgatttgcgccgtaaatcgtccgccgccactgcgagagtgcgacacctctttgtaggtttgtcttgaaaacctttcgttctacccacaagacgagtagttatcctcgtatcgatctaaatcggcctaaaggctgattttgatctttaaatcggctccactagctggtttagccgttttcaccgcaaggcgtttaggtgctgcgatcgtgcttgttgacttgtcacaaaaaatcaccaacacgttttttgacgactccgtcggggaagaaatctattcggctttaaaatagccgaatttgcaatttatccgttgttttgtcgagacgactgtttcggccgtgcggccgaaatcaatctactattttattttgtttttaccggctaccatcgtgtcatcctcgccgaacacatctgtttcggcggcaatacagcaatacacacggccacaggcacaggaaacaagcaacagccgaccgatctgatcgatcgtgctagtccttgctgtgcacagagaaagtttgaaactcaatccaattcaatatactgtgcatacgtattccaaaaattt

SEQ ID NO: 29684 - DNA, 1194 bp, Oryza sativa
tttgtctcgtctacatagttcttttcattcatatggggctagaacaacttatgctcacgacaacacactttcggcgcttcacggtagtgtcagatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacaccacacacgaaaatggaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacaatccaaatatgccctaaaaaataataaaattgtattttaccagtcttggagattttaatcttgtatagttttcaatataaaaagatttgataactattgatatttatacaaaaatatagagcacagtataaaatcgccctcccccagggcggcaagggggccgcctgcaaaattccatgccccctcgccgcccatttgcaggcggccccccgcacagtataaaatcgccctagcggagggcggcaagggggccgcctgcaaatttcgttgacggccgtcgcccgagagcgaacggccgtctgccacgtcatttttgccgccctctgagagggcggagggcggtaggcgactacttccgtcaattttcaaaatggaaaattatttttgtaaaacttttaataaaaaaaattataaataaaaaaaggtcattattggattggtcgtagctaccatcgtagtttatatccaatctttctttaggttggcatagatctaacttctaagagtatattttactcttaacaacatcgtattacacctaatatacatacaatagtagcaagtagcaagaagtttctcgttaatgttaaaccaacacacattgttatgactcctgagaagaactcggcgtccacggcgtatcagaagaccagagatgaactggatagctt

SEQ ID NO: 29685 - DNA, 1501 bp, Oryza sativa
cgcccggtcgatcggacgggggaggcggctcgcgggcacggctcaagctggcccgacgcccatggcacgcggcggtgcggctcgacgcagcggcggcgaccggccggcggcggagggcagcggcgtcgcggtgacacggacggcggtagcggcggctaagcggctggaggaggtgtctcaccacggcgattgacgatggcgagcgacggagggcgatgacggcaacgagacgagctccggaaccacctagcgaacacgatgaaaggggttagagagagagagagagagagagggaaatggaagagggcgaggacgccggccgaaggcggcggccatggcagggctcaccggcgcacagtgcggagtgggttccggtggcggaatccgatgggagaggggtggacggggtggcccgcacgatggcgaatgcgatggcgtcgacggcgtggctcggcgcagcggctagcgacggctagcggcggccagagtggtggcggcggcggcggaaacgattgcgacggcgctagggcggtggagtgcacgagagcgggcgattgcaaaacgaaaaagagagaggagggaacgggggtgctttatatagactcacgagggtcgatcgtggccggggtgaccgcgatttcgccggcggagtggggagaggtggggaggagagagaggcgggattcaaaaattgaatccaggccgtctcgagcgcgggcgcgggcgggagagagatggagtgggcgcagggaaggcgggcgcgggcggcgacgtgggcgatgtggcccgggagacgcgggagcgaacggggcggcggttgcgggatgcggcggtgccggctggaggtgggagacaggcccgacaggtgggtcccacctgtcggcgacctgaagggaggagggaggaggcggccggctgctgggccttggccttcggccggcccagcggggagggggaggggaaggagaatgggccggcggcccattcgaaaagaaaagggggaaaaaagaaaaagaaaaagaaagaaatgaatttccagggattaaacattgcttgtgctcaattttaattggttaaaattatttctagagctctgaaaattccactaaaaatcttattagcacatttcgacatgtagaactcaagaaaaattccatatgccaattccgattattatttgcattaatttattatggtttcactctttcttttacaccggtattttctcgagatcaattacaaattcaatttaggcttggggaaaagaacttcagggtgtgacaaagtactaggagggcatcagatagagggtattagatagtatatcggttaactagaatgtatgtatactatgtatattagaagtataggaatagattttctttctcttttcttcccacttagcttagatattatattatgagaatgagaagttaatgcttgtgtgtcactctacccttggattatcttaatccctacttagaatatgattatcacaagt

SEQ ID NO: 29686 - DNA, 832 bp, Oryza sativa
aaagaaaaggaaaaaggacttgttaaggtggagcagatggttagctgtgaataataaaattaaccggaaataacgctacataacggtcaggatggccgagtggtctaaggcgccagactcaagttctggtcctctaacgagggcgtgggttcaaatcccacttctgacattttgttttttgttatccgtatttattttatttagtcgagagtttcatacaaaccaaaattctccgaaacgaattcatatcgacagctcaaaaattttcaggagatttgtgcgacatttcttcatttcttttttgccctaatgggccgtaatccgaccaaacgaagcccaatcgaggcccatctttcacctgtgttgctgttgacgctctgtgagactgacctctccaatataggctgctgcttttccctccctaaaaataattcacgttgatatttttacttcctttttttcctggtatttcccttttttaaaaatcgatgaaatttgatgtgaaatcattatgacaccacaagttgacaacactagctcaaccaaaaatctgtatagttggacatgaaaattgatgataacacctatgccgcgcctcccatccatgcaacatttgccattttaaattatagagtccaatttctgatggaatctataaacgtgtcgggcctgttcactttaatgctattttcaacttttttttgttgtgataaagttgccaaaaaagtggttacatttagtttgctaccaaattttggtaactatatactaaaatttggtaaggttttttttatctaagtgaacacgtccgtcattttcaaagttcaaaaaa

SEQ ID NO: 29687 - DNA, 1501 bp, Oryza sativa
cctaatgccgactcctcgcaaagatcggcaaagtgaggttaaatatagttttgatgtggccaagtatgataagatttttgattatcttttacaagaaaaacaaattagattacctaaaggccatatcataccatctcaagaagaattgaaacgtcgagcttattgtaaatggcatgattctcattctcattccactaatgattgcaatgtgtttcgacgacaggttcaattggccatagatgaaggacgattgaagttcaccgatggctccaagatgaagcttgatcatgatccttttccggtgaatacaattaatttcaatgacaagaaggtgttgattcggccggagcaagccgaatctactaaaggaaaaggagtaatcattggtgaaccaaggccaaagataatagtgccaaagaacccagaggtttgtgtttgtaaagagaataaaagtgaagcttcaacttctaaagctcctaggaagaccaaagtgacccttgatatgcttttggagaaatatgaaaagcaaggtagtgagagagctcgcaacaaggggaaaatacagagatcacctcctagggagcgatttggtcactcgccaagacggtcgcattcacctccatatcatcattcacaagacataccatggggtccctatccaatgccgccgccgggttatccttatccttattacatgccatggggggcaacgccgccaatgttcaatcatatgcctccaatgcaattcaatcaagggtggggaggaccaaggaggccaattcatgagcgtttgtcttcaccaaacaacggccggttttatggtaagaaccgggccaatgaggaaaggtgagaaggaaagcacattaaagtggaggcaaggacttcagaggtaattaccatcaaagtagggtctcatgatgtgccaataccttctagagataaagttggagagtcctcaagcaaaaaatccgaagccggtaccagctcatcgcagtcggccgcagccatacggctggtctgaccgggccatcaggccggtctgaccgccgacccgacaatggtccgaccgacgcctcaggccggtttgaccgcccatcgaatattgatctgaccagcgcatctggctggtctgaccggtggtctacgtccggtctgaccaggctccagcgccggtttgataggaggtttgcaaagggcgatgtgagggcttcatcgtcatcaactagacctaatagggggcattatttacctcctggaacagagccgaaacctaggaggatgcctaagtatttaacggctactcaaaggagaaggttgcaatgtcttcgggcccaagaaataagagagaaaaaggctgaagagcaaagggataaaaggttcaatgagttgcgaccaccaccggtatggaggcgtaaaaccatagagaaggaagaaccggttgttgtagagaagaaggaagaacaatcgattgctaaagatgagtcatctccaaaagaagaca

SEQ ID NO: 29688 - DNA, 835 bp, Oryza sativa
gtgcacgccgcccctcccggttcgccgccgctagacggtacgagccgctcgccgccagccgtcggatcggccgcccggcctcccctccctttcctccatccaacgaaaactgtccacgtgggcttgaccgggtcaagctgacgccccgccagccagcccccccccccccctttgggcctcgccagccgttgggctgcgctgctccccggtccaatggactaaagtccacttatactccctcgtgccgagcccagtaccccccacccaaaagctaaagtccatctttgctcccttcccaaacacagtgaccaaaagtccatatctgttccctcccaattcacctctctctcaccatatgttggccccacatgtcaatgagtgataaaagaatattcttgagaatattcttttccataaaattcataaatcattgcctgcattccaaaaaaaaaagattcgacaaatcatttccttgtccagaaattccaattaaactcccaaaattcatatctcccgatccgtaattccgattaaccccgttccacttccagtattcccgtaaaatcgagatctatttaatggcaccattatctagtctaaataggatttttcttttggtcttttgtttaggtttttgattgtttgcgtatagttgcggttaccggattttcgtcgatcgcgggttttctcgaagattcgtgaagctccgtgaagaccttgagcaaggcaagtcaccctttgatcaattgctcctataattggaaaatcattattattttgtttgcaacttgcattagtagaatcacacacttaatttgcttggcctcggtttgca

SEQ ID NO: 29689 - DNA, 1501 bp, Oryza sativa
tgcaacgtggggtagcgttgaacagtggatggttaatattgatgaattattaaaactgttttactgctttcaactaccgtctttaaatgctcgctttatgttctttgccattggatttgttccgggaaaattgggatttgttcctgtggttcaagggaaaaatcttggtcgctcgtttaagtgggatttctcaaatcagatcagactaggattttagtaacattatttgagatttatttgacagtcagtcgggatttgataggaggaatgcattaggtcctaactcgggaagatgggttgcaagttatttatgctcttattgttattattagtatgtatctaatttctcattattttatcgctatgtaagtccgtcttatttattcgctctcatgcaaaaatgatctatgcagaaaattatgctctcatttgttcattttaattgagtcctttactgctttatttaaattggatttgagcatgcattgatcctacccctttgtcttctctagatggccgaccacccatccaaccatcacggagaaggcatggatgattttgtggctgagttggctcgcatgaccttggtggtgggctaccccaacgcaccggagtactcgaccgttccaccgctcagtggcgagcttccccaccgtgttcgtctggaggttcatggctttgtgggcacctgcctcgctaacatggtggttaaggcatctggaggcaccgcagatcacgcctgtcaggaggcagcatacctgatgatggccaggcttcgtgatcaccacagctacatcttctgcaacacggcgtaccgcttcgaccctcgccgagcaagtggcgatgatgtcagcacctttcgcccgacggccggcgagaacgacaccaccttcggccacatgtgtgccgtgatgatgggaatggacaggatgcactctgacctgcacaaggcgtccaaggccttgaatgatgggaagcttgtgaggatcatagctctgaaggatgagatagcgcgtctgaagaaggagaatgctcaactgaagggtctccccgctcccggaggagtccggatccgcaccacgcctcgcaagtcaacgactgcacccgtgcgcattcagcttgcgcccaggaacccacctcctcccgcagctcctccagcacctcccgcagttcccgcagcgcccgtagctccagctccagccccagctcctgttccagcgtcagctcccacgtccgctctctcctgcgctcccgcgtcagccgccaggggtccagccagtggcaacggagtttgtgtgtttaggtttgttcgcttgtgggtcagtcgacggttgacatcatgtgcctatgatgtggctgtcttaataaggatttctttgctattttaagtgttttaattcagatcagaacaattgcagtttaaattcatatataataaagcttagttcctgagcatctgtttttcttcttttccatcccttccgtctgctctcccttcaga

SEQ ID NO: 29690 - DNA, 1501 bp, Oryza sativa
ctgtgaattctgcgatgatcaaactgggactaaattcagagagaatttggtcaagctcaaaccaaattcagagataagtatagaccaaattatgagagaaatttagaccaaatccagcactatactaccatgtggacatgtggatgattacacatagcatctcttcaataatttggtgttattttttcatgcaacatgattgatggcctctgcatcttttcttcagacactttggcagttctactgcatgtacatgcattttttctttaattaactctaaaactgcaaccaccagatgacaataaattaattaaccacagtgaggagaggaccaacatgaatttagtgcttgcattgacattatctaaaagaagcagaagctaatggagtacaggtttagatcagagtaatcacttaaattcagtgctctgcatatgcagcagatgaatactcacaattcacaagaaacctggaagaactcagtatcctttattgcggcacatttatatcttgttaactttacaagagtattgatgttaactttaaaagaaattgcagactaacgttacaaacaattctgtcaagctagcttgcagatcagaacactctcaaaacaaacatgctacacataggtacagtgaacatgccacacatgtggagtcaagcattttgtcaaaacttgttgtcgcatatacagtgaacaaaattcaactgtgaagaaaatgattcatcaggatctttggcttggatgaatgcagcagattgtggtctgatgctgcatgcaaagttcatggacagttcagttctgtttcaattcaccattgcacatccgcaacgaattgcaggcatatgcaggaccagctgatctgcaatggttggagacacctagtctagtaaacagatcctgatatgttaaccatgaacattttttttaaaggaatattaaccatgaacattaggccaatgtcaaatcgtcattcatggttcctagataaatttcagcagggtcgatttacatcttgcccaaacgattgagcaaatcagacaacagtaggttgggattattgtgacctcgtagcactgaaaattgcagttgcagttatccaggtgacccaaaatgaactgctatcagaaattaagaacaagttcctggaaaaagaagagaaaaaatcgtctgaaaaggatttgggggaagttgacaatttatcgacgaacaataacaaagaacataaaccacgccagggcaccaggagcatatcttcttctccttgttggttgagcatatttctatccatgcatgtgataatgatcggctgagttgtgataagataggattagattttatctctttctgttacatccgttgtcgctgctgttttcctcctgagatggcgtggttgttgctgatctcgtaggcttctgtaaacgccacggtgagggcttttctgccaaattctttcacatggtatcagagcctgatccaatctaatctagcgacgtt

SEQ ID NO: 29691 - DNA, 1501 bp, Oryza sativa
ggacaatataaataaagagagaatcccttatatgccactgaaaatttgtctgatcccttggatgccactaaaaattggctctttccttatatgccattggttcaaattttcgctccctctcatgccactaccgtccgttgactggtagttgactgttaactgtagagtgaaatgacgtatttgcccttcttgagttgataggcatgcagtaggtgttagtatgtcagttatatactacattttagctaggcatcacatatatttggaataaatgaatatatgaatgtatagcattaatctatatattgaatatatgaatatttttcagtcacataattttgaggcacatatttctctgtttttcatagtagaacaaagcaatctgttatggcattaatgtattttccacatacattaaccatgtacgtacttctcgaacaaaagcttcaacaatatttactagggagcacaacatttctctgtttttcacagtatgacaaaacattcaagcaatataatagattgcttctgacagacatttaagataatgtgtaattgcacattgtttgtaatgcacggctaaacagcaaaaataacaaacagattgtttgctagagcaaggagatatacacagtagcacagaatatgcaacaaatattatagggagctgtttaaatgaccacagagtaccaaaatgcatactgacacagtaccaaaatacatgttcaggcttactgacatctgacatggtgcatcagagggatgttgggcttggcccacttggacgattgggccatattctcatgtttgggccaaagggtatttttgtcatttctgtaaaaaaatgacaagtgattacatcctatcaacagtcaactactagtcaacggacggcaatgatgagagggagcgaaaatttaaaccaatggcatataagggaagagccaattttcagtggcattcaagggatcagacaaattttcagtggcatataagggattctctcgtaaagagagggcacgacatggcagaacatgccaatattgtaacatcacaaaatttagttatagcttagccctaattaagagaaagtgatggtcttaatgcatcattccactagaatgatttcagcatcaattttaagaatttaccttgatcaaatatcttttaaagcagggctaaggtcccgttcttttctcgaacaagagtttgatgaagattaagatttttatggcatgcttttcaaactgttaaacggtgcgtttcgtgtaaaaactttttatatgaaagttgctctaaaatatcatatatattaatctgtttttgaattttgtaataattaaaactcaatcaatcttatgttaatactacctcgttttacgtaaaaaacttaatcttcatcttcatctttatcttcaagagaaaagaacaccaccaaacataggcctctattataatccacaattccaccgcacataaattctaaaatactacatagaca

SEQ ID NO: 29692 - DNA, 1501 bp, Oryza sativa
cgaaatttttgaggagagtttggaacgaaaaagcggccatggcgcagtggaggacggcggcgtcggcgtcggccacggcgcggtggaggacggcgccggccgcggtgcggtggaggacggtgtcggccgccgcgcggtggaggacggcggctgccgccgcacagtcgaggacggcggcatcggccgcggcgcggtggaggacggcggcgccggtcgtgcggtggaggacggcggcggcgaccgcgcggtggagggcggaggcgggccgcggcgcaggggagggtggaggcggcggcggcgcggtggagggtggagccggcggcggcggcgcggtgggggctggaggaggaggcggcggcgtggtgggggctggaggaggaggctgcactagtagtagggctagtatcacttctagggtttattttagtgggcttattgggcttcctaggtctattgggccaaaatttcggtcatttcggttaattcggttaaccgatcgagcctaataaccgaaatgaccgaaataaattcggtcttttgagggctgggaccgaatagataaccgaatttctcggtctcggtcttttcggtctcggtcttttcggtttggtttttcggttcggtctaaatatgcccacccctacgtgtatatagcgcccacaaactatcaaaacacaagtgtaaatccagtcgtttgacggtttcattctacatggtatctatgtgagaagttgacctagttttcgtctgacgtagcgcttacatgtatttattgtcattgagaaaaataagaaaataaaaaaagacccacacgtgagtggtaattatatcgtaaaaattgaatgaatttatggaacccatatcactcacatgagaaaaaaagtatctctacctctctccttggtaccccggtcggggccggcggtagaaggaggctgacgcattgggttacatgaaggcgaactgggcatctaggaagaaaaagttattcgagcagagctgggcatgccgaactcgcacaaaaagagtaagggggtgtaagcagacgcaaccgcattagttacacgcatgacaatcttgtagcgtagaatggtgctggcgcgatgctgaggtcgtattggtcccacacagaggtagactcgctggggcgcgcggtctcgcacagtggtgttgttggtgcactgtggacggggcaagaatggagaggggaggaccaaggaggagggagagggaatagagattttttttaaaaaaaaataatttttacatgtggctaacatttgtgtgacagattattttgagttttttttgcactgacatatagatcccatcacatttttagcggtaatcacacataagtgttgcatcaaataaaaaatagatcaatgtagatgccacgtaggagaaaatcaccgctaaaacaaccgagggacttgatttggttttgatagttgtgagacgctctatacacagtttatttttgaggaatgatcagaccttt

SEQ ID NO: 29693 - DNA, 1501 bp, Oryza sativa
gtgtgcgccctagggcaaccctaggacgtcctaaatcatatttattcagtagtcgttaaagtttagaatcgggttttgcttagattattttgccattgcagtttcgccgctactttggtttgtggaaccccaaattcgagtgcttagtcattcatatccaattgtgttgcaatctatcttgttcttgcttgtgtttttcgatttgcatacaaggattagtcttctcggcgaggtcaactgagtagggcacggctgataaccagagtttggatcatgttgatcagaagctggatcgtgtgtgtgaagtttccacgagagttatcaatacctatcgaaagatcgggatctaatttcctcaaatagagcgaattttgtcagctatcatcaaagataccgatggaattaagggatggaaatatacttttgtaagaatatgaagttgggaaattttctagtccctactccctagctaggctacgtgggagactgtttctaatgaaattcgcatattatacttggatttcaaatggagcattagtttcagtaaactgctagaaaacaaatgataataaaaaaaacatgtatattgcaagaacaagagtattatcaatagtgatagcgctggtacgatcattctatagagaaacgacgttctttaaccttttccttttctttggcttttacagatactcccaaaattgcaagacaattgcctgcattatttcctttttaaagttggtagttcctatggtgttcttttgcacgaggaatcgcttgtttctcaagcatatgcatgcaaagttaacttctgtaatatgtagctttcttatttatttttcaatggaattgaattatctttatcccatttattaactatccataacatcacaaaatttttctcagtgacaataactgtaaaattacaactatcatatcatgattttatatcggcaatctagcaactttagtccgatttatgttcattttcagtttttcaccaaatgtttacttttgtggagttcatgaaagctttctaaaatacatgccctgattatgtggccactgtctaatgttgcttatcgcatttcagtgtatatctcacaacagatggtgaccatcgatgaataatataatcaatcatagaagtggctatattagtcagtagtttactaaaaagagatggacaaaacttgccattttgtaggaggatgtaacctacctaggagttcatcagttgcatgcatttggaataatatttgccatcaacaacttgctaaagtgagaaaggggccctggagttcagtaaactatttctcatgctttgaatctcctgctttatctgatcttccctccactccagtggtatataagaagcactcttttgagctccctccaagccaagccaaccaaagtcctctgctcccctgctccttcactctgcttcactctcactcactcaccttcttggtacattgcaattttgcaatggccaagaatggtg

SEQ ID NO: 29694 - DNA, 1501 bp, Oryza sativa
aaattattccaactgctttcgctttagtgctctcccattttatacctaggttaatcatcattgcctacttaataatgcctgcatgtacctctgggaacaaagaggatgagaccaaactaacataaaaagagtacgggattttggatttgaaattcctggtttttttatctagatatttttagtacacctctatctgacccattggttcgcttatttgcagaataagctaaatggcatatttataaacgaaatattgtttgtgaataaaacttttatataagtgttcttagtgatctaaaagcaaagactaaaaaataaacttcgataaaaaaacctcaatcagctccaaatttaaagttgaaaattcaattttggccgataagtataagcataagagtttatactcctatattgcatcatgttaattcccaagaagccgaagttttgacagtaaatcgtgtttatactcattatcattatgctccattacggtgaattatgataatctcatttggtgcaacgacttttggatatttcggtgtttggtggaccacttttatttttagatctgtgttgcaaacaataatattaaaatattttaaaagtattaaataattttacgaaacacaatgcagccgcaggtgcgagataatcaaattattgcgctacaaaacaaacttcactattataagtcttcattttcactacaaatcaaagaacaaaaacagagccattaaggccattcacagtgggtgttcctcagatgccacgttgaccaaaaacgttttgagctacatgttttacagtgcaagttgcttgtagtaggtcctacctataccattttttttacttttcatctctatcttcttggtctttccccaacaactctctctcttctctcggtccccatcggaggaagctgaggccagaagagccgccagagctgagcagcggtggctgcgcgaggtggtccaatcgccgacgatggcgacgaggtggctgcggcaggatggctcgagcaacgacgataacgcccctctctccctaccacccatcgttgattcccctctcctcctcccactggtagagaaaccatctttagtcggttgacccaaatcaacaatagtcttggttccattaaaaaccaggactaaaaatgatttttaatcccggtttataagaggaagatctttagtcccggttgttgtaacatcatctttagtcccattggtaactccaacaggactaaacataaactttagtcccggttgattacatgtcaggccgtgtcagggccttaggatatttagtcccggttagtaacaccaaccgggactaaaaatagggttgatgttactgaccgggattaaaaataaaaaaacacaatagtatctatcttcttttcccgtccatacaacaaactcctgccctgtatctcttttttcctcaataacttcttataccttaccttgtctcactgtcttctctttcctttctttcc

SEQ ID NO: 29695 - DNA, 1501 bp, Oryza sativa
ttaataatatcctaatagctcttttcaggagaagtgttaatctgacgaacacgtgggggcttgagccgcaatgaaggagggttcccaggtgagcttgtttgttgcgctgtgtttctttttgtttggagtgctgatgtcgtagtacctcgtactgtaagaatctttcttgaaaaaaaaataaattcgatgcactgtcttttgtttaaagtgctgatgtcagtcacactgtgagagaacctttcatataaattaattcggaaatagatagcttgccaactcggaagattggattttacttcttagaatctatatgcaatgtacttagatgacttttggagtgtaaaatgctagaagatttaccatccaggctaatatggtaatttaatttttatgcaactcttagacaagagcaatatattttttccagtctcttttttttttgagaatttgtttgtactgaactgtaaaatgaaaatcatgtcccttgtaatcttctcccccttcgactttgaggaacaacaagtcggagcttgccaactattggctccaagaacagtgttggccatgcaactgatttctaatcagttttgaacatgatgaatctaccgcaatgatcgatttggcaaagatagcctccaggaacaacaagtcggagcttgccaactattggctccaagaacagtgttggccatgcaactgatttctaatcagttttgaacatgatgaatctaccgcaatgatcgatttggcaaagatagcctccagtagcctagtgccatgcactgtgaggtccccagtgtgaaatgtagcagctgcacaattctagtaaggagaacttggatggtgtagttgatggacttcaatgaagactggagaggtgtaagaatgtctatgaaaggcaaaataaagaacatctctagtaaccggcctgttaactctgtattagtcagtagagtcacttggtaaatataagagcaaccgttcaagataccaagtgctcatgaggtaaactcttgtggatctctgacataaaaactagttcattcaaggttatatattctttgtattggcacctctcacttttttgctgatgtcatgaccattgattgcccttgctttcaccttttgttactacatctttacatttataccacatttcaagtgaactatatcctaatgagcatatttctacaggatgttgagagcaaggcaaaggtgcatccattggtgcaaggtgatgatgaaatcaagggtgaacagccaaatactgatgcacctttaggggattctgattccttatccgctgcaagtaatgataataaaagggtttctcgtgaagatattgaacttgtaagatggctagtcttttctattatggaggcaatgttgaaaagtgtataatttttgtatacaaagtataataccttccattattaactaaccaaatattttgcgctgttgtaggtccagaatttaatagaacgctgtctacagctatata

SEQ ID NO: 29696 - DNA, 1501 bp, Oryza sativa
tgctaaaataagtgatcagattttgaatacgagcagtagtgtttggtggaacaaatagttactattcacaagccatccaccaacaactatggtttcactttcaaaatcgcaaaactacttaagaaagcaaatgaacaatctcgagccaaaatgtatagatagtgtttctttttagcacatacaaagatgaagataaatttcactgtatgtcgagtgtgcgtaccttttcaaaatttgccattatgttcgtccattttcagaatttgtcactgaggatataaatttcttcgtaccattcattttgcttgtcagccgcaagcaccatccgtgcacaccagcaccatcatgacaccccacggcaaggagccattccacacgctactgttgtaatattaacaacgccatgaacagcgacaagaggcccaaccactactcacaaccggcggcaccacccatggcatccagaaccactggagagacagaaggacgacatacaagatctaatcgaataggccttccatcatagactcgcagcgcgtgtaaagcgaggcggtgccaaggatatatgtggtggccggtaagtggcaggttgaatgatgtcgtccccatccaccaccaacttgtgtgtctctgtacatgtattcaccaaccaaccatagcggtatgacaactgtgtagcctagtcatcgtagtagccaatgcttgccatgcctgcacctcctcctcctcctcctgcttctttatcacaggatctagaagaggggtgcttggagtgcggggtgtgctatcaatgatggtggggcaactaggatgtgatgctgatggattggaattgaaagagagggtgcaccttcagggctcgtgcagcggtggtgcatgagtggggtgctttcttcaccttaggcaactaggatgccgtcggggatgagagtgatggtggacggacgacgctggtgctgatgctagcgaacaaacgaagtgactgatgaacatgatgttggatgtatgggatggcacggggcgaatgaattcgcattcctagtggaaaatttttttaaaaaaaacacgtgaattaggtggcaaaaaatattgaaagacgtggatattcggtggcaaatagtgaggctcctctgatttgtaggaaaacctgggaaacttggaggaatcaaatcctatatgaaaaaaatcctaacaagttggatcaaatcatatccttttctttaaatttcctatggaaggaatcatcctataaaaattttggatcaaaataagcttgatgttctccttgacgttttcttctttctataaccccaaatttttggaactatcaagtgatttttgttccgtaggaattcaattggcatgatattctatttctactttttttttctattcatgtgttttaaaggggcaggaaattccttcaaagatgaatgggaaatgctctatctgttttcgtcgttggaaagcgtaatcgagaatgccgttagctatccgaagg

SEQ ID NO: 29697 - DNA, 1501 bp, Oryza sativa
tggcgtagccagggtacgtgccgcggaagacgatggacgcggcggccatggcggcggcggtctcggcggcgaggtctgacccggggtgctgggggtcgacgcggaacgcctggcggctcgtcgtcatgtcctccggccgctgccagcagctgtggtcggtgtcgccgtcgccgacctcgccgtagagcacgtcgggctccgggtgcgccttgatgaagtagtcggtgccccacttgacggcgtccatggcgttccggagctcgccggccgccgccatctgcttgccgtactctaatatgctccacgacatcatggtcaccgtgaacgccattggcaacccaaacttgacattgtcccctgcatcataataacctccaacaagatcaacctgaaagacaaacaaaaacacaaacatttgcattgcactccattagaacccaactcatcatatctcctgaacaaattgaacacaatgccattgatggcatcatggttttgatcaaagatttgaaggtagaatggtgcatactccattggcctttccatcaaagaggccagagctggctctccaggagaccctctggttaggagggagaacgccggaccgctgcgcctggaagtagaggatgctcttcctcaatgccatggcatagtcatggccacccccagcaacaaatcccagcttcaccattgatgcaagtgccaagagaccaaacaatgtggctgcaccgtgagcaccaccattcttggccattgcaaaattgcaatgtaccaagaaggtgagtgagtgagagtgaagcagagtgaaggagcaggggagcagaggactttggttggcttggcttggagggagctcaaaagagtgcttcttatataccactggagtggagggaagatcagataaagcaggagattcaaagcatgagaaatagtttactgaactccagggcccctttctcactttagcaagttgttgatggcaaatattattccaaatgcatgcaactgatgaactcctaggtaggttacatcctcctacaaaatggcaagttttgtccatctctttttagtaaactactgactaatatagccacttctatgattgattatattattcatcgatggtcaccatctgttgtgagatatacactgaaatgcgataagcaacattagacagtggccacataatcagggcatgtattttagaaagctttcatgaactccacaaaagtaaacatttggtgaaaaactgaaaatgaacataaatcggactaaagttgctagattgccgatataaaatcatgatatgatagttgtaattttacagttattgtcactgagaaaaattttgtgatgttatggatagttaataaatgggataaagataattcaattccattgaaaaataaataagaaagctacatattacagaagttaactttgcatgcatatgcttgagaaacaagcgattcctcgtgcaaaagaacaccataggaactac

SEQ ID NO: 29698 - DNA, 969 bp, Oryza sativa
attcctgcagcccctaattttaaattgtattcctacttgaactcttcttttattttttttttctaattttggattttatttttatttttattcccaattttaattaatcgcgctcatattgggttcttatatggactcttcttttaatattctttatttttaattctaaattttaactattttaaaattgttattcctacttggactatcattttcttttataattttggattttatttaatttttatttcgaattttgattaatctcatattgagttcttatatggaaacttctttcaatattgcttatttttaatcctgaatttcagctatttttaaattgtatttctactgggactcttttttttctaattttgaattttattttatttttatttcaaattttgattaatctcatattggttcttatatagaaacttctttcaatattgcttattttttaattccgaattttagctatttttagattgtatttctactcggactcttcttttcttttttttctttttcttcgattaatgtgggaatttctagcccccacagcgaacgtggtgcctcctttcaaagctgttttaataatataatagatagatagatagatagatagatttgctacttcctattttttaaaaatgtgtttactagttggattgtaaaagtttacacccttgtgtttgttgcacaggtcataggaggaagagcaatgcggtcaagattgttctagcagtgttaagcagtattttggttgtcctatgcatttcctttgcatggttaaaaatcaaaggccggtatattcagtgctcttttatttacttagatgcgtatggtatactcacaagaaaaattaaagttggttacatttgattttgtgagcaggcaagaaaagaaaacgcgaaaagcacaggaagctatttttggatggtgcgtgtacatctgaagagattgagg

SEQ ID NO: 29699 - DNA, 429 bp, Oryza sativa
ccagtggttatacacacgtggtgtgaggaggggatggaaggagatcgactttgcttttaaagttttatagaaataattagaaaaaaaatcttattatcctaaaggatatatagatgtacctcacccattttagatactgattatggatgtgttctccattagctagcagcggcatgaaaaaaagaaaaagagtggcaaaagtgcggtttgcttgtcctagatctcaaataattgggttagggttccactttaactggaattggataattccagttgcagctaacagtacacctacatcatgcatgctgctctatacgtcatacatgtataatttgaattaaaaaaagagaggcaaacatgaattcaaggattttttttcattaattaatcctccattagcttcctattgggctcttttgggggcatcga

SEQ ID NO: 29700 - DNA, 1501 bp, Oryza sativa
acttgaaaaggactatgttaatactttagtttattatttagttaagctgcaggatattcagaggtatgagtatggacccagtataagttaaatgtgtgtgcatattaatggccaaagtaagatcgaatttgactgatactagatctggaatcaaatatgttaatggccaaagaacctgaaaggtacagacggaaatccattccatactgtttttgcagctaaatctgcttgctcgtcctcctcctccgatcttgtctattacattaatgcacacaagagagcgtctaaacattaggacatttcaatttcattatatgtgccaatcacggaatcacctgccgtggaagtgactaaatatttttttttcctgttaataatatttgtatgtcctggaatatcaatgggatcagttctgtttggaagcatgatctctatatgactttataaggtgatgaaatgaaatgttgtttgctttgaatgaagaaacattattaacttgtatagaatagttagcttgaaacgttatgagatttgtggtctattttgtctccttgaaaaccgtatgtataagtggtacttctgttctagatgccctggtacttcaaaataataggaataaaaacaacaatttaattatcttttctttgttatgagccttgattccagatttcaggacttgggagcattgccgtggcaaactagtactaagtatgcccagagtttaacgaatcttagtttgtactcattgtcccatacaattcatgcaactgataacaaatatgcttgttgaaatctgtcgaatatacagctggctcttttcatgtgtcaggttctaattgtattattggagccaacttcatagcattactgcaatattgtttgccaatagtttcaattccactccaaatgaactatgttacctactctctctgtccacaaatataaggggattttagctatgcacctgggagcacttgtccatgtatatagtcaaaataccttatatgtggacggagggcctgatccttggtgaattatgatactgttctaattcaagagttagtttatgaacatgataatttgttcagttatttaaacttgtaactcatgttctcacagatctggacaaattctcttctttatgactcatttcctttacttttgacatttcagtaaggcatcgtttgctccgagttagctggtcctcgtgaattcctgaaggcttattttgcccctgtcctggggtgagttttgttagtcaaactgtaaaacacaggaaaacactctttaacttaatttaccattccttgtgctcctgaaattaaagaggagcttgacctttactgacgacgaaattgccctgcagaaagggtgctggttatacatgcctgtattgccccttggctacatgccaaaaaagtcaatgcctactgtatgtaataatctgccagctttaccaatataacttccttatggttaccctgttaaatgaatacgcaaa

SEQ ID NO: 29701 - DNA, 1501 bp, Oryza sativa
cttgcctagtatcgggaggataccccctaccaacatcattataagcattaggaacatgtgggggaacttggggattagttgcagcactagatacaggaggatcaaatgttctaagatgatacaaataactagcattagtcattggatctatcccctgaattggtattattgcgccggtctgaccggtccagggcccggtctgatcgacatccagaggcgcgatcagactggcctaagtcccggtctgaccgccggggtaatacccggtcggaccggccgtttggcctgtcggaccgacagtgaagtcgcggtctgaccggccatcaggcccggtcggaccggctgtgtgcgccactccatcggttctactatttgtttgatctataggggcttggctagcagtggtagaggctttatttttacccacaaaatcggccaagagagggccgactttaaatcttaaaaactcatcaaatttatcctcaaaagttgcatctaattatctttaaaaacagtcatagatgaatctattgtagatgctacttgttgttggatagattgtgttacctcttcattgcttaccaaattgggagcgagcttaggacgtggccagggcttgatgatcacaccttgacgagtcctagtagacgccctcatcaacgcctcttgtgtgagctccttgatgtactcctccatggacttgcggtcttctccttcgaaatcattcaatgtgattggtatcacaatggccggctccacctccgccttggatgatggcggttccgtcatggcgaaatcgaagttgagttgacgttgaacggatctccccagtggagttgccaaaatcgtgttagcaactttttgtgacaagttgacaacaacgatcgcagcaccttatgccttgcggtgatcctagagtcgccaaccacctcgatctagcaaagagctaaacctagatggattttgacaaataaaccggctaatggagccgatttaagataacaacccgtctcatgggcaaaacggaaggttttcaggacaaacctacaaagagatgtcgcactctcgcagcggcggcggacggtttacggcgcaaaccgacaaagatggacaaactaagggaaaactaaaagcaatacgaaaaacgattcgattgattgattgtagattgtttttttacaatagaaccggccatgtcccttatataggggttggtcttgccctctacgggccctcctccacatccaactcggggtagaaactaaaggaaacccgaaacatgccttcccgagcaaggaaatctcgaaacccgacgaaacacaatcggactcggacctgtcagtcggaccggccacacaccgccggtccgaccggccgtcaaccggcggtctgaccgcccaacacacggcggtcagaccggcccactcgaaggaaaccggtagacttccaaattttggcaatctttcctattttaatcctaggtgccaaatttgggtgtaaa

SEQ ID NO: 29702 - DNA, 1207 bp, Oryza sativa
agcactgttgtgtgttcaagaaaaccctgatgatagaccacttatgtcatccgttgtgttcttcctggacaatgggagtaatactgcacttccagccccaaatagccctgcctattttgcacaaaggagttctgaaatagagcaattgagagataatattcagaactcaatgaatacttttacgctaacagatatagaggggaggtagctaaggataattctttgacttaggatgtaacaatcactgtccaaagaaaaatgcagacagctgatgcatgatttgtggtttggaactcaatttgttgctattcttttctagccctttctttggtctttctcgttatatcacaaaaaaaaatctaaaaaaatctaaacaacacattatacttaaaaagtaaaagccaacatctgtacaagtgtaggatgtcactcagttgaacagacagaacgttgactgacacgaagggtatgcattcatatgaagctaagtcaccttcaactcgttcccgaatcccgacgcaccagtgcagcacgtacggcaactgcgacatcaccgacgggtgccgccgccacgcgcaagtgcctcgacggcttcgagccggcgagcggcgaggagtggagcaccggcaggttctcggggggttgccggcggaaggaggcgctgcccgtgcgacgccgccgatgatttcttggcgctgccgcggatgaaggtgccggacaagttctctatgctcgtcgctttgcaatgaaacagtagaccagtttaccaagctttgctcctgctttgagacttgccgggtcttcacctttcctatacataaaagctcgtcacgatctgtagcgatcagtctctttcagtacacaagatggggaacaactggatttaacggaccaaggttttcatagccgctgaggtaaagagttttccttttcatcccttgtcaatgagggattgaggggcaggaagtctattttatgatgtttcattgtgtgaagtggtaaaccaagtacggaaagttgccaacgttgccagggaagtgggccaagttgttgaggatggattctaatatctcgggtggacgtccacccgtgtgtttaaaacagtttccccaagttgttccaaaatctatatttcacacgcaggcaatgatatagcattgtagcctgctcacttcacttgctcagtgcaagctcatactgaaaagga

SEQ ID NO: 29703 - DNA, 1501 bp, Oryza sativa
atggccatagatcactacttatgctaaatgatgcattttcagattggttggaggcttggagctgtttatttcccttaatttcagccttcctgataaaaatgcatgctgcctactgtgcagtgccaaagctttgattcgagacactgttgtaggtagcaatttacgtgatgcattgcattaattttttttgactgatgaaacctggactcactgaattgaaggaaaaacacatagctctattgtgcttatattcttctctgttggagcaggtcttctatgggtcttggaagtgctcatccactgttttgatcagtgaaggggatgctgttagtgatggagttagaacaagacataaaggtaatgatcaagttaatcagcgttttccttgcattttcaatatacacaacttcattccgtgtaattatattcacgttttaagattggttttctcatttactcctaatcattgaactttttgtggttttgtgctgcacattttctgttttttgcaatccacgaagctgttacatgttcaaaacaaaattatagatggtcctgtacaaatatgaatgcttggaattagtgaatatagtactgtgaaaattatgccacccagctaaatttagtgccaattgcaatttcttttgcatgtataatctattttgattgatttattcggtatatgaattgtgttctaggagcctatataaatgtgtggtgtcaaatatgaatttcatactgttcaacatgtactatgatagtccaaactttagctgttcattaatgattttattacaaatgcaggccggtttaacagaccactctgtttttcttaacatttcaatgtatgggcagtatttgctatgaattgagcacttgtgttggttgcttgcaatgcatttgtagtttcctgccaaccaatgcatattgtcatcctcagtaactgccatgctgctacacactggataagcaactgaaaatcaatatttttcttttcttatatttaagatcaatctgatatttcttcacataagggctactggccgtagataacaaatttcgcacaggaaatattccaatattatgtcaattgctattttgcaggcaagcatctatggtgcttgagacctactttcttattacgtcacccaattttgcttgaacaagaggcatgcaaaacatttgaaggtagtcagacataattttattcaaagtaaatttcacagaactacatatattttgaacaaatactttgctttgggccatatgagctggacaaattatggaaggactatagcacacactgcaagaatatattgttcctttagatatctttgttcattgcattagtaacctgtgcgattatttatgaacaggatggatcatgatcaacggcagagggtgagctgcgccatgggtcgtgaatcaccgttgctattgcctccaacttgtcgctggagccacgcgcccaacagctagagccaagatgaattcctgagag

SEQ ID NO: 29704 - DNA, 769 bp, Oryza sativa
ttaccttagtgcgagttgttctttgtgcttcatccaaaatagtagcatacaacataaagagtctcatgaaagaatcacatattcattaaccaataatgagttatctatttcaaggaacaatatcggataaatatgtaaatatagtatgtgatacaatcatctctatgattgcctctagggcttatcaccaacaggtatgatggttatggaacgcgaaaagacacttctgccctccaaccgtcatttaggagctcatctagaccatccacgcgaagccccagttcgaacggctgtggtagtggttggccgaaccatgggttcgaccaaacccaggtctggctcacagagcccatcttcggcctgttgctccttctctgcgtcctctatccatttctgtgagtggaaagcccatttgaagatgttttctggtagtttttggcccactcttggtatggataggaattattcttcactcaagtctatttttggtccaactttggtggtttattacctgcatacaaatatacaccaacactcgtggaatatgtcagaatttaaccctatcactatgttggatgttttatttccttgatttatgcaggtattggtggcataaagtctgtcattaacaacagccaacagcctcatagttaaaatcctccattctcgcattagcaagttgcttttggtgcaaagttaactggcgggtatattgtcttgtgctaacccctgctcgagttcgctttgtattcttgcctttgtgcagtca

SEQ ID NO: 29705 - DNA, 1501 bp, Oryza sativa
gtaactattgtttgggcatgctattaatgtttcatcctttttcctaaataggaagggtgcccataagagatatcacaaattatgctggctttggtgctaccaagcctattcaggtgccactgctatttacttcattagtaactattgtttgggcatgctattaatgtttcattctttttcctaaataggaagggtgcccataagagatatcacaaattatgctggctttggtgctacccaaacctattcaggaaccgtgatactgaaaggtaacatgtttgttcctaaaatttctggatatatacattaaaatagacatcatgtttatttagaacaaagagagttatgcctcctatgatgctgcccaaaagaaatcatgttgacaaaccatgaaatggccatagatcactacttatgctaaatgatgcattttcagattggttggaggcttggagctgtttatttcccttaatttcagccttcctgataaaaatgcatgctgcctactgtgcagtgccaaagctttgattcgagacactgttgtaggtagcaatttacgtgatgcattgcattaattttttttgactgatgaaacctggactcactgaattgaaggaaaaacacatagctctattgtgcttatattcttctctgttggagcaggtcttctatgggtcttggaagtgctcatccactgttttgatcagtgaaggggatgctgttagtgatggagttagaacaagacataaaggtaatgatcaagttaatcagcgttttccttgcattttcaatatacacaacttcattccgtgtaattatattcacgttttaagattggttttctcatttactcctaatcattgaactttttgtggttttgtgctgcacattttctgttttttgcaatccacgaagctgttacatgttcaaaacaaaattatagatggtcctgtacaaatatgaatgcttggaattagtgaatatagtactgtgaaaattatgccacccagctaaatttagtgccaattgcaatttcttttgcatgtataatctattttgattgatttattcggtatatgaattgtgttctaggagcctatataaatgtgtggtgtcaaatatgaatttcatactgttcaacatgtactatgatagtccaaactttagctgttcattaatgattttattacaaatgcaggccggtttaacagaccactctgtttttcttaacatttcaatgtatgggcagtatttgctatgaattgagcacttgtgttggttgcttgcaatgcatttgtagtttcctgccaaccaatgcatattgtcatcctcagtaactgccatgctgctacacactggataagcaactgaaaatcaatatttttcttttcttatatttaagatcaatctgatatttcttcacataagggctactggccgtagataacaaatttcgcacaggaaatattccaatattatgtcaattgctattttgcaggca

SEQ ID NO: 29706 - DNA, 234 bp, Oryza sativa
tagtttgcttgctttaagttgcttgtgtgtgcttcgcatgtaatttacatcagtgatgggatgtaagtgcatgtgtttgtttgcttttgagtgttaggaagttggtgagtttagtggtgtgagagttttcagttttgtaataaaactcagttaagatcaataaaagttaaagtaattctctgtcctaagtagtttccccccccggtttctcttcttgtgccctgtccagcaaga

SEQ ID NO: 29707 - DNA, 1501 bp, Oryza sativa
taattcatccgagctccgtttaagcccattcaagtctcagtaaatcaagaaaaatgcatagaatccattaaaaatgattttgttctctgtttcagtagtcttatagcatgtttgtattgtttgctttgtatgtcgcttagattccggctctcctcacgctccggtgtactttgaaatagtcgccgaggttcctccagcagcagagcgaggcaagtcatgcttgtcacttgaacatgttgatcctatattgcaaatgctctatcgttttcctttaaaaactgcatcgttttataatgttactatgggatctttacctactgttacagccatgctatttttgtaccatgctcctttgttagcttggggatataacatgactagatattggactagggattgcttagccatgcttagttcaactaacacacaatggggaaaatacattattgagttgatatcagattctagtaataatgttggttaatgccaccgctccggtgttggttaattaaaatatattaaatggtgggttgtgggtgcatggttttgatggtcgcgcccatagcaattaaggaccggttcgcgggatgccctggaagaacttatcgtacttaccacaagccattgtgggcaacggctgggcttgtagtgtagctttcctctagatgacgcatccaggcaagggtgggcatgatggagcgggacgggccctgcgacggcctctgtccttccggattcacctaggcacgagaggggactgcccgttgcccgctggggatgggggtgaaacctgaggtgtggtgtgcttggctagagggggttatgcgaagggtcctgtcacggcctcttttcggtatgtcgtggtggcatgtcagcgcacggtaacatgtcgtggggctgtgtcttgtgggtacagttgtacacctctgatcagagtaaaactattcgaatagccgtgcccgcggttacgggcggtcaaccagattcaccgtgattagtctcacccctagttagctaatgaactggtgtagttcaggtggttggttgggcctgttgcaacgtggtgtagcgttggacagtgattggttaatactgattaattactacaactgttttactgctttgaactaccgtctttaaatgcccgctttatgcaaatgaacctttctagccataccttgattataccctgcatcataccccctattttggtatgacttgctgagtacggtggttgtactcagccttactctattttccccaaaaccccggagtttgagtacgtgtcagatggtggcttctccgaggagtaggcttcgtccgtgccgtcgaggatgcctgtggagtggtgttcccgctgcagttcaagttaaggcttagctccatttatcttttaattttccgctgcatttatgtaagacttttataatgtttgtaagacgttgatctgtatgtcaactttatcgtttgtgtaccccggccggtcctagacgggggtttt

SEQ ID NO: 29708 - DNA, 1501 bp, Oryza sativa
agaggaggatttaaagaatttttcaattaaaataattcgtgccatgatgtttcatttattaaaaatacttttcttgctcaaataattctcagaaaaatatagaaaatagataaacaagcaaagtatttaatggaattttacgttgaaatttttcctagattattctagtttaactcataggcttttaaaataatttctaaaaatgatttaaaagatgaattattaaattaggcgattttcagggcgtgacaccctagcggcgtggtggagatcaggccattcccaatccaagacactagacatagtttccataagctccacatcatcaagaaactagtactagatattactctttcaatgcaaatactactattccatacttaaatttaatgctacttatatcacatgatgtcttatatgttgtgtagaaaccatgtctcatgcaagacatgtttccttctctttcctcatttattcacttgccacataatttttcatcctaggtgacagcttatttaatgctatggacactatcctagtcattgggttgggaatggcctaatacaggtggtgatcgtcggcactcggcacacgctggagcttagaggacgcttgatcagaggtgccttgcgtggtgcacgctactacaaagttgcataaccgtagtcttcaactttcggcatgcaacttttagaaaatctttatcttcatcacaactttgcagtggtttcacaataatatggaccgccctattattttggcttattcatggattaaaccaaatggtatatttgcaaatgaaaaataatttgttaataaaatatgtgttcttagctatctaaaagcagggactgaaaaataaactttgataaaaaaaatcacaaaatcaactttaaatttaaggttgaaaatttaaattttagctgatgagcataagtataagcgaaaagatgaagccgcaaaattatttagaatgaacatcggagcaatattctgcttactagaccgtactttatttgtttccaaggtatcaaaatgttatattgtggtcattatgactgatagcgattggaattgattcccagaaccgaaagaaaaaaaaaacagtaattctcatttctccgtccaatttcagatatcacatgcacatcgtgccactttaacgaaaggagagaaaaaaagcagcagattaaagatggaaactggacagaccaaagtcccaactagtctttaacaacccacgagtaaaaagcgaaagcccaacagtgcagtgctacacccaataactagcttcccgtactaaaccaaagccgaaagaaaaaaaatactcaaaattaaaaagcaaaaccatttcatcgacacagcgcccacaaaaccgcaaaatcctccgccgcctcctccggccggtagcgcacgccgccgaccacccgccgccgcggacgcgacgcctcctctccccgattcggccccggatcacatgcggccactaccccgatgtcat

SEQ ID NO: 29709 - DNA, 413 bp, Oryza sativa
aaatgttgaggtttgagtagatctggatgaaaaaattcaggggaaaaaagttgatgtctttcttgttaaaataagaagaaatatccaaagtctctatgtttccaaatagcaggtaaagttgcagcatgatgttttatccatattctgaaacaaaagtcaagattctataaggtcgtcacgattaattatcaagaattatcaattgagcaatattagccagactactaaccttgatgcgatgcatactttcagtgcaaggaagcaattcaaatattaacaatggatggtattttagattctaaagatctatattctctttataactgtttgccatgctcccacattaatgcctttttgtttaaccaagcaatggctgaattaggcaaattagaagtagttgtcttatttcacca

SEQ ID NO: 29710 - DNA, 1170 bp, Oryza sativa
actgaattggttaaggtgtcgatttatatgttttcaactcgcatatagttctttcatgttagtttttaaaaagtttctttcttgtgacatgtctgtgacttaaaaatgatcacatgatgacaatgtgtttggatgaaagtaatcatagaggctcatattttgggtgactgcagcccaatgaatgttgtttctagaagtaattaaatattgactgcaaaaaatagagatatgaaactttcatgttgttattcaatatgtctgaaactcctgtgtgtccaatcaggataagcgtgttgttgccttgttggctgtgtgcatgattgtgtgtttgtagtggcgaattcatgtaaaatatgttcgcactcacttttacattttaatggataaataatagtcttgtatccaagtaatccaatacaatgagatgtggggtgctgttggacttcatatttatgtgctggaggcattggtgcaggtggattttgtatatctgttggcatggctgctcattgacattgtatgcaccctgttttaaacagctatagtaggcagctaggccacatacaaggaacagtcccttgttgttgtaaaattggctggtttggtcatataatcagttttagatggggtgattgaacaataataattgttcattgttcttaaaaatgagtgatgaatatgcatgccccaagagtgatagattcatacacaatttcacatgctttagagttacatcaaagcaatgccatttagacttggtgcagaagggcacaagctcacagcacaattatgacagttttgaatatttgcttatggaaggtcaaatgtcaattgaatagcttgaatatcatatagagttgatcatgccctctgcatatttgcatgtagttgttgcttttagttgcatgttacaccagccatttacctgttatattgtaagatactgtcgctaatgaattgatatttcaaaagatttgttttagacactctatttattttactgattcaggacagtctaggtgagataactcaacctgcacacatatataataatcccaatcatcaacaagcaactctgttgaggcatggaccttcccaatacggtatagaatacatggccctctagctagcttgtgtaatgatgtagcaccatgcatgacctgatcatat

SEQ ID NO: 29711 - DNA, 1501 bp, Oryza sativa
cagaatgtctagaaagagatcaagaaaatcagtccaaagctcagttgacccttaacaaccatccttagtcgacattcacatgccctcaaaaaaattaattataccaggaaagagttaaataccttggcgttgacttgtgtcaccaattgctcacatttctcatatcagcatctctttcttcagaagccatggtttgaagctccaactcaaaggccgcattagccatgctgtctgctgttgagttctctttggctcatttcatgtagagaagagaaaataatgcttattggtataacttaaactcttggggaaacatatcctaattatatcacttaagctccattggaaaagacacgccaaaaaaaagagtacattgatggtgctctcttgctttccagtacaacaccatgattatcaatagactcagcctctcattcactgtttggttgctccctcataagcacgtgagaaagagcccctcattgtctcattgacttctccctctttaccagagagagatagtgcccctccttctcttcttggccgtgccttcaccaactgagatagaggcattctctatgacaacctcatggtcatcagagatagaccccctcattttcttttctgcaacttgagtttgtcagtactagatctctttctcttcctgactccacaagaacagttagaagagttgttgacatcatctgatacagctagactttcatcactttgctttttagatccacttctgtaaaacaagcacaaaagaaactcgtgagatatgagaacaggacatgtataaggaaaatgaaaaaaattcattagagccaagcaatgtaacgttgtaatgtcagtcatacctagacgatttcctccttgaacttgttgtggctgtgttaactagtctcaccatcaatagattcagaaagagagattcatagaagctgaagaatttaatgtcactaggcaatatattgtccccacatggtattctagaacgttttttggggctttctcacttgaacaacgttaaattcctcaagatctatatctggattccccaagatctatatctggatcacgaacactaggccacctgtttaacgataacaaacaactaccattatcatccaaccctaaactgtgtagtaaaatattaaaattactaatttacctttcattgcattgactctgtgcgaccaggaatgaactgagcaaaatcttattccagctgccagacccaaacaacttcacaggtaccatgaggcgtttgtcctcatcgagagaccaactccccacttttgaactttcaggattcaaggtttctctccacctaccaagtttgatgacatgtgaaatactagctaaaattctgtacgttagaactacctaaagacatgtgaaatactccgatagcacatatagacagaagcaaaaatgtgcaaatttgtaaatgatactccgtattattctactggcctgtcgggtattcccagtcagg

SEQ ID NO: 29712 - DNA, 1501 bp, Oryza sativa
acttaccacaagccagcgtgggcaacggctgggcttgtagtgtagctttcctctagtcgacgcatccaggcaagggtgggcgtaatggagtggggcgggccctgcgacggcctctgtcgcttccggattcacctaggcacgagaggggactgcccgttgcccgctggggatgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttatgggtacagttgtacacctctgatcagagtaaaactattcgaatagccgagcccgcggttatgggcggtcaaccagattcaccgtgattagtcccatcttaataaatcgacccaatacattgtagttcaggtgggttggttgggcctgttcaacgtggtgtagcgttgatcagtggagatttaatgttactttaattactcaacagttttactgttttgctcaataaaatgttttacaaccgcctttatgcaaatagccacaaaccatccttgtatccccttgcacatctgcatcgttggtgtggcttgctgagtacggtggttgtactcagtcttgctattatttcccccttttcagaagtgtagtgcttctgagctgaagatggagttagaggaccaaggctcagaccccagttgagttttgcctgtggagtggagctgaagctccgctaggatcgcctttttccgctgctgtcgttctgtttcggtgtgaggactaagtgcctcttccgtaagtattttacgctttatttacgtttggaactgtatattacttgtcgttttgtgtaccctggctggtcctggacagggatttaatacgcaaaatagtctggaaatttgggttaaatttctgggcgtgacaaagcaccctaggtacaagaagagagaaggggtgcttgtatttgaactaggcatgaagttcaatggcaagaagcaatttaagaaagccatgacaaggtatgtccttgctgaaaagaaggtggttaattttatgaaagatgatcacaagagggttagggtcacatgtgactgggatagctatccatgggtgtgtttattgtccaagaactcaaggtcagatagttggcagattgtgacttatgagagtttgcatgcatggtccaccaaggagggataataaaattgtcacaactggcaggatagctgagaaatactggaattcatagctgccatcccttcatggaacttgtcacacatgaaggccacagtacaagaagagatgtttgctgaggcctctatttccaagctgaagagagcaaagtctattgtgatgaagaaacagatggatgccacaaaaggacagtatcagaagctgttcaactaccagcttgagttgttaagaagtaaccctgggagcacagtggtgttttctattggactaacttttatgtttatgtagg

SEQ ID NO: 29713 - DNA, 1501 bp, Oryza sativa
atttcattgtctggcttccctctaccatatccatatgttgcagatgatttttgtgtattctgtgagggatgatgagatgaatctccccgtccacggcccacaggataactagatttccatgatctagaaatattatcatctctttcagcatccttctcatgactgttgccgtcttttccatgagctatgtagtgagagaaacctttttcacgggcagcatcaccatctttgcctgaatcaccccatctgtcacgccaattctcagactccttatcattagggcccctacgagcactccatttgttatcacggcgttgatcatagtttccctccttgttaccggagtcactccaacgttcctgtggaggacgacgaccatccacagagtacttggaggagtcatctgaccacctttccagtttgcgtgtatcaccatgttccttgtctgtctccctccagcgattccaccgaggggctgaatttggttctctttcatcatcacgccagcgttcacgacacccagtttcaccatcaagcacagaggccctgaaaacatcctttcttttcacactgaagcttgtgtcctcatcatttcctggtatctttgaaccatctgaacgaacacccagtaaactgggttcctgccacaagcaatcaacgatcttcagtatagacaagcaaaaaataactaataagagaggttattatacacttaaaaggtatcctactgttacaaccatcatgtatagtattagcatgaccagttccctaagtctagttattaacctagcttctcaatgtctaaccttgttttctcccaccttcataagccattgaggagaaagaggcatctcagtatccagtccttgcttgtctgcaaaaaaaaaatagtatcatgaatgaggcatggaacatgttctgctgacaaagaaaatgtatagaacacagattgcgccattaatatgtgatattaccaacacaaccattcctctcatatgtttgtaacaaacaaataattaaccaaataaaggaccaatggttgacttgataaaatgaaaggctagaataatatacctcaaatcaacacaactagatcagggttttggacattagttctacaactttttaccacaatattgggcctgttcggctgccagggctgcgacgcaaaccgtagccaactggaacagtcccgcaagcacgaagacagcagcggctgcagcccttgcttgccgaacaggccaattggcacaggatgcaaatttaaatcaaacgggtttctacaacaacacgtaggttttttccacatgttgagtaatcagtgaaacaagctgtcatcctctacacatagctacatcaaatccaaatttctcacacaacaacgggtgtgacatgacatggcacatgctaacaacatcaaagcataagttaccaacaacagcatatgcacatagaaaaaaatataaatctgcaagcatacacagcagaaatcaaagtaata

SEQ ID NO: 29714 - DNA, 1501 bp, Oryza sativa
gtagtagatgcatgcaatcgcatgaaggcatggcaacctagccaactgccaatatctacaagaacagtctctcatgtctagttggactgtgaatctattgtcatgatgtttgatctcaaatttattgtcaccattgcagattgcatgacagaaagcagactcaatgatgtacacattcagtttttttagtatgcctggacaaatcacagtggtccatctagttagcttcttcctctgatcatttatcctaaccattactttccttctaatggtttctagcattgtgattatggggaaaaaaaccttgcttccaatatccatttgttaaatgattcacacatattattgtcaacagaatcacaattggaacctaacctgaaccaggctcggctccagtgctgtggatgggtgttgaggatggcctgggctccagcctgtgtaacttgaactagcttggctcttgcaagattgaaaagcattctacatggggcctttgcacatctccagaacttcttctggtactgcttatcagggaaatgtctcttccagtttgcatagatatgcctagcacaattcctatgctcagcttcaggggcacatttctcaatagcatttagaattccctacataaacataaaagttagtccaatagaaaacaccactgtgctcccagggttacttcttaacaactcaagctggtagttgaacagcttctgatactgtccttttgtggcatccatctgtttcttcatcacaatagactttgctctcttcagcttggaaatagaggcctcagcaaacatctcttcttgtactgtggccttcatgtgtgacaagttccatgaagggatggcagctatgaattccagtatttctcagctatcctgccagttgtgacaattttattatccctccttggtggaccatgcatgcaaactctcataagtcacaatctgccaactatctgaccttgagttcttggacaataaacacacccatggatagctatcccagtcacatgtgaccctaaccctcttgtgatcatctttcataaaattaaccaccttcttttcagcaaggacataccttgtcatggctttcttaaattgcttcttgccattgaacttcatgcctagttcaaatacaagcaccccttctctcttcttgtacctagggtgctttgtcacgcccagaaatttaacccaaatttccagactattttgcgtattaaatccctgtccaggaccagccagggtacacaaaacgacaagtaatatacagttccaaacgtaaataaagcgtaaaatacttacggaagaggcacttagtcctcacaccgaaacagaacgacagcagcggaaaaaggcgatcctagcggagcttcagctccactccacaggcaaaactcaactggggtctgagccttggtcctctaactccatcttcagctcagaagcactacacttctgaaaagggggaaataatagcaagactgagtaca

SEQ ID NO: 29715 - DNA, 999 bp, Oryza sativa
ctgacaggtgggccccacctgtcagcgcccgagggagtgagggggaggcgacctggacttcgggagggggcgggagagatgggccggcggcccaaaggaggaaaaagaggggaaaaaggaaagataaaaaggaaaaaggattttcccagggatttaatattgcactttgcttattttaattggttaaaattatttccaaggctctgaaaattccactaaaaatcctgttagcatattttgacatgtagaactcaagaaaaattccacatgccaattccgattattatttgcatttattaactagggattcatctctaggttaaattaaacaatttcttcggacgatttattttatgaatttagagcaagggaggggaacttcagggcgtgacagccggctgggccgctcggccacgcgcggctgagaggagagttgggccggaaacggcccaacaacttagaggaggatttaaagaatttttcaattaaaataattcgtgccatgatgtttcatttattaaaaatacttttcttgctcaaataattctcagaaaaatatagaaaatagataaacaagcaaagtatttaatggaattttacgttgaaatttttcctagattattctagtttaactcataggcttttaaaataatttctaaaaatgatttaaaagatgaattattaaattaggcgattttcagggcgtgacaccctagcggcgtggtggagatcaggccattcccaatccaagacactagacatagtttccataagctccacatcatcaagaaactagtactagatattactctttcaatgcaaatactactattccatacttaaatttaatgctacttatatcacatgatgtcttatatgttgtgtagaaaccatgtctcatgcaagacatgtttccttctctttcctcatttattcacttgccacataatttttcatcctaggtgacagcttatttaatgctatggacactatcctagt

SEQ ID NO: 29716 - DNA, 1447 bp, Oryza sativa
aatgctttagaaaaccaaatagttgacctgttaattctttgatttgtatatatgagttctggaatcacatatccaaagtaacatgttctttgatcccgccatataggagctgcatcaatcgaagttagattgcttaagattggtcatgggtgtggttttttgaaactctaggaccataacactagaggttatctgccactgccacatgccaaaatccctatggtttcgagcaacttgaaatttactctagtaaaaaaaagaaattgctcactgttgtgggttaacatctagtggtgtctcctcttgatctgagctgccttgatctccaaagctaattctcccaataccatcacggctaaagcacattgcgaaggaattagatgtcagacctttttgtgctagaatgctaggaattgatatcatatctatcccaagtccaaatagaccgtttggagcagcagcatccagaaatgatcctgtctgaacctgtccacatctgataaatgtagagaagattttatcaaaatgctgaacacagtctccttcacccattatatgaaatgtaaaaattacccaaatagtatttgcgccttgagaatttgaggaatggcatcctctgttgacaagtagagcacatcctctactagaaaaccagaagaagatgtgtctgcagaaacataaaccatcttgtatggacactgtgatgttgtagagcattcctttctcagctcacaaaattggctgttgcaaggaactgcttggcttgttgacgacatactagggatgtaaaaggaagcctgaaacccaggggcagccagtgagtaactgagcaatatagttacccaaatcttatcttgagagagaacatacatgtagcaaaagtgccacttggaagaaaaataaattgtaatttttcagagtaccaacacaatcaatatgacaatagaaaatattactttgctatagaagttttaagtgtgagaaataaaaaaacaagcaggcaaaacttttgtccaaaaaggagatagactaaggtatgtatgagaagttgagaacagaaacaaaggaaataaaaacaaaaaaaaatcatagaaaaagacaatcaggtacactcaagctacatatatgcacaacaattatatcaagtggtacagttatggttggataaggctcaagcacttgagtctcggcctctactagcttccggcagagctccttccaacacggtaggaagtcttcagatcataagaagaaagtgagactagcaactttgttacatctagccaaggatgacaatgtcatactatatagagccactccctaaaagctcaatctaatatttccaaataggcaactgataagaatgattgccctaatttctaaatttcaaagtacaatcataaaaataacttggtagccaaccaagcttattctcatgacttaatta

SEQ ID NO: 29717 - DNA, 1501 bp, Oryza sativa
tgactgcattgtcatgctcatccatcaaccgtattcacagctctcgtttgcaagagtaggagaagatcattggaattggattcctattggtttgttttatactgattgcatctatcataagggatggttttacaccgtcagtgttttaggagcagtggatgccttcaatctgaatgggccatctgtcgtacacaaaagaattcttaaagatatgctaacactagggtatgaacagatgtatatagttcaatctccatggggcgatatcctaatagtaaacaggatgacaataattccgcgcaatgggaatcctgaaatagaagaaacagagctatatacatctgacattgtagtatacaaggctgatattggtgaacagaagcttgtcaaactgacaggcataggtgattatgcgctgtttattgggcataatacttcctcctgccttcctgtgaaggattgccatatgttgatgccaaatcatgtctatattaccgacgatgagtatctatggctacttgagtttagacataagcgacgggatgttggaatttacagcttggaaaataactctctatcaaatgtggttagccctgaaccttggaaaagttggttgcctcctatatggatgatgcccaatctcatgaaaacaggtacagttcggaatgcaagttaatcaattactttaagcatgggaattaggaaatgtaaaacatttagtcatctattacttccatttatgctggtatatatgaataagagagagtactgttagaacctaccatcttaatggacggagtatccagccagatctataagtaaacacggttcatcctttagcttttgcatattgaactactccagcctctttcttgttttctttgtaattttgtcaagtttcttcagagttcgccttttctagccccatttcattatgaatacataacagttgattctaaatctgcaactcttttaactacatatgcatgtccatgatgcaaccagttatggagttcacctgacctataaagcttttgtttgtattatcaatttcgttccctgagatgcccttaaccagttatagtgtatctcacatttctcaactctacttactgatttcttacctgtgacatcgtaaatcttttttagttaataatttgttgcttacatctttcttcctgataggttttcaggaccaaaataatgggggagattagtttatggtcttcaaaatcatgctgaaaacatgttgtaaaatttgagatgtctctgaagtttagttgaataattatgcatatcctgcatgctgccatatgctgagtgaggtattgactgaacacaatggaacaagaatgtactggaagtgcaagttaaaggcgtgacgaaaatcacaatgctttcacatgtgcgcaaagctgcataagaagtaataaaacaagggaaaaagtatgaattaccccataaactatcatatcagtccgaattaccccttaaaccataa

SEQ ID NO: 29718 - DNA, 890 bp, Oryza sativa
acacgctgtaaatgaacggaatgaagatcaatagatcatccgttaggtcgccttcggttttgaacaagccctacaaggtggtcaaagaaattctattcttttatttaccattgattggctatctgttgatgcttttattattcaaccaaactggtggaggagccaaggtcacagtaatcttattaaaggtggtacttatagaacttccatttttatcggtacatgtgagtgtgagctaatgtattccatgatgaaatgcattccatagcattaggattggatgctacagggaggtagatctcggctgtgtcatgtattccatgatgcaaagtcgatgttggctattgtctcggagttttaaatagatcgaagattattagaatagaatgtaatggtgtagcttctttgggcatgatgtacaagaacttttaactcaactgatttaagcgaaggatgtatatcttttactccattaaatgtatgttaacgtgccttgcacgtgcacgctaactagtgaatttgaaatgtgccactacataccccttctaaccattataaaaattttcttgaccaaaataccccttctgctttcttcttccttccctcaccataggagtaacttgcttgctgccttgccatggtcgagctcaggctgcccaacttgcttgcttgattacgttgacaacgacgacgttggcagtagcttagttagagctagtagctagctaggcaatgagcgtgaggagcccgtcgctagatgtcgacggcagcggcgctgagagtatatttgggtcgggtggcatcggcgggttcgcggctatagtgttggagcctccgtcggcgtgctcctcattgtctccaccgccgcactcaccatctacttatgtagc

SEQ ID NO: 29719 - DNA, 690 bp, Oryza sativa
cgaaccaccatctcgaccgttggatgtggggtttggcgtggacgttccagatgcatccctaatgacggttggagggcactttggacatttctccttcgccaaccgtcatacctacctctatataaagacatcactccctcacttcactcacacacttccaagcttgagatgaattataagaggctctattgtactatattgtatactagaataggaagagagtagagtagaagaagtcagaagaattccagagttgtcggtaatcttctcctatttcttttattctgattattactctgaattcaatataatattcttcttgagtaatttagatttatcttgtgagaattatctcttggttagttcctaagtaacatacgggattattgttcactataatcaactgaaatatagtgattgttttggtgagttataaacattaaagtagatattaattgtttagacgtggtgtttagtcaattgttatccagtaattgctgcgtatcccacagtatgtgtttgaggtaggtatagaggtggtgacaggcctcaagatcacccaagtcctccctgtccgggtacgtagtagagcgacatctgggaacagcgggttgctagtgcatgaagtattgcattaggattaaagtctgtttctcactagaaaatcctctatatcctggcctatcatct

SEQ ID NO: 29720 - DNA, 1501 bp, Oryza sativa
atatttctctgttaagctcggtaggaacttggcataccactgcacttgatagaggcccaaagagagagcatgacacccagaaccataagggcgacctcccaagggcacctcagcgagccctcgatattcctccttaggacaattcgtgcctgaggacgactagacctcctcgcgtcgtacattgttctcacgcctctcgcgctggtcctcgaggttgacaggggcatccttgtgcagccacagttcgttggggcaagcacaaatatacccatgctcgttccactctcggggcaaaccgcctcgtacaatgccctgatgaggggccggacgagccgcatgcgatcgcgatgagctcagggcagcgtgagacatggacccaaagcgagaagcgaggcctgcggccactgcctggaggtgggtagcacccatcaagtcggtaatcttcttgagccaacagcgctcgggagcaccactgtcagcttgacgttggggaaggcaaagcaacgcttctgtcatgaatagcgcagccttggtgtagtagagtcgaagttgagacaacgccacatcgtaagacagcgcgccttctctcgtcaaatggtcgaggccgccgcagaactagctcctaaacccccttggtgatagagggagtagaggttgcacgctttgcccgcctgtggtgaagatccgcccatcaagtgcaagcagtgcacctcgatggagattgtggagggtgcgatgtggtgtgaatggggtcgataaactcctccgctggcagttctgccactgcatgggagttgaagtcatctcgatggtgacccgccaagcgcgggaacacaaactcataaatgtgcacccctacctagatcgccagctgtcggcgtaggaaacccctatagcaggaaggcaaggtatccccactttgaagtttggccaaggtgttcaggccacttggaagtgtaataccctactccggtgtccttactatatgagatcaagtgtacaaagtggttttacagttgttctaagtattagatcatgaacacttcttcgatgtatgtggctagagcctaactcagtccagagcatgtgaactcaaacttttccaacccttttctcagtggcattggtcttccgtttaggtgctaaggaaataccacagcgcctatgcacgcacacaatggttggggcgagctaattggagttggtaaactggtcttgtcgatgtccttccaaacttgttagctggatgtgacaggctcaccaattggctaacatgtggatcagggtagacgaagtccttgttctagctatcaacggggccaccagtcggtctctaaagccaataaagagggggcccttgggtgtcagcagagtacgtgccacatcacccaccatttctctagggtgacatgggcaaacaaggggtgacatgaacagccacatcccccacatcgtccgtgacctgtccctagtaatcatatcacgccgcatttaacgtgga

SEQ ID NO: 29721 - DNA, 1501 bp, Oryza sativa
ctcatcctaggtccctgtttcggaaatcaaatccgaacatccatctctctctgtagttccttttcactattatatgacttcgtgtgtgattctgcggtaaccacgaatctcgctagatacggattgaacgcccatcaccgactcgccagacaattcctttcttaagcaactccaaaccatgaattattgatctccaccctggcgaaacattaccaccgaagcttgtatctattaaggagatactttgcttttaacactctcacacataagctgtctagacagtctatcagtcgccaagcctgtctagctaatagagcctaattgaacaatctaaaatcctttaagcctaaaccaccagattgtttgggtctcgtgacatgattccaaaatttctaatgggttctccttttccctttatcgactccccacgaacaattacgtgaaattttgttaagatcatcacaaacagaagcaggcagcttgaagagactcatcacatacactggaattgcttgaatggcatttttaagcatgatttccttcctaccgctggacaagaagttctctccccacaacataatcctcttccagattttctcttgcaaactttaaaatttccctttgtgcattcttccttcaggtgtaagaaaccccaaatatttatcctcaaaaccccttctcccaatttgcagggttgttatgatagcctcttggcaatctaaagggcaagaatcaccaaacataatagagcacttagccggattaatgagttatccagttcctgtagcatagttagctagcacctcctttataatctttgcttgtccattctctgcttggaaaaacagaattgtgtcgtctgcaaaaagcagatgtgaaatgcctggcgcactccggcagaccttcaccggagtgatcgctccttgataaattttttcatccatcagtaaagacaacctatcaaccatgaaaagaaaaggaagagaaagggtgacaacggatctccttgccgcaaccctcgagttggagcaaatgtgttcagaagggttccatgaaatttgactgcaaacctcaccgtggatatacacgtcataatccaacttacccaccggtgagcaaaacacaacttgtacattgcctgctccaagaacttccaatctacacgatcataagctttcgatagatccagcttgtaagcgcatgttgccttattaggttgtctattcttctggatgcggtgaaagcattcgaaggcaagaagtgcattgttcgtgatcatccgtcccggcacaaaggcgctttgattcactgaaatcaactcatccagaatcggcctaagtctgttcaccaagcattttgaaacaattttgtagataacattacacaaactaattggcctgaaatctttcaagtcgactggttgatttaccgttggtattagaacaatagaagtctcattgatcccctccggcatatgtcccgattgaaacaactccttcac

SEQ ID NO: 29722 - DNA, 1501 bp, Oryza sativa
  unsure (1)..(1501): unsure at all n locations
atctcatgagcagtttgaagatgagcaacacgatcataatctgaacgagaaataccactcaaaagaatattgcgagctttgcaattttattcaaaagcagttttttcagcatcagtattaatagcttcaggaatcacataaggatgagaaacttttctccaaatatcataatcttcagccataatataagattgcatcctactacaccaatgagaaaaatccgttccatcgaaaacatgaggcttagttgaaaacctagtgggagtagccatggcaaaaactctagatcgattaaaatccaaagaagaaaacaagactctaataccacttgtaggattgaatcacaagaactaagccaaccagaagggggggtgaatggttggtatatccaaaaaccgaaaacttttagtggaaataaaagttaccctcgaattcgacggaagtcggtctgaccgagattgatctgccggtctgaccgagtggatgcccccggactgaccagtatagatcacccggtctgaccgccgatgtcgcctgccgcgcctgttgcagccaccggtttgaccgccgtgctcccgccggtctgaccgccgccttgccgccggtctgaccgccggtgagttgctggttagaccgccgaaacccggtgaaacacaaatcgaagatctctaaaagtagatgacaactttattgcttctctctgtgtttacaaagtgcaccaacagcactccttacaaaaatctcgactaaactcgaaaccctaactaaactagcaactcaattgctctcaaaagcgatacaaaagcgataccgggaagcctcacgctccccctctatttatacatgaggtaggcagccttaagcccgaaccanactatactaagagtcctaaacaccttaggaaaccctctagtacaagacataaactttacataaccaatcatacctaatttggactcctttcaaattcgactccgcatcccatacgcacacaatacctccatcatatgccatatggaatcttcaccaaccacgtgcatcaactctagccttagtatcccgcatgatatctgaccaccacagacatcgtcttaccaccaagccgactcccggtccatcactgcaaatactctcccgaggcatcgagtcacctacatatgaaacaaacaaagaaaccatattccgagaccaagctatccccaacttgactcattgttagcaaacaatagtattacatacgtatagcatccatctagaagccataaccatgaaacaatcacggatatccaaagaaacaacccaaaaccgaaatcgacacagcgtcggctagtcagaccgcgggccggccggtctgaccgctacacatgagccggtctgaccggcaacaaccgcccggtctgaccagtcccaacaaaaccgacaaaacagctatatccaaaaaccacttcgatagtaatctccaaatatcaaaaccaataatcacagatgccaattgttcatc

SEQ ID NO: 29723 - DNA, 1501 bp, Oryza sativa
aggtccttccatctagtatttgtaaatctattttctaaagctgtgtcgaagcaagatttcagcaataataaaagggggtggctgtcaagctaggaaagtggatgggtttggagacaagaaattttatacaggttcaggccttcttattcaagaagtaataccctactcctgtccggggatgattccgccgagtgtgttattaattgtatagactgggaaaaagaatcgccttccaagaggcacacggaccctccttatataagggaaggagtccgctttacaaaatacagtccatatcctaacggaatatgggattatagataaaatacaatcgtaaccgactaagatcccgggtatttccttgacatacaagtttagaacctaacccgagtattcatagagatattccatctatatttggtaccgtatatccgactaaattacaaccgtcatgtcgatatgggatatccataatctccacagtagcccccgagaccttcgtagttgacaaaatagccttctcgaaacaaaaaacagtagtccgagtgcttcaattcaacttgctccagcttgccgagtactaaaaatcaaaaactgtgaagggcgaaaataaaacatggtgcatcgagtagatgcacctaattaggtgtagcccctgactatgtgattagttgaaaaactaaacatatagtcaagaaccgagtggttttatagcgaagcacgcatggtacttagtaagatacccagccgactgcttctcaacttgaatgtatcaaggacaaaaaatacaagaagggccgagtgataaacactcaaaggtccaaaaatagacatgtttgataggaatccgagtaaaaatctcataaaatgacccaccaaacaggatagaaaatcatggtaattaatgagtccaatagcctaggctgtgacccttaccataaccaaaataagcatataacatgctaaaagaatgactattaataaaccagtcatctcaaatcaacccaaacagcttttgcagcctaataaagcttacaaaaaaatggtataacacctttctgtcaggcacctttttatgcgcatcataataattccaaagaattattgaatcgcgttaaaaaggattttaacagcattaggccacaccatcgtaaacacaaattgccaaagcaaaaagtgcctaagtccctagagatcacaacagaccacgctgattatagcattgggctgaagtactgtacaggcccaggcccattagtgctcccgataccctaataataccgaagtaaaaaacgtctcttcgtcttccccgccgagactctcgccattttccccatttcctgctacagtgcaaaactacgccgggcaaactagggttcatcaatccgctccaatccacactcaaaaacttcacgaaatttctccctgcatccaccgctccaattccccatccctttccagccgtatctcgaactaaatcagaccatccatttcacattca

SEQ ID NO: 29724 - DNA, 1501 bp, Oryza sativa
tgcgccataaaccaaaaagaacggcgactggtcggtagcccactaggagtagtgcgtaaagaccaaagtacggacggcagctgatctacccacttgctagcatagggacgtagtcggtcaaaaactcgtgctttgatcccttgcagtatcatgccgttagcgcgctcgacttgtccgttactcatagggtgtgccacggaggcgtaacaaattttaatgccgaagtcttcacaaaagtctttaaatgctccgccagtgaattgagtgccattgtcagtgatgatcctattaggtaccccaaaccgatgcacaatgttgatgaagaaatctctagctttatctgctgtgatcgtgatgaccggtttagcctcaatccacttggagaatttgtcgatagccacaaagagatgcgtgtaaccgccgactgcccttttaaacgggccgaccatgtcaatcccccagaccgcaaatggccaggacaacgggatggtttgcaactcttgggctggcaaatgaatttgtctggcaaaaaattgacaaccttcgcatgtccgcacaatcttgtcagcgtcggacaccgctgtaggccagaaaaaaccttgccggtaagctttgccgacaatggtccgtgcagcggcatggttaccacaaataccaaaatgtatatccttcaacaactatatcccttcttccaaagacacacagcgctgcagtattcctgacagacttttcttgtacagctcagtctcatgaataatataaagtctgctgcgcctggaaatccgctcagcttcatttttgtcttgaggtagttcttgtttgctcaaaaattttataaacggttctctccagtcggcttcgatcatgcttatgccttgaatatccatggcttcgactgtctcttttctgggcacggtcggttcgtaaaggtgttcgacaaacacatctgaaggagctgcttcccgttttgaaccaaaattagccagtctgtcggctgcctcattgttatgtcgaaggacatgggtgagctcgagtccatcgaatttattttccaacttgcgtacctcttgtcgataagcggtcatattatcatctagacatgtcacgcccgaaaattcacaagtaatttccgaacttatttgtgcataaaatcctcgtccaggaatcagccgaggtacacaaactgacaatttaatatacagattcatcaaattaactaaaacgataaatacttacttaagaggcacttagtcctcaccaagaagaaaattgcagcggaaaataaaatctagcgaagctccggctccactcccacaggcagctcaactggggtataagccaaacgtcttctccttcgcaacttgtcttcaactgaggttgattgattattgcaaggtgagcatatgacatactcagcaagccacacagcaaatatgcaagtgcacaaggatatcaaaggaatggcataatattggctcatttgcaaaagcagcatttagca

SEQ ID NO: 29725 - DNA, 1501 bp, Oryza sativa
tgaacatatatactgccagttgaagtgaattgatttaaattgaactttgccttggatgaagctcaccatgtttcactttgtatcaagtttagcatatagaaatttctcataaaatctgaatgaaatttcatgaaacaagtcgaaggtcagaaagttccaggagattcaatcttgatttctaaaatttcccttcaattatatggtgaacctctttacagagtgataattatttcaagatacccaaatgtagagtgaaagtatatcctgatccggtgcaaagtaaaccaggatactctaccttgtgcaaagcacaatttactcaaaatattttgatctgcagtttaatgaatgaagagatatcccaatccaatttatgcttgaatatcacattgatgggtcattatcatgtcccatgccaatagtgaaggtgaagacgacatgttttaattttgcatgaaatattgattgtcttgctacctaagaagtatgagggacgagggcgtggcattggaggagagtgatgcgccagtcgtagtcgcccccttcgaggggagggggggtccgctgctacggcagccggtgtgcagaagtagacaacaacagagatcttctgcttttataggaggataacccttgaaactagtagtactactatacattgctactcttctattgttcagctggcatgttctgcagctgcacaacacaagcactgccgcaggaatagctactgaacgctgatgtgactttgctgctactactgcaaagtcacatcatgaatgtctatacttatctagaaattgcaaggatgaggaccctgccatgtgctggtatattcaaacggccggcatgatggcatgacaataaggttcaggatagcttgacaataaggttctagagcctagctacataatcgagaagcaagaataacgcaggtagacgccggtggaggagcacagacgaagacggaaatccgtaaaaggtcaggtgtagaggcgcgatcgaaagatgaatgaatggagacgcgggattgcgtgtgagatggaagaacgaaatcataggcaggtcacaggcacctacgatgtttccagagcacagtgagcgatgtctagccagaccaaccgtacatcaaacaggacgctcattggcacatggatatgggcaggcacaaattatcacaaatctagcggtttagagaacggtaagtcgattctgaaaatcagcaataataaaagtggtaacgcacgagacttaaaattaaatggataaaaaaaataaggatttagataggttcaaaccgtcttgattaatggcaataccctactcctgtttggctattgtatccaccggatgtatattaatctgatgacctaattatgttatgtccttggagggcttcgtgctctccttatataggttgggggcaaagttacaaagggaaacccaatcggacataacatggatttccttatatagttacatacactactacacaaatgat

SEQ ID NO: 29726 - DNA, 1501 bp, Oryza sativa
caggtccaaaactcgccttcgggtatgctagcgtaccagtcgatttgatcggcagctggaaatagataataaaggactaaatctattcgatcggctgtagatattaacaatatataatttttacatcgatatatatttaaatcaagtgattgggatagatcggtcgctatgccgagacaatataaatcacttagatcgaaatatatattaataaccgaactatatatgtttacagcatagctgatcagatagatctagcatgtatcggctaatactctgatacagttctatgttaagatattaaaacaagcagaatataccaaaccaaagtttaatatacgtagatgcaataatatcttgacataaagggcagatttaacatgtcaacgaagcatatagagcaaatgtagttaaaccagataagatcggctgaaactccaatactaccctaatcggcaactagaaggcaggctagagactgatattctaagcacgacttaatagatcaaactcaagtgatgcagcattaagtatgaaaagaagaacaatatctagacaatcaagccgctggaagtttcatagagtggtggagatcttatataatctaaatcaacatcaaaatctaacctaatcggctgccctctactgacagatgttagtcgattgtaggttagataatgatattgccagagattatgtaagatatatgataactcgatgaattacataaacatgattagagtatcataaagatggaagcactaatcccgagaacgcaagccatcataacaagttttacctcttgttgaagatcgaaaccgatgcagctcaacccgaaagcaaggactcgtcgaaataaaacaaaagcaaaagggtggtgatgcaccgaaattgtattgaacgagtgtgttaactgattacatggggttcgtgtcacaccctgaagtttctttcccaagcctaaatgaaaattataaatcacctagagaaaataccggtgtcaaagcaagacaaaccctaataaattaatgcaaataataatcggaattggcatgtgggatttttcttgagttctatatgtcgaaatatgctaacaagatttttagtggaatttttagagctctagaaataattttaaccaattaaaaatgagcaccagcattatttaatccttggaaattcttttctttttttcttcttcctttgtcccctcctttttcccaaatgggccgccggcccatttcctccacctcccgcgccgttgctgggccgaccgaaggccacagcccatccgctcgcccgagcctccctctccctcgggcgctgacaggtagggcccacctgttaggcccatccctaacctttggccgcccaccgtctgcagccgccgcctcgcaaccgcccgcgcccgccttccccgcgccacgtcggccacacccgcgtgtgcgtccgcccctcccgcacccctcaacccctctcccgctcgcccgcgcccccgaga

SEQ ID NO: 29727 - DNA, 1501 bp, Oryza sativa
acccccaatgtaatgtacctgaggcgaaaggccatggcgcgagatgtgccattttggcgcgcttgctattcttgcacgatctgtactgcaatctgttcggtttggaagttgcctgcagcgagcggcagtttgcatgtcaaaaagctgacgtggaggaggaggagaattaaagggcggttacacttctgtgtgcgtgatacggggacacctagcgtcagttttctgaccggccgtgctactactcctcaggtcattacgcaggccattttactggaaggccctttgatttgtatagatattacctagagatttttttttaagtttcttgtgttttttttagagaagtagagatattacctagagatttttttttaagtttcttgtgttttttttagagaagggtattttttacccggcctctacatacaaccggatatatacggccattgaaatagggaacttagccccgcaaacaactcaatctaaaattcgctccataggagatttgaactcagaaccttggtgtactactcaggtcactgtaaccactaggctacatgccctttcgtaagtttcttgtgtatgcaggcaagtatggtttacgccctctctatttctttaaatctgttatgtgcagctgctgaaactgaaaaggtaataaattatgctttcacccacgatctctttgagtcctcttgagttagcattccaaaaatcatgtgtcctgaaacaaaatggatgataatggaaagcatgaaagctcgagagttcattacatgatcacatatggaatttgaaagcatcgagtctcataatattgtatgtctatatattgtctagggaagtaggttaatgggttgcacatttgcgattattagcttgtaatgatactatctgatcatgcaaggacatccttgaaaaaatctaaactgtcaacgacggtgcgccataaaaaaatatttcaaatgttggtcgcctacagtcagttagtacttcctagttcacttgttgcttgctagctttaatctatcgcaatggattaggtttttcattcacatgtgcatatatcaagcattaacatggtttgaaaaatcgaacttagtgggccaacacatcgtgagaggtttgaaaaatcgaactcagtgggccaacacatcatgagattttaaactaacacatattaggcgagatgccatagttggattggatctgggcctgggcctaagcggatgaattgccaacccctaaaacatgctaaagtagctaggggtttctcatgggccaactatacattcacacgcggccgcttaaagcggttggaccgtctaatgtgtttggcgctactctttatccatatctaaatctacgcattaatgagtcatcctaacatacatataaatctacacacgatacatatctcaaagatagacatcattaaagctacaaataaatgttacaaacaacccaacgtatccgtgaaaatatatcgatatgggagatg

SEQ ID NO: 29728 - DNA, 171 bp, Oryza sativa
gtggctcaattaggactcggctacatgagattcaagctctgatcccagatgagctagccgatgtcctaactccagctgtctatctcgagcagcatcaattcaagctggagaaggccaagctgagactagtcgagcgtcgggagcgcaaagacatcgaggccacaatttagg

SEQ ID NO: 29729 - DNA, 1501 bp, Oryza sativa
atcatcaccttcatattcctcgatccacttgataagtagaccacattggcttcttcaagtttcaacaactagtttcagaactactcaagctgaaagaggaagaggaaaggatgataaagcaatttgcaaagaattctggagaaggaagaaaggaaacattttcacaaaatcatgttttttgaaaattagtccttaaagtttgaccatttggcttatcctacagttgagatggctctgatactaacttgtcacgcccataaattcactagtaatttctgaactaatttgtgtgtcaaatcctcgtccaggaatcagacaaggtacacaaactgacaatttaatatacagattcatcaataatacagcattacatacttacaaaagaaaagagaaaatagcagcggaattacggtctagcgaagctccggcaacactcccacaggcagctcaattggggtataagccaaacgtcttctccttcgcaacttttcttgaactgaggtttgattgtttattgcaaggtgagtacatggaatactccgtaagccacacagcaaatatgcaaatgcacaaggataccaaagaatggcataatatagggctcatttacaaaagcagcatttaacaaacattcgagaattgtaaaatagtagagtaattaatcatcaatattaatcaacactgaacagcacacccatactacacagacccaaccatactaaacaaccatacccggctgtacagatctatctccaaaccaggaatgtatcattccaaaccaggagctaatcaaattattaccagttatagcattatttattatggtgaaaagtgtgagactaatcacgacagacattgttagagccgctcatgaccgcgggcacggctattcgaatagttttactctagccagaggtgtaccactgtacccacaagacacagccccacaacatgttaccatgcgcctcaataccaccacggtacctcggaaaggagctgtgacagtacccctcgcataatacaatccaccacagcacaccgttcctggatcataatcacccccttataaacaaggcatggactccccagcgacccccgtgggcttatctccaccacttctcaatctggtgccccgcaatgaaccatgctatacaaaaggtaaaggcgttgcgcatgctggcttgtggttggcacggttaatgtttcacaaccgaaactcgtgaaccagtccttaattgtcatgagcacaaccatcaaaaccatgtgctcacaacccaccattatcaagttttaatggcatattaattaattaaccaatcacgattaaccattgtgagctacaattaaatatccatcattaagtaatagtaaaacattagttatcccaattgtgtgctaatgtttctaagcatggctaagcaattatgtctaacatctagctgaacaaatatacaaagctcaactagtaaaattataataacacaaggtatcaaggaataga

SEQ ID NO: 29730 - DNA, 1254 bp, Oryza sativa
ctcacaatttacacgcaatatgtgtaattagatttttttatctatatttaatactccatacatgtgtttaaatattcgatgtgacagggtgaaaaatttttgcgtgggaactaaagagagcctcagaatttgtcactgcacctatctgttgtatacttgtatacggacacaggacactgagtatggccgtaaactgtgccgggaaagtagatttgagttggagttattttactgtgatctcgatcaatctctactggtagtatacggtgtgctcttatacatgcttagtacggagtaacaaacgattttacagtaatttgtagcagtcattagtgttcctggtcatttgcgatgcgggagtgcggcaactttgtgcattgttttgcaaaaccgcggtttgatcccgtatagtactccctccgattctataataattgatgttttaaagaaggttaaggtcaaacttttataatttgaccatccataactttaaaaatatttagtataaataaactagaacaacatatgtagttttgtcttctacatatgtactttaaaatatttagtataaataagcaccataataaaagtaaacatgcatttatttattatatactccatccgtttcaaaatgtttgacaccgttgactttttagcatatgtttgaccgttcgtcttatttaaaaaaaattgtgaaatatgtaaaactatatgtttacatgagagtatatttaacaatgaatcaaatgacataaaaagaataaataattacttaaattttttgaataagacgaatggctaaacatgtaccaaaaagtcaacggtgtcaaacattttaaaacggagggagtagtccggatgataagacatcttagaccttcttcggagctagaaactagacactaaaaccttataaaaaatcatataaaattcatatgttctaaatgattatattatcgtggccgtagatcgtgttgagtgtcaaataacgtaactgaaaatgacatggctctaatttgataactctcgaatccttaatcaataaatacgaaatcgtatctatctcggactttcaattaatgatttttattaacttagttctaaaaattaagattaacggttaccaaattgtaactgatatgagctcttctttcactataagaagctatgatttcaaagttagtaaacatatagtataatattaaaattttaatatttatagtatctataatcataatccgtgcaacctgtagg

SEQ ID NO: 29731 - DNA, 1501 bp, Oryza sativa
tagtatttaaagcacaactgtaacagtcggaaaacggcaaagtgcgaaacttgctcggagttgatatacagcaaatccggaacattaccaaatattccagacttggggggcatatgttaacgaccaaatttggtaatatcagcatcggaaaagaggattagattgaagtggagtcgaaggcggagatcgattcgagaacagagcaagaatcggcaggagtccaaatcagctacgattaggatcggctggatccgaatcggactgagtaagttgatatagccgattctgacaatacaacttcgtatacgatatcaggttgaattaaggtgcttcaagatggttgccgcacttggatagagtcctgagaaggcaattgtatctattaattaggatattttatgtaattttcttagagatatgtttagggcaaaagtctgccataaagacttattgtatcttagagtttgttagagatacgagtcatgtttgatatggacatagtttgtaatttttgtgtataaataaaccccgaaccccatgtaatcaattaacacacacgttcaatacaatttcggcgcatcgccacccttttgcttttgttttatttcgacgaattcttgcttttgggttgagctgcatcggtttcgatcttcaacaagaggtaaaacttgttatgatggcttgcattctcgggattagtgcttccatctttatgatactctaatcttgtttatgtaattcatcgagttatgatatatcttacataatctctggcaatatcactatctaacctacaatcggctaacatctgttaatagagggcagccaattaggttagattttgacgttgatttagattatataagatctccaccactctatgaaacttccagcagcttgattgtctacatattgttcttcttttcatacttaatgctgcatcagttgagtttgatctattaagtcgtgcttagaatattagtctctagcctgccttctggttgccgattagggtagaatcggagtttcagccgatcttatctggtttaactatatttgctctatatgcttcgttgacatgttaaatctgctctttatgtcaagatattattgcatctacgtatattaagcttcggtttggtatattctgcttgttttaatatcttaacatagagctgtatcggagtattagccgatacatgctagatctatctgatcggatttgctgtaaacatatatagttctattattaatatatatttcgatctaagtgatttatactgtctcggcatagggactgatctatcccaatcacttgatttaaatatatatcgatataagaattatatattgttaatatgtatagccgatcgaatagatttagtcctttattatctagttccaactgccgattgatttacatatgacatcggctcagagataaatgatatgtcatcggcatctagccgatcagctatcatttataggtttaactgcggtt

SEQ ID NO: 29732 - DNA, 324 bp, Oryza sativa
tgtattgcaatttgcatatatcttatgaattatgtcgatcgtcggttgagaatgtgagacggagaaagaaaaacacaactgatgcaaccgtgagagaaacattggtcaggcctagctagaggaagagatcccatcttttcatttatgattatacttattagccaaaatttaaattttcaaccttaaacttagagttgattttggggggttttttttcatcgcagtttattttccagagtttgcttttcgtttgcaatgttgtttggcttattccctaaataagccaaacgatagccccgcaaatctgctgtaattcacaaaaga

SEQ ID NO: 29733 - DNA, 1501 bp, Oryza sativa
accgtgccaaccacaagccagcatgcgcaacgcctttaccttttgtatagcatggttcattgcggggcaccagattgagaagtggtggagataagcccacgggggtcgctggggagtccatgccttgtttataagggggtgattatgatccaggaacggtgtgctgtggtggattgtattatgcgaggggtactgtcacagctcctttccgaggtaccgtggtggtattgaggcgcatggtaacatgttgtggggctgtgtcttgtgggtacagtggtacacctctggctagagtaaaactattcgaatagccgtgcccgcggtcatgagcggctctaacaatgtctgtcgtgattagtctcacacttttcaccataataaataatgctataactggtaataatttgattagctcctggtttggaatgatacattcctggtttggagatagatctgtacagccgggtatggttgtttagtatggttgggtctgtgtagtatgggtgtgctgttcagtgttgattaatattgatgattaattactctactattttacaattctcgaatgtttgttaaatgctgcttttgtaaatgagccctatattatgccattctttggtatccttgtgcatttgcatatttgctgtgtggcttacggagtattccatgtactcaccttgcaataaacaatcaaacctcagttcaagaaaagttgcgaaggagaagacgtttggcttataccccaattgagctgcctgtgggagtgttgccggagcttcgctagaccgtaattccgctgctattttctcttttcttttgtaagtatgtaatgctgtattattgatgaatctgtatattaaattgtcagtttgtgtaccttgtctgattcctggacgaggatttgacacacaaattagttcagaaattactagtgaatttatgggcgtgacaagttagtatcagagccatctcaactgtaggataagccaaatggtcaaactttaaggactaattttcaaaaaacatgattttgtgaaaatgtttcctttcttccttctccagaattctttgcaaattgctttatcatcctttcctcttcctctttcagcttgagtagttctgaaactagttgttgaaacttgaagaagccaatgtggtctacttatcaagtggatcgaggaatatgaaggtgatgatcgatctgaagtgtccagttgtcaagaaggaatgaagtttggatcctaccttagaacttaaaccgccaaagtgactttgaagtatagttagtagggtagaacgcttttgtttgcttgtgtgtaggtatggttgcattctcatcattgaggaagttcattgatgagtgtgtaattgtactaggttgctcgtttaatcaacttgaacaatataatggtctacacacaccagatcagtgataacctagttaaggtctttatctttagtgtaacccctctccttctatcttctccaaatctgcaacgaa

SEQ ID NO: 29734 - DNA, 1501 bp, Oryza sativa
ttataacccatccttgtatgtatacataattctcctcactttagtctagatttcctcccaacatcggggtttatcacctgcatacaaatatacaccaacacttatggaatttgtgagattaagcatctatcactatgttggatgttttattatctgaactttatgtagatgttggcggtatagaatcgacatttaacagttgccaacaatgtgaagattggaaaaatatatatatgaatttttaagtagatactccctcatgtattttatatacgtatggcctttcgtcttattaaaaaattaattattatttattttgttataaattgatttatcatcaaagattcttcaagcattactttatatatttattttagtttatatttgtttaaataatactatgggattaactatatatttatcgtcaatttttttttaaaaaaatgacagatataaatatagtacaatcgtgatgtaattacatataagttgtatgtaacttttaaaaatcccgaggtaatatgttgccaaatcccctaacacgtgcgtggggtgtacttttctgctacctccctggcatgaattttaaagcaaatagaacggttcaaaattatattatagttacatgctagttatagttacactagaatggtactatatttacagttgtcaaatttttaattatcgacaaatatatagtaaaatagtaagaggaatgattaaaatatgtctaaagttaatggcgtcgtatattaaaaaccggggagagtgtatttaaaaccatatataagaatatatagggataaggaagagatagatatttatcccaagttgacagatgaagctgtagataaacattactatatatcaaatattaattcacataaataaaggaaataaaaacaaaaaaaatattaactcaaggttatacgctgttccgatcaatataataatataatatggtggtttcaaaatatttctagatttgatcacttacattttgatcaaatttattctgctttagtatcatgttgctcactttgcatagtgccagtccatgtttttcttctaatttattagtttccgttttttccgtggagtatatttttttactttgccagagcctacagtaaaaataaaagaaacagaaaaattaatagaaaaataaaaagaataggaataggaaaggtcggtttccatgttttggaattcatctctgatccgctgaggaagtgtgcagggtttacgcctgcttttggtaatcgtcttgatcgttatgatcctttggagttaagactagggttttgtcgtacacctggtctctttcaatcttgggaagtctggaaatcaaagaggaagtttagtccgggtcggtttccttgggatgcaaaagggatatttccaatctcgtttgatctccgctataaagttgtggtattcggcaggccagtaatacaatacaaagttctccaaggttttcccctcctggttgcaatttagg

SEQ ID NO: 29735 - DNA, 1501 bp, Oryza sativa
attgttagatagatgaagatgaatatataacatagccttacgatcccttttcttcttatcatcagaccaatcctgtgtccttttgttatatccagaaagcgcatcatcgaggtcttgttgtgcaagaatggctcgcatcttcacttgccaaagtgagaatcttgtgtcttggtccagaagtggtagatcatatttcaaactcaccatgagaattaatcctgaatttactggtaagaaatttaggtaaaccttgcaaaaacgtgaacctctggtgcactttccgtgtgcacgtagcgaagtatgtagatcaactaggtacacaagcttggtagccatagaaattttcctctggaaaaatcaagctctcggttgatttgtttttttcacctcaggaaccatgcgctggtagagatggccttcttctgctgctgctttaaccctgcgctgcttctgtccgactccgatggcaatttcgacgagaccgacgaacgatatgcgccgccgccaccgcgaatcaaattgatctcccctattggaaaaacatgccggtgactgggattagcagattgatctccaatgctctgataccacttgttataaaaatagatgcacaacggagacatgaatttttatgtggaaaacccttgcgggaaaaaaccatgggcgccgactggcaatgatcactatagaagagttgattacaaacgtaggggaataacaataggaacgtcaccccttctcgtacggcttacaagagtatattaggagataatagaaagacacctaataggatagacatggagtcctactaggaaattaatctgaatatattgtgggcccgaaattcggatcacatatttaacagcagggtcaaggctaccccatctgaagggcccgtaacttgttcttttgggggagctgggagcgctagttcttcgtcttcaaggaggaagcaaggagatcatggggctaaggagatcccggctagagtggatgctcatgatggttttgatgtaagagaaagtgcaggagataagaagatagatgaacaattggctaaacatactcagaacctcaaggtagatacaaagcagaagcaaccgagttcgacacatggggaggaacctgtacttcagggtgaaggggttgtgaaatcaactactgctatatcggaatctgagatgattccaactataaagaacattgaccagcaggtttcctctggcgatgggtcatcagaggatatgattagggataaccgtaaaagaagtcaagtgcaaggggtgcgcagaaggctggccgtgtcaagcaagcgctgctagagtatcagcaaacggtggagagtggtggcaactcctctttagaaccggtgagcgcttctcgggctttgaagcggatcaggaaatcggttgaggggacaggtaggagtgatatggaggcaaccagccctggggctgctggtcaactgacgggacctgtgagagggtttcgtcaggagcaa

SEQ ID NO: 29736 - DNA, 1501 bp, Oryza sativa
gccttctgtgttccaaggaatcaccaaatgataggccaggaatgagggaagtttgtgccaaaattgcatccatcaaacaggaatttgacaaaaccatgtgatacagcgatttgggaaaaatgggagatgcattctatgtacgctcatcaatgttccaaaaaactgtgcactgatcaatgatgtagcttcctgggcatccgcagaaaagcataagccctcattgtacagagaagccaaaaacacttctctaccagcttcttcctggatacctaattctaaaaacatgctaaaccaatgtaaataaagcatagcttttattagactaatagctcctcagaacattgttttttcttgaatatgcaagagagttgcatatcattgcattaatagaagaagaaaggcgtccaaaacacgcctcagaacatagctactttatggttaattgaaaagtgatgaaaacgaacggctgttgtatacgcttaattgagaagaaatccatattcagttgaatatttgagtggtatatacctctcgaatattagttttgctatgggctaattaatgaagagaaatttcttgatatgccttaccacttactttgcttgcccccttgtggaagtgaccttaccttcaatgcctcatctttctttctccttcctcactctgcacgacacctccacattcatggaaaaccatcagttctggcacaggcacaggttgccatcaatgagacatggcgagcacattaccggtcagaggagcgatggcgggaggagcccaaggccatggcgacgacgacgacctggggacagtgttgtcgggggcaagtgggcaacaacctggggcgagggagagatcagatattcagattggccatggcgacgaactcctgggtgctccaggatgctccatcggcgagaaatcgacctggactgcagcgtgcagcaaatggcggctacggcggcgcggttttggccggatccagggaagacgacgtctccgacgagctcttaacttcctttttcacacagacctcagcactgaaacgaacaagactaggagagagatctccgcgggcggatccggcagcggcggcgatgcttttgagaggaggaggtcacccgcggcggtagctcgcggaaggaggttgcgccggcagcagcggcggcgccccacgcggaggtgcacggatccgacggcagcgctcgcgggaggaggtcgcgggcgatggcggcggcgcttgcgggcggactccgacggtaggtggggcgacgcttgccggcgaaactccggcatccggcaacgtcagctcagagcatccccagcagatacggtaaccaatcctccatcccggttttagcgtatagaggccaaaaaacgccctccagcggatacgctaacccacacgccaattttggcggatacgccatagtaggagagagaagcggtaaaaatagcgtatctctctcctcacgccatttcgcccgagcgcctctggatc

SEQ ID NO: 29737 - DNA, 1501 bp, Oryza sativa
gcccccctaacacacggcaaaagagatggaaaccagcgacgtatgacttttcttactaaattccgattaaaatttgcatgcacacaatatttatgggcaccaggatttaaacacgagtgaaaagagttatatatgcatccactattctaccacgacaccaccggttgctaccccgcggtcaacttaattaattaattaattttaaccacacacgaaatctagtaatactcatgtagtccatcaattcttgggccatttggaacacacgaatttcaggcaaaatcgattccaagctgtcaaatgttctttttcttagtgcagaagcaactactgtattggaaccaacataaattagctaaagatataaagaaaacgagatagttatttatttctcaaattggattgatttatggtgccaaacttttataaaatagtaagataagttcaacaacatgcattttacactataaattatctatatttacggataaatacccactagtgcaaaatcgatcatttgtatcgagttccgacacccatctatatcggcagaggccagagggcttggtcatcgataaggcgtgttcgattggcttgtgtggatagaaatttttagcgcacgcaaaatgagaaagcacaatggcatagcacataattaattaaatattaataattataaaattgaaaaatagatttatttgaatttttaaacaacttctacatagaattttttttttgcaaaaaacacattatttaacagtttgaaaagcatgctcatggaaaccaggaaattgaagtttgaagttggaaaaaagaaatgggcctaagtaatcagtgatgtgaaaactcatatgtttcaggcgagcgaccatcaccgttgtcatacatcttaaacgagtttcaatatcaacccgtcatcgatatggttcacccgcgcgagcgagtagattacaacttgtcacggatgactcaattgtgatgggttacaactctaacccgttaaaggtgactggtgaccattgacaaggtactttagagcccgtctcggacgagtcatcggtgatggggttcagttgtaacctgacaatgatgttgctcactcatgacggggttattggctagcttcaggaaattactagccatgcccattacaaaatgatagaaacacagatatattcccagaatccccaaaatatcccgtacatttcatgtacacacattcatttacatactacgtactcacaatcacatgattttcaagtctccgttatttgtaagtctcaagaattggattcctcacataattatattaattctcacattcagtaaaactttaagttgcaagcctcaagaacttacaaaaccgcccatacatcttccaaagagaaaccttcacaatctgcgaattcagttacaatttgaaagaagtaatagaatttgtaaaccaaatgttaccaacatacacagcatgtacacaagaattagaaattgttttacgtac

SEQ ID NO: 29738 - DNA, 1501 bp, Oryza sativa
tagtaatgcttggtaataccaactggtgctaaagatacttaccaaccagtactaaaaatgcctctagagttagttaaaaagaaaacatatctattcaaatcacatgtgtgtagtaggtgggatggtaacacgcatgagggttgaggtgagagatcttgagttcaaatcccacatattttatgacttagtatatatctttagtaccgattccttcaaccgaatcaagaaattcagtctcagtttcttcgtctcggttgctacaaccggattaaataggagtttagtaaagatcatatctctactagtgtgatgaacccacgaacaatatagaaagaaacatattttagcaacatctcctcctagtataacgatggtccagattaggttagcttttttttttttaaggacggagggagtactattttttttattgcttccttccattcactgggaaagcctagaaacaggctggggttacaccgttctgcgtggaactatagatgcccaaatgggccgtccggcccgacatggcccaggcacaaccaggcctgagccgaggtcgggctgggcctacccaggggctgcatccatggcccaggcatgacaacccatcgtgcttctccatacaataagtatatttttccttcctcatctctctagacattgccttataaggctaggttatgtctattttgggtcccgtaattattttttctttgaccgtgtcgtgccggctaaccgtgccaagacatcggcccaactatcaggccaggccggataggtctaacacccggcacaggtataagaccagtagtgccacgccgtgcttgggcctggccaaatggctgtgccatgggccaggtcgtcgggcctcgggcctcatggcaatcgaacctcgtcgctatttcgatgccgttgtcacaatgtcctggttagtcagtctgttggcttctttggaaggttctgaatgacaaacaaaccgtgttgtcgttcctccaaatttgtaccgttttccctcttcttaacaaaaaattgggtgttctaaaaaaaaattgggcggcaaatttgttcgccggcggccggcccgaagcggcgaaaaaagaaaccgagactgttttcccctctgctggacgacgacgacgatttgatcatgtcgaacttccatgtgatgtcatcaacacgtactcacctggctaccttcggtgatcaccatcacaacagcatccagcactttgccgcgccggaatacccatgaagtcgttgggaggtagccgtcagcacccaccctcactttcggcgaattgtccaggcactcatcaggcatttcagctaacaagctgcatatacaccattatatatcatcctcatctgcttattgtaatctacaagcttattatgcacattcgaattgctagctagctcgtcgaagaaaccaaagtgcgagcgatcggctagctgctgcaagaagccttgaccatggaggccagacaccgtgtgatgt

SEQ ID NO: 29739 - DNA, 1501 bp, Oryza sativa
  unsure (1)..(1501): unsure at all n locations
ttgatagggccaaccgtcatccatctactaccaccgtcatcctagctgccaattccaccatagctgtggacaagccaatgggccgactagctcctggtgttaggaggatgaggttgtcgccgtcatcttcaagcccaacattaagtggctgacctccgtctccgtgtacgccgatccctttctatcgccttcaactagttcaaggtcgaaatctcctcccctctcaagtgctttgtcagactcccgcacggtgctgtgcagccactttcctccacatcgatccctccgcatcatgctcctgcagcagcatgctctcctgtctcccacactcccacaagcgaccacttcctcatgctctcctccttctctgttgtgcacctctactccgcatggcactagacgtcggggatggtaggacttcgcaacagccacacctcctgccattctagagcttgagcaggtggtcctcgacggtgcaaagctctaggtgatactgcacgccacggttccaaggggaagactgctctgcacatggcagccacagtggggaaggtataggtttggggggggggggcactggtcgatgcagatgggtgacaatgccacgactaatgattcagtaggaccactcatcccctctcaacgccacatgtgtcatgacgagtgtcctgagccatgtcatggagctgactataagatcaatgtgtgttttgattcttattctgtgatgaacaattggcatctgtgattattggttttgatatttggagattactatcgaagtggtttttggatatagctgttttgtcggttttgttgggactggtcagaccgggcggttgttgccggtcagaccggctcatgtgtagcggtcagaccggccggcccgcggtctgactagccgacgctgtgtcgatttcggttttgggttgtttctttggatatccgtgattgtttcatggttatggcttctagatggatgctatacgtatgtaatactattgtttgctaacaatgagtcaagttggggatagcttggtctcggaatatggtttctttgtttgtttcatatgtaggtgactcgatgcctcgggagagtatttgcagtgatggaccgggagtcggcttggtggtaagacgatgtctgtggtggtcagatatcatgcgggatactaaggctagagttgatgcacgtggttggtgaagattccatatggcatatgatggaggtattgtgtgcgtatgggatgcggagtcgaatttgaaaggagtccaaattaggtatgattggttatgtaaagtttatgtcttgtactagagggtttcctaaggtgtttaggactcttagtatagtntggttcgggcttaaggctgcctacctcatgtataaatagagggggagcgtgaggcttcccggtatcgcttttgtatcgcttttgagagcaattgagttgctagtttagttagggtttcgagtttagtcgagatttttgtaaggagt

SEQ ID NO: 29740 - DNA, 1501 bp, Oryza sativa
ttgtcacgatttccccctttgcaatatcatggtgatacttcggggcatggcgacatgtgtggaatcatgtcttgtgggtacagttgtacgcctctagccagagtaaaactattcgaatagccgtgcccgcggttatgggcgatcaaccagattcaccgtgattagtctcacccctagtttagcttaatgaactagtgtagttcaggtggttggttgggcctgttgcaacgcggtgtagcgttggacagtgattggttaatattgattaattactacaattgtttttactgctttcaactactatttttaaaagcctgctttattgcaaatgaacgattagcctcctttagttatatcctgcatcatttctcctcttctggtatgacttagtcttgctctcaatcttgctctcttttcccccacaccagagctaaagatcttccaagttgaagctgtcttgttagggttggtttcgtcgctgccgtcaagggttgcttgtggagtggagtcgcccgctgcagaagtcaagcttccaagtttagctggttttatcttttccgttgcatttgtaatcttttatatttttgtaagacgtggatctgtatgtcaataattgtcatttgtgtaccctggctggtcctggacagtgatttaatgcacattcagcttagaaattctggttcatgaatttctaggcgtgacaagttggtatcagagccgaccttcaccgtaggacaagccaactggaaacctaagagccctttgaaccccttttcatttgcatatgctctttgcacttggattcgtttcgggaaaatttggggtttatgcctctttggtttgcgaaaaaaatcttagtcattcattcggatcggatctttataattagctcagtctagggttttagtaatattttattcggagtttattcgaaagtcagtcgggaatttatcgggtgatatgcattaggtcgtgtctatgttcaatggggcaattttatgcatattattataactatgcatctattttatgcattaagttattgtttagtcagttgcatttgtttctttatctgggttcacgaaaaatgttctatgcatagaaatcaccatgctcggttattcatttgagtcatttgttgccatgtttaatttggatttgagcatgccttggttgctatcccttgtccatcttaggtgtcaaacctgttcactgatcgcaagcgccgctccgagcttcagagtcactgcctttagcttcgtcgccttcttagttttgtttgcttgctagtttccgtgtttaggtttgttgcttgttggttagtcggcggtcgatatcatgtgtgagtggtatggctaccttaattaggagttgtttgcttccttttcagtgtttcaatcaagattaagataattgcacttaaatttataagaaagattagtttctaagcctcctgtttttcttccttttctcatatttctacccaatcccctctagatgg

SEQ ID NO: 29741 - DNA, 1501 bp, Oryza sativa
ggttcaaattaacctagagctaatttcttaattaatgaatgcaattaataattggaaatggcattgtggaatttctcttgggttccacatgtcataatacattaacaggaattttagtggaattttcagagccttaaaagtaattttaaccaattaaaatcatcaaagtgcaattttaatacccggaaaaataatttttctttttctcttcctcctttttctcttgatgggccgtcgacccatctctctcccgcgcccctccctcttgctgggccggcccaagccgcctcctctcctcccttggggcgccgacaggtggggcccacctatcgatcttcttcctactccaactggccggcaaccgtcgtagaaccgcccacgccgtcgcctttcccgcctctcccacgcccactccgccccgcgcccacgtcaccgcccacctcctccacctctcccgcacgcgtgcgcactcgcttggaggcgggattcgatttgaatcccacccctctctctctctccctccactcccccacgtcgccggcgcaataggggccctcctcagccacgtctgcccttcccgtgcccataaaatccttcccccgagccccctctctcgtttacctcactcgctgcgctcccccgtgcctcctaccgccgccgcaccgcgctcgccaagcttcgccgccgttgccgctctccggccgtgcatcgccgccgctgccgcgccgtgaaaccgccgctgtcacgctcgccagtgccgtccgcacctcggccgccgctcgcttaccgtgcgccgtcgccgtaccgctctccccacacaccgctgcctactgccaccttcattcgccgctagccgccgctagtcctaccgtcacgccactccgtcgccaccatcagcctcgcgaggtcgaggactgcctcgtctgtcacaccctgattttcgttacaggatttataaattatttaataaattattatcagaatttatattaaatgttcattaatttactagtgaagttaaatgtgggaaataaaaatataaagcatggatgtatttaatttttattaaattcttcatggttaattatactctctagaactttctcggatttttcggagctcaattcctaattttaatcatacaaagagaagttcagcaattatttaaatattaaattaatcattaaatggtctgattgtaattttgttaagtactttgagtgtccaagtattttcaggatttttcttgaaattatttgagcataggaagtatttttaacaattcaaagatcatttcattgattaatttaattggaaaagtaataataatcctcctcctcagcttgggccgaatccagcccattccctcctttccctctcccttcctctcagcccggcctaaagtctgtttgacctccctggcactacagtactccatcttcctcctccagacagagccgagccagccgtgctcgtgcacagtgccgccgcctccgccgtc

SEQ ID NO: 29742 - DNA, 1501 bp, Oryza sativa
ataactaattcattgtaactcagtttaatgtggttgaagttgcaaaaattatacaaaataaagatctacatattaaaattatccataaattgaattaaatttatttaattctttttaaatgggctttaattagatttaatcttgtaaaattcataataaattcatatgaagtcagaatgaggccattcaagtctcataattcatctaaaattatgatctacatgtttgtttactttttatgtactgtttatttggtttttattagtctttttcttcgttttgcgtgttagcttgtcgtttccgtcgttgcgaaggttcgcgagtgcgccgaaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgagctttatatattggttcagctagatattagatatgattgcttagccatgcttagaaacattagcacattattgggataacttatgattcactattacttaatgatgatttaatgatagttcacgatggtcaatcgtgattggtaaattaattacttgccaactaaaacttgataatggtgggttgtgagcacatggttttgagagtcgtgctcatgacaattaaggaccgattcgcgagctactgttgtgaaacattaaccatgccaaccacaagccagcgtgggcaacggctttaccttttgtatagcatggttcattgcggagcactagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcatgattagtctcacacctctcacaataattatggatgttatacctggtaataatttgcttagctcctggtttggagttagatctgtacagccgggtatggttgttcaagatggttgggcctgtgcagcatgggtgtgttgttcagtgctgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagt

SEQ ID NO: 29743 - DNA, 1501 bp, Oryza sativa
aaccgtgccaaccacaagccagcatgcgcaacgcctttaccttttgtatagcatggttcattgcggggcaccagattgagaagtggtggagataagcccacgggggtcgctggggagtccatgccttgtttataagggggtgattatgatccaggaacggtgtgctgtggtggattgtattatgcgaggggtactgtcacagctcctttccgaggtaccgtggtggtattgaggcgcatggtaacatgttgtggggctgtgtcttgtgggtacagtggtacacctctggctagagtaaaactattcgaatagccgtgcccgcggtcatgagcggctctaacaatgtctgtcgtgattagtctcacacttttcaccataataaataatgctataactggtaatatttgattagctcctggtttggaatgatacattcctggtttggagatagatctgtacagccgggtatggttgtttagtatggttgggtctgtgtagtatgggtgtgctgttcagtgttgattaatattgatgattaattactctactattttacaattctcgaatgtttgttaaatgctgcttttgtaaatgagccctatattatgccattctttggtatccttgtgcatttgcatatttgctgtgtggcttacggagtattccatgtactcaccttgcaataaacaatcaaacctcagttcaagaaaagttgcgaaggagaagacgtttggcttataccccaattgagctgcctgtgggagtgttgccggagcttcgctagaccgtaattccgctgctattttctcttttcttttgtaagtatgtaatgctgtattattgatgaatctgtatattaaattgtcagtttgtgtaccttgtctgattcctggacgaggatttgacacacaaattagttcagaaattactagtgaatttatgggcgtgacaagttagtatcagagccatctcaactgtaggataagccaaatggtcaaactttaaggactaattttcaaaaaacatgattttgtgaaaatgtttcctttcttccttctccagaattctttgcaaattgctttatcatcctttcctcttcctctttcagcttgagtagttctgaaactagttgttgaaacttgaagaagccaatgtggtctacttatcaagtggatcgaggaatatgaaggtgatgatcgatctgaagtgtccagttgtcaagaaggaatgaagtttggatcctaccttagaacttaaaccgccaaagtgactttgaagtatagttagtagggtagaacgcttttgtttgcttgtgtgtaggtatggttgcattctcatcattgaggaagttcattgatgagtgtgtaattgtactaggttgctcgtttaatcaacttgaacaatataatggtctacacacaccagatcagtgataacctagttaaggtctttatctttagtgtaacccctctccttctatcttctccaaatctgcaacgaa

SEQ ID NO: 29744 - DNA, 1501 bp, Oryza sativa
atccctcaactactgtgaaaattctattatttggtcatattatatttgaagctttcgtcaatttggaaaaagcctggcacctgttgagtcagctagacttgtatccggtgttttggtttagtagacacacattaatggttgtgttatgatgattatgatatggaattttcctttagtgttgatttgcatcaaacaaaaatgaataatcactactggagaaaccatctttaatgggttgtccaaaaaccataatagtctcggttgcttaaaaaaaccagggctaaaaaaatttttagtcgcagttaaaaagggtagcggtattttttctatctcctccctagcgcgtagatcaacaaaaatcaaacagagcaagcgtgtcgatcaattctcaaaaaaaataaagaacaaaaaaaatcagaggcgcccagctcccttatctgttctcctcctccactcctccccatccatctcttcttttcttcctctcctccttctcaactcctcctccagatgcacttctcatttagttttctccttcttctccttctccactcctcccctccccttatctttgacctagctggcaggcgggagggccgcggcggctgcgtcgggggcggccggcgccgggcgggaggccgcggccggcgccggttgggaggcggcggccgacggacaacatgtttttttttcttctcttctctgttctctgtgatgaatgctgacgatgttgtagatgtgaactttttttttctctgttgtctatgatgaatgcttgttgtcctggagatattgtagatgtgaataaatgcaaagaatattgatgctttgatgttgattttattcatttgatttgtgatgatttgggcttttttttattttattcattcgatctatgatgatttgggcgatatgcaaagagtaaaagaacaatgaaaaagaaaaaagaccaaccggataaaaggaaaagaaaaaaaattttttaatcctggttggtaacaccaccggtacagactgttgcacctcccaggatcagcctgatgccgcgcattccaaataaaaacgcaaaataaaagatcatcgggcgcaaccaataaaaaatcgccgcttcattgatttcaatataccaggtactaaatattttcacatatcaaagaacgttgtagttatgttagaactgaaaaaaaatatcggaagaatgggagcataaattaagtgggtcacgttgtatatggagtgtatggtccgatgaacgtgctttgctggatgatggtcttttatattgaatttttacggtataatttattggtagtataaacaatccaatgacgaattagtttcctaccctactgcataaatggttttttcagggcgagaccctctcctttcctttctcactctctcacctcttcttctcactcttctctcctctgcgcagctctcctatctcactctcctcttgcagccagcggtgggcggcgcggccggtagtgggcagcgt

SEQ ID NO: 29745 - DNA, 278 bp, Oryza sativa
tcaccctagaataaacaaaaccccaactagtggtcactctactcatggtaccactagtatgattttaggtagatgcttcgccgcttattaggtaacattaggtggttttacaactctagactttgggatattcatatcacctggacactatggaatggttggattattgtggaattggattcacacctccccctctattcaaaatcctcaaaatggttttaggttgggctcggggtgcatggttttgatagtagcacctcggccatataaggaccggt

SEQ ID NO: 29746 - DNA, 1501 bp, Oryza sativa
tttctcttttcttccctctttttcttccacgtcatcaaatttatttgcatgacaacgaaaagagctcgttattaaccaccattgtacatgccctaagctggaactgacatatatgtatatgcatgtatcgctggttgctgatttggttgagatgggtttaatttaattctattcaatttaattgttgtttgcagggctgtgtattgcgccgtgtagtacgtgagaggatcggagtcggagcagcgagcgagatttgttgaagcaaattaagtagatcgatctcatatcgatcatccttaattaatttatcatggagctggtgctggtgatatcgctgccgctgctggcgctcatcataatcgtcgccatcgtcctctgcgtcatctgccgctagcttagctgattccttcctgcctccgcgatcattttgcatacatgtagtatgtcagtatgtggtgcatcaaatgtgatcattttgccgcccgttgttgttgggcacggtgattgacgacagaaagaattactcccttcatattttaatgtatgacaccattgactttttaaccaacgtttgaccattcgtcttattcaaattttttatacaaatacaagaatatttatgtcatgtttaaagaacatttgatgataaatcaagtcacaataaaataaatgataattacataagttttttaaataagacaaaatgttaaacgtttattaaaaaattaatggtgtcatacattaaaattaaaatacagagggagtactagagaacacatggcttcttgttccttctttggcctggtatggtgtgagtcgttgtgactagtgtgctcccaatccaggctgcctatacatttgtccatttcttcttcttcttcttctttttcttcttcttcttcttcgtttttctgttggttactgatgagttcttttgctaaggtttccaactctactctcttatttttcacgtgtatatgctttccaaactactgatcaatatctttttttttcaaaatttctatgcgaaagttactttagaaaatcgtattaacctattttttattaaaaaaactaatacttaattaatcatatattgatgagtcaatctatccttatatgtatgaaagattagttcacaccactaccaaccgaacgcagctctaacacgaaaggcatcgattccaagcgtgcggtagtctgtccatggtgagtgcgtgagaagatgatcccaacggaagaagagcacataccgtgcacagtacagctcctgtgctgtgtgtacgcctagctgcaggcagcaccggccggcacgtggcacgcggtttttctgggcttttggcctcttccccctaggctcgcacccccaccaccacccgattcccggaacccgccccatttccgcctcctccttcgccttcgcggcttcgcctctctcccacacatgcatcgccatcgccgtcatcgtcaggactaagctctgctctgcatctgcaccacc

SEQ ID NO: 29747 - DNA, 1501 bp, Oryza sativa
gatcatcaccttcatattcctcgatccacttgataagtagaccacattggcttcttcaagtttcaacaactagtttcagaactactcaagctgaaagaggaagaggaaaggatgataaagcaatttgcaaagaattctggagaaggaagaaaggaaacattttcacaaaatcatgttttttgaaaattagtccttaaagtttgaccatttggcttatcctacagttgagatggctctgatactaacttgtcacgcccataaattcactagtaatttctgaactaatttgtgtgtcaaatcctcgtccaggaatcagacaaggtacacaaactgacaatttaatatacagattcatcaataatacagcattacatacttacaaaagaaaagagaaaatagcagcggaattacggtctagcgaagctccggcaacactcccacaggcagctcaattggggtataagccaaacgtcttctccttcgcaacttttcttgaactgaggtttgattgtttattgcaaggtgagtacatggaatactccgtaagccacacagcaaatatgcaaatgcacaaggataccaaagaatggcataatatagggctcatttacaaaagcagcatttaacaaacattcgagaattgtaaaatagtagagtaattaatcatcaatattaatcaacactgaacagcacacccatactacacagacccaaccatactaaacaaccatacccggctgtacagatctatctccaaaccaggaatgtatcattccaaaccaggagctaatcaaatattaccagttatagcattatttattatggtgaaaagtgtgagactaatcacgacagacattgttagagccgctcatgaccgcgggcacggctattcgaatagttttactctagccagaggtgtaccactgtacccacaagacacagccccacaacatgttaccatgcgcctcaataccaccacggtacctcggaaaggagctgtgacagtacccctcgcataatacaatccaccacagcacaccgttcctggatcataatcacccccttataaacaaggcatggactccccagcgacccccgtgggcttatctccaccacttctcaatctggtgccccgcaatgaaccatgctatacaaaaggtaaaggcgttgcgcatgctggcttgtggttggcacggttaatgtttcacaaccgaaactcgtgaaccagtccttaattgtcatgagcacaaccatcaaaaccatgtgctcacaacccaccattatcaagttttaatggcatattaattaattaaccaatcacgattaaccattgtgagctacaattaaatatccatcattaagtaatagtaaaacattagttatcccaattgtgtgctaatgtttctaagcatggctaagcaattatgtctaacatctagctgaacaaatatacaaagctcaactagtaaaattataataacacaaggtatcaaggaataga

SEQ ID NO: 29748 - DNA, 1501 bp, Oryza sativa
tcctacataaatcctttgattcaaaggggcccttagctataaatctggacacataattatctagatttatagctaaaattgtttatattctgggacggagagagttactatgatatgccagcagccagctgcagctagcctccgtgggttgtgtcacgaatgtaccgcagtaagaacgatacgtacgagtgcgggccaatttttggtcatggaggagtccatggattaataatgatctgagggaggcttgctggctgcctcctctctcgatcgcgtcatgcaacacgtgcagcgccagtactaatctgtaccatggcgcatacatacacttttgttaattcaaaggatccgctagggatcaaaacgaaaagaattgcaaaattttgccgtaaaagattatggctatacgtttttcttgttttttttttgagaaaatggttatgcatctttagctcttcgacacatgattcaagttgttttgggtccagatgtgaaatcaaggtgtttccaggttgtgaaatcattgtcatgattaatatttgtgatgaacaattggctatacaaatgatttaatcaaataattggtttgagagtttgtgtgaatgttggtgtgagtgcgtgtgactaatgtgggtcaggttgtgatatctgtgctcagaaacggttgttttgtctaattgtgtgcaggtgacttgaggtcagccttgatcaatggtgaggaccgggactatgctcagggagaagcagaggtctattgcggtcgggataccatgtgagaaggtgactagagtctggattcttggaggtcaacttcggtcaacggtgggaatcgggactagactcagggaggagttgaggtccagacggtcaaggataccgggtaacaaagttggatacaagatggcatacggtggatggaaatcgtgtgggagagatctttgcaacgggcttcacgaggtgtgcgtgcaagtgccggtgttcgcgaagggaattgtaaagttggagtagtatatggtgctacagtacacgaggtactgtagcgtgcaggtatgcatgcatgtacggtgctgtacatgtatgtgtgatcgatacatgcatggtgaagcatgtatgtgtgcatgactggttggccgagcagcaggagagcggctcggtgggtttcggtggctgttggcggcatgccaagtcggcccaggagaagcaagggcccagctggcagcgagtcggagacggtcacgcgtggacgtcagcttgggagcgaatccgttttggatttctggtgcggccggttgtttgctgcacgtttggaaattgtaaaacgtatggaaactgaaggatggagtcctattgtgtataggagttctacacctactttgagtaggggtttttgtggtataaatagaaagggagcgtgaggcttctgtatcgctttagagagcaatagagttgagttttggtttagggtttagagtttagtcgaaatttttgtaaggagtgctgt

SEQ ID NO: 29749 - DNA, 618 bp, Oryza sativa
tttgttttatcgtgatttaaaaattgttccaaattttcgaatcaatagtagttctttcatgatttaaaagtatcaaaatttgaaagtaattaatatatatcgctacacttatctgaagtatcagttatttctatgatttaataattatgaatttaggaattaactggtacctatttgtgcttgtgttggtctcctaatttagtgtactacgctagatgcatgaattttagtggcacttttagatcatcggtgtgttgtaaaagtggcccacatcattacagtagacataattcagaccaaatagtccttaaaactgacaaaaggcttaactcctagttagaaatcatgcaatctaactcctaattagtcagctaaattgaattttttatgaaatcatacattcactgaaacaaatgtatttggatgaagcatatatggagcagatttgttagtgatgtatgtttaacttatcttgtcatcttggtaattgggcactttctagaagcttccacgttaatcagattaatctggccatttattaaatagatcgtaaaatcatgaccatagattaaatattataaccatggacttttaattaaaggcccaacaagagaaaca

SEQ ID NO: 29750 - DNA, 183 bp, Oryza sativa
gggaggggggcggacaccgcagtgccggcgtgtcgccgccttgctccacgtcccgccgccctcgccgctcaccacccgctccccgcgtggcgtgtgcgcgccgaccacccgccacagcttgacctactcccgacggcccgagagagagagggggcaagagagagacatgtgatagagtatata

SEQ ID NO: 29751 - DNA, 1501 bp, Oryza sativa
ggtccaaaactcgccttcgggtatgctagcgtaccagtcgatttgatcggcagctggaaatagataataaaggactaaatctattcgatcggctgtagatattaacaatatataatttttacatcgatatatatttaaatcaagtgattgggatagatcggtcgctatgccgagacaatataaatcacttagatcgaaatatatattaataaccgaactatatatgtttacagcatagctgatcagatagatctagcatgtatcggctaatactctgatacagttctatgttaagatattaaaacaagcagaatataccaaaccaaagtttaatatacgtagatgcaataatatcttgacataaagggcagatttaacatgtcaacgaagcatatagagcaaatgtagttaaaccagataagatcggctgaaactccaatactaccctaatcggcaactagaaggcaggctagagactgatattctaagcacgacttaatagatcaaactcaagtgatgcagcattaagtatgaaaagaagaacaatatctagacaatcaagccgctggaagtttcatagagtggtggagatcttatataatctaaatcaacatcaaaatctaacctaatcggctgccctctactgacagatgttagtcgattgtaggttagataatgatattgccagagattatgtaagatatatgataactcgatgaattacataaacatgattagagtatcataaagatggaagcactaatcccgagaacgcaagccatcataacaagttttacctcttgttgaagatcgaaaccgatgcagctcaacccgaaagcaaggactcgtcgaaataaaacaaaagcaaaagggtggtgatgcaccgaaattgtattgaacgagtgtgttaactgattacatggggttcgtgtcacaccctgaagtttctttcccaagcctaaatgaaaattataaatcacctagagaaaataccggtgtcaaagcaagacaaaccctaataaattaatgcaaataataatcggaattggcatgtgggatttttcttgagttctatatgtcgaaatatgctaacaagatttttagtggaatttttagagctctagaaataattttaaccaattaaaaatgagcaccagcattatttaatccttggaaattcttttctttttttcttcttcctttgtcccctcctttttcccaaatgggccgccggcccatttcctccacctcccgcgccgttgctgggccgaccgaaggccacagcccatccgctcgcccgagcctcccctctccctcgggcgctgacaggtagggcccacctgttaggcccatccctaacctttggccgcccaccgtctgcagccgccgcctcgcaaccgcccgcgcccgccttccccgcgccacgtcggccacacccgcgtgtgcgtccgcccctcccgcacccctcaaccccctctcccgctcgcccgcgcccccgaga

SEQ ID NO: 29752 - DNA, 1501 bp, Oryza sativa
ggtatgttttctaagacgaactttaatactctctgttttaaattattataattttaattttattctaagtcaaatattttaccattaatttgcatacatatataatttaacctcttaagatttatggtttagatttacataccatatataattaacatgccgttaaaccgcataaatttatgcccaagaataaatacataaatttctaaaattattagtgaaagttagcaaaattttgatttagaacaaaccgtgaacgacaagtaattgagtaagtaacattccttttcagaatttctaggtttttaagtattttttaactttataatatatttaattatttcatttgtgccctagaataatcgacaaacactctatttcgtcccccaacgcatcattcataaaaactttataacattcttcatccgacacattaaaaaacaaatgcatactacaaattctaaaccatcctaggtttgtgggagtacctaactagaaacatcatttagattgcataagttcaaaacaaccacgcacgaaccaaatttcagtggagattatctagcagtctgttcgggtagcttctgtaaaaaaaaaaaaacaaaaagaaaatcaagcggacacaatataatgtgtttagttcatgcaaaaattgaaaatttgattgaaattgaaatgatgcgatgaaaatattgaaagtttgtgtgtagaaaagttttaatgtgataaaaaaattgaaagtttgaagaaagaaaaaagttaagaactaaaccaggcaatctgaattataaattcagaaacattctgtaaaaaaaaaaaaccacaaccaaaccactcggtctcatctcatcagtcgtcactgatccgcagactccgcgcccgtgcagcaccccgagcccgagccccaccgacaacagagtagaatccgacccacccactgacacgtggtccccacccaccccacctgtccccacccgtcatcatcactctcgccgcgctgtccgcttctcgcgccgccgcacccgatcccgacctgacgtgtgggcccgtctccactgcactaccagcagcagccgcagcagcgaagcgaagcgagcgacccctctctcctctaagccaagcaaaaacacaaggagaactcgccataattccaatccactgtgccctagctcgcccacctcttcctcccccgcgagagagagaggagagagaattcgatctcttctttctccctttttttctgttcggtttttgcggtgtgggagggggcgtggatttgatgtagattattagggactaccaccaccaccgtttctgttgcagttgcggaattggaggattgtgtgtttggtttcttgatctgaggaggaagaagacatgagaggtagtatcgtttgtgtttctttgtgatgatttcgattcagtttgcgttttgtgttttgtttttttgatttagttttggattggcaaggtttggtgggtgagcggtgatcgcatttgg

SEQ ID NO: 29753 - DNA, 478 bp, Oryza sativa
actatagggcgaattcgagctcggtacccctacgatgattcagaccgaactggcaactcgaccctggttcccagctcgtcccaagctaacccaggccaactatttccacatttcagtggttaaccaggttttaaaaataaaaacactaacttgggtacattgctcggcttgcctataaccgagggcgcggctattcgaataggttatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccctgggacaggtaggcaggactgagcccctatcagcaggacaccggccctatgccatgacatctcgactaccgggccgcagctcgtgtagccttcatttgtcctaga

SEQ ID NO: 29754 - DNA, 1501 bp, Oryza sativa
accctttctatattatagtattctcacatttgaaataaacaaatagaactggatgtgacatacttcacccgtttcataatgtaagactttctagcattgcccacattcatatatatgttaatgaatttagtcacacatatatataaatgtgggcaatgctagaaaatcttataacctgaaacagtggtagtatattagtataagtagtagtttttatttattttaagatggtaatccatccgtactacgatataagaaattttacttagatggaattatgatgctacgaatatccttagtattagaatgtgtccaattaaaccaaaacttcttatatcttgtggaacggaaggagcactagattaattgttttaaattgtttattaattttatttcttaaaaaatcaagtgatttttatagttattgagataatctgcgatgataataatcttatcaaacgttaggcagcgctcgctagctttcgccaactcctcctcctcatcacgtcgctacacaggctagtgtagctcgcagcgtgtacgagctgagctgagctagccccctgccactctctctctctcgctgacgctccctggcctttaaagctgtcgccttttgcctccccctgctactgctgctcctcctcctcctcctctctctctctctctctctctcccgtgctgtgattgctgcctcggggtgggcggtgcgagctacatacagcacaccggcggcggcggcggcggcggcgaggctccgggagaggtccagctaggcgtggtgggtggtggtttcttgatttcttgtgtttgggctgtgtcggcggcgggtgatggcggcggcggctccgtgcgccggagcgcggggcggctaggggcggctgtttctctgaggcgtctctcccccggcggcggcggtggaggtatgttgtgagcttctcttctgctgctgttcgtcgcttttggggttttccggggatggttctccgctgttcatatcctccttgccattacggtttttctaacaattttttttcatgattttttgagcctttggttcatccaaagcttcaaaccccgattcttggtagattattaattttactcgatttaaaaaccgtgctcttcgcctccaatttcgcgactcccgcggcggcggcgtctcatcgccggcatttcgcgtgctttgctctgcagaatcggcgcgtcctttgcgtgcttttccacgccttgttgttcaagggagaggagaggagaggaagaggcaagcttgcgcaatcgcacaaccgcctgtcgatttctctctttcttttctctctttctttctctttctttttttcatttccccctttcacatgtcaggttatttttttttctcctcgtctcctgacgatttcgcttttgctcgaaatctcccaggtttgttgttgttgtgttgaaggcggagaagaggggaggctttggtggtggtggaggaggaggatggcggcggcggtggcga

SEQ ID NO: 29755 - DNA, 1501 bp, Oryza sativa
tacacgaggtggtgggctaatattcacgttttttttacattgcttgcatattgagttataaaaacgcaacaaaattataaataacatgtcatgtttgcatgagatttaatataactagataataattgttaataggtgataatgttacacgtttgtatgttgaactttaggagttagtggatacatatcaactatatagaaaatatagatatgctattttggtacctgcaagggaatttagatgatctattactgtgattatgctagtttggatcatgcaattaacctatatcctttagttgttgtattagtcgtggttgaagtctcgtgaaaaaaaaatagtcgtgattgaagtcccttggtggttttttccatggtccttcgaaccaatactcatgattctttccctttaagcgtctgatatggacaacagcttaaatttgcagaactaacacaatacttgccttgacatttttctggaaattcacagccccattgaatatagttgagtatatgtagtttccttcaattgtcttgttattatgccttcgtaaatcttgactgctatagcctactactactatatattatccaatactataattttctaatctttttgtttgccagaatcaaaggcgcatcaatatgcaattggtaggctgctgtgcttgaagtagcagattcagaaccagatgagagttgtcatcatggtttgtagagtaagctttctttgatgattaatttcaaatgatgaaatgctagctactatccttatgctgactctctatgacttccttgattgtaggatcgtgaccataactacaagtgatggttatcgtgtctcgtcgtagaatgtattacctacccagctaccctttctcaagataaagtccagtaaagtcgatcgtctggtggtgtgagctgctacaaggatgaagccgacccaaggccttgactttaaccagaaagctagtcccagactgcatccagaagaacagcaaataggggccccagctctgtttttttccatcctttttcttttcttgtgaactgtgatgtgtaatgtgtttgatttcgtttgtgctccaccataagagaaaggggcaattgcaaatttatcactgctttgaatcgttattgtaagactgctactagaaaattacaaaaaataccactgaaactatcattcaagtggcatccttgtaaaattaaaaaaatcggtggcaaatttacaaatgcatctaagataaactaagagaaacgctgctagcacttccatttcatgatgtactgtcacgtcgtgatcttttttggctttccgttcttttcgtctgtttacgaaaattcacatttggtttgttcgtctaattagcttaatgaaaatttcgttaaatcaaaagagtttaatgtaatctctactgcttaaaaaaattgtagtggtgatgatgaagccaacgtagacacgcgatccaacataaaaacgtagacacgtgaccgtaga

SEQ ID NO: 29756 - DNA, 549 bp, Oryza sativa
tcaaaaccgccgagagagttaaattgcaccggttttaagagtttgggggtcgagatacctggtttcgtggtttagaatcatgaattagatttcgattacttttaagggtcacaaagcgaacttattccaattctggttgatccaacaaagctacagctttgacataagctgatgtcatgcatacaatgattacaatagacaatatctgagagtttagataatcatacctatttaggctagaattatatttcctgttacatacgaaagatgacaactgacaagggaacaagctcatacggccctgtttagttttaaagtttttttttccaaactttcaactttccatcgcatcaaatttttcatacacacaacttttcagtcacatcgttccaatttcaaccaaacttctaaacttcagtgtgaactaaacacaaccgtagtagattcagcaatcagcatatgctatctgctctagaacattgtttttttctcattagcgctttttttgggagtataggtgtttctttattcttcctattaaactttacc

SEQ ID NO: 29757 - DNA, 1501 bp, Oryza sativa
tgagtggttgacaatttagcggttttcactttgatgattactactgtaatgatgtttgtattttcaaattagctattgagatatgggaattttgagaaaatccaaggagtattttcaggcatggagaatttaagaaaagtaacactaaccatgatttattaaggaaattttatttcccttatttacttcacttgtcaataaatttacacatgaatataaattctaaaaatggtttattagataagtttaaatccttgaaaaaaaatcaaggcgtgacaatcgcccgcacgagggacggctaggccgggctcgggttcattggcccaatgttatttttgggctcactgtgcttggatgagtgatgcagcgagtaggaaacggagaaagcggtatctctctccacgtctctgcaaaagagaatttaattatttgccacccttgccaattcttcaaatgccacatttgcctttattcataaatttttgccaatggaaaagcatccatagtcccttgccacttttcccacgtgacatgacatgtccgactaccatcatgaaagctagaggagaaatatccttcttgcctctagtcgtaccacctcttccttctatctcctattgacgctcatggactaagacgtagtgcttgtcaaattcacctcactgtcaccctccttctccagtgcaccccccttggccaagtgacaccatccaacagcatggcctgggcagcatcgaggccatccttcatcatatttctcacacccatgatacaacctcatctattgccctggcaaagcatagcgtagccctagccatagacgatggcggacttgagcatctggagtgccttggcggatgcgtcgggatccaccttcgtgaactgaatgatttgacaacttgttggccacctccctttcctcgccaacgatattggtgaccaagaactcgaccatcctggtagcatcgattctctccgccagccactccctcccagcgaaacgggtgatctcagcaccgagctttgtagctcgaagtgagcacatgtgtgcaataaatataatggtgtaattgaatctcaacatatgaataattaactaggagaaagaaccatttgaagattactactccctccctttcagactataagtcattttgactttggtcaaagttaaactgctctaagtttaactaagtttgtagaaaataataataatatttttaacccaagaaaaatatattatgaaaatatattcaattatagatttaaatgaactaatttggtgttgtaaatattaatatatttatctataaaaactagcaaaatacccgtgcgttgcaccgggtattgaagggtggctgaagtttgatatttacgatttatccaaagcacacgagatgattataagcatcggcgatatgaacaattataaaaagattatgtttgtttttgataattaattctttatatttgcacgatgtggatgacgcttcttacgtgt

SEQ ID NO: 29758 - DNA, 193 bp, Oryza sativa
aaatgagctctgatgaaggaggcggctcatagaattcgccccgaggagcagacagctcaaaaaaggttgctccatggtcgagaagagtttgacaggaatacttctctaggatagcaggggtgaagaaatgatcggcaaccgttccccggcaacggcgccagaaatgcttgttggtatttgattcggttacaga

SEQ ID NO: 29759 - DNA, 893 bp, Oryza sativa
ctgtagatctgtttgtctgatatccttgtaggcttctaatcattcaaaatttgctagcattgttaagactttaagacatacagtgtcacaccagttgaattcaagtgtacacattgatctaacactgaactaaagtactgcttactgcctaacaaacagtacttggcaaacgatgcctactgtgtaatgagaaagataaaagaaaatgtcttgcaggtagtgacgtttttttttaagtaaatttcacaaaactatatgtattttgtacaatttatcataaaactaaagatttaagagctttcacaaaactacagatttagtgtctccgtttattataaaattataggtactttgtacaatctatctcaaaactatagatttaagaatttatttcacaaaactatagatttcgtgtatttgtttatcacaaaactacacattcagtgtcttcatttatcacgaaactacagatttattgtctctattatcacaaaactacatgtttttaacaatgctcaaacttgtagttttgtgataatgaagacactaaacttgtagttttgtgataaatgaagatattaaatatgtagttttattataaaagtacttaaatctgtagtttgtgatatattgtgcaaagtacctgtagttttgtgataaatgaagccactgaatctttaattttgtggaaaagttcttaaatatgtagttttataatagactgtacaaaatatttgcagttttatgaaatttactctcttttttttatattaaagtaaatgacaaggataaaagaaaatatcttgcacgtagtaacgttatttttttataggaaaaagtacgaattaccccctaaactatcgtggttgatcgaattaccccctaaactcgaa

SEQ ID NO: 29760 - DNA, 713 bp, Oryza sativa
accccctggttcggccgaaccaccagctccaccgttggatgtggggttttgcgtggacgtcccagatgcatccctgatggcggttggagggcacttcggacatttccccttcgccaaccgtcatacctacccctacataaagacatcactccctcacttcacacacacacttccaagcttgagctgaattataagaggctctattgtactatattgtatactagaatattaagagagtagtgtagaaggagtcggaagaattccggagttgtcagtaatcttctcctatttcttttattctgtttattactctgaattcattataatattcttcttgagtaatttagatttatcgtgtgagaattatctcttggttagttcctaaatagcatacgggattattgttcactataatcaactaaaatatagtgattgctttggtgagttatgaacactaaaatagatattaattgcttagacgtggtgtttaggtaattattatctaataattgatgcatatcccacagtacgtttgacgtgggtgtagaggttttgacagccctcgagatcacttaagtcctccctgtccgggtacgtagtagagggacatctgggaacagtgggttgctagtgcctgaagtattgcgttaggattaaaattaagctttccctagacactgtttctcactagtaaatcatctctatcctggcct

SEQ ID NO: 29761 - DNA, 174 bp, Oryza sativa
caacacaataacaccctcatcagcgcagcccagcaacagatcagagaccgatttacaagctctactatgcttcaagcaaagcataaccgaccccaccggtgctttcatctcatggaacacgtcagtccatttctgcagatggaatggtgtcagatgtggcacgacatctccagc

SEQ ID NO: 29762 - DNA, 250 bp, Oryza sativa
gtgactgggacaaaccctgataatctgtttccactcagatctagcttattcaggtttgcgatttgactcaaggattctggaattggtcctgataaattgttttgtcctagcaatatggaacttagagatgaaatatttgctagagatggtggtattcttccagaaagcaagtttccattaaggtcaagaaatcgaagagtccccatgttacgaggaagtggaattttgccaacaaaagaattcgtttgta

SEQ ID NO: 29763 - DNA, 1501 bp, Oryza sativa
ggccaaattcaaaaccgttcatatttgacaataatccaaatccagagcatcacaaatacataatattggcatcaatccaaattcaacattgacatcatcaacagaacagattaacaacacacatatcctaataaacatctttacaaacaagaacacacaagaaaacacagtagggggaggggagggcagtgctgccgccgccgcttcccctatgctgtggcgccgcccatcggcctcctctgtcaccgagcacggccggcagctttgtcgtcgtcgttgtcaccgcggtcgtggtcgtcgttgtcagatccgccgccgcccgcgtgctccccgcggtgcatgcacatccgccgcccgccgccatggcaggcctcctctgtcaccgagcacggccggcagcgtcgtcgtcgccgcggtcatggtcgtcgtcgtcagattcgccgccgcccgcgtgctacccgcgccgcgtgcacatccgccgcccgccgccgtggcaggcctcctctgtcacctagcacggcctgcagcgtcgtcgtcgtcgtcgccgcggtcgtggtcgtcgtcgtcagatctgccaccgcccgcgtgcacacctaccgcccgccgtgtcgtcagctccaccgcgctgtgtgctcccctcggttgtgacgccgacggcggcctcctcccctcggatagatctgggagaggggtgaggaggggatgggagggcagggcggcatggggagccgccagtcaccacctccaaagccgccgccgccggtcaccgccaccagggccgccgccgccgttgctggtggggaggccgggagggaggaggagagtgagaaggagagaagagaagtggataagaagacgagagaaggtgaagaggatgaggtatgtgggtggttttaatatgtgacaggtatttttgggtgttttccctagcggtttcatttgttggccgccagcaaaaatttgaccgccaatgaagattatctatttttgctggcggcgaacctaagtgaccgctagcaaaaatagacatattttcgctggcgggcggtgccccccaccccctcgttacgactttactggcggttttcacatttttccgccagcaaaaataataggccaacgccataaaaaatcgtttttctagtagtgcgcgcgccaccgcccatcgccgtgccggctctacagctatctccgtccatccgattctcgctgacgaccgacgaatgccgtcgcgtgtcgctaacgactgccatcgccagtccttccactctcgctgtgccgactcctcgccacgacttgcatcgctcctggccaacgaccgccctaaccgctggggcttagccgccgatcaccgtcgccgccttaaccgcccgtggacctggccggtaaggcaccgcacgcacggcgccgtctgccagacgccatctcgtgtccctcctcgccaatgccatgccgccacggcaccgcgccgtcaccaacaccgtgccgtcgcgccgccacc

SEQ ID NO: 29764 - DNA, 240 bp, Oryza sativa
cagtaccccaaaagtgtcactcagcaagttttatggcattagtcaagcatgaccccaccatatgctaacaaaaacctgcatctgtggctatacctttatagctagatatcttggagttttgatgatgttatcatgttgatatcatttctagaagaatgcttatgtactgcatccctcacctgttatcatttgtcatgaggttcttctctgttaacatttttcctgattttcttctgtagg

SEQ ID NO: 29765 - DNA, 1094 bp, Oryza sativa
tttttttttccgattcacctagatgcaccttttatactggtagaatttacaccaaatcatatttttcattacgttaaggttagaatattatttgtttcaccataagataaaaatacagataagttgagttgctgatattaatctagtgccaaaaaaaatgattgatggaaaagaaaaaaaatagtcatttggcaaatagactgtcaagtcagttttgttatttatgagtttcttgattactttcctcttttattttgatgaacaatgttataggaatatgaaaaatttcaaatacccatctatacctaggataaaagtctgtctaacacccttaacttttaaaccagacattgaacccttaaactttacaataaagtttatataaccccctaagatggtttttgcatagtggtttttatctaatttatatataagttggttgagtttgatcatgtgacatatacataacacacacgtatatatacctaaatatttctttttacctgttgttagtcctcacatacaggtaccaacacaataatagtaaattatcactgtataagtataaattgatgacttacaattgatgatatccaaatatattatattagttattcaaagttattaatttaacctttaaaaatatgaaaaaaaaacaccatctaaaaccaccttagggaatggtattacaaaattcagggggtggatatccggttctaaactttatggtgatagacggacttccatctaaaatttagaggagtatttgtactttttcattaggaatatggtccatatggaccttgtatgttttgatccaatgccgattagtagcgttgctaaagttgcgtttcagcatttgtaccattaattgcactgttcaataacctttattggtgctggttccaaacccccaaaatcggcatcaatttagtggcactatgagggtagtcattggttctggttctaaaaccggcaccaactaccttactacccctcattggtgccggttctaagatgcgaaaaagatacagaaaaatatttcacattttattaggcacctaccacactcacacttcacttctcattttttt

SEQ ID NO: 29766 - DNA, 1501 bp, Oryza sativa
gtctggacaaaaccgttgaagtcagatgatttcactacttaaaaaataatttagacgagaccttgttaggttgtagatggaccataactacccgtatctgcaaaaatcgagcaggcatttttgcatacatcttcttaagaggatcatatgcaattaaaaaaaaagcgattttcacatgcggaccttttaaggggttgcatgcaaaaataaactcattttttacgtgcagacaacttaagaggtccgtatgggaaaatcaatctttccatatgagcctcttaacgtatgggcctcttaacgagccgtatgtgaaaatcgatttttacacaacaaaggtttctcattttaatctttgactaaaacttgtaactagtctttctccctcatactaacttaaaatgtgttgattctttttcctaaatatttctaaaatcatgttctatcatgttattgtattcttgttgctattattttggccgtcttctattgtgaatttgttttatcaattaaaaatttgaatttcaaaaaaaatggaaacttcaaataatattttgaattagtaaataatttcagttgaaaaagtcatgaacataaaagttgtagaactcatcaagatatacaacttttattttggtcatttgttcatccaacaaaatgacagtaacattgtttataaaatttgcatatctctcttatagattataaaatcatacgagagatatgtaaaatttgtgaaaattttactatcactttgtcggatgaagaaatggccaaaataaaagttatagatcttgatgagttatacaactttgttgttgatgactttttcagttgaaatcatttaatatttgaaaatgttgtttgaagttgtcatattttgaaattaaaattcaaattgttcaaacaaagtcatatagaaaaaatgaccaaaacaaaagttgtagatcttgatgtgttatacaactttgttattgataatttttacatttaaaattatttactacctgaaaaattatttgaatttcttatattttaaattcaaattttaactagtttaatcaaactcggatggagaaatgagcaattttcaaaattggtagatcttaatgagttctacaactttgtttttgataacttttcacataagttcatttagtatcataaaattcgaatattcgatttgaagttatcattttttcaaattaatttttaatgactattttcacatgcggtcctcttaaagagctgcatgtaaaactctatttttgcatgcagacatttaggtggtttgcatatagaaatgctcactcttttttctcccctcctctttctttccctcctcaccacttcaaaattttcatccttatcccctctctctctcgcacctcctcatccttaccttactttctcacctcatcctctctctcactttctctcctctcctctctctcacagcagcgggcgcggctcagcaagtggcaggtgacagtgggcggtggtg

SEQ ID NO: 29767 - DNA, 1501 bp, Oryza sativa
acactaccaaggcagcaggttgtgcaaccagttcagcaaacacctccaatccaacatgttgtgcaactagttcagccaaacacctccaatccaacaggttgtgcaaccagttcagcagacgccaccaagacgacaggtcttgcagctgattcagcagacactgttgaggcaacaggttgtccagccgattcagcagcaaggtccgatgaatgcatcggctgggtttgcaacacctggtggtcaacccatgcagcatgccgcaaatcaggttgtcccagaacacttggttcatcatgtgcagccagatggcacggttgttcctcaagttattcctgaacatttggtgtgcaatattcagccagaccttcaaaattaccaggggggcaacttgaattatcaatatcacccaccatcacctcatgttcagtaccagcaagcaggatcggctcagccccaatttgttcctcaatacaatcaatttgagcctatgccacaacaacttcaaggaacacctcaacagcggccatgggccgatttgattgtagatgtcatgaaggagcagttcgggcttaggccgaaagacgctggaaacctatatcgacagccatatcctgaatagtttgagagagttcctctgcctaaccgatttaaagtttcagatttttcaaagttctcagggcaagatagtacatcaacttatgagcacattagccgatttttagctcaatgcggtgaagcatcggctgtagatgccttgagggttcggttattccggttgtctttggctggatcggcctttacttggttttcttctttaccgtatggatcaattaatagttgggctaatttagaaaagcagtttcatagctatttctatagtgggattcatgagatgaaattgtctgatctaacatcgatcaagcaaaagcatgatgaaccagtgcatgagtatattcagagattcagggagatgggaaataagtgttacagcttgagtttgactgatgcccagttagccgatttggctttttagggtatgattgctctaattaaggagaagttctcatatgaagactttgaaagcttgtcacaccttacacagaaggtagccttgcatgaacaaaggtatgcagaggctaggaaaaattctagaaaggttaatcatgtttgcccttatatatatggatcggacgatgaggatgatgattatgagatagctgcagctgagtgggtaaggagtaaaaaggttataccatgccaatgggtaaagagctcaggaaaaaaggagaggtatgactttgatatcactaaggctgacaaaattttcgacttgctactccgagagaagcagattcaacttcctgccagtcacacaattccatcggctgaagaattaggtaagaaaaggtattgcaagtggcataattctgggtctcatatgactaatgattgcaaggtcttcaggcagcagatccaagcggctatcgaaggaggcaaaatc

SEQ ID NO: 29768 - DNA, 1501 bp, Oryza sativa
atacctggtttcgtggtttagaatcatgaattagatttcgattacttttaagggtcacaaagcgaacttattccaattctggttgatccaacaaagctacagctttgacataagctgatgtcatgcatacaatgattacaatagacaatatctgagagtttagataatcatacctatttaggctagaattatatttcctgttacatacgaaagatgacaactgacaagggaacaagctcatacggccctgtttagttttaaagtttttttttccaaactttcaactttccatcgcatcaaatttttcatacacacaacttttcagtcacatcgttccaatttcaaccaaacttctaaacttcagtgtgaactaaacacaaccgtagtagattcagcaatcagcatatgctatctgctctagaacattgtttttttctcattagcgctttttttgggagtataggtgtttctttattcttcctattaaactttaccagcataaaggagttcctaaatttggaagctgggaggatgaagaccgtggtgaacacctctacacacagtatttcgaaaatgcccgcaagggtaaatctcaaggaggtctgttaatccaaacaatcatggagatgcggaaacacgctctaaggcctctccagcagtgagaaaacccaaggatgacagacgctcaaaccgagaagacgatcttcgtcagcacgaaaccactgttcgaaaaccatatgctgagtcacctaatcatagatatagggatcataccaactacgacaatgccgtgagaaaaaccggcatagagaagtcacccgttcataagttcattggaaggaaaccgtggatctgctcccactacacctggaaggtccaagttcagatcaactggccgtggtgatgagacggtaaagctctaacttacgatgcatggaacttcctccgtttctaaatatttaacgccgttaaaatttttttaatgtgtttaaccgttcatcttatttaaaaaatttaagtaactattaattattttcctattatttgattcattgttaaatatacttatatgtattagaactactgttgggagcgctgtgcgctcttatattccaagcgccaaacgtgtatcagccaggcccacctcaccccacgttccatcatctcgctcccaccgttatcggagtaagcgatttacttcgataaaaacttatctggttacaatcccaccccacgccctgtcatcccactcataccattatctgagtaaacgatttacttcgataataaaaacaactttcctttcgatcccaccccatgtcccgcatcgtgctcccaccattatcggagtaaataatttactccgataaaaacaacttctctacttctagtatatattttatttttcccgtacccaaccaaccactctcgcccccacttcatttttttttccggatctcaatcgatccaccatcccagcccacagataggcgacgcacca

SEQ ID NO: 29769 - DNA, 1501 bp, Oryza sativa
aagcctttaatgtttagcgtacaagtcagcgaagcttaaagtgacctaaggtccgaagccgcctcaatttgaataagggatttagtggactccccccaagtcccgagtagaaggaaatgtataatggaaagtttcgtgcgtattccctctatttaataaaaaaaataaaattatagagatgaatataaatatatactatgtctatatttattctcaaattttagttttttatgaaacaaagagaacaatataatttggagatatttttgccatctggcttaaaacgacctgaggtctgaagtctgaacgattgaagccgacacccgatcgacgttattgattgcttcacccatttgtgccatttgcagtggatacatcccttctctcttctccatgattgactgtatccccttcttccttgacaaggccacagcgacaaaccaacgttgtttgcttcttttctctacagacaggtgcaactgtgcgaggctctctcctttcgtgacttgagctgatcaagtgcaagctggctacggcggcgcgcggggctgcaggctgctgagctcgtccgtcgagctccgccttaatttgcgacgggtccgagctgctccaaccttgctctccacgaaccggccaagcccaattcgccgttgagttccggtcgacggagcaccacatcggtgagcatcctagctcctttcttgcggaagtcgtcgcagtgcatgtgcttcttctcagactcagctatcgtcagtacttcgtggttgcgcttgcgccgaccgaccggcttctctcccgcgcactgcagttttctatctctatcgccgcccagttcttggaagcttactgcactgtactgtacttgcttactccttcattccaatcaaacacaatcattccaggcagcaactgttaatactagctagttgcattcagtcgaacacattccttcagtttccatttcccacaaaaagcagctgctgctcacactccttgcttattgtgcttccccgtgttatgttcgtgtgttcttagctctaggagatccttccgatggcagagctgatggccaccatggtggtcgggccactgctgtccatggtgaaggacaaggcctccagctacctcctggagcagtacaaggtcatggagggcatggaggagcagcatgagattctcaaacgcaagctgccggccatcctcgacgtcatcgccgatgccgaggagcaggcggcaaaacacagggaaggggtgaaagcatggcttgaggcgctccggaaggtggcctatcaggccaatgatgtcttcgacgagttcaagtacgaggccctccgccgcaaagccaagggccactacaagaagctcggcagcatggatgtaataaagctcattcctactcacaaccgttttgcgttccgtcgcaggatgggcgacaagctcatcaagattgtgaatgaaatggaagtcttaattgcagagatgaatgcctttaggtttgaat

SEQ ID NO: 29770 - DNA, 1501 bp, Oryza sativa
accaccgtctggtccggctgcacatgatgaactaaatgctctgggacaacctgatttagagcatgttgtcctagctgattgttaggtgttgcaaacccagccgatgcattcattaacccttgctgatgaatcggttgaataacctgttgcgttaatggcatttgctgaatcgactgcaaaacctgccgtcttggtggcgtctgttgaattggttgcacaacctgttggattgggggtgtttgctaagctggttgcacaaactgctgccttggcggtgtttgctgaatcggctgctgctggactagaacaacaataggttgaggtggtaagaacatggccgcaacctgatcttgcgtagccgattcacatcctgccccctatgctgtggttgttctctcatcaacaaccgaggactaactagttggcctggtgccgacgtagacgcagcaagtgcgggagccgataccggtgccgtcggctgagctgatggcgcattgggaggaactgtttgaacagatggctgagtattggtgatcagaggccgataatctggaaagacacctccttgcaaataaactgggcctgtagcctgatattcagccattgaaccatcaaccattgatttcatcatgtttgacaaggtattgactaacaccccagactgattgatcaaagcattgtgcacggcatagtcaacccgatcttggaagttattgaaaagctcatgtgctgcattgccattctgactaagatttccaccttgtaatccttgggaattatcaccttgagaaccaagaccttgaacttcttgaaaaccatcgccttgatttccttgagaaccatttgcaacaccttgatcacctggctgagccataccatctggagcctgttttagttcaccatctttggaagaacctgtcccaggaacatccgcaaccaccattaatttatacttctgaaccaacgttcccttgcgggtctgtgtaaatgaactcaaaaattggttctttgcttgctgcatcattgcttcaagatccttatgctgttcaggtgtcaatttatccagagtgatgggcataatgttgctctcatcaacctcagacagacccaacttaaggatcttagctttgacagaatcaggttctctagccgaggacggtgacggtggcggtttctcggccatgaggaaaactgctgttgtgactctgacttctaatcagtcctatcaggcatgccaaaagcgtattgacagaaaacacgaggcctgggagatctgcttaactccagtgcaggtccaaaactcgccttcggatgtatgagcatgccagttgatttgatcctacaatcaacaagaaataaagacaaagaaaccgtggttaaatccataaatgatagtcgatcggctaagtgccgatgacatatcatttacctttgggccgatgtcatatgtacatcgatcgatagccataaatgaataaaaaggaactaaatctactcaatc

SEQ ID NO: 29771 - DNA, 622 bp, Oryza sativa
catagactcaaggtcagcaacaatttccttgaaagcggagagatggtccatcacagacccatcatcttgcaatttgtgcaaaaataacttttgcttcaggtgcatcttactggtcagatccttagtcatgcatatctgttccagcttcaaccacagcccagcggctgtctcctccttaagcacctcctgcaaaatattgttagatagatgaagatgaatatatgatatagccttacgatccattttcttctcatcgttgtaccaatcctgagtcctcttgttaaatctagaaagcgcatcatcgaggtcttgctgtgcaagaacggctcgcatcttcacttgccaaagtgagaatcttgtgtctcggtccaggagcggtagatcatactttaaactcgccatgggaattaatcctgaatttgctagaaagaattaggctaaatctagcaaaaacgtgaacctctggtgcactttccgtgtgcacgaagcgtagatcagggaatctcctggtacacaagcttaggtggccgtagcaattcaacgtgaataaaaatcacgtgaacaggagaagagctggctgccctaattttctttctcctcgggacgtgtgctgctggatgga

SEQ ID NO: 29772 - DNA, 1501 bp, Oryza sativa
gaacaaaattggcttcggtggtgaaaacggaagtaatggggtaaagattttccagggcggcggttagtatttaaagcactgaggataaccgtcagaaaatggcagagtgccaaacttactcgaagtcgatacgcggcaaatccgaaacattaccaaatatcccggacttggggggcatgtgttaacgaccaaatttggtaatatcaatatcggatatgaagattaaatcgaagcggaaccgaagataaggattgtcgcggaaacagagtaagaatcggctggagtccggatcggctacgactgggatcggctaagtccgagtctgactgggttaagtgatacagccgattccgacaatacgacttgtgtacgacatcgggtttgagttgataagcttcaagatgattgccgcgcatggatagagtcctaagaaggcaattgtatctattaattaggatattttatgtaaattctttagagataaatgtgggcaaaagtctgccgcaaagacttatggtatcttagagtttgttagagataatagtcgtgtccgatatggacatatcttgtaattcttgggtataaatagaccccgagccctatgtaattattaacacacacgttcaatacaatctcggcgcatcgccacccttttacttttgttttgtttcgacgagttcttgctttcgggttgagctgcatcggtttcgatcttcaacaacaggtaagacttgttatggcggttttatgatactctaatcttgtttatgtaattcgtcgagttatcatatatcttatataatctttgataatatcgtcatctaacctacaatcggctaacatctgttaacacaaggcggccgattagattaaatagcgacgttggcttagattatataagatatctatcactttatgaaacatccagtggcttgattgtctagatattgttcttcttttcatactcaatgctgcatcagttgagtttgatctattaagtcgtgcttagaatttcaatctctagcctgccttctggttgccgattagggtagtatcggagtttcagtcgaccttacctgatttaactaccttatcttatatgcttgattgatatgttgaatctgccctttatattaagatcttgctgcatttaagtatattaggcttctgtttggtatatcctatttgctttaatatcttaatacagagtggtatcggagtattagccgatacatgctagatctatctgatcggctatgctatgaacatatataatcttgttgttaatatatatttcgatctaagtgatttatactgtctcggcatggcgaccgatctatcccaatcacttgatttaagtatatatcgacataaggattatatattattaatatctacagccgatcgagtagatttagttcctttttattcatttatggttgtcgatcgatgtatatatgacatcggcccaaaggtaaatgatatgtcatcggcacttagc

SEQ ID NO: 29773 - DNA, 1501 bp, Oryza sativa
ctgcggcaaaaagttgagatattgtttggtagcgagacatgacatgtatttacacgaatttgaagcttcttgttgagcattttgtgcttttttttttgtataatgagggattcgtttatcttggaaggcatgtgtttggatagaggatccaaatccatacgacaaaggctaaattttaaccaaatcatgaaaatccaggccactttcaaaaaccaagtaaaaaaatgtatgaatttcctttttcttctttggaaatgtaagttgctgaatctgaacaatcacgacacctgacatgaaaaaatcaggttcgtctattagaaatttcagagtaattgcctgaactaacattagtttgcagcgcatacagtatgggctgagatgggccatgatgggctgggccacgtaatgttacattgtgttgcattgcactaaattttgttgcagtaggccatctgaggtgttgggagatctttcggcactatagttttctgaactttagttcagcaatagcatttacagagctgaggaatttttttttaccttgcaagtcccaacgattctgtcgagaacaattcatttttttgacgtaagaaggtagagctggctctaccttatagccatctcattaatagaaatgaggtggtacaaagttttagaaagaggaaaagccaaatatgggaaagaaaaagaataagaggagcatagaaagaagaaagagccccggggggaggatttaaataatgttaaatatgtgatccgaattttgggcccacaatatattcggattatatagtttcctagtaggacttcatgtctatcctattaggtgtccttctattatctcctatatatactcttgtaaaccatatggaaaggggtgacgttcccattgtgattcccctacgtttgtaatcaactcctctatagtgattattgccggttgacgcccgtggttttttttcgcaagagttttccacgtaaaagttcgtttctctgttgtgcatctattttcatatcaagtggtatcagagtattggagatcgatccactgcagtcccggccacgggcgatttttcctaatcgaagaaatcgatctaatcgacggaacgcgtcgtcgtgttcatcgttcggtcgaatcaatctgtttggccccctacctgtcgactccgagtcggccttgtcccacgcctgcgcgagaagaaaaggcagcaccgcagcagcagccacgtcaaacggcgcacgcgacaggaggaaaaggaggagcagcagcgtccaatccatccatccagcagcacacgtcccgaggagaaagaaaattagggcagccagctcttctcctgttcacgtgatttttattcacgttgaattgctacggccacctaagcttgtgtaccaggagattccctgatctacgcttcgtgcacacggaaagtgcaccagaggttcacgtttttgctagatttagcctaattctttctagcaaattcaggattaattccca

SEQ ID NO: 29774 - DNA, 758 bp, Oryza sativa
ttccatcggccgaggaattaggcaaaagaaggtattgcaagtggcataactctgggtctcattctactaatgattacaagtcttcaggcaacaaattctagtagccattgaaggaggcaagatcaaatttgatgattccaagaggccgatgaaggttgatggtaatccttttcctgtaaacatggtgcacacagctggccgaacagctaatggaggacgtacaagaggttttcaggtgaattcggctaagattataaacaagtatcaaaggaagtacgacaagcaacaggagaggcgttatgaagaagataatggtggttttgatcctcattggggttgtgagttatttaggttctgctataatgagggtatgaggctgccatctatcgaggattgtcctgggtgcagtaatgttgcagggagatcaagccgatcgtatgatggaggcaatcggctgaagcaaacaagagttcctattcatcaaaggttgggcccggtgaaccaagactatagccaaaaggatgatggagacaggaagattcagtggtgtccttctggtatttttacaaaaaatcaaaagagaagggttcaaaggttgaggaatagagaatgcttttaggaggttgagcaggaaatcagtcatcggctgaagacaaagccgaggcaggagtggcgcgttaagaatcaagctcctgaagccgatgacgccacagccgacgaggcgaagaagttggcaaaagggaatagtgttgtaacgg

SEQ ID NO: 29775 - DNA, 391 bp, Oryza sativa
tttatataaaaattgtagccctcgacgcgacctataactttgtagttgaaaagtttttgaactaaaattgtttaaggtcccaaaatattgttgcatgtttatagattttgaaattttaattttaaaattacattttgggacaaaaaatgacttaaaataaaaaaaaattcaactaaaaagttgtagatcgcgtcgaggactacaagtttgatataaagtttgtctttattagagttcacatgaaaaagttatgaactatttttaaatataaagtctttagaccgtcctatttaacccagatgatattcaaatccaagtttagggaccggggtgacacaactgaacaggttggaggacctaaacgagtgatctaaaagtttaaggatcggga

SEQ ID NO: 29776 - DNA, 1501 bp, Oryza sativa
tatcccctatatatactcttgtaagccatacgggaaggggtgacgttcccattgtgattcccctacgtttgtaatcaactcctcaatagtgatcattgccggtcggcgcccgtggttttttcccgcaagggttttccacgtaaaaattcgtgtctccgttgtgcatctattttcataacacacaattatatttacagatttaaggttctaactgcagcagctgacagataattacacacatgtttcaacttgagtagcgacagtttatttttcagcagcttgtaccagtctttccattttttccacaatgggaaattcattccaataagtaggaacatcaattgatcaattccattgatcaacaatgggagagataacgttgctgcaaaatgttgttgatcaatcacaagtatcctctgcagtcatgtcatgtaggaaaaacatcattgaaatggaagtgctagctgtgattctcttatgatggagcatgaacgagatcaaagacatcgcagttcacacgaaaataaaaaggattttaaaaaagtgaagcagtttaagctccagcatgttattctttagcttacaacctgggactagctttctgcttaaagtcaaggccttggatcatcggcttcatccttcttgtagcagctcacaccaaccggacgatcgactttactggagtttatcttgagaaagggtaggtaggtaatacattctaccatgagacacaaatcacacaattaataacccatcagttgcagatttggtaacgatcctgcaaggaagtcacaccacagagagagtcagcataaggatagtggttagcatttcattcgaaatcaatcatgtataatgatgttacaaaccatgatgactcatctggtcctgaatctgttactttaagcacagcagcctagcgactgcagattgatgggcctttggttctagcaaacaaaagataatagtaataaaaaatgttatgtattggttggataatatgtagaccacagcattccatagtcaagtttggcataagatgattagaaggaactacgtatactcaaactacatgcaatggagctatgagtttccagagaaatgttaatacaattcaagtaccgcgacagttagttctacaaatttaagctgctgtccatatcagacgcattaatatatatttttttatttattttagataatattataatttattatttattcgtagtaaagcacgtgcattcagcttgcataatagtaatggctacagtagatataactaaattcttttgtacccccaaatgcaattcaaaaatttgaagtgtttaggtcacaccactgcacaagtgagttatcgatgtgcattgtactctgtacatataatcgtattaatggttgactagagattctatacaccacactgcaaacttttagcaataaatcgcggtacatgcttaagccgagagttgccttttagggcacccaccaaattaaattgagc

SEQ ID NO: 29777 - DNA, 1501 bp, Oryza sativa
aacattttggagttcggctggtggggctagctcgaacagagcatgcccgtgcgcggcacgcacgcacatgtcccgcggcgagagtggcgcaatgggtaggaggctagacaggtgatgcggttcatgaggaaggttgtctagcgtggtagcgttgtagctggtgaaatggcggctagcgcaggggctgggtgcggtgtttcacccttcgtgtggcaccgtgccatgtcggcggcggcagaacgagagacagagggagagcgagcgtcggtaagggcgggagagaagggcatagtcacataccttgtggcagttgtgtagcgacacaacgggcggtgatccctgcacgaaacaatggtcgtcgaggtattgcctggggatggtcaacccgcggatcgtcctcgcacgccaagtgttcgatcgacgatagcaaataaacacacggcgttaaggataaatgatagtgggttagggcgagttagttgttaggggccagttagctcaacaggaaggtacaagtcaacggttaggggttagtgcaaacgaaatcgaaagggttatcaattagtcgtcccaagttagttgttagccgttcttaggatcgatcaagcgtggcagcctatccacctcttgctcgactgaggcccagccgaagccggccgtggcagagcaagcagggagacggcggcttgtgcgcgggagagaggtggtggagcgaacgggcatgagtgaggacagaggggaaagagagcgtgcttgcgtgcatggccggggcagggtttatataggtgacagggatgtgaggactccccacgcgtgcattgaagaatgctcatcgccatgcgcgtgttggtagggtggtaggcgaggtggcggcgcgacggcacggtgttggtgacggcgcggtgccgtggcggcatggcattggcgaggagggacacgagatggcgtctggcagacggcgccgtgcgtgcggtgccttaccggccaggtccacgggcggttaaggcggcgacggtgatcggcggctaagccccagcggttagggcggtcgttggccaggagcgatgcaagtcgtggcgaggagtcggcacagcgagagtggaaggactggcgatggcagtcgttagcgacacgcgacggcattcgtcggtcgtcagcgagaatcggatggacggagatagctgtagagccggcacggcgatgggcggtggcgcgcgcactactagaaaaacgattttttatggcgttggcctattatttttgctggcggaaaaatgtgaaaaccgccagtaaagtcgtaacgagggggtggggggcaccgcccgccagcgaaaatatgtctatttttgctagcggtcacttaggttcgccgccagcaaaaatagataatcttcattggcggtcaaatttttgctggcggccaacaaatgaaaccgctagggaaaacacccaaaaatacctgtcacatattaaaaccacccacatacctcatcctcttcac

SEQ ID NO: 29778 - DNA, 1501 bp, Oryza sativa
aacccttttagcctgaattcattcgtgatatgttgtgatccaactatgtatgtgtgtaccaactactgatccagggattggtacggataaacacagaagatttccgatttccaaaatcgggggtctacaataaactagtttcaaatttttaaattttattttcgcatacggctccttaagatgcccgtatggaaaatttcatttttccatgcgggcttgatgagggagttaggtcccgatctaccgataggtattgatcaacagtcgatttgggcagagtcacgacacaactcgatctggcttctgaacgaacacgctactgagccccgcaatcgcagtaccacgtctcctctggttatcaaccgtgccgaaatccggttgacctcgccgagaaggctaatccctgcatgcgaatcgaagaacacaagcaagaacaagatatattgcaaccaaattgcatatgaacgattaagcacacaaatttggggttctacaaaccgatctagcggcgaaactgttcttgacagaataatctaagcaaaacccaaaaacctaaagatggcggtgtcgacgggtgatacctgtagaccggatatagagagtattggggtacgttgatacaagggtccacgtaatacgacatcaagcaaacagaagacgaaaattatactggttcaggccccttgataggtaatagccctaatgcagttggtatgggattatatcatggaaatcacaggttacaaagggaacgatggaactcgatgaaaccgacgagatcgtaatcgagttaatccgactagacctcccggcgatctggcttccgcgggctctgacttcgtagactgtggcagtggtgttggctgtgagagattccgtccccccaggttctcccagggggtcccttttatatcgcgggtcaagcaatctccaagcaggactcggagacgtcgaaccgtacacgatacgttgagaacctagccttgtccgagtaggtctcttttcgtctgccaattccgcgaaggatttccttaactcatacagagagtgtccatgtatgcgcgggcatgccatatcgatacgtgagatatatcgaagggtaaggggtatccctaacccgtaaccctgacagtagcccccgacttctgcttaaatgaactcgtgtgaccaatcgcgacttctgatgtcgaagctgatgtcgttctcggtgtggaaaccgtagagacaagacataatcaagaacaccatgtgaagcccaacggtcatgagtgaatttaaactgaagtccaagaaaccgccgcgcgtaacagacccagaaaattccggcgggcatctctctctccttcccttcaaattcgcgccatgcgaagcgtgtctatttaggggagttttggggattcattttgaagtccgcctgttgtgagaaaactttccaacctccaggcgtccctcgtcttccccgcctccgtaaaaaccctagcttgtcaatctccgcccttcc

SEQ ID NO: 29779 - DNA, 1501 bp, Oryza sativa
gcggattttcgcatgcggttgtgcctgcccccacggaaaaactccgattttcacagaccttgtcacgcttccggctggagcaaccgcatgcgacaatcagtttcgtccgtatgtaaaaaccagttttgtagtagtgttggtttcactaacgtgtcgttttagtcagcaaaataaaactaagaacaatatggggctacatgtaagtggactttcacctctctcccccacctatcccctctcttcctcatctcccctctctctctctaccttaggagctcattggctaggagaggggtcacccgtccatgagaggcggcagcagcgatggggggttgtcaatgagggggctccggtcttccgtgacggtggaggggaagaggagggaggtgagggaggctgtgagcttgagcttgccgaccagccacgggaaggcggcggtagcagtggccagtgggcggtcgaagaggatggggtcgcggctatttgcggtggtagaggaggagaggatctggtgccccagcagcttcgtctcgcgggtgctcctacggtcttgcgcgacgctgggagtgggctcctgtgccggccatcctgtcctcacaaaaatgggaagggtcgagcagagggcgggcgcatgcagatttcgcagttgcctctctgcctttctcgtctgccgctgccgccaccacggcatctcttgtttgctgaagccatcgtcataggaaagactttaatgagaatggttgcttcatgctggctttacgcatggttaacatctagctattggaaactagatgcagaattgccaatttaattcagttcttaaatcatgcagtaattttgtttcgaatcaatcccatgcgttcaattttttttaaagttaaaagccccgtgcgttgcaacggataaaagcaactgattttttcttgcaacggataagagataaaagcaaaaattatgagtttctagtatggctagttgattaaagcataactgatagtacatgttcaaacactccaactgatttttcacaaaataaaaaggcgaatgtccagcaaaacagtgaacacaattctaattagacgcttcaaaacgcatagtggacactgataatcataatatcacttaaggttagtaatatcaacattaaacttataataatacatctaataaggatgcaacacagcatcagagtatgcacacaaaggaaaaaaaacttcattttagcaaaactagcgaaatgcacatgcacatatatctcatgaacttgcactgtagtatgtataaaaagtgtatatgatatgatggctagagatagtaacaggtacatattctcatacccacacccaaactaaatacgtccgctccaacacctacacccgatcactagtgaaattattttcccgtacccatacctgaacgggtgatgggtacccataccatacccgttgcaactaacttttacagatcgagaggctgaagggcgagacgatgatggcctggg

SEQ ID NO: 29780 - DNA, 1501 bp, Oryza sativa
ccaaactccaagaacctcgggggtcacacccttcaccatccaactgattgcagaccttctagacaacgcctctaaggaagatgcgatatttaaagcagtatcactgcacatccaaaagaacttagacatggttttcaataggggatctactagaaaaaaaaggaatgtatctcgacaatggcgcctcctagatagaatatggtatccaaaaggttgctgctattgatctggtgtgctgccatattaggctttcgcctgccaccttcctaccccctttgctcatagctctaacaccccacaaccaacaaaccgccattggcgcataaccgccgcctgtaccgacgccccaccatcgatcaaccatcgtgcgagtgcccaagcacattcacttgagttaaggtaaccccactattttttatagctatgatcatttgagttatgactgataaggagttgaaaaatgaaccaagtaacaaaataattatatatgtattattattattattagtctataaaagaaaatattgaaacatagtctaaaataattctagaatcaacttaaaactgaaattaaactttaaaattgaaattttagctatgataagttaaaggacgacgaaagatttaccccaatattcatcgtacggctcgtactgatcctatatcatccaagtgggcgggggaaccggaaggaaatggaatcatctagagcatttcggaagccgctaacccaagtatcccaccggggacgaatttacggatttgccctccaccttctccctccccctcgcggcgccgcttcttatacccttcctcctcctccggcgtcgtccccgaggtcttctaaaaaaaaccctaatccatccactccaaatcgccacgcaggaagggaggaaaggaccaccagccaccgcgcgcgcccaaatcgtcgcagctgcttccccgaggagaagaacatgaggtaaatactccgtgctgcactttagcttgttactgctggtgatggtggtggtgtcatgtggaggtgcggctgattgtgcctgggtggctgtggggtggtgatgttttagtttgttcttacatgttcttgcgattgctggtatgcttgtgttagtttggttagatcgtaggatatatgaaatcttctggaagaactttggctgttgacttgctatcagcggtggtcaattttctttggtggagcaagaaacattagagttgttgcggttttgttgggacgctaggtcctcccgaatgcttttgccctgttctcggatgcggatgcgatttcttatccttttgagtaattgatgaaacgattgtgctgttgtcctattggttaacttgtctctgttgctgtgatttggggcaatcctatggtgcgctttctggctgttttactgcgtgtgttcatgattgcaaacctgaaatgtgttcatgattgcaaacctgaaattgtgatgtggagtgcgattctgagcaaaattttatgggggattgg

SEQ ID NO: 29781 - DNA, 1501 bp, Oryza sativa
tcagtgaggccgccgcctggtggtccgcgagcggtccaatgacgtcagtcagagggagagcctacaccacatgaagtcattttccaacccgtgaagcaaaaatagcgaggttgccgaatacactcacgttgattgcggcttcgcgctcggtcgcctccttctcacaaagaggcacggggatgtcgcttgccgttgtcgggccgctaatcatcaattggccgacgcggcactccacggtagcgctactcaagcctgcagatcgagaacagaatttgataaatcaggaagaacatgatcagaagggaatcaatttaactaaaaaggaaaataccccgaggagaaacccgggtcgcgtcctccggcccggaatagtcaaaggctgggtgggctcgagcctggagtggctggatccgcctaccaacgaagtcggtagcgacttcataccccgacaaacctcgtactcggaggtcgtcgatggcatcgatgaagcactggagtgaaggggccaagacaggctttgcggtccaagacgaaattttgtcttgttgttcctcgggaacaacaaagacagggtccgaattctttatctgaagatagaaccacctcgcccgccatttgctacgagaagaagggcactagaacgggatatagcgcgacttcaaaccatcctgaagtcggaacccgacgcatctggacaccctgttggattccatccaacgcaactcatagtaaaagcggaagagatcgaggaagggctctaccccaatgtaggcctcacaaaggtgcggaaaaatactaaggaaggcaatggaattggggttcaagtggagcagagaaaggccgtagaagttcagaaccaatagaagaaattcagaaggtggagggagaaaaccacaaagaatgtaatccttgatcgcaaccatgtgacccaggacaggctggggttcagtacctcctacttctctctccatgactccatgaccgggaagggcgccatcttcctggagcttcttcagcgacgcgttggtggaagtagacgtgccgagatccatcgccgactacagatcgctggaggaagggcggagattgacaagctagggtttttacggaggcggggaagacgagggacgcctggaggttggaaagttttctcacaacaggcggacttcaaaatgaatccccaaaactcccctaaatagacacgcttcgcatggcgcgaatttgaagggaaggagagagagatgcccgccggaattttctgggtctgttacgcgcggcggtttcttggacttcagtttaaattcactcatgaccgttgggcttcacatggtgttcttgattatgtcttgtctctacggtttccacaccgagaacgacatcagcttcgacatcagaagtcgcgattggtcacacgagttcatttaagcagaagtcgggggctactgtcagggttacgggttagggataccccttacccttcgatatatctcacgtatcgata

SEQ ID NO: 29782 - DNA, 505 bp, Oryza sativa
agtagcagtctctaaaatggacaccactttgagccatcataggagtgtcttctccattgaattgtgaggaaactgggcaaagcttcttcatggcagctgtaacagagagtttaagcaaaagggagcaggagtttgcatttgccgaactcgttgtcactgcccctgagagcaatattctgtcatctttgtgaagatctacatcttcttgtgaccttacaatttgttaaatcaatgcaagaatatggttatctgcttacatgatcatcaatagttttgagatttttgaattccctagaaaacaaattgtcagtgatctccatgattagttgtataacatgtagatcaggcagtaacaatatggattgagcaagctggatacttcagtttatttttacagtcacgaacaattatgcaagttccaaagtacaaggcaaatggaacatgccaccaaaccgctatgagtaaaagtatgaaacacagaatggctggatagctttgcaatggt

SEQ ID NO: 29783 - DNA, 456 bp, Oryza sativa
cccgattaccaatatggttttctttgagcaacaatagtaagtgtgacctgtctgtatcctgcatgtcactttctttattgaataaatgctgtaactctgactttttgcatgtaatctgtatgtttatgggcaacaacttttccaatggcattccttttgacattccacatcatgttggatgcagcatgttgattctaatgcaggactgccagtcttagcagttgattcaatgaattgccagtcttagcagttgattcaatgaattgttgttatagtctgggtcagtcaacgtaccattttgtctatgcaataccatttcaaactagactagttaaccaatgttatgtaaaactcttgtgaaacatctgatctgatttagccaacatgagcatagtaaactgaactttccagggatcttaatttctcataacaagaactctgtatattcaacttagt

SEQ ID NO: 29784 - DNA, 163 bp, Oryza sativa
acgattgcagtcaagaggagcttgatgcttatatggtaggagaagtgaagagacaactcaagcctcggagtcctgaaaagaagatacctattgacccgagcgtgaagaacttcttcaagggaatgtccatagcaaacaaggaggcctttaagatatcagacta

SEQ ID NO: 29785 - DNA, 1501 bp, Oryza sativa
tcgtctcgtcgtcctctacgtgtacatgtcctccaaagtcgcagccgaccatccaatctccggcgaggtcgccatcttggtccggccattgatgaggtcatcatgacgtcatcatcgtttttctttttcctgtttttctaatagattaaatcttcggaaattcataactaaatcatcgtaactcggttttgagtggttcaagttgctaaattcatctaaaatcgagatctacatgtttgtttactttatatgtactgtttatttggtttttattagtctttttcttcgttttgcgtgttagcttgtcgtttccgtcgttgcgaaggttcgtgagtgcgccggaagtattcaagaagattaattgaagaccaattattgcaaggcaagtcacacagattctaaacacaatcctttgagcatgttgatcctatatttaaattctctatttatttcaactgtgcatttattttcgaatgtcactgggtggtgtgaatctgttcctttgttatggccaatttgcattgattactttattccttgataccttgggttattataacttgactagttgggctttatatattggttcagctagatattagatatgattgcttagccatgcttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatggcaattaaggaccggttcgcgagctactgttgtgaaacattaaccgtgccaaccacaagccagcgtgggcaacggctttaccttttgtataacatgattcattgcggagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattattgatgctataactggtaataatttgtttagctcctggtttggagttagatctgtacagccgggtatggttgttcaggatggttgggcctgtgcagcatgggtgtgttgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataataaa

SEQ ID NO: 29786 - DNA, 326 bp, Oryza sativa
ctattcccagttatgaaccaagtgatatgctcgaagatagtctatggaggtcagattaaaatcgcatctaacaacgaagcttcagatttggcaggataacgatcagaccataacaagtccagcagtaaagtcatttggggagacgtcaaagcatgtcaagtgggataagttggttcttcttagaaacataattcaaaggcaaagttaccgacccttgcatcgaatagcagaagtagcttgcacccggagaccaggaaagctaatatgaggcagttggtggcaagttagaagtaaatgacaagcatggtattctcatgatgacaagc

SEQ ID NO: 29787 - DNA, 407 bp, Oryza sativa
attctccatggttaattatactctctggaatattctcggatttttcggagctcaattcctaatttttaatcatacaaagagcatttcagtaattacccacatattaaactaatcattaaatggtctaattgtaattttgttaagtactttgagtgtccaagtattttcaggatttttcttgaaattatttgagcattggaagtatttttaacaattcaaagatcatttaagtgattattttaattgggaaagtaataaaattctcctcccttgtcttaggctgaatcggcccattcctttccttcctctctcttccgccggcccaacccgagcctgcatcctctcttcttctctcagccaaagtcctgttttgctccctcttctaatcaggctgagaaaagaaaagc

SEQ ID NO: 29788 - DNA, 1140 bp, Oryza sativa
gggatccccctcctcatcgcgatcagccatctgtgcatacaaaaaatatttgttaggtctataggtcatattcgctaagcgtaatattaaaactctactaatcttatattaaatctctaataatcttatattaaaattgtagtaatcatatatgctaagtctaacaatcttatattaaaactctaataatcttatattaaaattataataatcatatgctaagtctaacaattttaaattaaatcgctactaatcttatattaaaattgtaataatcatatatatatatatatatatatatatatatatatatatatatatatatatatatatatgctaagtctaacaatcttatattaaatcgctactaatcttatattaaaattgtaataatcatatatgctaagtctaacaatcttatattaaatctctactaatcttatattaaatctctactaatcttatattaaaattgtaataatcatatatgctaattctaacaatcttatattcaaactctaataatcttatattaaaattgtaataatcatatatgctaagtctaacaatcttatattcaaactctaataatcttatattaaaattgtaataatcatatatgctaagtctaacaatcttatattaaatcactactaatctttgtcacgcccggaaatgtcacgcccggaaattcactagtaatttccgaccttatttgtgcataaaatcctcgtccaggaatcagccgaggtacacaaactgacaatttaatatacaaatccatcataataataacgttacacacttacaaaagaaaagaaaacagcagcggaataacggtctagcgatggcttcagctccattcccacaggcagctcaactggggtataagccaaacgtcttctccttctggatcctttttcttcaactgaggttcatttattattgcaagaatgagcatatgacatactcaacaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaacaacacacccatgctgcacagg

SEQ ID NO: 29789 - DNA, 1501 bp, Oryza sativa
ggagcccctggatgatgaaggctttggtgtttagctcgtgcctgccatcaagcgcctgtggtcatcgccctagtcttccgctgtttcccgtttgtcttcttgtgtgctgggccttcgccgcccatgtaataaagtaactatttatgcttccgcttgataaactctgaattgtatcaactttcagtgtaccttgcctcctgggacaaggaataatacacgcacgtaaggaacgcccgttgggttatttccggtcgtgacaagttggtatcagagcccccttgaccctaggacgagccttagatcccaagccttagcaatattttcgaaataaaaatcctttcttatttgtgaaaatcctctagtctctctctgtcctgctgcttcatttatcgccaaaatctaatctttaaaatgttgcttttctcttttgtctttttgtttgtagatggccggcagcatcaaccgtcgtggtctggacctgactagcttcgttttggagctgcggggcatgtgcgttgtcctggggtatccgcatggagtggattaccagggcaagcagctcccggagcaggagggtgacgatgtagagccccatgctgcttgggaggtcactgcagtgatcctcactggctcacctgagaggacttcgttggcagtcaccgcgggaggagattctttctctgccgcttgccagaacgccgcactcctcgccatcggcactcttcaccagcgctacccggacgagttgcagcactcgccctaccgctaccaccctcgtcgcggaggagcccgcgactacgccaccttcagggatgctagctcggaggatgacgctaccatcatgcacctggcacgcatggtggaggcgtacgacgcggctcgtatcgacttccatcagatggtgcgccgcgggttggtcgagaacaacatgaagatcctggagctgcgacaggagaatctgcagctgaagaaggacctagacgcagtggaggcgcagctgtgtcagctcaagatcgcccagggagaggtctgtcgccccaagcgccgccgcgtctgccgcagcctgaagatcaccgcccgcaagagtacctccaggcctgagcttgttcgtcagtccctagcgtggacctgctttgtcgagacccctcgtgccgagcccgcgcccttggttcctcaggaggagggagcctctggcgtgggtagcacgaaagatgcgctactgctcaccttccgccctggcccgtcgcagaagtagacgagcagttagtaggcttgcacgtgtgttcttctcgttggtctttctgcttgagtcgtgtggggcatggttataccggtgtggggtataactgtatcggagcctgtctttattttatttgcttaagcaacttgaaccttaatgaaccaatttaatagcagtaataaattcaagaattatggtagtcgtggctagttagttttaatagtcagctctctctgtttgccggttctgtgtgggattttg

SEQ ID NO: 29790 - DNA, 1501 bp, Oryza sativa
atcaacggcagctcttcagataaatatacagagccacctgcagtgtgtcaaggaacgagctaacatgctgcttcgagagtccgagtacgtgcgacttccagggcaatgaactcgatcgtacggtaggtcgtcgatgcagtcggcgcgcgcggtagctcatctaggtacctacgcatggccgcctctaccgcggtactgcctgccatctattaagtccattcataatgcataatgcatatagttggcgttcggccttggccatccacatcaaagattcgctgccacatcatcctcgtgcggtcccacgaagaatgcggaaccaaagatggtcactcgttcttcagcctgttcgagggttggtggcatggggagagaaggcaggagaggcgttgtggagggcatggcttgccattgcctgtgccgcctaggaagggaaagggagaaaccgcctgggtagggaaagggagaagggtgatgaggaaatggagcccgtctcgatgaccgaaaagggagcccatcatcccccgtcttcccagctccgcgccgcaccgaggagcttgctgtcatccccttctccacactgccaagaaggtcacgaccctcggctctgcgtttccgcggggctcgtcgccatcccccgctgcccaccaccgacctcgtcgccatctctcgatcctccggagagctcgacaaccgtcgccttgatcgagctcgacgaccgtcgccttgatctggaggctgtcggcagaggacgctcgcgacgtggacaggacggccgcagcgcgctgacgccccgatctagtccccgtcgaagctcgatggccagcctcgaggtcgtcaccggaaggggaggtgaaggtggtggcagctgggagagggacggaaagccatcctcggcttgctcgccagccgcgatctgtgctcgttggtgaggccagccttgatctctgcaagctaacaattctaatttttccaccgctgccccgtggcgaatgtacttcaaatatgataacaagactgaaccagaactataccacattgcatgagcctgcaaaaaagcaccatcaacattaatcttggcccaaccagttctggcaattcccatgagctgcaacccacgcccaaagttctatttatcttcgggtttggggaattaatttatactgcactcaaaactgccttacctttttaccaggttcttgtaccacggcttgtgcaaaagagtcatggtaactctgtaagaacattgcagatcttgccaccatctcctcacctttgccatggacaatatcattacgtaaatactataagctccccaaaacagcacaaggatatgacaagagttagttggtacagagctaagaaggataagaaggatagacaacctttccagcaatcacgccaaaaaaattaaaagagctttcccctaggagagcccaaatcctgcacagagcatgtcgcagagctttcgctttttgtacatctaaccattgtgtgaaaa

SEQ ID NO: 29791 - DNA, 1501 bp, Oryza sativa
gttgttgatctgaaaactgaattgaacttgtgggctgcggccatgcctctattcaggccttgatctgaaaatctgaaaaggaggaaagtttcctactgaaatgaatgctctgttagctttgctaaaaccgggctaggatggatcgttttatttgtgtgaataacttagaatatattctggtttactgtgcaaaagctttcttttcagatgttgctattcagtggtttactatgcaaaagctttcttttcagatgctgcataccaccatgcagagctgttgatctgaaacggaagataagttttcctactgaaatgaattaatgctctgctagcttgctgaaatcgggattcgatggattgtttaatttgtctgaataaactcagtatgtattctggtttattgtgcaagccttcttttcagatgttgcaagcctgaattgccgccattgttagctcgcactcttgacgaaccgcagcggcgacagcgagcttgaaggagtaacgccattttcaaaaggtgcaaaaggggtcggagaacaaaactccgacccccatttaacctcaatttttccacccacatgaatgcatgcgtatctccttctcagtcaacaacaatggctctcttctccttatcatgcgtgtatgtatgcacagtgaagctaatgtggccatatggtgaagaaatcaattcatcagcagctaaacaaatcttcgtatagggaaaaccttagccctttcttcccctggttccttcactgaaaatttcagattttctgctaatgaatcacacataaaagttaagcacattcgatccgttgcgtgtgaagcggacacctttttttgaagccggagctggagataagctggccaaggggtggtttgacctttttttcctctgtctctgcatggacatcttgttctccaggttaacgacgttcgtggacatcgacacatcgtcgagatgttcattcatgcatagatgttgacagttagcttggtcaaattcatgtatgtatgcacaaatagattgcttcaccaggaattcacggcaactgttgaggctaatagattgaacagtgaaatatatttacgcagctaaggcagcctgccatggaactgaaatcagaatcagagacaacaagcgtctctgattttcacattccaattttgacatatcagaatcagaatcagccccaattttgacattccacattccaataaaacttggccggcacagtacaggattcttgaaccaaaaggccaaaaaatctatctcaacctactgaccatgactttgtttcccctcatctctcttgcctgggcagattttagctgccaatgaggtctagttggatcaagaattcacatatccttgtcaacgcatttacaaaaggaaaacaaagtggtggaaagatccttccagatttgctcgccaaaggccaagacagcatagctaacaatgctagggttttatgttttccaaagatcgccaagaatgtgt

SEQ ID NO: 29792 - DNA, 1501 bp, Oryza sativa
gttttctcgtgtaatagaaatcaccggacgttatgaccctgaaggcctgaacctggcatttctgggaagatggcaatcagcttccctcttttcttgagtccatcctctgttttttttccccctgtggtttcaatctgtacactaattaagaacagaggaagtatgcaagtctgtaaaatgcaaatttggaatggtgcatattatgtactacttgacaattagattacttaaatatctgcttggatgttttcataataaatgcttatcataaacactaaccaaagagtacaaatcagaaccaccttgctagatcaaatccctctcatgagtcatgagaatatattatgttggaagatcttatggtcatgaacccttgacatgttaattagcgcgcgcgtactacgaaataatacatgaatataatccgggttttgtggataatagtaaaatgttgcaacaaagccaaataatactgatgagattcggttgtatcactggtgaccttttatttcgtgattgaatcatcgctgtatgaaaaaaaaattcatacaactgaaattagtttgcgccaataaattatcatgggtagggagctacacaccaatgtgataaaccatgacatatgggtcttttccatgccaactaccatcagcacatctggcggatcagtaatcctcggttgagcaggcagacatctgactgttctgagatatcattttcctgatcccgcgcattccaatcagacattcatatttcaattgaaatggaattaaatgtgaaaaatacccccctacaaatcacttgtgtttcttctttgcctactactacttgatttcgtacattaaacctccacacaagacaatttctcctaacaattgtggttggtctctcgcaacctccttcctcccttctagtatctgccttcccaaatccctgtatgagctaagatgatggcagaacacgatggcacaacttgtgcgctagctgtaatttctataataccaacctatcgaggtggcatgagtttctattgtcccatgacgctggaggcccatgcagcactagaaattgaaataactaggtgaaataattgacaatgggactttggggaagttaggacataaattaacttgttgggaggattttctgtataaaattgagttgtagggggaaatagaaaaactagtgagttgtagggggttatttggaatttcactggaattaaattatgagcaaagaatggcggatttcttttttgaatatttaaatgtcatgattcagctcctgttgtttttgcgtgctctagggcgcataattcctctggaaactcaggatgtatcctggcagaataagagagagaatgtggggatacgtgttacggctactgtacaaaatacaacaacgatgaacccgatcaaagtgaggcgtgctccacgcatgccaggcgtgccaatgttcaccttgctggatccgaatgggcagatgtgctagctgtaaaggg

SEQ ID NO: 29793 - DNA, 1501 bp, Oryza sativa
ttgcactgtttgtcccctcgccttattcaaataaaatgtgcaaatataaaaaatgaaaagttgtgcttaaagtactttggataataaagtaagtcacaaataaaataaataataatttcaaaattttttgaataagatgaatggtcaaacagtgcaagcaaaatgtcaaaatcccatatattacaagacggatggagtattttattaagagtgtatttttttaagttcattttgtcttaatatttatgttggccactttccattgagtaaatttcacggaacactacaattttcagggaatctgtatcactaccaaaccacattcaactatcggttacctgataagaaaggctcaccggtcagtgactagccgtatacccccccttgtgcgtctgatacgcaggcattcgctggagccgaagttagcgaatcagaaacgacaaaaaaaaaaaaaaaaccacgctaagcttttttcaggagtagcgtcaccagacccatgtgcacaacacgaagacaaccaactctttttgaagctcacgtttgcttgcctgcctacttcggtagttcggtcttttggttttcggcccaactcgagtttacgacgtatataagaagttccaaacctagtatttgcaatgatgctctgattttctgcatacatatacatgaatatattttttttatctaaagtgtgatttcaaatcttttattaaagaaattagttactataaattctattactagatataaattttatcttagggatgccaagtcttttataatattttcttattatggatgaaaacccacaatattttttaaaaattatttctatatgtattttatgtatgttaactttacatgtataaactttttatatgtaaactttatatgtacaaattttatgtatataaactttacatacacaaattattggtagaaaatagtttgcatacaaatcacaaagctgcatccgcccatgaacattttgcacttttgaaagatcatgggaaaaaaagaaaaacaaaaggtgcaaacaacgggagagggccaatgcaggaaaatgtccatccatttagccctaagaaaacttcaacgcatgcagaccatatgctgaaatccagaatgggagacggcccatgtgcttaaatgcagaaaatagaaatagcatgtttgcttgttagacttttcggaatcaaaccaagagaggaaacagaacgctatagttgaaagagaaagtgggacgttcgcgcgtgtgactaatcaggaatgcgcattagtcgttccgccgcttccttcctatatgccattcacccgtttgccccgaaaaattatgtagttgcaaacctaaaaactagtctatagtaagataaaaaaaatggggcaattacgcatctgagcttgttttgaagcctaactactaatttgaccctctttaatcaattttgtttattttacccttcttttcaaaattgaagatccaatcttaccctattctgtt

SEQ ID NO: 29794 - DNA, 1501 bp, Oryza sativa
ctaagagtgacccgaccgccactagacaatgttgacggcattcctcttcctccgccgccattgttctctgctctctgcttctgcttctctctgacaatgttgacggcagttgcgggaaaaaattgttcagtccctagaaaagaaaaaggccaatttagctttcttatatatacttgctccattttgttaatatattgacaccgttaacttttcaacgcatgtttaaggggtggatcaggaacaaaaagaaaattagggagggctcaattacgtagtttcttcaacctccagccatttaggaacttttagtctatcattcatgataaaaaaatcgaaggaggtattctaagggtatccatgcgtcttgtgagtgtagggataactcaattctccctgcatccacgttggatccgcccctgcatgtttactcatttgtcttatttaaaaattttatgcaaaaaatatatgatacatgaatcatgtttaaagtattttaaatgatgaaataactcacgacaaaataaattataattacacaatttttttcaataaaacgaatgaacaagtaaaaaaattaacgatatcatcgtatattaaaatacaaaggtagtagctcgaatacgagtcatattcctcaaccgcaaaaaaagatactactccctccgtttcaaaatgtttgacgccgttgactttttagtatatgtttgactgttcgtcttattaaaaaaattatgaaatatgtaaaaatatatgtgtacatgaaagtatatttaacaatgaatcaaatgatataaaaagaataaataattatttaatttttttaaataagataaatgatcaaacacgtactaaaaagtcaatggtgtcaaacatttcgaaacggagggagtatatcactgttttgagagtggtttgcactgatatttccccggttatctgagcccttgtgttttagatgaagggcccagattaggcctaacgcaccactctgcactggtaatacttccgtggatccgcatcgtcctccttccttgtcgagccgagcagcgcatcatctccatcccgcctcaactccgccgctcgatcgcctccacccgccgccgttccgtctacctctccgacccccggcgggcgccgccgccgccgccgcgcctaccatggtaacctcctgcccccaccttatcccgttccctttctctacttacgcctctctccggatctggcctctgggccggcgccgcatttcccctttccgcccaccgcgacgaggcctcctggacccgccagatctcgcctcgaaacctgaacccttcctctggtctactccacggtatattgatggatcgacggagcccttccgataaccgatcacggattctagaaggatgggatgagattgtttgtcgctttggttcgagattgcattttttttttaaaatcagattatttgtggcgtttgctttggaagtatgggtgagtgctcatgtgtttgtgctattgt

SEQ ID NO: 29795 - DNA, 1501 bp, Oryza sativa
acaaatgatttctcactccatgctaccataatttttttatcacctagatggagcatgaaagcagcaaaaacctgatgcaagcctaaagcaataggagtccttattgtatccaacccagtccactacagtaacatggtactactgtttctttaccagttgaccacacaagggacctggcataaatgcaaagtgcaatttgctcattaagaattgaacatacacaacattcttcaatgataggatcataacttcctgcttctagtttaaaatgtataatgtaaactctctagcttctgtaaaccttagaagttaaaacaatatttggtttgcacaattatcgacctcctccatcattaagagcacttgctacacttcatccaagtagtagtaactagtaagttgagtagtaaagaatcaagaatgatgaaatggcgagctcaccgatgagggaggcctcgaggaggtgagtccgccatagcacctggtccatggggctgacggtgccgagcttgaggcccctgttctggatcttgaggatgctggcgacgctggacatgaggatcaccgagagcgtgcaggccagcgtcttcaccgtcgccgggcccttccccgtcttcgcctgctccacgccgcgcatcgccacctcccgcagcggccccaccttcaccatcagcagcagcgccaccgccgcctccgccaacaccaccaagaacagcagctgaatcatcctcccaaaaccaacccttcctctcctctcctctcctccaatctttttcttctactgttccgccctgagaaagctgggggttttaccaaaacgaagaccagctttgctcaatttcttcagcatcaaatcgaggaaccggtgcaggaatcgaggttgctttgcaataactccacaccccaaatgctgaagcactcctggtaaaacctcggttctgacggggaggagtggggaagaaatcgcaaatttaatgggaaaatttggagattgacaagaacctgccacctttcttggcctgcaaaagggtagctcatcagcaatcaagagaccaaacccaaaagggggaagcaaatggaaaatttcgagaggagtgaagaaacgaagaaagaaacccaccttgccttctcttgccaagaaccaacccaatagctcaatctcaaaccaatcaagagtctgtagccgtgtgggcagattatggtacgatgctaaagaagaactaattaactagtaaaggcgccgaggcattagagtagagtagagagagatggcggcggcgaaaggcgacgagcaggaaggcggcgtgcaagcagctcactcagctggaagagagagagagagagagagagagagagaggagtgtgaaagttcatggcccctgctgcctgctccgtgctctttttgtgattgataatggcgcttaacgctgctaatcctaaagttgcagggacatgcttaactttcaagagattttaaaaagctgctacgagcaatgcatta

SEQ ID NO: 29796 - DNA, 269 bp, Oryza sativa
caaattttattcaaattcattcaaaattaatcaaatttttaaataatttcggtcaaaaaaaacccaaatttttgatgattttggaaattttggtcaccaccggcaaaaaccttatttggaaattgaaaaccctgctgtatactaagtatatgcatgtttgaagtagttttgagcatatattggaacacgcgttatgttttttttttaagcttgtgtataattaattatacttggtttgcaatgtgtatgcaccaaacgttacgtgcagg

SEQ ID NO: 29797 - DNA, 1501 bp, Oryza sativa
cttcttctaatgactcagcttttgtgtatggtggcttctctcttgccgctttacactcagtcactgaggagcaattagagaagatccctgaagatgatcttgctctttttgctagaaaattctcaagagcttacaaaaatgtgagagatagaaaaagaggaaaaaccaatgaaccatttgtgtgttttgagtgtggagagcctaaccacaaaagagtgaattgtcccaagttgaagaagaagagtgacaagacgaccaagaagcccgagggacaagggcgaaaggggaagaaggatttgatgaagaaggcgatccacaaggtcttggcggctcttgaggaggtgcagcttagcgacatcgactccgacgacgatgatcaagaaaagggggacaaggacttctccgggatgtgctgtctcgccaacaacgaggacttcatcaacctgtgtctcatggcgcttgaggataaggatgactcatcggagcatcctgaggtatgtcttgatgatatcccttccttggatggttctctttgtgatgattcttgctcagataatgactctgttgatgatgaactaagcaaagaaagaatggcacacttgatgattgaaattagtgataagtataggtcttctaagtataaaattgagaaactaaaatctgaaaatgatggaatggcgctagaaattgctaggcttcgatccatgattcctgaggaggatacctgttctacttgtgcttcatatctttctgaaattaatctcctcaaggataagttgaaatcatgtgctttaggagctgggaatccttctagtgctagtgctgcttgctctacttgctatgaaatgaaagttgatatgggtttgcttgagatggaattgaaagaactaaaagaaaaatttgttcatgataggattggtaggtgtgaaaattgtcccattctcactagtgacaatgatgaattaagacaacaagttgccatgcttaagaccaagaatgatttgttagaatcttttgctactaaggaacctattcattcttcatgtgctaattgtgctatcctggaaactgaactaaaagatgctaaaactgtcattgattctatcaaatctattgattcttgttcttcatgcatttctctgaaagttgatcttgagtctgctaagaaagagaattcatacctacaacaatctttagagaggtttgctcaaggaaagaaaaagttgaacatgatcctagaccaatccaaagtgtccataaacaatcaaggtataggctatgattttgctgagtctttgaggataggtacccatgagattttaggtgtcacagatgggatgatagaactagctcaaaaacctataaccttcaagtctgcaggtttcattggaaacactagttctagtacacccaaaacctcagaaccaaagatggtacctatgactagcaagtctaagcctgtagagttacctagacccaaaaatccaaaacaagttgagca

SEQ ID NO: 29798 - DNA, 596 bp, Oryza sativa
aacatctaaccattgatttttacttaactcggtggacccatcagttttgaccattagtttaaattctcatctctccaccctaatatacgatggttgcatgatttggtcccaccaaaataattagttaagacttaagagcaaacaaacgcagagaatcagttatttctctcccaaaaaaatcaccgcagtattaattcttggaaagaaaaccgacgttgtaggtttaatgcaggagcctgggtgtgtgcttccatcatccaaaaaattataccatcgaaaactttttaagtgaatatcacctttgcatcaaaaaagtgaatatcactaactgctctaaactatttacagagttaggttcggattcatgaatattgccctcaatagttagtttctgaattttcatgtttctgtttgattaccagggcctgatgaaattttcacggatgctaaatctcactatatcaaattctcatctctcctccgtaatatatgacggtttcatgctttggtcccaccaaaataattaattaggagtaaacaaatgcagagaatcagttgtttctctcccaaaaaaaatcaacaaataaattttcaga

SEQ ID NO: 29799 - DNA, 1501 bp, Oryza sativa
ctgtgcttgcttaacttaatcctagcttgttctgaactgattggctgagggatggcatctggtggtggcgccccggatggcgacctgtagcccgtcttttgttttcgcttcgctgaacaattgtaatgctgcatttctctaacagaaacaggagatgcatctcttcctaaaaaaaaaggttcatagttcagtaattaattttgtgcaaatcatcgagctgggtgttcagtattttaggagtcatcctcctcaaaatttgtttttttaatggtacacagagtacaatgtattttggagatatttttgccatctgctagtaatagcttaaagcgacctgatgtctgaacgactgtacccgacgttgttgattgcttatcccacttgtgctatttgcagtggatacttctccatgattttatcgacaaggccacagagacaaaccaacgttgtttgcttcttttctccaccgacaggtgcaactgtgcgaggctctctctcctttcgagactggagctgatcaagtgcaaggctacgggctacagcggcgagtgacgcgcttgcggctgcaggctgctgagctcgtccgtcaagcgccgccttaatttgagacgggtccgagcagctccaaccttgctctccacgaaccggccaagcccaattcgccgttgagttccggtcgacggaggaacacaagaacgacagggcaccacaccggtgagcatcccagcttcttctcagctatcgtcagtacttcgtggttgcgcttgcgccgaccgaccggcttctctcccgcgcactccagttttctatctctatcgtcgcccagttctcggaagcttactgcactgtactgtacttgcttacttcttcattccaatcaaacactttcattccaggcagcaactcttaatactagctagttgcattcagttaaacacattccttcagtttccatttcccacaaaaagcagctgctgctcacactccttgcttattgtgcttccctgtgttctgttcgtgtgttcttagctctaggagatccttccgatggcagagctgatggccaccatggtggtcgggccactgctgtccatggtgaaggacaaggcctccagctacctcctggagcagtacaaggtcatggagggcatggaggagcagcatgagattctcaaacgcaagctgcccgccatcctcgacgtcatcgccgacgccgaggagcaggcggcaaaacacagggaaggggcgaaagcatggcttgaggagctccggaaggtggcctaccaggccaatgatgtcttcgacgagttcaagtacgaggcactccgccgcaaagccaaggccaaggggcactacaagaagctcggcagcattgttgttataaagctcattcctactcacaaccgtattctgtttcgttataggatgggcaacaagctcaggatgatcctgaatgccattgaagtcctaattgcagagatgaatgcctttaggtttaagt

SEQ ID NO: 29800 - DNA, 1501 bp, Oryza sativa
acattctgtggcccctatgttgcgagttattaagatttgtataaccctttttctcatctaccacaaaccatccctgctgtttatcctcagcttcttcaacaagaagccttcgcctttctttcttgatattttcccagtctcccagagacagctgcctgcactttatgcagaaataatgtactgactaaacagatacaaagagacttacatggtaatcctccatttctatctcatattgctcaagtcgtctagtgtttccctcttctctccatctggaagaggggagtacatgttggccattgctttctttctttctttttttcaaattagtctttaccttctcgaacgcctctggctataagagaagtcattcttcccaagatgtttggtgcattcctaatttgctcgccatagggaatacagagatttttggattgattcggtcgccaccaatgtagtgagattgtttgtagcatcacgagtcgctgcgaggctaacgatgacaattgacaaaagatgagataatgaatgaaatcgatttaactttttagtagggactcctccatggctctcctaaaatataacgaagaaaatttatttaactttctgtttttctgttgtttctttgagggattaaagatagagtgaaaaaaaaagaattagagcatcaccaagagactatgaaaattctatccctaaaatttagttattaggattcctaaataaaatttgaggggtgaatatattgatctatccaagagaatacctaaaaatgactcccaaaacataaaaaagtgggccgcatatgaactaatcaagataaatcagttttattttttttgtcccgcgtgatcttgatcggccgggcgctcctcccggcgtccacccgttgctcagcagtagcatatacaaggacaagcagcataaataagatgagcaggtagcagcagcattcagatgatcagatcaataacatcattagcatcatcagcagctagcttccagatcaacatcatcagattagcaatatcaacatcagttaagcaccaacaaaaaccagcaagcatcatcaacaacatttccagctgcatttatcagcagcaacgaactatcagcatttagcaacagaaacaccagcatacagtagcagcacatttagcagcaacatccagtagattattcagcaccagcagtagcaggaacaatttcagaatagctaaattgatttgatggaggaactctccatcgacaaattaaatccgctgaatcgtagacaccgtgaccagtcgcctggtcgtctctgatggttctgggcggtcgcctcaccctgttgtcgcctgtgtgttctcggacgacggcgagcggccggtacagggaggcgtcgagcagacaatatgtcaggcggcggtgtggcgtcgtccggacagcggccaaatggttgaatcgggatggcggcgggacaaatcgaggatgcgtatgagctttggggagaggcgacgga

SEQ ID NO: 29801 - DNA, 177 bp, Oryza sativa
attaatgaacgtgaacgaacgcgaacaaacgtgaacgaaacgttaacgaacgcgagcgaatgtgaacgaaacgcgaacgaacgtgaacgaaacgttaacgaatgcgaacgaacgtgaacgaaacgcttacgaacgtgaatgcacttgtactaaaagtatgtgaacgaacgcgagcga

SEQ ID NO: 29802 - DNA, 424 bp, Oryza sativa
taccctccaaccgtcattggggtgcaatcttggacgtccatgccaaaccctggcctcaacggtggagatgggggtttggccgaaccccctggttcggccgaaccatgggctggcccaaaccagcccatcttcggctggcgacgtcctctattgctccactccgcagacttgtgaattttagcccaattcatcgtgtcaattctgacttcttggcccattcatatataagtctggttctcgacatcgtccgattgttttatcgttggtgttgatgtcgattctcctccactttattgtcattctctgcaaaaggttagaagacctaatactagtagaatattactattctaacatatttatgcattgcaagcatcactagttctctcctgttttagtaatattgacggtcgaaactgatcgataa

SEQ ID NO: 29803 - DNA, 191 bp, Oryza sativa
acacgcatgcaggcaccacaccaacatgatcaaatccaatttcccaatctccattcttgattgggagtaagcagtccactccaacagacacaattttatacattcacacacagtgcttcgttgttttatatacatatagttgcaaatatcccagtttcttccacactattgcttgtcaaccccagtagtgc

SEQ ID NO: 29804 - DNA, 945 bp, Oryza sativa
ttagctcttctttgatgattccctgcatcatgcctctattccggtatgacttgctgagtacagtgggtagtactcagtcttgctctaattttcccaaccccagagcacgagtatgtgtcagacgaaggtttctccgaggagtaggcttcgtccgtgccgtcgaggatgcctgtggagtggtgttcccgctgcagttctagtcaaggcttagcttctgttgtctttctttctttccgctgcatttatgtaagacttttatgatgtttgtaagacgtggatctgaatgtcaacattgtcgtctgtgtaccccggccggtcctggacggggattttaatgcacattctgcttggaattctattcgggaatttctgggcgtggcaagttggtatcagagccgaccttgaccgtaggacaagccaaatggaaaaacctaagagccctctgaatccttttcattgcatatgttctttgcaattggatttgttccgggaaaattgggatctgttcttgtggttcaagggaaaaatcttggtcgctcgtttaagtgagatttgtcaaaaacaagtcagtccagggttttagtaaaactgttgagatttattcgtcagtcagttgggatttgatgggtgaaatgcattaggtcctagctcaagaacatgggtagcaaggtatttatgctcttattgttattattagtatgtatctaatttccccattattttatcgttatgtgagtctgtcttatttattcgctctcatgcaaaatgatctatgcataaaatttcgctcttattcgattcgcttatttgagtcttttattgctttatttaaatttggatttgagcatgcattgatcctactcctttgtcttctctagatggccggccactcacccaaccaccgtggagaaggcatgatcgactttgtggcagagttggcacgta

SEQ ID NO: 29805 - DNA, 701 bp, Oryza sativa
cttccgtatgtctccttcaaatagaaacccctataatcgcagctactgggatgagggcctgtttagatttcttggcaaaattttacaccctatcacatcgaatgtttggacacatgcatggagtattaaatataaatgaaaaaaaaaactaattacacatattgcgtgtaaattgcgagacgaatcttttaagcctaattacgtcatgatttgacaatgtggtggtacagtaaatatttgctaatgacggattaattaggcttaataaatttgtctcgcggtttataggcggattctgcaattagttttgttattagactatgtttaatacttcaaatatatgtccgtacattcaatgttacaagctaaaactttagcagcatatgccatgctagccttcgtactactactttgtaaggaatttttttttcagattagagtttctatctagactctattttgggcctgttcactttgatgccattttcaaccttaccaaattttagtaaagttaccaaaaatatggctacatttaatttgctgccaaattttgttaactatataagaaatccttaccaggttttttttagcatcaaatttaacaggcgcttggatactgaaagattggaattcagttttctaccctttgcgaatttgcgaatcagaacagcaaaaacctaagcaaaccctagctccggcga

SEQ ID NO: 29806 - DNA, 1157 bp, Oryza sativa
tgatacgattaggattgtttcaaccttggttgttgctgcttgttccagaaaaaatgtagatggatgtcgttgatattggttgaaaaagtaagctagaggcgcattgctttcttttcctatggctttgcatctgaaaatttatttgttgattttttttgggagagaaacaactgattctctgcatttgtttactcctaattaattattttggtgggaccaaagcatgaaaccgtcatatattacggaggagagatgagaatttgatatagtgagatttagcatccgtgaaaatttcatcaggccctggtaatcaaacagaaacatgaaaattcagaaactaactattgagggcaatattcatgaatccgaacctaactctgtaaatagtttagagcagttagtgatattcacttttttgatgcaaaggtgatattcacttaaaaagttttcgatggtataattttttggatgatggaagcacacacccaggctcctgcattaaacctacaacgtcggttttctttccaagaattaatactgcggtgatttttttgggagagaaataactgattctctgcgtttgtttgctcttaagtcttaactaattattttggtgggaccaaatcatgcaaccatcgtatattagggtggagagatgagaatttaatctaatggtcaaaactgatgggtccaccgagttaagtaaaaatcaatggttagatgtttatctaatttattagagcgccacttagcagcttgggagcgtttttaggggtgccaggtgtcgacttaggagcgttttcaggatgtttcatggacttttaatatataatagatagatagatagatagaagatagatagatagatgaactaaatttgatttgtcatatcgtggtatcgataattaatttgacgaaacgacaaaggcgaagaaagagtactatggtcgatctattctccgagataatttatattgttgaaattctggtggttttccttctgattataactgaatgaaagttgtttgatgtttgttcagtgaatccaccagcattaacaattcaacatcttgtacccactccttgagtctaatagacttggaagactccgtccccaacaaggcttgttgtgatatagtcattagatcacaccggtg

SEQ ID NO: 29807 - DNA, 1501 bp, Oryza sativa
gataacaaaggatggcatagtagggtttcatttgcataaacaacatttaatgaacatttcagaatttaataaaacagttaagtaataattaaacaatattaatccaacgctatacaacataccttgttgcataggcccaaccattctgaacaaccatcccggctgcacagttctatctccaaaccaggaatatgccattccaaaccaggagctaatcaaattattaccagttatagcatcttttactatggtgagaggtgtgaaactaatcacgaaagacattgttagacccgcccataaccgcgggcacggctattcgaatagttttactctggccagaggtgtaccactgtacccacaagacacagccccacaacatgtcaccatgcgcctcaataccaccacggtacctcagaaaggagctgtgacagtacccctcgcacaacacaatccaccacagcgcaccgttcctggatcataatcacccccttataaacaaggcatggactccccagtgacccccgtgggcttatctccgccacttctcagtctggtgccccgcaatgaaccatgctatacaaaaggtaaagccgttgcccacgctggcttgtggttggcacggttaatgtttcacaaccgaaactcgtgaaccggtccttaatcatcatgagcacgaccatcaaaaccatgtgctcacaacccaccattatcaagttttagttggcaatttaattaattaaccaatcacgattgaccatcgtgaactatcattaagccatcattaaataatagtaatttataagttatcccaatagtgtgctaatgtttctaagcatggctaagcaatcatatctaatatctagctgaaccaatatataaagctcaactagtcaagttataataacccaaggtatcaaggaataaagtaatcaagaacaaaagggctataacaaacaataggttaattccacccaatgacattcgaaaataaatgcaatagttgaatagaaacaatagctttaaacgagatcaacatgctcaagggttgtttgggatctgtgtgacttgccttgctggccttggaactcttcaaattcttctcctgcaaaaacggactctctggaaacatcggaatctaaacagaaaggagcaaaacaccaaaacaacacataaacaagcatgaacagtacatgtggatatttttaacatgtagatctcaattttagaaaaaaatagagacttgaaccaactaaatccgagctaagatgaattagttatgaattttcaaagattaaatcggattaaaacacttatatggattttaattgaattatgacgcaataatcaattatttttgaaaaggaaaaaggggtttattgcgtcagcggctagggttcgcggtgaaccgggtgcacggcggcggctcacggaaacgaacggccgagatcgattcatccaaaacggacggccaagatccatcggtccacgaccgggccacggg

SEQ ID NO: 29808 - DNA, 1501 bp, Oryza sativa
gcgcaattgcgtaggccaccttgctagttcatatagatggatgttaaagattctaggcatatgggtaatataaaaaattcttataatatgaaacagagaaagtacgtacgacgtcctgcgttacgaagaagggaagaacaatgtattttttatgtacacgctttacctccttggagctgatgctggagcctgtagtattcgagctcgtcgaccgcgtcgtcggcgtcgtacagcacctcccttagacgaccgagtgatcgggccagcggtttgttcgcgatcgccctccccttgacagcaccgaccaccacctccaccctctcgacctcagaccggagcttttcggtgtcatcggcgagcccgacctggctaatccacgcgccaaacttgtcgttgtccaggttctccactatggtatccgccagccatccaatcgaggactccagcaaattaccttctatctcctccatccgcaaatgagaagttattagtaactcttaaccgatggtctatggttataagcaaaatacgcgaatgatatttgggaacgggagcaccggagcagccgagaagagaagaacaaacaacgacaacaaagtacaattacagccggggggactcaccgcagcccgcatataaaagcagtacagaagtcagaactcagaagtccgacatggttttggaccgagtgagagacgatgactttgctctccccatattcaaaaggataaacctcgagcaagcctttcaaaccgcacgcattttagatttcgcgtcgtcagatttgcatatgttatcattacgcatacgactgcagcaatttgactgaggatataaacattgtaatgaatgaacttttagagttgaaataatccctccccgacacggctgactcagaagctctgcagtacgcaaataaaacaatttggagaaccgcacgctgaaagcggaagatggattctaatccctcaggccttgttcggttgctagggattaaatcctaaggggaagcaaaccagggagggattgagtgaatccccccaatttcactcaaaccctgtggggactaaatcccttgtttcttccaatccctctcttagaaactctgtgttcgttttgacagggactatagcagctattggcagggaatataggagcgtattgctagctctctttatgatctggacttgtattactactattagtacatttggttaccactatttacctaaaaccagtagtgctagtaccctgtgacggcagcgtaggagcaagatcaaaagtaccattagtccatttcagagaaaactagaaaacaatatacacgcatgttacaacttcctggatcaagaaagttgatgccaatgtagtgccagccaaaattacaggaaatgcttgtaatattccaattatatgatataataaaaagattgttctgattccatttaactgcttgaaaggttgttaaagatggctgaatgaactgcattcaggcattgtt

SEQ ID NO: 29809 - DNA, 1501 bp, Oryza sativa
tgtctagtagaaggaaaaagaataattggatggtagtagttttgttttcttctctatttctgtgataggtaaactgatgtctactcactgattttccttgcagactccttgaaattgactggtagggatgttccatagaatttctttgatggtagcagtttcgtgatggtgtcatttatagactaattaactatccaatgaagggtattactgatgtgtcattttagggatgttgggagaagtttggattttgttgtgcatttagactaatcaatcatcgaagtcgccacagatggattcaacttgctcagtatcagtgtctactgatgtgtgtgctaaagaaaccagtggccactaattaaccatcgaatgaatgattaattttggataataacactatgcctccaactgaaaatagcttatttcttgatcaggtgtaattgttgacattgtgacatgtcagatcttcaacaatgcctgaatgcagttcattcagccatctttaacaacctttcaagcagttaaatggaatcagaacaatctttttattatatcatataattggaatattacaagcatttcctgtaattttggctggcactacattggcatcaactttcttgatccaggaagttgtaacatgcgtgtatattgttttctagttttctctgaaatggactaatggtacttttgatcttgctcctacgctgccgtcacagggtactagcactactggttttaggtaaatagtggtaaccaaatgtactaatagtagtaatacaagtccagatcataaagagagctagcaatacgctcctatattccctgccaatagctgctatagtccctgtcaaaacgaacacagagtttctaagagagggattggaagaaacaagggatttagtccccacagggtttgagtgaaattggggggattcactcaatccctccctggtttgcttccccttaggatttaatccctagcaaccgaacaaggcctgagggattagaatccatcttccgctttcagcgtgcggttctccaaattgttttatttgcgtactgcagagcttctgagtcagccgtgtcggggagggattatttcaactctaaaagttcattcattacaatgtttatatcctcagtcaaattgctgcagtcgtatgcgtaatgataacatatgcaaatctgacgacgcgaaatctaaaatgcgtgcggtttgaaaggcttgctcgaggtttatccttttgaatatggggagagcaaagtcatcgtctctcactcggtccaaaaccatgtcggacttctgagttctgacttctgtactgcttttatatgcgggctgcggtgagtccccccggctgtaattgtactttgttgtcgttgtttgttcttctcttctcggctgctccggtgctcccgttcccaaatatcattcgcgtattttgcttataaccatagaccatcggttaagagttactaataacttctcatttgcgga

SEQ ID NO: 29810 - DNA, 340 bp, Oryza sativa
tttctttttataaaccttttcaactttgtttatttcttaataattattatttgtgctctgaaaattccactaaaatttgagggctccttttagaccaaggagaatttaacaaaaattctccgggccatatttgaatttttcttgtacgtattttagtgtttgccaatttcttttcgaattttaattaattctattattccttttagaagatgatttttattttgggatgaatttatcaggacgtgacaccctacaaccaactggcagtttgtagccgaggccttggaatcaaagagacaattccccttaggcaagattctcctcggctatttgtaccaaa

SEQ ID NO: 29811 - DNA, 888 bp, Oryza sativa
aaaacttgtactcccgttttcaacaccacttacctaactaccaataaattttattatttttttattattagtggagcactttagtcagattttcttagtaacatttgtcgacaaattttctcctaaaaatttaacaaatgtaattatattacaatcgtagtgtaattacactgtaacttatatgtatttacattgtagcttgcatgtaactacaatgttacttgtatataagtttcatgtaattttgaacagttaaatctattacaagatttgttttggtgaggaagaaaaaaatcacagcgcatatatatgtgtaaggatttgttcccacaacctctattttaccgaaataacatattacagagagatttttgaaagttacatacaagttacactatagttacagtgtaattacatgcaagttacagtgtaattacactgtgattgtactgtaattacatctgtcaaatttttaggagaaaatttgtcgacaaatatatagcaaaattgatcgaaatatattactactaattaataggatgagttttttgggcccggcccagtagccaatattgcatgcttactgatcagatggatggttgccccggtttggcccagcgtatgctatgcatgcttatttactgagtggactaagttcacttgtggtcctttatcttgacgccaagtttgaattacgtccttcgaccgcagtaccatatataatgcatttttatcttgcaaaaccggtatactcgaggtcccaagacattatagtgtctaattcaagctagcgtgacgagtgagacccatatggatcccacatgtcaacgatcaactcttcttcctcctctctctcccacttccctttcttccccatcgctcttgagg

SEQ ID NO: 29812 - DNA, 1501 bp, Oryza sativa
atatcttcctctcccataactaggcttgtgtggagcacgacaatcacgcataaggtgtcccatctcaccacaattgaagcactccctgatctttttactttgtgcaactacatatgtgggatttggtgaagatggtgtgacactaggcaatactttcttcttaagctccccatgtgccatagttgcaatagcctcatcaacgtaggaagagtggtttgatgaaatattgcatctcttctcccttcaaactccgaatttaggcccttcaagaagtcaatgacccttctgcactcaatccattttctcatttttgctatacaaacggggtgttctaacccaagaggatcataatgatccaaatctaaccacaaatgcttcagttctgcaacatattctgcaacagaacgttccccctgtttcaaagcacttatcttcttttgtgcctccaccattagcatcacatttccttctcccgagtaaaaattagtgagagttttccacatctcacttgcactagagatggtctcaacagttgttgtaacagtagggataagtgaagttaacaaccacgctaatattaaagagttggtagtactccaagtcttccactcaacacttaatgtactgtcaggctcctttatctcccctgtaacatatccttctaatccctttgtcttcaagatcaataatgctctccttcaccaactcaaataatttttgactccttctaatttaatatcattttgcatcaactcaatttttttactgattcagcatgcgaaacaatcgcattgctggtattagaggtctcactaagtttcttagcaagcatatctaccaatttacccatcacctgttcaatcccttgattttcccgcattacagcaagttaatagcagctatatcccttcttctcacctccacaagttaatctgttccccttcttttattgctgtgagacttcaatctgaccaaatcctcaccttctcaacagtagcagtagaaaaaattctcaccttctcaagcagcatccgcaacactttctcaagcagcaagcggcagctgcaccttctcaatcagcacctctacacgctagcaagcaatatcaccatcttctctccacacacacaatcgccaacagtagaagcgcaccttcactccacacgccatcgtcaacttgccctccgcgcatgcggtcgccgttggcgcttccagctagctacaccttctctccatgtcggattcctccaagcacaaccacagcagctgccggtgcctccaccgtcaacactgtcgctccctcaccacagcaaccgtcgctgccttgctccctcaccacaatagttgccactgtctccaccctcaacacgctctcttcctcgtcaggagctccagcaccacacgccagtacacctaggggtgggcgttcggtctaaccgaaattttcggtctcggtcttcggccttttggttatttcggtctttgaaaagtgaagaccgaa

SEQ ID NO: 29813 - DNA, 1501 bp, Oryza sativa
acaacaagttgatggcgatggtggatggcttgatggaagacggcgcaggaagtggggaagacgacagaggtggatggcataacagtgctgcgccattcgctggtaattgagagatctcccaacgatggtagcagtgctggaaatgagacgaccatcatgccggctcgatcttcccatggagcagctcgtgcttgcgatgacagcggcaacattggtgctcactcgatcggactgcaacacaaccgcgtctactcgatgtcccgaggcaggaacctaggccggattatagtgagcagcaatagcagcaagacatggtccggtggacgacgatggagagagaggcggcagtgcaagttcgcagcgaacggccggtggagggatgcaggcgtgtcgccggaggtgaggaagatgcatgggaggtggccttggccttggtgttgaccggcggcggcgacggcacggtgtggcaggaacggtggtctgcaaagggaaaaggagggggtgctggatctacttatagaggaggacagggagttgagcggccagccggaagatgtttattcatttttttagctgagacgatggaaattgaggtgactgactgatgatggttactcattttttggctttggtggagaaaattgatggaggggtttcgccggggatttggctggtgatgtgatggcacggccggggctagctgaagcgcgcaggcgggctggttcgaactgcatgcgaggaaatgagatatggggcttcggcctcctgctgatgggacttcggcctcctgctggccagaggaagaagatgaccgatcgagaaggaagaaagaaaagatgaacagccgggagacaagatccaactcatcaaaagagattcaattttcggcattcaacaagtgaaattgatgatggagaggaaaggattagggaatttctgttagcttcagctataatcatgtgtcgtattatcggttactgtaacgtgtctagtgttgtcgtttcttcagtttcgtcagactctgtttcggcgtctgtttctctgtttctttttcctgtaagccgagtcttccgggtcgtgcgtcgtgtgcgagtcatccggatttcagtgtcgtggtcgcatcgtcgtggatgatggcgtagtggtgtcagtttgagtctgtacatatttgctatatatatgagcatcagaaaacgtcgctggttggttcgcgacaccaaaaactctgttcgtgttcatcgtctttccaattcagagaattcgcgtgagagagagagtgaggattcacaatcttgggctttgctatcatttggtatcagagccatgtccgctcccgccagcggttcgtctcgcactcaccggcgaacaggccgccggctctcgccgtctccgccgcgcgtgagcgggcgacagctcgtcgtgcagcggattgttaaggaagatggctccgtctactatccaatactcagacgctcaaattactccgattgggcggtgttga

SEQ ID NO: 29814 - DNA, 1501 bp, Oryza sativa
ttccagatcaaaatcaatatctgcatcgtctatactagagtcaccgcattccgggatggttccctgtgacatgtcttcgattataatattttacgcatcaccaaagcagaaatcatcagcctcttcgttacgaccaccgacttccccgtgaaaagtctatatctcgtagagagaatcccttatatgccactagaatttgaccagttcccttatatgccactcaaaattagcttctcccttatatgccactagttcaagtttttccacccttttatgccactcctaccactatagtgttagttgactgttagtcaaaggttagtttttttcgtaaatgactaatatgccctctcaactaaaaaatgtgtaaacttcaaaaaaatcataactaatttattttaaatcctctttgagtgaacaaaattttgtcaggaccagtgaaaaatgctctttatattaaaaatattgttggaaaactgcatgtttcatacttacattgaaaatttatttgcgatggtaatggctaaaattgcacgcgatgtagaaaaaatcaattttcatatgttgtatcccgtagctatattagtactaaaatacctattattggttgtagactaattctcaagggcaaatgcgtctttttacaatcaagttaacggtcaactgacggtggactgacggcaatggcataaaagggagaagaaacttgaaccggtggcacaaaagggataagccaatttgaagtggcatataaggaagccggttaatttagagtggcatataagagattctctctatctcgtaacccttcttaaatcctcgctctacgatgtgcgacaatacttaattcagatcttgcaatctttgcatgggcaaaaaatgcccctcaaattctccctcacagcatgtgcctttgccagctcaacgaatttgcctgcttccttcaagaacgtaggatgagttctttttgtgttgtacattcatgtccgatccatgacctagaatacagcttgtcatgaatacatccatgcccgattcaaaaatgagtgtatttaaacagagggaactaatcaaatagtaaattaaagttttatggacaatttaaacgagcgtacagaattttaaccattaatataatattgtccatttctaaaaaatgaaaaaaagtccttttatccgaatgaaaataaatttaatggaggcaaacccaacttttcaatttggatactaaatacttttaaaaacatgtaatggaaacattatacattagctaaaatataaaaaaaacaaaaagtgcctacactattccatttataaaagtgcaagtttcttcgaattgcaccgacgaaaacttacaaaaatggaagcaaataaaggagaagaacaagctctacaccttttatatggaacccaatcaaagatttgaggtcgaaaaccttcccccctaatttgtgggtgtttaggagagagaaaacaccgacatatatggcaacggtcgggc

SEQ ID NO: 29815 - DNA, 1501 bp, Oryza sativa
ggagttcctggaggatgaaggcttcggtgtctagctcgtgcctgccgtcaagtgcctgtggtcgtcgccctagtcttccgctgtttctcgtttgtctttgtgtgtgctgggccttcgctgcccatgtaatagattaactatttacgcttccgcttgttaaactctgaattgtatcaacttttggtgtaccttgcctcctgggacaaggattaatgcacgcacgtaaggaacgcccgttgggttatttccggtcgtgacaagttggtatcagagcccccttgaccctaggacgagccgtagatcccaagcctttgcagtattttcgaaataaaaatcctctgttatttgtgaaaaccctctagtctttctctgtcttgctgcttcatttatcgccaaaatctgatttttttttaaatgttgcttttctttttgtttttgtttgtagatggccggtagcgtcacccgtcgtggtttggacatgactggtttcgtcttggagctgcggggcatgtgcgttgtcctggggtatccacatggagtggactaccagggcaggccgcttccggagcaggagggtgacgaagcagagccccacgctgcttgggaggtcactgcagtgatcctcgccggctctcccgagcggacttcgctggcagtcaccgcgggtggagattctttccccgccgcttgctagagcgccgctctcctcgccatcggcactcttcaccagcgctacccggacgagttgcagcactcgccctaccgctaccaccctcgccgcggaggagcccgcgactacgccaccttccgggatgctagctcggaggatgacgctaccatcatgcacctagcgcgcatggtggaggcgtacgacgcggctcgtatcgacttccatcagatggtgcgccgtgggatggtcgagaacaacatgaagatcctggagctgcgtcaagagaacctgcagctcaagaaggacctagacgcggtggaggcgcagctgcatcagctcaagatcgcccagggagaggtctgtcgccccaagcgtcgccgcgtctgccgcagccagaagatcaccgcccgcaagagcacctccaggcccgagcttgttcgtcagtccctggcgtggacctgcttcgtcgagacccctcgtgccgagtccgcgcccgtggttccccaggagggggaagcctccggcgttggtagcacggaggatgcgctgttgctcaccttccgtcctggcccgtcgcagcggtagacgagcagttagtaggcttgcgcgtgtgttctttctcgtttgtcttcttgttgggttgtgtggggcatggttatgccggtgtgtggcataactgtgtcggagcctgcctttattttatttgcctaagcaacttgaactttaatgaaccaatttaatagcagtaataaattcaagaattatggtagtcgtgggtggttagctttaattgccagctctctctatttgctggttctgtgtggggttttc

SEQ ID NO: 29816 - DNA, 1501 bp, Oryza sativa
gttcaagcacagagcgcaacaccgtatagtccttgtcgcatcctttcgcttcgtcgtaaagaagatccttcgctgttttttcaacgcttcccaattgtccaaccctcgtcttctaccagttaggacctctggttcaacatgccgcaacatatcttccagatcaaaatcaatatctgcatcgtctatactagagtcaccgcattccgggatggttccctgtgacatgtcttcgattataatattttacgcatcaccaaagcagaaatcatcagcctcttcgttacgaccaccgacttccccgtgaaaagtctatatctcgtagagagaatcccttatatgccactagaatttgaccagttcccttatatgccactcaaaattagcttctcccttatatgccactagttcaagtttttccacccttttatgccactcctaccactatagtgttagttgactgttagtcaaaggttagtttttttcgtaaatgactaatatgccctctcaactaaaaaatgtgtaaacttcaaaaaaatcataactaatttattttaaatcctctttgagtgaacaaaattttgtcaggaccagtgaaaaatgctctttatattaaaaatattgttggaaaactgcatgtttcatacttacattgaaaatttatttgcgatggtaatggctaaaattgcacgcgatgtagaaaaaatcaattttcatatgttgtatcccgtagctatattagtactaaaatacctattattggttgtagactaattctcaagggcaaatgcgtctttttacaatcaagttaacggtcaactgacggtggactgacggcaatggcataaaagggagaagaaacttgaaccggtggcacaaaagggataagccaatttgaagtggcatataaggaagccggttaatttagagtggcatataagagattctctctatctcgtaacccttcttaaatcctcgctctacgatgtgcgacaatacttaattcagatcttgcaatctttgcatgggcaaaaaatgcccctcaaattctccctcacagcatgtgcctttgccagctcaacgaatttgcctgcttccttcaagaacgtaggatgagttctttttgtgttgtacattcatgtccgatccatgacctagaatacagcttgtcatgaatacatccatgcccgattcaaaaatgagtgtatttaaacagagggaactaatcaaatagtaaattaaagttttatggacaatttaaacgagcgtacagaattttaaccattaatataatattgtccatttctaaaaaatgaaaaaaagtccttttatccgaatgaaaataaatttaatggaggcaaacccaacttttcaatttggatactaaatacttttaaaaacatgtaatggaaacattatacattagctaaaatataaaaaaaacaaaaagtgcctacactattccatttataaaagtgcaagtttcttcgaattgcaccgacga

SEQ ID NO: 29817 - DNA, 1501 bp, Oryza sativa
taaaatcatattaaaaaaatatatgattttatacgggtgctagtcgcgcaattgcgcggaccacccagctagttcttattattaaaagaaatgaagaaagtggagattaccttcgtagcaggcatctagctctttctcctcgatgtcatccagacgttgctgcaggctcggtggaagcacctttataccagaacaataactaactgtaagagatgtaagagatgagtatgcttgaggccccttcggcaaggataccaggctctcgcaatcaaaaagggtgagttgttgcagcgacgggagctctcctaagcaagattccagtgatttcaagctctggcacgattctatatttaattcttgaacggcatccagctttcctgagagggactgaagttcttcgcagcaagaaatatccaatttcttgatggacggaggaagatggagaacctccaaacgatcacagttccatattactagagattctaggcgtggaagggtgcgattgttggtctcgctggtggagcctgatattaatgatgacttatccggctgtgcaaagctttctgcattcaccaacatcgtcctatcctgctgctgattgaatatgatggactccaggccacggcaccccctaatgtctaatagcttgagagacgcaggtaggttggggacttctacaaaagaaccacaacagcttatctgtagggactctaaacgtggcaggagttcacttggtgctggtgtagattgcccacgagcttgtgtgtgtcctgtcagattcttgcattgataaatactgtacctaacttcctcaaggaaaccaagccctggaacaccttttctggccagtagagaagcgcatcgactttccgaatattcagatctatgagctgaacaaaacatgtccagagagccagcgcacttgggtgagagaataaaaggttgcacccatttaagttcataagttcaaggggagatttatgattccatttctcatcctcaatcaccaattcactcgaatcttgttgcttggccaccgatgttgtttctgtgccatcagttgacaaatgcagatggagactggacaatgaagtagtatatctgctagctgcctgtagggatatttgttgattgccttcatgtatgtttaagacacttagttttggtgcttcaggtagagtagtcagctctgggcactcgttgattgttaatttgtcaagctgaggaaatgctacctcctcctttagagttccatcgactgcctcccatttctgaaagatatccaaatcatctaattccatttccttcaatgctggaaatgcagaacgacacacggtgctaactccgctagacgattctgaaatcacatttgacgcttttggtaaggcagttagcctagggcaactttcgataaacagcttttcaacctcaggaaatatcagctcttctccttttacctcatttgtgtcccaccatggctccttgaaatgttaaacacagc

SEQ ID NO: 29818 - DNA, 1501 bp, Oryza sativa
cttggatcggttgggtttgctcgaatcgtcttgggcgcttctcctgccatgtgggatttctcggggttgcctctgatttgcagaaatgcttgctttgtcatttctttcttctcggtgcccaatgttaggggttccttaaattgcagtatttttgtttactggtgaggagacaggttgcatcttgtggaatcattttcttgttgcctccttctggggctattttccttgggatctttttaatttcccaagaaaatgtgccaatctgaaaccgaaattgttgccatgtccttttctgctcaattatgtagttatccaatctgccaagatccagcctttctgcattcaaggatgcaatttatgctgcggattcaatgttacaagaatgtcgacatggcatgcttgcagggctgatttgctgagtaatatattaatgcaggaatctcgtgcagagaaaagatctcagcttcgtgaatgtgataattgatacagcttgtttacttgctcgtttgagacctgtccttttaatgcatccttagtagtgttcctgcagaaaagatgcacaagtagttacattcaagttctttcaagcagtatagatagcaggatctgagtaaattctggttgatcggacaaagctgatgtcatgcatacatgattacaatagataatatctgagagtttagataatcatgcctatttaggctagaattataattcctgttacatatgaaagaaaacatgatgacaactgacaaggcaacaagctcatgtagtagattcagcaatcagcatgctgtctgctctagacttttttttttcatcagctcttttttcggagtatatgtgcttctttatttttcttagcgcatttcaataatatgatagttctttgttaaactttaccagcataaaggagttcctaaatttggaagctgggaggatgaagaccgtggtgaacacctctacacacagtatttcgaaaatgcccgcaagggtaaatctccagggaggtctgttaatccaaacaatcatcatggagatactgaagcactctctaaggcctctcccctgcacgctggatctgatccagccatgagaaagcccaaggatgacagacgctcaaaccgagaaggtgatcttcgtcagcacgaaaccactgttcgaaaaccatatgctgagtcacctaatcatagatatggggatcataccaactatgacaatgctgtgagaaaaaccggcatagagaagtcacccgttcatccccgtcaccaggcaagagctgcaaacaagggtggagtttcgtctccttcacgtgaccgtaggggttcattggaaggaaaccgtggatctgctcccactacacctggaaggtccaagttcagatcaactggccgtggtgatgagacggtaaagctctaacttatgatgcatggtattaagtaaactgccctttgattcattgactataaaaatacctttagatgaagtaattaattgcgtt

SEQ ID NO: 29819 - DNA, 1501 bp, Oryza sativa
gatataatctgcctcgctggtcatgacgggagcgttgccggtaccagactgtttctcctccctcaccttctcaaatatgtcagtgaaaccttcacctgtagaaggatctttctcatcccattctccaaactttggcacggctgatcctctatcaggctgcaaacgcaattaattacttcatctaaaggtatttttatagtcaatgaatcaaagggcagtttacttaataccatgcatcataagttagagctttaccgtctcatcaccacggccagttgatctgaacttggaccttccaggtgtagtgggagcagatccacggtttccttccaatgaacccctacggtcacgtgaaggagacgaaactccacccttgtttgcagctcttgcctggtgacggggatgaacgggtgacttctctatgccggtttttctcacagcattgtcatagttggtatgatccccatatctatgattaggtgactcagcatatggttttcgaacagtggtttcgtgctgacgaagatcaccttctcggtttgagcgtctgtcatccttgggctttctcatggctggatcagatccagcgtgcaggggagaggccttagagagtgcttcagtatctccatgatgattgtttggattaacagacctccctggagatttacccttgcgggcattttcgaaatactgtgtgtagaggtgttcaccacggtcttcatcctcccagcttccaaatttaggaactcctttatgctggtaaagtttaacaaagaactatcatattattgaaatgcgctaagaaaaataaagaagcacatatactccgaaaaaagagctgatgaaaaaaaaaagtctagagcagacagcatgctgattgctgaatctactacatgagcttgttgccttgtcagttgtcatcatgttttctttcatatgtaacaggaattataattctagcctaaataggcatgattatctaaactctcagatattatctattgtaatcatgtatgcatgacatcagctttgtccgatcaaccagaatttactcagatcctgctatctatactgcttgaaagaacttgaatgtaactacttgtgcatcttttctgcaggaacactactaaggatgcattaaaaggacaggtctcaaacgagcaagtaaacaagctgtatcaattatcacattcacgaagctgagatcttttctctgcacgagattcctgcattaatatattactcagcaaatcagccctgcaagcatgccatgtcgacattcttgtaacattgaatccgcagcataaattgcatccttgaatgcagaaaggctggatcttggcagattggataactacataattgagcagaaaaggacatggcaacaatttcggtttcagattggcacattttcttgggaaattaaaaagatcccaaggaaaatagccccagaaggaggcaacaagaaaatgattccacaagatgcaacctgtctcctcac

SEQ ID NO: 29820 - DNA, 1215 bp, Oryza sativa
ccatgttcacgcacagaaacacagtagtccaggttcacgcacaaaaaacacaggagtccagttcacacacaaaatatacatacaaaaaaacagagtccaggtttaccaggttcacgcaagaaaacaatatcgcatacgagtcaggttggttcgcccacaccttttcctgctcctgtttgcgcagcccaagtcaggagttagattctatcccgattctatcccgagtcagattctatcccgcttttgtttccgctatatttagctagcactcccactaacgtgattttatagatttttctcgcaggacaaaatacacaaatatgattacaggcaatacaaataatagaagcgcacaagaagatatagatcacaaggctcttcttcctctaggatgtcaagccacctccaattaatgtcgattccaggttatcaatgaactcaaccctgaatgcaatttcaatttcattagatttataagattaatattgaataaaactacccaaggtcttttttctgtccatgcagaaacatatagcaagttagcaacaggcatattttcatttcagttgctcagcggctattttcataacataccaccacaaaatctaggagttgcaaacccaaacatgaaaatctcttttttaagtggctttatatattactagaagaaagaaaaagtattggtaattgcagcaagagcaattttatgcagaaaaacattaactgtgcagacagatgaaccatcgtttaattattgcaattttttatcatgctctaagaaccttaatgtttatcatgctctaaaaaccaagtaaatacaacacgactagatgaatgtctttctgctttctttttaccttatgtccgctctgcttttattcttatttattggcagtaattaccggaatatttttggcaatcatctcgattctatacctccaacccatcaaagggtgataagaagaaggttcacaatgcagcacgacattgccaattgcctgaaaacaatgtcatagccaacacttataccaatccagatcagcagacatcagtatggagctcttaaaaattccaaagcattacaacggggcatagcaagtacaataggttccaatttagccatgcaactaaacttaattctgaaaaaaaaattgacctgatcatcataactctttagattaagaaagatatatcttgatgatctttcagaatttc

SEQ ID NO: 29821 - DNA, 567 bp, Oryza sativa
tgctatatgccatgatgcttttatttgatttaaagaaactttgttttgatatgtgatggatattttttcttacttgcatttgtttccatgatgcagggacagtatagcgatattggaaccaaggactatacatctaaattatcagtgtactgaggttcatgatagtgctctgctgaagaatgtggagattattgcaaaaagactcactaatgcatccgtgatttaaggtacttctggtagcattggagtctataaaatttccctacacatctttgatttaaaatattttgctttatgcatgtgtatagaattggagcctttctcaacaataatataagcttatgaacatgaaattctgaaagatcatcaagatatatctttcttaatctaaagagttatgatgatcaggtcaatttttttttcagaattaagtttagttgcatggctaaattggaacctattgtacttgctatgccccgttgtaatgctttggaatttttaagagctccatactgatgtctgctgatctggattggtataagtgttggctatgacattgttttcagg

SEQ ID NO: 29822 - DNA, 1501 bp, Oryza sativa
acttttaggtctcgtgtgctaccccttttattattgctgaattcatgtttcaacaatcgatatcatatttttcttttaatcgccgaatatccgaaacattaccagtcttaaccaatgtcgcagtcatgagtgatacatattattttattcggtacatgattctagtgaccactctgtcgattatgagatgaggggtgattgtgcggaaaactaagttaattgactatctcagtgatctagattaacagctggacaatcacaagctaaatatataaaaaaaaggtatgctgtaggattggatcgatcaatatcgagttatatactccctcctttcctaaatgtttaacgccattgactttttaaacatgtttgactgttcgtcttattcaaaaacttttgtgaaatgtgtaaaactatatgtatacgtaaaagtatacttaacaataaatcaaatgataggaaaagaattaataattacctaaattttttgaataagatgaacggtcaaatattttttaaaaagtcaacggcgtcaaatattttgagatggagggagtattaagatatgtaaactccacagcactagttgattctcctgaaactcattaatttgaaagggaagattaagctcaatgcaggagtgcagtgattgtgcagaaaaaataatttaacaaccccaagccagctatgtttggactacaatgatagctcgacgatcgcaagctgcatatgaaaatacgaattaatgctgaaatatttgggtacggtatcgcattctaaactagtttgctctacaatattatatgttagtatttattaattacatactctaatctatagtctatcgtgaaaataagatactatatatattgaacatggcagggatatttttcctgttatctaaaaataataacgcgcgatgcaatggaattaatcatgatagcagccaggtacgtagcagctccttctaatataataaagctcgtgtaaagattttgctcatttgatactttgcacgatgttagaggacatgaagtggaaaaagggtccttgatccagaccacagtagctgtggattgaatggcagacccaactttaattgtaaatttagagtttggaagatatgtcttttatagttctcttaatgtatgattttgttcatggccatgtgatcagggtgttactacatatattatggtattgagttatatatatatattatatgtggtctatagaagaaaaatatttctatttcatttcattaaacccacggaacatgtgacgattttttgagaatttctctaagccatttactaatgcagatagagttcgtggctacctagtgctaggtagctgatatgcttagtataaaaacacagagacagcagcaagaggctccatccatagacgcatcacataatcttctatctctctcaggctaactaatttcataagcacacatcttccatttccatcaccatgcctggagcagctaccaccg

SEQ ID NO: 29823 - DNA, 1086 bp, Oryza sativa
atatatacttaaactaagtaattgggatagatcggtcgccatgccgagacaatataaatcacttaaatcgaaatatatattaaaacatgaattatatagaagtttatagcatagccgatcaaatagacctagcatgtatcggctaatactccgataccactctatatcaagatatcgagacaagcaagatatatcaaataataaacctaatataactttaacgcaacgagatcttaatataaagggcatatttaacatatcagtcaagtgcatgaggataaaatagctaaatcaggtaagatcggctggaactccgatacatctctattgatgatcataaaccaggctagatatcacaattatagatagaacttaatagatcgaactcaaccgatgtagcattaagcataaagataactgtaagatctaaacaagatgatgaaaacctcttagagatggtagatatacgatataatctagattaataacgagatctaactctatcggctactttctaacagtaaaaaccagccgatggcaagttatatagcgaaactaacagagattataaagtatatatgataactcgatgaattacataaacaagattagagtatcataaagatggaagcactaatcccgagaacacaaaccgccatgacaagtttacctctagttgaagatcgaatcgatgcagcttaaccagaaagcaagaactcgccgaaatagaatgaaagtaaaagggtggcgatgcgcggaaagttttgttgaacgtgtgttgtttgattacatgggttcgagtcatatttatacctgagattacaaaatatgtccttgccggatacgactcttatttttaacaaactctaagataacataagtctttgcggcagacttttgcccgaacatatctctaaggaatttacataagatatcctaattaatagatacaattgcctatctgagagctttatctccatcgtggcaatccttgtgaagcacatcgatcgattctagaaacagactcagccatcggaatcggctgtaccagctgtatcattcatcctctgaccgatctaactcagt

SEQ ID NO: 29824 - DNA, 202 bp, Oryza sativa
tggatccctttttgaacgagagccataatttactcttcttttgctttatctttattatcttatctgaggtatttatttgcttgggtttttatgatgccatcttgggcgattcgaccgcaggacgaggtactcctccttccttcctcacaaagtcacaattgtttccgatccaaagtttgagtttcggttgattgaaagacga

SEQ ID NO: 29825 - DNA, 595 bp, Oryza sativa
attttataggtcgttactgcactttttgcagtaacatcattatgaaattgcaataacagagaacatatggtagtaacggtactactacagtaccactgcatgtgcatagctaaaatttaaaatctcaatctagtgcaaaatataaagtgctaagaaagtgcatgtgcatagtcacaacttaacacaagtgctaaaagtacttctctttgtccatacaaagatacatagtagaaagattagtacaagtaaacttttagaattataatatttaaacaataatatctctcatatcgcatattattttttagaaccgtcttcaccataatgctttaaaacgatattacagcgagacaatagtcctgttactacacgatgattaagacaaaaatgcttttattatgttgttactgtggaaagtagtcgtgttactacacattgatcgtcgcgttactacggttttctaaagagaagagaacttaaaaaaaagtaaatctcaatctttagagagcaatatctctcacattatatagtatgtttctaatccgtctgcaccatgatgttcgtaaaaaagtgcttaacaaaactagatccatca

SEQ ID NO: 29826 - DNA, 1501 bp, Oryza sativa
agtgtatctttcgactttccgtatacacctaggaagccaagaaggtttacgcaaaggttcttagtgaggtgcatcacgtcgattgcgtggcgtacgtccaagaattcataatatggtaactcccaaaatatagagttctttttccacatcgccgcgtgaccatcttcgctctctataggctggcttccaggcccctttccgaacactactttaagatctttaaccatagcaaacactgttttctcgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacacatactttctatttcatccatacagtgagtgcaagccttgtaccccttgttggactgtccagataggttgctaagtgcaggccaatcattgatggttacgaacagcagcacccgtaggttaaactcctcctgtttgtcctcgtcccacacggggacaccttccttcttccacaatagtttaagatcttcgaccagtggtcttaggtacacatcgatgtcgttaccaggttgcttggtgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagataaaagcgagctaagcctgaagacttgactcctgcagcgggcgactccattccacaggcatccttgacagcagcgacgaaaccaacctcttcgagacatcttcaactggaaaggacttcaactctggtgtgggggaaaagagagcaagactgagtactacccactgtactcagcaagtcacaccggaagaggaggtatgatgcaagatatatccaagggaggctaaaggttcttttgcataaagccggcatttcaaagcagtagttgaaagcagtaaaacagttgtagtaattaatccatattaaccaatcactgtccaacgttacaccacgttgcaacaggcccaaaccaccacctgaactaatcagttccaaaagctaactagggtgaaactaatcacggtgaatctggttgaccgcccataaccgcgggcacggctattcgaatagttttactctgatcagaggtgtacaactgtacccacaagacacagccccacgacacgtttccgtgcgccgacatgccaccacgacatcccggaaagaggccgtgacaggaccattcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctaga

SEQ ID NO: 29827 - DNA, 1501 bp, Oryza sativa
agtccttgtcgcatcctttcgcttcgtcgtaaagaagatccttcgctgttttttcaacgcttcccaattgtccaaccctcgtcttctaccagttaggacctctggttcaacatgccgcaacatatcttccagatcaaaatcaatatctgcatcgtctatactagagtcaccgcattccgggatggttccctgtgacatgtcttcgattataatattttacgcatcaccaaagcagaaatcatcagcctcttcgttacgaccaccgacttccccgtgaaaagtctatatctcgtagagagaatcccttatatgccactagaatttgaccagttcccttatatgccactcaaaattagcttctcccttatatgccactagttcaagtttttccacccttttatgccactcctaccactatagtgttagttgactgttagtcaaaggttagtttttttcgtaaatgactaatatgccctctcaactaaaaaatgtgtaaacttcaaaaaaatcataactaatttattttaaatcctctttgagtgaacaaaattttgtcaggaccagtgaaaaatgctctttatattaaaaatattgttggaaaactgcatgtttcatacttacattgaaaatttatttgcgatggtaatggctaaaattgcacgcgatgtagaaaaaatcaattttcatatgttgtatcccgtagctatattagtactaaaatacctattattggttgtagactaattctcaagggcaaatgcgtctttttacaatcaagttaacggtcaactgacggtggactgacggcaatggcataaaagggagaagaaacttgaaccggtggcacaaaagggataagccaatttgaagtggcatataaggaagccggttaatttagagtggcatataagagattctctctatctcgtaacccttcttaaatcctcgctctacgatgtgcgacaatacttaattcagatcttgcaatctttgcatgggcaaaaaatgcccctcaaattctccctcacagcatgtgcctttgccagctcaacgaatttgcctgcttccttcaagaacgtaggatgagttctttttgtgttgtacattcatgtccgatccatgacctagaatacagcttgtcatgaatacatccatgcccgattcaaaaatgagtgtatttaaacagagggaactaatcaaatagtaaattaaagttttatggacaatttaaacgagcgtacagaattttaaccattaatataatattgtccatttctaaaaaatgaaaaaaagtccttttatccgaatgaaaataaatttaatggaggcaaacccaacttttcaatttggatactaaatacttttaaaaacatgtaatggaaacattatacattagctaaaatataaaaaaaacaaaaagtgcctacactattccatttataaaagtgcaagtttcttcgaattgcaccgacgaaaacttacaaaaatggaagcaaataaa

SEQ ID NO: 29828 - DNA, 1501 bp, Oryza sativa
gcgccttcgaccaactcaacttcgaccttcgagtatcctgctggaatcggccgcctgcagtggtaagtacctgaagggtccgttgggatggccatgcccgacgccaccttcatgttgtgagagattatttattagtaatcaacatatataagcagcaactagcggaatggctaaatctcgaaaggaaacatgttgtgtaggtacacccatgtacctctcgaaggaaacatgttgtgtaggtacactggcccgagaatactgatctctttcacaaggtgataaagcagatgcgtcattatattgaaaaatgaaggtggaaatatcgactcaaaactgacgagacattgcaccacttcattctgaagggcttctaatctatccggatcgatgaccttcagcgaaattgtgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagattattacgtgcttccagtgtatctttcgactttccgtatacacctaggaagccaagaaggtttacgcaaaggttcttagtgaggtgcatcacgtcgattgcgtggcgtacgtccaagaattcataatatggtaactcccaaaatatagagttctttttccacatcgccgcgtgaccatcttcgctctctataggctggcttccaggcccctttccgaacactactttaagatctttaaccatagcaaacactgttttctcgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacacatactttctatttcatccatacagtgagtgcaagccttgtaccccttgttggactgtccagataggttgctaagtgcaggccaatcattgatggttacgaacagcagcacccgtaggttaaactcctcctgtttgtcctcgtcccacacggggacaccttccttcttccacaatagtttaagatcttcgaccagtggtcttaggtacacatcgatgtcgttaccaggttgcttggtgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaa

SEQ ID NO: 29829 - DNA, 1501 bp, Oryza sativa
gggcacacaagataggaatatctctaggtaaacttatgggaaaatttttaaattttgacaattttagttgaatttcaagcaatttggacaaaatccaaccaaattcccacgttcaaataatatcttgcccgagatagcgagatctcaatatatgtcatagagatttttaacatgaagtgatcatcgagcgatggaggagtgtcatcatattctcctgtttctcgttgacttatctttttcactcatttttagttgtttatttacatttccttgtttttatcgtttcgtcgagatattttcctcattttccaaacgtgaagacagaagattgtggaattaatgggggcgtcgtagcattgaccttttcttcgtagacgctccttccaacacgctcataaatacattaaattacaggaaaagattaattgaatcataggtcttgcaatataggactgccctaaccttgacataggttaattactcgagtaaagagagattagttagcgaacatgtcgttaggccaatcataaaacaaatgcatgcacgattaaaattctaacacaaaaaacagacaaaggtgggtattgaacttgcactactgtactgaaattttaagtttgttgaacttgtttaaatgagatgaattagcaaacttttggaaggctaatttccgataagaagacatataaggcttattattagttacttgattaaaatacaagcagaaaagctagattaaatcatttggaactaaacttacactaatttcatacttaccgatcgcatgacgaaatatcttattacatgttacttaacatttttcttcatagttatagtcatgtccatgtatgtactcatttttaatagataacgccgttaacaattagacacatgtttgaccattcatcttacattcataagatataaattatgcttaaaatacttttagtaataacaactcacaacaaaataaacgataattatgtaaagttttttaaataagacgaatggttaaacgtgtatccaaaagtcaatagcacatatgattcttttcagaaaaaaaacatagtattactatgatttattttttttgactgaatactatgtttttctttgttaccattatctaaaaaaagtttatactttctccgtttcacaatgtaagactttctagtattgcccacattcattttgatgttaatgaatctacatatgtctagattcattaatatcaaaatgaatgtgggcaatactagcaagtcttgcattgtgaaacggagggagtatgtccttttgagtatttgtttgctttattttgttttacacacgggtggagaaaccctttgtagtcccggtttgtaacccccctttagtcccggtttccaaactgggactaccaatccgggactaaagatcgctatctttagtcccgggtgaaataaccgggactaaagatcaagctgaccttttttttttgcatggccctgttgctgcatggttt

SEQ ID NO: 29830 - DNA, 1501 bp, Oryza sativa
catttatctttgagccgatgtcatatatgcatcaatcggcagtcattaataagtaagaagaaactaaatctactcgatcggctgtagatattaatgatatataatccctatattgacatatacttaaatcaagtgatagggatagatcggtcgtcatgccgagacagtataaatcacttagatcgaaatatatattaataacgagactgtatatgttcatagcatagccgatcagatagatctagcatgtatcggctaatactccgataccactctatgttaaaatattaaaacaagtagaatataccaaacaaagagcctaatatacctaaatgcgacaagatcttaatataaagggcagatttaacatgtcaatcaggcatatgaggaaaaaatagttaaatcaggtaagatcggttgaaaccccgatactatcctaaatcagttaaatctgttccctagacgatttccatctcgaattccatctcggtttcttcttcatctccgatccttggattaccaaatttggtcgttaacacatgccccccaagtccggcatattggataatgtttcggatttgccatacgtcgactccgagagaaatcaactcttgccgtttcctgaccgttattctagcactttaaataccaaccgttgtccccgaaaaatctcacaccgttttcctccgtttttaccgctgaagcaagctccgtcttgtctctcttcggcgatcccctcggtgcacgaagcgatccccaagcgatcccttctccggccagatctccgcctacggcgatgtcgtcatctgccagtccatctgccgcaccatcagccgagtacgctgaggtaagttctcatcagctagatctccttttctcacatcagattggatttcctactcctcatcttgtttttccccttcctagttcttctggatttgtagcatctctccaacttagttgcaattccaagcctatcgcatgaaaattactacttcctcggcccagttggtaaccctgatcctaccgagttcatcatcggcgaaaccaataggattcctttcagattggccaacccagatctaggtcactggaaaaactccacccgagaaaagctggattacatggttcaagcgcatttcggctagcaagagagttcactgggacgagatcggaatcggccaagcactcgaccttaccatagctaactcagccaaagacgaacctttaatggcctccgcctcctatttctggtccaacaccatcaatgccttcctgtttaaccaagtgccgatgaccccgactctaatagacatcaccatgatcaccggtttggatgtcacctcatcggctaatcccatgagtccgaacacgaagaatcaatatgacttcaggaccaagagcataggtgtcacgcccagaaattcacgaaccagaatttctaagctgaatgtgcattaaagcgagctaagcctgcgggcgattccattccacatgcatc

SEQ ID NO: 29831 - DNA, 1044 bp, Oryza sativa
ggggggggggccacccatttaccccttaaatttagtttttatttttttattttatttgcagcaacaatttcactttagtccctatgttttatgtaatttagtcgaaacagttcatcagttgtacaaacaattatgtaatggtcctatagaccactgatgttatgtgtttattaacataggtgtttatttaaatactctgtttcactaaatttattgttgtcttaataacatgtcttttgcatattattttaagacacgctctactttctcgctttattaatttacaaaattctataaattttgtattttgatttagcaaattcttttaattatgtccaacataattaatggaggatttaatgcatgttccacttcacactttgacttagaaattaatcacatgtcgatggagtcctatactttggtcatatcgaccataacttaggcagcgagtatctcgcccatcataaagtggtctacattttgagatgattacccgatggagtcctagaaattggccgcactggtcataacttaggcggcgagcacctcgcccatctcacagaggtctacatctcacgattattacccacatgtgttcttttccaagaatatgttttgagaaatgagattatttgaaatttggttgaacacaaggtagtggagtcctaaacattggctgcggtatattcaccagaatatatttgcctggagaccgtgttttaggcagcaagtataacttgcccactattaagagatctactccactgtttaattacttagagattatccacattgtgccacctaatttcgaattctaactcaaaattgtcaggtccataacctacatctttcgaaacattacagaatatgaagttttacatttcgcattgagattacacccttaatatcatgtttttattaatttacctctgtaaattgataatgttaaccatgattgtagggacatggcaacaaaagagttcgacgaactcgccctcgatgggactaactatcccatctgggcttctgatatcaaaatca

SEQ ID NO: 29832 - DNA, 1501 bp, Oryza sativa
ataaagtaggaagatattgaaatgagagataattattagaacaaacaatataactttaggaatccttatttgtagacataggattagagtctgattgccggtatgttgtcataagactttcaccgctagcttatttacaagtaatccgtgagatttttttttatatatctatgttcttattagtgatttaaacaccaacgttagaaaataaattaaagtactacgaaaactcctcaaaatcaactattttcaaattcaaattttatatgtgattcatacactaataagcaaatgataagaatagtataataatagaaatggattgcctggtttaagagggaagaaaaagggaagaacagtgatcgatggggagtgtcctccggcaggaactattttaaataaattcttcaattatctctaaattttaatcataccttttatatatgttgtgaactcacctcttcctccctctttcttcttttaccatgaatatatcaaaagaccgtttaaccattatggctatcttctttattacttatattttcttttaccactgtggccacatctagattatgttaccaccggtagttttgcttttcagcttattagatgcagccaaaatttagatttagatttagattttaaaacttaatttcataattgattttttatattttttattgtagtttatttttaacattagcttgctaagagcacacataaaaattttatatgcaattttttatcactaattcttataatcagttctacactaaacgatgggttttctcactgctccacttggctggcaccaccttctacatgctcctccgccaccaacccacctaacatattccctgcctcctaatttatgacttctctagccaccattaaccttttatctctattgtcacaccttaaagtgtactttaaaaaaacagtataaacacaggcgactaagcaatcaaaaaataataaatatacataattagttgtttaaacaccaatgctgaaaatcaactagatggaaaaaatcctctcaaaatcaactctaaaattaaaattaaattatacaattttaatttgagagttaaagttaaattatataaacgagtagagagcgtcactacctagaacctagtatagcattacatgatctactctatcatcaagtacggatcctcctcaaatgttggacgattggtaataacaaatattatatacctcttatatactccctccttccaaaaatctgaaacctatttcattctttggtttttccaaaaatctaaatcctatttgtagtcactatatgctaaattaaattgttgatcggaaactaagaagtcattctaatacttattggttgcatgttcattggttttgccacatagtgagtgagctaattgcttcttggtattgatgaaaaagaaataggtctcagatttttggaaggagggagtacctcttagttcttgcttcaagctaccatgtaggatga

SEQ ID NO: 29833 - DNA, 280 bp, Oryza sativa
tattgcgcaataaattatttaaggatttttgttatagtaataaacacagtgaatcttctaaaattcataactaattcatccgagctccgtttaatcccattcaagtctcattaaatcaagaaaaatgtgtagaatccattaaaaatggttttgttccctgtttcagtagtcttatagcctgtttgcaatgtttgccttgtatgtcgctagattccggcaattccgacgctccggtgtacttcgagatagtcgccgaggttccttcagcagcagagcaagg

SEQ ID NO: 29834 - DNA, 1501 bp, Oryza sativa
acccgtcaaccgttggggaagaggagaagctgaggatgggttcctctccgtggctcacacggataacgtccgacgcggctcgacgcgggcgggcgggaggcgataacgccggcggacttggatgacaaccgcgggccagtcgccgtcggggaatagcacaaatgaaatgttgccgagagagttttttttttttcatgcgatctcccgagaaaaaaaaagaaaaaaaaaacgtctttgctttcgtcgtccgttcgtgtccgttccggcgtgcgaaaaaaaatctggggatggcaccgcggaaacgtcgccccgggctgggcgtttttgtcgtggaaaacgtacgctctcgctcgcggcgacgcgacggctcggctgcaaatatccacagtagcatgcagttcattctgcaaatgggagtagcgtgtgtgtgtgtgtgtgttttttgtgacgctgcgtcgttctggctgggatgaacaaatatccgagattcttttgcaatggtggcagtgactgactgactgactgactctgttagttgaagacgttgctgctagggagagagcattggaaaccagggaaaaggggcgtctgtttgttgtgttttcgcggaattggtggtttgcacattgttttaaaggtgtcatggagttggaacatacttgtatgagttattgatgtgtagggggtgtttggcataactcgagatctaagagtttttaaactatgaatacaaatcaatagatctggatctacaattatattgataacttttgaatgaatcatttagatgaaatataaaattttaaaccactataatttaatatacaaacttcaaatccaatgcgaatttaagatggagagttatgccaaataagaccctagtatgtgtctttacgatgatattttccaaatttctctttttttttaaaaaaaatctgctgttcacgaaagaaaaggtaacaccatattgctttcaaccagtgatatctaggggggtaaaggataaagatgtgagataagatggactgcaaaactacgaaggtaaaaaaaagaagatgacgaacgtgctttaggaagttctttttttttttcttgcagctgctttactagcatattctttgcaagtttatattaaggccaagcgtatcaagtattataatggagtgaagcagcaaggcaggacttcaaaattttgctttataatgttgacatgattgtgactaactacaactagaactttatcagcaattgtatgtccaggctgaaggaagaggtaggcgaatttgtcttgccggtggtggagatgtcaaataatgaaaatcacaatgcattttctcctgcaagatgctccttcacaacatcaacatccattgcttttgcctcatggttaaaagttcgacaagacaaactccatgcagtactatgataatgtttcaagatgttagctgtacactacaatctatcccaagtagaacgttttccagttcagctgctatacagt

SEQ ID NO: 29835 - DNA, 1501 bp, Oryza sativa
tgactgcgatgttcttgctgcctctcgctttctgcgtggctaaaacctgtttagtgtgcagttaactctcagattagagtggtggtttgatgcctccttgcacagtggcagctaggcctaggcacaaagattgagctgacacccacaaaacaaagcggtacacaagccatcgctccaacaagttaggcctggtttagttcccaattttttcttcaaacttccaactttttcatcacatcaaactttcccacacacacaaactttgaacttttccatcacatcgttccaatttcaatcaacatttcaattttggcgtgaactacacccttacatccatgtcagattcatccagcgcccaggaagcccataacttgtcgttggccgcatcaatgcgagccttcacaaacatgaattcagttcaggatatggcaggtactagaccacgacagcaaaatcaaaacagtaggtcatatcacacgccttcaagtttcatagcacaagacacacacaccagctctgtgcacaggaatcatctcatacaaaaacagcttcacaaatcgtcagttatcgctcatccatacttgctgttatcatttgacaaatcgacgtacaaaactgttttggaaagtcacatattcacaatctagataaatatagaatctgacattatagggtactccgtgaggggaatttagatggggagaaaagaaaaaggaaacaagctacgattatatacatttcatctgccgcccccgtttatttgagttcaatgtataaaggaacaagttgaatgtatggactgaaaaatagtttcagtgctcaatctgttaattgtatcccctcagaagaaattgacctgccggatgggtgttgcgaacgaacggttctcaaacagatttggttgtaagggggacaaaccgaatggagaaccagagaatccaacagctggaagtgtggcttggctgaagtacagaataatgatagcacttagcggatataaaagtctggctttgggagattaactcattcgtaaaggacatgctgatgcttacccgtcaaccacatatgcctgtggccaggatgacatggctggaacatcgcccattggccggtctgatgcaacgagaggccaaaaccctgctaaataatgtaaaaaggaagccatgtttgagcaccacgcatctcaattaaatctataaccatctggctgttggcgcaaaaaagcaagcaaatacagtcctgaactataagtcaaaaatggaggagggcagagagacaaagaacggacctgactgcacaggaggattttcaaatcctgggtacagcagaatttcctgcatgatatgatagcgaacttcaggataacacccattccactctcatgcaaatatatgttcccacgtcatgcaaataaaatctcacctcttttgtatgctctggaacattgttagaaaaatctacaagcagaaaaggaaatataagccaataaaacaaaagataa

SEQ ID NO: 29836 - DNA, 1501 bp, Oryza sativa
gattcgtttggaaatcctcccgcaaccttcgccggcgtcattgatggagccgagatcgccgcgccggtttccttcccctccggccgccctctctcactcccaacactatataaacgctccccgtgcctccctcctccgtttccgccgctcgccgctctctctccccgtcggaatcgagctcgcgccgtcgtcctctctctccgccatcgccgccgagcttcggtccgccgccgtcgtcgccccggacctcctcccgcttcggcatcgcctccttcggcttcgccgcgtcctcgccgacctcgtccaccccttcgtttcgcccgccgaccgccggaacgccgccgtcctcgtcgacccgagccgcgccgccgcctctctccgcttcggtcgccgttcccgtcgtcgccgtcgacccggggtgagccgaggaccgccatttcgcttcccccttccctcccctctctcgggcgccgctccgtcgcgccggtggtcgccggcggcgaccatcggggcgcgggcgcaccgcctcccgtcggccgtgccggcgaggccgccttcgggcgcgccccgcggctgccatgtggggcccggccgtcagccgcccacgccctcgggtgcggctgacgcgtgggacccacggcgtcggccggcgcaagccgcgtgcacccggtccaccgtggaccgtgaggctgacgcgtgggccccactcccgtggacccggtccgcgcgcccctcccctcggctgacgcaataaatccgatttttaatttaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgcctgttatttggagtttattagagtaaaagccttttcttttccgttggtcgtgtagacgctgcagcttcggaagatccgctcttcgtggaagtcgaagccggcgtttgggaaagcgagcaaggcaagtcacatcatccttgagcatattgaatcccagtttataaaattattttgatttaaattattgcattaccgctttatttaaattcccgcgttatcactgttttatttagccatgcctatttacctttgttatgacattatcattgctattgtattattattaccttgttcaccctagaataaacaaaaccccaactagtggacactctattcctggttccactagtttgaatttaggtagatgcttcgctgattaaataggacaacattaggtggttttataactttagactttgggaattctcatatcatttggacactttggaatggttggcttatgttggaattggacacacacctctcttcctctttcaaaacccctaaaacctgttttcggtggggtttgggtgcatgccagttgtgggaagtagcaccccggccactataaggattaa

SEQ ID NO: 29837 - DNA, 1501 bp, Oryza sativa
gaccgccgcccgccctgtccctgctttcggcctggcgcgtgcgccgctggcccgctttcggcctgacgggccgccggcgaaacgggccgtgccgtgccgcgggccgtgccgtgccgtgccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggcccgtttggccacctctaccctagccgctgctcacgctctttcctctctctcgtcttttcctctccctctccagctcccgctgccgccggctcgtgccgcctccgcctccccctcgtgccgccctcgacgacgcccgtggccctcctcgacgaccatagtaaaaaaacccgtaccggtggtcgacccggtgatctcgttggttcactggttcaccggtcggaccactgggtcagccggttcaatgctgaaccgaaggcatatgactattatatgttttctattagacaggatgagttagctagctaaatggtaagcatgataaggtctcgacgcacaggttatgggttcaaatcccttcccacgcatgttttctctcctattttgcataaaatgtaaatgggccgtggggtaggatgatgggccttacaagtccagccccaagtgttagcccaacttgcaatgaaccacctgttcttatgagcccggttcaccggttttcaacaaaaaccggccagttcacccggttcttaccgggtcaaatgcacgagcggtctttttattgaaccgaccggtgagagacctggttccggtttttgccggttcaaccgccgggcccgtccgcttttttacactatgggttccacctggttcacacgcgcgggggcggcggacggagggagggacggcgccgctcgggagagggagcgggagcgcgtgcgtcgccggtggccgagccgagccgagctgcgtcgcggtggtgctctccgcgggcggcgagattcagccctgacccgaggaaggtgaggggaattcttcctcgggggtgggtttggtgcattccgtggtgtgagatgcgggggatgaacaaggctttcggggtttgggatgtcgcggggatttgggggcggtgggtggttttcggctgggaatttgcggatttcgtggctgctagtggtgttcccgtggctttacgaacagatgtatatgcttgatctcgtgcggctttcccttctatccctctctccatggtttgctcgcgttggggggtttcgaaaaattttccctactgttagtcctcgattctggtcgtcggcatggtggcggtcgcctccgcctccccgctcaccgccgcggcggcgccctccatgtgctgctcgccgcccgccttcctccctctccgtgcgcaccgcaggaggattttccgcgcggaggcga

SEQ ID NO: 29838 - DNA, 452 bp, Oryza sativa
tgttccccaaccacaaaaacagatatatgacattccttaacttataaaaccgttcaccacaggtcttttggtgggtttgaccccgattttatctgatgtggtagctgagtcagcgtaggatccacgtggaccctaccagtgaacacatcatcatgctctccttctttcttctgtctctctcttgctctcttctcactcgcgccgagcaacgctcggcgcggcgaggcaacggtggtcaccagtcgcgactccggcggtgaagggcagcaaccggcgcagggctcagagaagtggcccccacgtgcaagcgagtggcggtcggaagagcagccttgggcggcggcgtgaaactccggatctggggtttggggcagcggcggtggccggatttagggaaaacaacagcggtggtcgttgggcgccggcgaggagtgaaatgggcatttggttgt

SEQ ID NO: 29839 - DNA, 1501 bp, Oryza sativa
agtgaggaagaagttagatcccgacgtgtacatttggcggattttctatgttttaggccatagatctttcatgtttatgtttctggtgttggatcaatataatgttgcactggacttttttccggtgtatgttttatatttttgtctttgattgtttctgaatgtgttagttttcatcagttgaatcggtatgttttgtgtgagacccaaatgttttaatcgtgattcaccgaaatgttttaatcgatatgtcttaatttgattctttagatttagctacagtctgaatcactgacatcacaaagaagctacaggaattaattgacggctttgatctccagcatggacaatgcatgattaaccctaatcacatggatggcagtgacaaggctgctctcagcgccaacaaaatcaaatatagagtataaaattgcaatgtccacatagcaatgtgggcagatcatcatattggccacacatcagcaagtgatggtggtagactgaagaggtaagagcgtctgccaaagtgcgacatatattctaaaatggcgtgaaaggtttcaaggagctacaccctctgtcttgaaaagaatcaacttctagttatgaacttgtcaagattcatccctagatgttcgtttatatgggatggaggaagttgtaaaatcaaagcgtgtttgattattattctgtgatgaacaattggcatttgagtttattggttttgatatttggagattattggcgaagtagttttggatatgattgattttcatgtgatgaacagggtttgctattttgtcgggtctggtcagaccgggctggtgaggccggtcagaccgatgctatgcgagcggtcagaccggccagcccgtggtctgaccggccgactctgtgtcggtttcggtttcgggttgtttgtttggatatccgtggatgtttcatgtttatggcttctagatagatactatacgtatgtaatactgttatttgctaacaatgagtcaaattggagatagcttggtcttagaatatggtttctttgtttgattcatgtgtaggtgtcttaatgcctccggagagtattgccagtgatggatcggaattcaacttggagataaggtgacgtccggacggtcagatatcatgcgggatacttaggctaaagatcaatgcacgtggttggtgaagattccatatggcatacgatggaaggagtatgtgatgcggagtcgaatttggaaggagtccaaatttggtatgattggagtttgtaaagttggtttcttgtacggaaaggtttcctaggtggattaggacttcttctatgagtttagtttgtggctttagactgcatacctcatgtataaatagagggagggtgtggcctcccgatatcgcttttgagagcattgaattgagagttgagttagggtttcgagtttagtcgaaattttcgaggagtgttgttgttgcactttgtaaacacaaaaagaagtaa

SEQ ID NO: 29840 - DNA, 1501 bp, Oryza sativa
gtttggctagaaaaaaaagttaaaacaatttataatatggaagaagtattattccatacaatagtactattataaaaataaaaccccatgcttattcgatttatttttctatggtcgtgctaataaatatttatagattcatacaaagaaacatttttagatggttaaccagcagtgttgataataaacacaaaacagcagcgtgcaggaagccaggaagaggaaaaccgacggcgacgggacgcaccgggccaaaattttcaaacttgttactagtactgttctcttcccttctctccacttcgcaatggaaaaaaaaaaaccgggaaaaaataaaaatgtttgggcgtaccacggtggttgtacctagcagcaacgcgggagcacgacgccgttaacgcgctcgcccgcgcgaaatgacgctactaccctcgttgctcttatccactcgcgcctcgtaccaccacaaccctcccggtttccctcgtaaatccggaaaccgagcggaggtaggatggtcaattcaccgcgccgtccgacttccccaccgtggcgttggatataatcttctcgtatcgtctcgtccctcttccgttttttcccccaatttctcgtctccccccttcctccaatatatcggcggcgatcccggctcgaggagaggaggctccgccgcgattttttcggtgtcgcatcgaaattatggtgagttggtttcctccctccccctaattcccgatccgcaattcgattgcgatctccattgcttgggttctgccttttttgggggaatattttgggcgatatcggcgaatatatgctgggctctcgcgcgattcctttttgattatggtggttggtgttcggtgcgttttggttgaggaattttggctctaattcggtgccattaggtgggtttgtgtttaatttggggatgtttctgaattgtttccgtgcgtttcagattggggaatgctgtgtttcgccgagattttctcatcttccatatgtgatatcagattataattgtatgtgtttttgtttcgctgcaaattaattatattgatgcgaagtttctctgcatttgattgcagattttcgatgcattttaggctaaaagtgctcgggtctgaaacctacgtgcttttcttgtcgccgaagatggtgtcagcaaatatacatcgacgcacatgaacagcgatgatgcgttgctgaatccgtctgaagctgcaataagcatgacggttttgcaaattatgatactaaaccattcatgctgctacgccctcgtctggaactttcttcttctgatgcaaccgtgcacaagcaaacctagcctcgaagcgattgtgatgagttttagaggtggtgcgggttcgatcacgtggagttctattggtgttcagtgactcttggcaaaagttctcttgtaaaatcgacgacgatggaaaggtcagcagtaattatctcgcgaatcatattatttgttgcgtgcgcacta

SEQ ID NO: 29841 - DNA, 184 bp, Oryza sativa
gtatcaaaattgctttttacaaagaaaatttccaactgtcaataatgcatcgatgagtgatacttttcttcatggttgcatcacaacactctcctttctctccttcctttccccttttgtcgccctccaccctctcaaatcaaagcaaaaaaaacacaagagcatttcccatctctcccactcc

SEQ ID NO: 29842 - DNA, 435 bp, Oryza sativa
tggggcggaggggtacggtgcgtcgagcgttttagttataacgcaccctgggtgcagtttagcgcgtcccagtcttatataacaaaattatacacttccaagagtatagctagtctacaatttccagatttccttcatgtctaagggcaaaaaggtccttttcattgaaattaaacattcaactaatggaatgagtatgaaagggatcaaaatcaaaattcaggggcatacaagggagtggacaaaactcgagggcatagatgggattggctaagctttcaggggtatagaagaaattttctccaacactcccttttatagcttgaaagggaaccaattagaaacttgcttgttgtggtggagggtatggtcaaatcggttgtggccatggtggcaccaattgttctgtggcccaacatgagttgaatctggcca

SEQ ID NO: 29843 - DNA, 1281 bp, Oryza sativa
gtagattacagagtgtatagtaccaaagtagggactagaaaacagaataacacagcaacacataggatgaactaaaagaagggtgagtggctgataccttccctggcaacagctcaaatgctcaatcagtacagtcttcttttaaacaccagcattaatgtatggtcatgtttgggtccccatacagatcactaatgtagggtcatgttggatcccctctacagatcactaatgtaggaccatttcatatgtttggctcctctacagatcaatgacgaacacttttgtctgatagtcacaacaccacatagttctttggtgctctaagtacgtgtaacaagggttttgacataaaacattatgatgaacaaaattcactggtcgatctgaatgatgcccaataacagaactcattgatatctgagctgaaaatattttactgccatgttttgttaagtatcaccacggattcagttaataattacaatgtatcacctatcaaaatcaatgtctgtgccaaaatatcattaagacctcaagagaattatatgatcattcatgtcgacagtgaaggtgcccagcaattctgttaatcattggcttaagtatgttaaattgttaatatgatatggactaaaggtgtgtaatgagacatcgacatctccacaaatttacaaaatcactgaattgattatgctgatataatatgcatgaagctaagggaaattttggaataaaacataggggtcattataaggaacaataaaaatatcttaatatgtttagctgttactaaaatatattgttagttggttgacgtgtacgtgttcaaaaagaaagtttaaagctacaaatcactagcttaatgctggtctaacatagacagcgaggaaagtttggtgaacaaaatcacatcataccaaacacggtgaacaaaggaagagttagacgccatgtcatcctaactactgcttcttttctgtatactttaccatagaaatgataaaatgagcaagaaaaaaaattaccatgttctaagaagctgctaaaaaacaaggtagctttgttgtcatatgtccaggaagagtttgaaactaggctgtcgaggtgaccaatatttttttgtatttcagatggaagctcatcaatgttcataggtggtacttgctttgatcaacttatcaacctttgtactcattgttccagatcaaactcaaacgaacaccagtaccacacagttaacccgaaatattggtgaatattaaacaaataaaactgatg

SEQ ID NO: 29844 - DNA, 386 bp, Oryza sativa
acgacgtgattttcgttgcaatacataggggttattgctaccgaagtctaatttagttacgataggggggcatattgccactaattgcgtagtgttgcgattgtaattttttttgttgcaataagtaggaagtatcgcaacgaataaatctgcgttgtaattagggtgacaatattgccacgctttttgttatcgttgcaatagttatccatgtcgcaacaaatttagagcgttgttataagattcatgtatatagcaacgcgaaactactttgttgcaaatgagtctataggtattgcaacgcaaacctaaatcgttgcgaattagtctataggtattgcaacgcaaacatgaatcgttgcaatcattctttgatattgcaacaa

SEQ ID NO: 29845 - DNA, 1501 bp, Oryza sativa
tttcttatctaaacaaaatttgttcaaaatcaaaaatactttgtgaagtccacttttttttagcaaaactgcatgcacaaggtgtaaagaaggtaagaaagaattggagaatcccttttttattattcgtattttatgttatatgtatatttcttttgaaattccgtccatgtggttataatattcagcatggacgatccgagcagtctgtcattcaatttgggtgactttgaccctaattacctatcagcgtcatacataaataacgagtatgatgcctccggatcggttccaacaccgtcagttttggacgaggtaccggtggcttcagatggatcaggaactatgagcaggagtccatcgacgaacaccagctcaaagagatcacgaacttcggccgtttggcaacattttgatgaggtggctgtgacatgccctggtggaaggcaagtaacgtatgcgaaatgtaaaatatttaaacgcgacaaataatctgctacagaattttctactcctttatatctttaatttcaaaatcaaattcttggagtggaagaacccatctaattaatcgaagttttgcatctttcttagtgagcaggaattttagagcagcatgatcaatgtacacaataaccttagcaactaagtaagacttgatcaccccttattaccccaagtgcattttctatgcgagaaaccaaagaagtgcactcaataggaccggaaaacttgaaattttctaaccattggcgaatcatgtattacataagagaaacttttatctttctaaccatgtcaaataagataatcaacttatcttcacgaatgggtctaagattagctctaggaaataaagtcatgccaagccatttatacatgagtctaagagtaggattatggatgccatctaggccttctacataacttgtttttctcagagttggaagctgccttccaaaaattaattttgcaagttttgtcaaaacctaaaagcagactcaattctttaaaagagagatagaactccttacagaaaaaccaaaaagaaatgccatcatctacttctagcaaagtagcaaggtacataaaaaatttctaggtaagtaagcgagaacctggctcatctaccacagcaaatttctcccatcctatagccttccaaacaatacgaaaatcaacatccgtacctattttctgaagaagttctaggtcgtatgctggggtgtcagcaaatggccgatccttgagcatgtgatagccctgcatctcccggtctcctatgaggtcgaggttggagtcatcgagaagccttggcgaggtgtccacctcctccatggagacatcggtggaagagtgtgtactcgacttatcttggtgatgacttgaacatgagcttgatcccttcttgaacaaacccgtgattcttctcttcatgactgcagaaagagcaagagcacacactacaaggaaatcggcctagcaccacggcgccaaatcg

SEQ ID NO: 29846 - DNA, 618 bp, Oryza sativa
tatctactcttacggtttccatccttatcttctcatccaccctccccccaccactcatttccccctctcctctctccctatcctctatctccctcgcgcgcagcagaggtgaacggccgacgacagctccgacgagcggcggcggcagggcaggacagcagcggcgacggctccgacgagcggcggtggctccgctcctcgcctcctcgagcgccgacgaatgacgacgacgcctccttgagcggcagcggctccgacgaacgacgacggcgccggcggctcccccctcctcgcctcctcgggcgccggatccgccgccggctcccctcctcgcctcctcgggcgccggacgccgacgaacgacgacgacgcctccttgagtggcggcggctccgacgaacgacgacggcggcggctcccccctcctcgcctcctcgggcgccgaatccgccgccggctctcctcgccgctggccggtctcggggaggggaggggagtggaggggagggaaggcggcgacgaggagaggagacgcgacgatgacggcgccgacgacgacgacgacgatggcgacgacgcgacgacgacgacgacgacgacgacggcgacgacgcgagt

SEQ ID NO: 29847 - DNA, 1501 bp, Oryza sativa
tttattatctgcatccaaatatacaccaacactcgtggaatatgtcaaaattaaaccctaccactatgttggatgttttattatctttgtattatgcaggtattggcggcataaaattagcatttaacagccaccaacactcatgtggaattctagactaatgtccttgtatgtgaaagaagcaaaaggggattagttcagttgataattatctagctccatgttggatgctccgattagcatagccaaggacatgcaaaactaataaaaaaattcagttaaccaaccggccgtatgcaaaatcttgtaccagctacgtgctaatcctagccaaaatttgtcgtttcatgtatacatgccattactatatgtgtgcaaacatgtgttctgtttacttgcttctcatgatgatctagtttacacatgcttcattgtttgacatgtatatgggagctagatgaaatcccacatgttactacggaaagttctatataatagtagtataaaatatggttaattagttccatgcattaaaaatttattggttttgaaaaatatcaatactatttgcgtatttgtaacgatgccactgatatttatttgtaatcttctacctctctcttcccatcttctatctctctccctctctctgcaatctgttgccgccaccgctgctgctgctgccgcgccgccgctcgcagccgcgtcgctgttgctgttgccgccgctcgcagccgcgccgccactgctgccctacatacaaactctagtgcgcatatgctagctgcagaacagcaatcgcgattcttttttctgaacttggttaattttcattttccgcagaactggttccatttccaggtgaaggaactaagctagctggatgaacgagtttccatcaagttacaacacacagttgacaggatcgatcgagttatacatggttttgaacagcaggaggtaaaatctcgtgttgctttgcctacaaccttactgctgccgcccccgctcgcagccgcgtcgctgcggctgctgctgccgccgccgcgctgccgctcgcaaccgcgttgctgctgctgctgttgccaccactcgccgccgctgagaacgaaaagaggaggaaggagaaaggggaagaaggaagaagcggggaaaaatggcagtttggtccaattttctatggaaatgcatataagaggtaagtagtgatatttttgaatatgtgtgaaattataatggcatatttccaaatacataaatactagtggtatatttaaaaaccggtaaatttctaatggcatgtatccaattaaccctataaaataacatgaaaaatagctagatgacataactttatatactttatataattttcatatttaatcgaccatgaaaaaagttataaacaattaagatgacaaggtttataacaatttaaattatatgtagtttgattattcaaaagtaaaactaaggtaatgtatcttaatgacagaaggaa

SEQ ID NO: 29848 - DNA, 1501 bp, Oryza sativa
cagggggtgtggggcccaccgtcagtgaaagaaattcgaaaatagccttggaggcaaagtcaaagagggttgcctgccaaggatctttggaggggattcaaggtggattttgtgcagcaagaagcctgggctagagatcctcttggtcgagggtgatgtggagagtaaatgtgctgaagtggattgggttagaagtctctggtttaggtttgatggagggatgaacatgggttgacagtgttggttagcagcagttgatagtgcagttgatagctgattggatttttggagggagggaagaaagggttagagagtgatccagggtgttccactccttagggtgttagaagaatgttagtagaagacctgaaaccaaacttcaaaaagagattttgaaataaattttacagagagagcaagtttgaatctgctaagcagtttttcaggattttggagagattaaagtagatcaacgagttagcaaaccttactgaaaaactctgaaaatttgtgggttgatttctgacatatcaaggtatttttgagaatttttgtagaatttttggatgcatataattaccagattaattatttttgtgactctaggcctatcattgcatatgatgatgagatgattaagatccaaaaacaattaaaatcactccacaaccacatgatgcatttaaattaaatttagttcttaggtttacaggcttgggtatgttacaattagagttcacatgaaaaagttatgaattatttttaaatataaagtcattagaccgtcatatttaacccagataatattcaaatccaagtttagagaccggggtgacacaactgaacaagttggaggacctaaacgagtgatctacaagttttgggaccgggatgacacagtcaaacaagtttaaggatctgaacagtcgatttgtgagtttagggaccgggaagacacagcggtacaagtttagggaccggtgatggactttactcaatggcaaaataacatgtgccatttactgagcacctatcacactaatattcatgctacttattatttttgtggatgctgagaaatgagttagtggggatgaactatatagtctatatagattcgaatttatgttggcatcatttattattttccatgatacatttccattgaaaaactagacaactgagacttattataataactcggggttatctatttgtaaccattaaccctgttagttcaacacatttaacagtaatttagctgcagtgtgatttattttttgtttcgctttatattttcatgtaactaaattgtcccatgaagataaggtggcttaacaaaatgcataggaatatgaacaccatttatgcttgtgttttagaattttgtactttcttgaacataaaattccattattacctgcaaaaaaataaaattccattattacagtatccaggtccatcaaataatattttggtttgcttacatgtattctacaga

SEQ ID NO: 29849 - DNA, 1501 bp, Oryza sativa
agagccatgtgagtagcgtacaccagcccatagtagcatccgatttttgtattccatcagacgtccgatcgctagtactctcactctaaagtatagatgttggatttttttagatgatctcacttatttctccatcttcgcatgcacgtatacgtattatggtgtctctctaacatgctaatgtcacttgacacgggcagcccacttattgtcgagttggacaataaacattgaggaacctagctggtgattagaaagtattttaaacataaaccaaaacatcatatttggcattcacatgtatattttttatcattacattttctaatcatgtaattaatatgaaatacgaaaattgttggaaacataactacgtgaaaacattattaatttttcatgacaaatctactgatattatttttatataccaaatcttatcattttttatatagtagtgatctctaaaatgttacgttcaattgtccgtacgcatcctaaaattaacagcatccattgtgaacagagttgatagacttcagttgattttgaaacgtaaagtgtcacagagatataggtaaaacttaattatatgacatagtaccgatcaatccttttgcttgtaagttgtaaccgcatgcgaacgttttattatctactagtatctcagaactcacttgcagttactcgcgtagtagttaacacgaatcactggaagcaccgtcactcggttactaaaaaatactccttccgtttcaaaatatttgacaccgttaactttgtagtacgtgtttgaccattcatcttattcaaaaaatttaagtaattatttattcttttcatatcatttgattcattattaaatatacttttatgtacacatatatttttacatatttcataaattttttaataagacgaatggtcaaacttgtattaaaaagtcaacagtgtcaaacattttgaaacggaatgagtatacatttgtgtaacgaaagaacaataaatttttttaacagcagatgtaggagttctacctgatatattaaaataacaataaatttgagacataaatttcgagggtttcatacaaatctttagttactatataaacaaatcttcatcatacaaaagaaaaagcacaattaaccatgtcgtcttcctcctcctgcctcgccatcctgtcgctgctggcgctagcctcccacctgccggacgccgcctccgcgcctcgcggcatcgggccgctcagccccgccgcggccgcgaagctcgtgtccgccgtcaatgacgcgcggcggcaggccggggcgccgccggtggcgtggagcgcgacggtggcccagcgcgccaagctgagggccgaatggctgagcgacccgaccaaaggccggtgcgacgtggcgaacgccggcctcgatccggggctgacccgagtcctgctcaagccgatcgtggccctgacgtacttcgtcaccggcggcggccccgggcggcggcgcgc

SEQ ID NO: 29850 - DNA, 890 bp, Oryza sativa
atgacaaatctaaacagcatttgtaaatattacatgactttaaatgggaaagccataaatagctaacttgtacagctaatcaagatctacaacttttattttagtcacttcttcatccgacaaagtgatagtaccaatgtttacaaaattgacatatctgtgttaatatttataaaccagatgagagaaatgtgatttttgtgaataatataactatcactttgtcggatgaagaagtaaccaaaataaaaattgtagatcttgatgagaggatcaactttgttgttgaccatatttccatttgaaatcatttagtatttacaaatgttgattatatttgtcatattgtgaaaatcaatttcaagctgttagaaacaaagttatatagataaatgaccaaaataaaagttgtagttcttgatgagaggatcaactttgttgttgaccatatttccatttcaaatcatttagtatttacaaatgctgtttagatttgtcatattatcaaaatcaatttcaagctgttggaaacaaagttatatagacaaatgaccaaaataaaagttgtagatcttgataacctctacaattttgttgttgaccatatttcgatttgaaataatttactatccgaaaatatgttatgactaataaaatgaattattatacaacagctatatattttgtactcacaaatataaagacttatctgggaaatggaaaaatagtcatcagtgacgggccttagttcaagcccgatagagattaatctatctctatcgggcattatcttagggcccgtcacagatgagtcatccgtgacgggcctgactgtcatctcaatcgggcattagtatggagcccgtcaccgatgagtcatctgtgacagg

SEQ ID NO: 29851 - DNA, 1035 bp, Oryza sativa
aaatcggaatcctatttttcaataaagtttatgaattttcaatacaattcgtgttttgctgcaatttgtgttttatctaacttatacgatctaaaaaattagaacataatatttttttttcaacagaagttttatcaacaatagctagcatagtctattttatgttttactagaaaaaaatgcctgtgcattgcaacgggtgaagtcaattttaatcttattattattgttatatggtttagttaagatgaaattcaccgtgggagttcgcttggatatatgtatttttagaaaatcatgagctgcagttaggagtccgatcgtctcaagttagcatgcgagtttttttaaacatgtttcttatatgattccttctgtattaccaaaagtgaacgatcttaaaaaccgactcaaatacggatatgtatttccaaaagcaaacgaacttaaaaactgactcatacacggatgacataccaaaataccagcaaaaacatcttcaatttttataatagtagagatagagaagagatatagattaaaaccaaaacataaaattaaaaccgactcaaatacagatgacgaaccgcgaaaacatcttcaatttttataaccgactcaaacaccgattacggaccacggaaacatcttcaatttttataatagtagagattaggagtatgaattgactatgggtgggaccgtgggagtgagggctcaaatccgatgattttatctattattttatatgtcttttagtttatattttcacttttaattagggtctatttggtaagactttaacttttaaatttaattataagaattgggtctggagtgtagttgtggagctgtctaaatcagctccacctctctagtttgttttgtagaaaactttagccagctccactgcaattttttatttttaatgaagttgaaactatttggttggactctctgacttcaagagaggtggggatgaagctaaagttgtaccaaacagatcctaaatttgtagtttgtcttgctagttgt

SEQ ID NO: 29852 - DNA, 1501 bp, Oryza sativa
tggcggatgaagcctgaaaattatatcattgagtgaggaatattactcaagaagatactgcagggaccattttaaccactcctataagctggcgccatactattagggtttctaactttacaggggtattgttgtaacttcctatgtatagttaggggtaggattgtaacctcacatgtacctccggaggctatataagccggtcatgatcttgtaatcagacacgaggtcagatatatcataataccatacaacagatgagactttacttttcgagtcatctcacttttgggaacatattactttcctacctatccctgatttgtccgtgacctaaggtcactacatactcttgcgcacaacttagaattttgttatatattttccagtcaatttactcatttgctaaaaatttcctctatttaccaaaattttttttgctacatttgtctaagattaaggctgtgttcttccccctattttcccaacccacctcactcgtttttcgcgcgcacgattttcaaactgctaaacggtgtgatttatgcaaaaaaattctatatgaaagttgttttaaaaaatcatattaatctatttttcaaaaaataataattaatacttaattaaccatgcaataacacagcctaagtgttcaaaattattgtcacatcttaggtcattagtaagcctaagatacatttctgattttgtgtcacatgatttatatagatagaccctttattaaaagcacgtttttgctagttaactatcgacagttttcagcgctgaaaactttcctttttttgtccgttcgatccagctccaagattcgtgctggcggtgctggaagatagaaaaaaatttgcaagcccaattcgtgtctgcaccaatttgtaagcctagttcgtgcctgacggtgcaggaagatggaaaaattttgcaagcgcgccatggggatcgaacccaaaacctacagcatacacacttgctccattacactttagtgggagttacacctgagttaaatactaaatatactgtagttccataacagttacatagtagttacaatgtaattacactatagttacataatagttacatttaaaagtttttcatctaaaaaactgtcgagtgttatatagctactccctatacaactacctaagctaatcaaacttgcctaatatttagacgtatgactagctataaaataaccccattaacctcaggagttaggagtacaaaatagtataccttttcttatcccttttgaatttcaaaaggaggcacctccaccactgaccgtccgatctccccagcaagggcgaccaccggataggatccccctcggccgtccgatcggtcgcggccgctgggatgaagccacgcgtccctcccgcgtctctccctcccaaaagcccacctccaaaaccccggagcccgcccgcgtcgtaaaccctagccgcctccgccgcctcctcccccctcaaatcccccc

SEQ ID NO: 29853 - DNA, 1501 bp, Oryza sativa; identical to SEQ ID NO: 28580

SEQ ID NO: 29854 - DNA, 1501 bp, Oryza sativa
ccgaaaaggagttttcgggttacagccgagtatatatgaacctacagggtcgcacgcttaatgggccgaaataaggggattggatggagatccaatatgagcttaattcggatagggatccgaataggagtcctatgggccttggaggcccgagtgatggatcctatatattcgtgaggggtgtgactggcggaggcattgcatcacgtgagaaaccttagccgtcacttccctccccgagcaaaaccctagccgcgcgcgggtgctagcacatctgcgcgtggtgttccgtccttgtacgtgtggataccggtagaggcgccgctggtttgcgatgttgatcggcgtgggagtacggcgaggagaacgcacgaggaggagaaggtcgagccggtatgatcgacaacttcctctacatcgacgcgcgctacttcgtgagagttccttcgacttctcagcgtcttcttccgttgcgcagcgcgtcgagtggtaacgatctatgatctaatacttgcatggttcctagtttacgcgatagaaaattttgatgctatcgtagcctacgcgtatcccaacagtggtatcagagccgccttgtatagtttatgatctagatcattgcatataattgatatgcgggtgtagtagatgagatctattatgttgtatatgagttcttaggtgatcggaacatgagatgaaccgatagccacatgggttgatgagatcaatcggtatgtgtgttggtgacttcactggaatgtttagtactcaccaaggctgagcgcgattgtgttcatcggatagtctgatgtccactggaaccgcacgccaatgagaaaaacgagccaatgagattgactcggtttcggcataatttgattacgccgttaaggttttcacatggcgaatcgtagatgagatctatgtaccactgggactgccgtgtgcgttgccccttagatttcgcttggggtttttatatctatcttactttattactgttatatatttgatatgacatggtaggatagattccctcagaaaaattaagtgtaatttatgctcttctaataattgcacctattacggttgtgatcataagtgatgagtttgccatagcaaagtgtcacttttatcatgataaaataggatagatgtcggacatctatatgcagagattattggtttacttgacaaggtaatcaaaacagttttggaccttggggcataggttgggttggatatgaagatgtcaccccaacagcagaagagtcacaatgatgtgattagtaaggtgttgcttacctattttgatagttgtctagctgcgatgccaaagctcactagacactaataaaatgaggatcttgactcactatgttactagagggaattttgtttcacaatacatagtgggagtatcttttgttaaattgtttaatgaaaggttaaatgcaaacatggtgctgattttgtatacatatatttctattgtaga

SEQ ID NO: 29855 - DNA, 269 bp, Oryza sativa
ttgaactcaaacataagcttcctttggtacacatgagtttttttccttgatttgtatgaaaaatgagctccttgatgtaaaggctctctttgtttaggcttataagccaactttttttttaaaaagtttaagccaaaacaaacaagcagctttttcattcggcttttttgaagccataagccactctaacactattaagccaaaagctaggttggagaagctttttttggcttatatgagatagatgtatgactccaccactaaactta

SEQ ID NO: 29856 - DNA, 1501 bp, Oryza sativa
ttaatttggtatctatataccatgatccatgagacatgatcatcaattaatacatgtgctgatcatctaatcatatttgttacacatatgatatttgatcagggatcctttagaaatagtaacacataatataaagagtctcatgaaagaatcacatattcattaaccaataatgagtttatctattttaagaaacaatgtcggataaatatgtaaacatagtgtgtgatacaatcatctttatgattgcctctagggcatatcactaacactacgctggctctacaacgtatattgattcatatgtaatgaaagcataaagacaatttcatttggttccaggagtctttttgaaacctagttccaggagtcttgatggctcataattatatgcatagtaccctttgatttacactagttgcaaacctgcaaccctcggctataaaatacgacagctaattgatcctgtgcttcacttccaggtgctatcagagtacctcaccttcatttcatttcctgcagcaacatctttgtagcggtagtgcatacaagacaggcagtacatggtttgtatagcattttaccgcgtaaatcaaatggtaattaaattgggcacgagagacctcagggaaggaaggaacacaggatatgatggagtgcttagttttcactcgaatgccacatttctactctaatatggcacagcagatttcattcatgccacaaaactactgcagttcttggcatgatcaaattcctgtgattattgcctgattgtactggcgtagcagagagagagagaaattgaacatgtctttttatttgaaaccttttggctaaagatgccatgttttctataagagtttataaaatcctgggtgataaagttctagcatgcaacctctgctaaagattcaccttaaactaactaggtggagtaatttgcatgttggctgcattcgcctgcgatttgttgtagctaatgagatcttccagttggatgtagcataggaagaaagagtcataactaatgctgaaaaggagcttagaacatatctaaagacaatagtggtggtgttgtatctactttaaacaagattaagattagacataaggcaaggctaacttggaccaaagaaggtgatgtcaattgactgttctttcacttaaaagcagatgccagaggagagaaagaattatacatagatgttacaaaccccatcaagggatgtaaccactcaagacaagaaagaacttcatcgttttttcacacaactcctaggggttccgacgatctcggtgcctgaactggtcggcgataaacctaccaaatgtatagctctactataagaccaggaggatacagcacaaggtgaattaaaggagactatcttctccatgccatctgaaaaattaagcccctgatccggatggttacattggggcctttttcaaacaagcttgggacatcattaaagtctgcaactatatatgcccgagc

SEQ ID NO: 29857 - DNA, 1501 bp, Oryza sativa
gaagaaatgaccaaaataaaagttttagatcttgatgagttattcaactttgttgttgatgactttttcagttgatatcatttagtatttgaaaatgttgtttgaagttgtcatattttcaaattcaaattcaaactgttcaaaaaaatgttatattgaaaaatgaccaaactaaaagttgtaaatattgataagttatacaactttgttgttgatgactttttcagttgaagtcgttcactgatctaaaattctatttgaacttttcaaactttgaatttcaaatttcaaattgtttaaatagagtcagatggagaaatgaccaaaataaaaattttgcacctcgatgagttctacaactttggttttggtgacttttccatttgaaatcatttaataaccccaatttgacatcctggcctagggcataataggattaatacaatactcataccaacatgttacaattacttttccggaagccaatctctagagaactttgacgttaagtgtgcttggtctggagcaattttgggatgggtgcacacgagtgagggctagccagaaaataaaatttatttatttttggaatatactcatctgtgacgggcattaactggtcgtctgggaagtttaaacttcccacgtgggtgcacacgagtgagggctagccagaaaataaaatttatttatttttggaatatactcatctgtgacgggcattaactggtcgtctgggtcaaagctatcggtgacgggctttacttagggcccgattgagatagaatcatccgtgacagccgtttgcccgattgagatagctcttcacatcagtgacttctagcctgtgacggacgccatacccgattgagatggggcttaccgcccgattgagatgagggtatccgttatagtgtacaaaagtattgtatatctatgttaaggatacaaaacacacttggtgaataccaaatatttttgaagtatcgatctatgcattttcttaaaatgacggccggcgagcagttaaagtttaaaaataaatgaatagtatatccagtatatatatcaacatctcccaatgtttaacgttggttagtgcaaatcaacgtcaaacaaaaaggacggagagggagtatttgtccagagatcaggagtagatcgatcagtacacgcacgtacgtacattaattaccagatgtatcacagatgaagctgtccctactagagaaaccatctttagtcggtcgcctaaaaactacaatagtcccggtttaaataggaacagagactaaagatcatttttaatcccggttaaaaaaaatttaatctttagtcctggttagtaactaaagatcatttttagtcgcgatcaaaaggttgttgggtcaaattcagaccccaattatctttagtcccggttggtataaacaaccgggactaaaaataggttttagtcccgattgtttataccaattgggactaaagataaaaccacctg

SEQ ID NO: 29858 - DNA, 1149 bp, Oryza sativa
gtgtgttttaacgcctacacctcatatgtagtatagtatctatataatataagactattatatttatgactttattataccaggtattttttatgaaaaagtttaattttatataatgacataaaactaatatttatttacttattaaaacagtatatgtagcttttttttatgatagttcaacatattttctccagttgtatatattatataggaatgttttccaaaactatatttatcattttaaaaagtgctacacatactttttaatatatattattttttatgtacaacaaacttatgcatatgataatcacacaacaaattttatacttccaacaatacagtttacaaatttctacttatttctcacatattgaagggtaaaactaacttttctatacctattaaacggtcaactaatggtcaattgatggcaagggtacgaaagggatccaaatcaaaattcagaggtatataaaggagtgaagaaaattcaggggcatagaaggaatcggctaaaatttcaaggatatagatttgaaatgagtggacgaaaataggagtattgcaattgatgctagctttgagcaggaaatgcaaaagtgtttggatcttgattttgcttcgcagttaccatccactgaatttttggggccgttgttcaggtgctgtccaaatggaaggaagggagtaatacaagcaaagggacatcacaggagaaatgaagtcaacactatgcccatatcctaaatgcaattgtgatgctttgctgaaaatatgctcacggatattgcgctataaaaaatgggttgtaactgcaaagacaaatcaatatcccaacacttctatcatgttcctacttcctagcacgaagcagagtggagacatggactataagaaccatttttatgataatatcatgaatgaaaccatgcctggaagcaaatcacccggccggaatgatgaaagtgatttgttaaatgtgaaggtaactttttatgccatgacacttcatgttcagtcattagatctaggaggtttcaacttattggcttgggaacaacctgaatttaaagcaaaggggattgctaggaccggtggctagcaacaggtcaatacaagttgagttgttgtattaactcacta

SEQ ID NO: 29859 - DNA, 702 bp, Oryza sativa
taacttgatgctaaacttgtatttttatgatacaccctatcaaatatatagttttaatttaattggatcaaaatagttttatataatttactcaaattataagtttacgatattataaagtatacttaagttttaaggataaatatatgcattatatttgtgtttccaaactacttctaactattttaaaatgcatcaatagtcaaaatttaaaatatttattaaaatttcaaacgacatatctatatacttatgggcagagaccggagagacaattatagacttgcgagtccaacattaccatcaatttttgtaggaggacttagatctatcttgtagtactatgattttcttcttttaaggaaagggggaaaaatgatgtcttaattattcttctcagacacattattattccacctactttggcctaaaaaataccctttgccaaacagaaagcacatcgatctgaccttgacatgtcacattccaagcaccttaaacccaactttgacttcttcctttttctctttctttctcgcgcgcgggtatctctgtctattaactaaactaaacatgcaacgcaacgaattgtaccaactctgtactagctctagctactaccatatagaacgtgacatatataactacgttgtcaatttaacaaatactacttatatattattcccttcggtttcaaatagc

SEQ ID NO: 29860 - DNA, 1501 bp, Oryza sativa
atagagctaaattgagatgctaggactagattaacatagacatatgataaatagccaggcaaatatattatccaaaccagagtaatccaagaggtcgaatgtcctgatgcagccttgaacgacgccgacgtagacgatacaattgcctggaccggcggaacattggacttatcccttcgctggagatcgaagacgatgcagccccgcgtcgggtgccaagttccgtcggaacgtaaaaacaaaagtagaagtaaaaaagggtggcgatgcgccgaattgtattaatcgtagcgatagattacatagaccccgggtgtacatatttatacccatgggttgatacaagtccttgtcggacaagaaagaaaccttcctaaagataaaaggaaaagataaagtccttataggacactaaacacactttcctaagttaaaaggaaactaacaaactattcctaattaatagataacttgccataccgtattctctttgaactcagtctcttctgcataagcctccttaagtagatcaatttccttaaccgaatatagtaagaatccgataactgacgacttgacaactctcatcggctaatctcaggacttcgaagccgatgctgactctaagccgatgactactccgggcttaccaaatttcactattaacagtcaccctttttattcagctatctagtatgtgttttgcgtcgtttgtgacagatcgagatgaagagtccagtacactgctgcacaaacccttttagtcccagtttgcaaccccctatagtcccagatagcaaatcggggatacgaatccgggactaaatatcgctatctttagtcccggttcaaatattcgggactaaagatcaatctttagtatctttagtcctaccaaccgggagtaaaagattttttttctttttatttccattgtttttatgctgtttgcacctcgactatcaccgtcacacccaaatccccacaaatcatacataatcatccacaaaaccatcaacaaatcatacacaatcatccacaacacatgcccatccacaatccacaaatcaatcacaaatcaataaaaaataactacaaatcattcattacaaatcaattcacaaaaaaatctacgaatcaactccacagccaccgcctggctgcctcccctcccgaatcccgcggaggggaggccgccgccgccctcgcgcccctcgggccgccccggcgccaccgccgccaccgcacggccgcctcccctcccggatccggcggaggggaggccactgctgccctcgcgcccctcatgtcgtccccacgacaccgccgccgccgcccgccagaagggagccggaggggaagaggggagcggagtggaggaggggaggggatgggaggaggccggaggagaagagaggaggagaggggaggaggagatgagggtgagtgaatgacgggaggtgtcacgcccagaaatttagcccaaatttccagactattt

SEQ ID NO: 29861 - DNA, 1501 bp, Oryza sativa
ctattccatcggcttgtcagccgatcggctgttttgatctactatttgcatatcttgtcagttgtaggatcaaactgactggcacgccctcatctcactaagatttggacctgcacatgagcttagcaaatctcccaggccggtgtgttcattttttcgtcaacagtaacatatctgtaacttttttcatatcctatcttactgtaaagttatcccccactaactccttaagcttaacatgcaaagatgccacatcatcatccactaacaagatgccacatcatcatccactaacaatcatcacatttaaacatcatgcaaacatgctatatctttatagttttttataatttaagagcttttcaaatacaaacatgttaaattatcatccaacataattcacaattcacgtaatgtttcaatgtatatctttattatgttttatgatatcatatatatttatatagttcatcctcacttagttagtgcttaaatgattaatctatggtccaaattatctttctccttttttcctctaattaagtcatatcacatcaattgttttttgcctttagatgattaatctacggtccaaactatctccctactttttttttccataaagtcataccaccttactttttacgtatactatttaaatttaaattatcataaaccacattaatttacttaatttgatgttacctagctatcttacacgttattttttttattgttatcatactaaattcccgcagcaatacgcggggtttcaccttgtatattcaaatgacatgtcttgttttccctcatactagcaaatatatatatttcccccatatttatgctttgaaaatactcgcatattagatatcgctgtaaatgactcgagtagtcgggtctgacaaggggctttacattgtcaaattacaggatttgtgcagatcacccaactactaaataaacttggaatttttttgtctttaaccgacaaagattataatttgttaactagccaatctgaccgagagcaatcgctagataaaatcctataacgtctggataactcgaagagtttgtggtaatgaagatgacttattgctggtctggacaagagaaaatattagtttatgatgtcggacaaatacgcacgggtgcacaatttttattaggtgttttatatgcatttagtggcttacgtttaatgtctgtatgtggagctaaccgacgctgctcgacgactttaatgtttgctgataagtctattcgagtatttcagaaaaaaagaaagaataagcaaaacaacaacatcgagattctaatcacacaattagactgcttaagttctgaactttatacaaacactactaactactacaggattgattttcctggacactacctttttttccatgctgttcataactggaaccgcacagaaaaatagggggaccagcgtcgggttgtcgcccgcacggaaaaataagctgattttcctgtg

SEQ ID NO: 29862 - DNA, 158 bp, Oryza sativa
attaaagtctttcatgcaagacatgtcaggaattacttagttttgctatggtgatggatgataaatatttttgaacaatttggttatatatctatggttgaacttcccgtggatctgtttatggattaattaagctgaaatttgttttgatgtgacta

SEQ ID NO: 29863 - DNA, 618 bp, Oryza sativa
tccaattagaaaaagacggaacacacgaaaacaacaaagtgcaccaatataatacaatgaattgcaacaagcctaccgtccattcttttcctctactccaatagttagatctatcttcttcctttaatttgctcctgtggccgaatccgggcttccaccacaggacaaaactgagctacctcggacagggttctgggatacggaccgagtgggccgaaattcggtgaaattcgcccatttcggtccagcccgagacaacactaaaccggccaaaaaaattcggcccaatttgaattttcagcccagcccatggtccaaaacagccctcaagtatcttccctagtataaaagagcaaatctcacacaaaaaaaccctaacccactctttatcctccctgtcctctccccctagtggcggctggtgaagagactccatcactccaagccggaggagtggagcagcagctccggcgtcctcctctttctcccagctccatttctccctgttcccctccaccatcttctacttgagtccccaatccacattctcctcatggtgattttgtgcggcagcggtgatgttggttgtcaaggcaacggttaggacagtccaacaat

SEQ ID NO: 29864 - DNA, 364 bp, Oryza sativa
cctaaccacatttattgcggtttggctgagcgtgtcacgccgcatgtaacgcagtgcagtgcactcgtttatccggtctgtgaccagtcacagaccggtcagatcgcgggttaggtggcgataggcgatctgacacacgcctcgccccatcccgtcaggacgagggcttctaggcgctcgtccccagctggagctagcgtgttacctcccagagatggcacgttagtactggtcagatatatgccaggcttcatcctaaccattacaggcaagatattgtatgaagaagggcgaacatgcagatggataaactgacgcgtggtggacaagaatgaccgatttgtgaccggtctgacactggtca

SEQ ID NO: 29865 - DNA, 1440 bp, Oryza sativa
ggggggggggagtttaccctaatccgttttctcttcacttgcgcgcgctgtgagctacggcactcgaatcttctgctttcggtaaaatggaaacgctggttttgcagttcgcctgggattcactgccgtatattgtggggattatctcgctggttgaaggagggaagggtggggtttaaccttgtttttgcttatttatgctagtataagcattcctgtgggtaggttactatcatgttatatatttcgcggtaggcgtgttgcaagtgattttgccctagttggaagggaggggaaggggtgctcattttgacggttttagatgttaagatttaggtcaacatgtgctgcggaagtgtgtatggattcactttgacctaattttttctcttcattgttgcaagaaaggtaatacagatctttctgcaatattccatccactaagtttgtgtagatgagcgcccgctatttgattgggcctattttaccccctttgattttctgatgaccttgcactgaatatactgttccatctcttattgttggtcttcagggcacgagatgtcattgtatactgcccaggtctacctgcgcttgtgctagctgtttaggttattttgtgttttttgttatgtgagttgcttctgggtggtgctgttcagtgtaaacataatacctgtggatgtccaaggtctggttattgtggctattcacatgcttatgttgtgcctatgttgtgtggaccggtttttttttataccacagcatatatgtttgcttttcttatggttgattgataacaaactgatttggcctgttcaagatcctgatactaatagcatattcacctattcaacctgtttactttggtttagtaatttcttcattgtatgtcagggtgttgcccttttatttggttattcatattttatctaatgtgttccgctgacttagtgtacttgtgcagctgcctgttgaatatctaattgcccacagcatagttagtctaattgagctttgcattgttaattgtacttagcttggttcccttgtttagatgaaactcatggccaaatgaggtgcttatccaactgtttaactgagtaacttgattttcttatgggaaacaatcaatttttaagtaagggtaaattaaatttgaataatctttagcagagcttaactgtgttgctaatgtggataacataaatgttgcatggtgatagttctacatcttgtaaccataatttgcaagtatctgtggatggaaaggaattctgaaggaccctaagctaggtcaaactggcccaacggcctttagttgctaggattgttaattgatgtgccttttcattaagtttgtgtaattgtttttcgcttaacatgattaacagctaaaatctgtttctttgatgtctgctaggacagttggtacagcca

SEQ ID NO: 29866 - DNA, 1501 bp, Oryza sativa
actctctccatcccataatatactaccaccgttccaaaatacttgtcgttataggttgtttagcatatagtaatatttgaagaaaaatactataataccccttaactaataatggataattggatgtgggatggtggttaggggtagaatagggagaaatttgaattggaagtggttgatgtgacatgtagtacttcaaaatggcaactgttttgggacaatttttaaatgctagaaagacaagtattatgggacggaggaagtaagagattttattcctactattagtcccacaatgggactttgctatactacttgtcacattccattaattctaattcaaatttctacctattttaaccttcaactacccactcgtcacaaccaaaatcacattcaatagaggcattgcagtcttttcttttcattcttaatctttcccaaaaggaaataatcccttatattatggaatggattagggagtacatagtttgtgttgcgcaatgggattaattgacaaaaccagcttgcatctctaactactaactagtcaaatttcaaactcatttttgtttttctgtttgaggcccgaattcaattttgaattttgaaaacgtcgttcacactgcttcatgtgcctcaatagtccagttatttttttttacataaaattctggctatctactcctagctagttctgccgttgaggtagttgaagaggatgagctgccaaagacaaaggggatgctagctactaccatgcatcaagttggtcaggtcaggcaggattaagctttagaaagcgtggtagatggtacatcaacaaggaaactgatgtgaggtctcatgcagatttgacaccaaagcaaagcattctcagagattttcctaacacaccgcgtgttgattgcgtcgtttgtgatatcttagtaaccaagcagattaaattaaattatgacctgtcccataaacagaggaagacaaatagacaatcccgatgggattagacaatccagaggaagacaaagagttcgtcagaagttgtacgtcgaagtgtaccgcaagctggaaacttctacgtgaactgattgaatgtgaagaactgtgtagtgaaccgtaagatcattggctcccattcggtgcgcagcctcagccagctatgccgatcgctaatttcgttcttcatttttatcaattacataggagacatgcttgttttactctacttcaaccgaatttaaactagataatacgggagtttggcatggagaaaatgcccatttaatgaaaatagataaactgtaactaaaagaatttctcagccaggttattgacactccccctcttataatgtgtgtagctccaccctcacagacacacgcatataaagtcgtagattatttcaattacgtagaagacatgcaagcgcacacagactcgatcttgctctcgatcgattacctcttgtaatataagttagttccattgacacacccatata

SEQ ID NO: 29867 - DNA, 1501 bp, Oryza sativa
ctccacttaactggacgttgaaccagttttgattttttttaagcttatagtttagtgtgaatcatctggtcctccatctttatttatcacggaatgtatcagaaaatattaggagctggtttgaacaagacgcgacggaatagcaactgggaacagcgccctctcacccagaatcaggtctgtcatctttcatattccttaaaagctgtcctcacgagtccttattccttgaaaggccctatttgttggtatgagtgattaattaatttctcataattttgtattgtgagttttttttttcagtctcattctgaatttattttcacaatacttttctaaccatgacaggtgtttgtatgaaaaaagtagaaaaagaaatttactttagaaatgagcctgtcgattaccacatttttaacatcaccttaagatgcctctccttattctcatgtacaagcaaattttctatcagatcttgtgctaagcttatcttggtaaacaccattagttaaaactaagtcaaacatgcttcatcttgcaatctaaagccacgagttagtttgatagcctactgttcatcgaggacaaaaagcgccatccctaaaacagagagattcttcctccttttgcagaaagagtatgctgcccttgatgctgtggtccttgttcatatattccatcacgtcaagggacagcctcagtttggtgtcaccgagggatgcaaagtggaatggaagtcccatattgtaagtgcaatctaaaaacatcaaagtatcaaactgccatgtttatatgctaatcctgaacatcatgtgacattttaaccatcgttgcaggtttctcgggtgaagaattcacggagtacattacgcttctaaaattaagggctgatcaaagttgactgtggacgtagtatcttgctaaagtgttagccaggaagaagttaagaatcaatctgttcatatctttctcacatcttacatgatctcagcagctgttgctgccatctgtaaatattatatgctcagatttcttccatgttgtgttatcgctaattaggagctatgagcctatgacagttcaggcatgcatctttttggtggcaatggactttattatcaggaagcatgatagaaatgtgccaatgtgccagttggagacgattgaaatttcatgaactaacactagaatgtttgtatttagatgaacgtgaatcctacctttgctcaagggaattcatttccttcatttacgggaatgtaggaactttttttttaaaaaaaatttctcgtattccatatagttgtggcagtacagtagattcccacaagtccagcaagtccagtaaggcacaaagtaatccagagttctcaacattactttttttcaagtgatctaagctttaaaagggcaagttctctcattattcgtgataggtacatataattatacagaattattacttcctaactatgctttcatcttttgctcgtacgtggca

SEQ ID NO: 29868 - DNA, 312 bp, Oryza sativa
catcagatctgaaatggagtgaagtagagatgggagcggatcagaattgtatgtgaggggtagagcgaccttagcccgtactacatattattaatgaaagtgttaaatgtgaaattagagagaggtattagagcagtctaaggcagttcatggcctccccgaggcttttagaagtaaagcatctatgaaaaccaataaggatgtctatggttccataactttctctcttctatttagcattatagtgttaattctttcttcaatgagcattttttctatccttgagaagctaccatgaggtacgaggtacca

SEQ ID NO: 29869 - DNA, 821 bp, Oryza sativa
aaccataatgacaaattttccgaaactttatttgtgaaaattttccctttcttccttctccataattctttgcaaatcattttatcaatctccccttcctccttcaacttgaatagttgttaagctttctggagaaacttgaagatgccaaagtcaagtcaagtgtatcgtggaacaagaagatgtggttgaactgaagaactgaagtatcgagctttcgagatggaatgaagttttggatactaccttagaatctaaaccactcttttgcaagagtataacatttgttgcttggttgtgtgtaggtatggtagcattttcatcattgacgagcgtgtaactgtactaggttgtttgcttaatcaacttgaacaatataatattttacacacatcagaccagtggaaacatggttaaggtcttatctttagtgtaacccctctccttctaccctctccaaatctacaacagatggtgaacactcgcgccagtggaaagtggaaataataacaacgatgagaacccaaccatcacacaagtcttggctcaatagactcagctcatgaacatgatgatgtagcagatggataaccagtttgaccaaggtaacaacaatcctccgccccagaaaaagttagctgaatttctttgtgtgaggccacctacattctctagcactaccaaccttattgaagctagtgactagttgcatgctatcgagaagaagttgggactgctccagtgcacggatcaggagaaagtcatttttgcttcgcatcagttgcatggacctactttagaatgatgggatcacttccgaa

SEQ ID NO: 29870 - DNA, 1501 bp, Oryza sativa
ccttatattttagaacggatggagtattcaaaaatatcgtagaagtattatcgtcagtatacaagcgctcacaacacgtgcacattcacgcctacgaacacacaaatgcacatcctacccttattagcgtattcggaagactcagtgacgtatcttcgtattgataaaggcatcacaaatgtcttgttgttaatggatacgtcatcaatcactgaaagaataaatagtcgtaaatacgagtacccttattaagtctatattatataacttaaatcaaggtgagctcgttccatcacaaagagcataaccaattaacctacactcactactgtcgatgggtggtacccgtaaaccggatattggcggaccggttgagatcggcatcgtggcgtaaatcgggaagacgatttcgccgacttgagtccacatcagcatcgttgaagcagggaatacttggttgaggttggtgttgacgctgttgtcgacgaggctggatgacatagtagtagaaccttgagtaccaagtccccctacctggcgcgccactgtcaacgggtggtacccgtagaccggatatagagggtattggggtatgttggtacaaggatctacgtaatacgacatcaagcaaacaaaagacgaggattatactggttcaggccccttgataggtaatagccttaatccagttgatatgggattatatggtggaaaacacaggttacaaggggaacaatggaacttgacggatccggtgagattgtggttgagttggttcgactagatcccggcgatttggctccttgcaggctccgacttcgtaggctgtgagggttgtgttggctctgagattcgatgccccaggtcctccctggggggtcccttttatatcgcaggtcaggcggtttccaagtagaactcggagataatagaccctatacgatacattgatgacccagtcttgtccgagtaaaactcttcccctccgtagacttcgtgaaggatttccttagtgtacgcggggagtatccgtatgcgcgtgggtatgccataccgatatgtgacgtacatcaaagggtaaagggtatacctaatccgtaaccctgacagtagcccccgacttctgcttaaaatgagctcgtgtaaccattcgcgacttctggcgtcgagactgttgtcgttcccggtgcgaggaccgtagagacaaaacgtagtcgagagcaccatttgaagcccaacggtcacgagcgaatttaaactgaagtccaaaaaaccgccgcgcgtaacggacccagaaatttccggcgggcatctctctctgttccttggaattcgcaccgtcggtagtgcgtctatttaaaggaattttgaggatccattttgaagttcgccccccatgcaaaaaacatcccgcctgcaagcgctcttcgtcttctccgctcccacaagaaaccctagtacatcgacctgagctctttctccggcgatctccgatcagaga

SEQ ID NO: 29871 - DNA, 1501 bp, Oryza sativa
tgataacaattttggggataaaaaaaatcaaaatcggtgttgcaggccgccatagccgtaaccaccactggtcgccatggctgcaaatacagcccgcggtggccaccgcctgccaaagcccacaccgcggtcaccaggtggtagaggggaggggattggaggagcccaggcgtcatcgtcgtggtagccgtcgtcgtcatcatggcagccaccgtccatggaggatccgttgttgcggcccagcggaaaagaggaggacgacgcaggaagccatggcggagaggaggaggccacgcgccgccggtgggaggcaggggaagagggagaggacccgaggggcagagaggaggagaaccgcccccgccgccagatctgtgccaccgtgaccaaccatggtcgaggtcgcttcatccatcaccgagccgcaaccctagccaccggatccgtgccacagtgacccgccactggatccacgcccctccgacttgccgccaccgaatccacccccctccaacctgccgccgctggatccatgcccctccaacctgctgccactggatccacgtcccctcccctctggctagatctgggaaagggagaggagggtcgggtcaccatcaccgctcccaggagcgtggccgcccagtcgtcgaggccacgtgcgctggaccgcgtcgctgcctcccctacactctgccgctgagctccgccacgcgctgccgcctgccgttgagatatggggagccgagagaagttgcgagagataaagagggagacaagtcgtgagagagagagagagagtcgctgctgagatggatatggggagccgagaaaaaaaagaggaagttaaaatttcagttccgcacgcgctcccacattttttgctagcggaagttaaaaggaagataaagaactgagatggatttttgctagcggtggcttaggtgggccgccagcaaaaagggtgcatcttcattgacagtcctcttaacttggccgccaacgaagatccattttcgctaacagtgctaggtgaggaagaaaaagctgagaatggaatatggctgcagaggcagtggtgcaacgatgggtggtcaacgacaaggaggtggtgccaatggacggcctatggtctacggttgatgatggcgtcgactgaaatttcggaggtagcagcctatgctctccagatgatggcaaacagcgagagacagcaccagatggtggaggtgaagccggagggttggaagatggtagaggtagtaccaggaaaaaaatggtggtggtagtgccaacaacgacgtggtttgggaacagtgaagtggcggcggtttgacaacgaggcgttggcgaggataacagtggtggcatctccgatcctttggatagtataaagaacaatgatgcacacaaccactgggatggcgttggaagaaacagagtggtgggcctggttgatgaaggagctactgctatcggaagatggaaacttagaatgaac

SEQ ID NO: 29872 - DNA, 1501 bp, Oryza sativa
gggccaaaatctggaaaatataaagtgatgcttagcatttgatttgttggctttagttttggttcaatattagaataggttgtatttaatgtgggtatgactagtgttaacctttgaactgtactccctccatactcataaaggaagttatttaggacaatgtttaagtcaaaccttggaaatataaatcatgattaactctcaagttgttgagtttgaaaatgtaaaaagtatatgaatagatttgtcttgaaaaatactttcataaaagtatacatatatcacttttcaataaatatttttatagaaacaagaagtcaaaattgtgttttagagaccgtgtcgctgtccaaaacgatttcctttacatgtacggagggagtactaggattttggatgacatgcatagcaagcaaatactacaactatctcacaatataagcgattttgaaaagataattgtccagatttgtagttataagatatgtcacaaccctccaaaatcccttgtatcggaggaagtagtctgtgtgagagagtatcttgcatgtcggtttcaaaaagtatcttgcatgtgacactaccatgttactgcttaaaccaactcacaaagaaacaaaggaaaatcaacaaatgaaacaaacatagatgatatgtcttctaccatatgagaatgctctaaatcaaaccacaatgcattgtgttctcaggtgccaaagagaggtaaaggaagagcaccttggtcatgttcagaatgtaggctaagcgtgccaggatgaacttcgcttatttgatatatagttctttttataaactatttggttgattgctctaactatacaaagccatactttctaaagaaaattctttattgtcaaatttaatcctttaagacgtgtttttttttcatggaacataatggtggataaatacgcacgtttctcaagctagggatgaaaacggacgaaaaccacatttattgttttcgttttcataattttttcggaattagaaaccccatatacgaaaatggaatcaatattattgaaaccgaaaatggagcgaaaacgaaccggcgcgggtatggtaatgaaaatttaacggaatacaaaaacccctcaaactgataaatccaattcttaagtctcaacggtaaacaattcatcataaaacataatcatataattctaattgttaagtctcaacggtacatcacaaaacacaatctatgaataaattatctaccttgaagagagtaatgttgttgataaatcccaatgcaggaaaaagatatattcttatgtaacttcagatttgcataacaaatattctagaaaaaataacagccaaacaccatggtattcattgtttagtgtttaaaaaatgtctagggtattgttaacagtgaaatttggtaagccccaaagtcatctatttgtcttagagttagtatcggctttagacttttggaatcggccgatgggaattataaagtcgccaa

SEQ ID NO: 29873 - DNA, 1501 bp, Oryza sativa
aagatacctctccattaagcattcctcacgaaggcaaaaggcgaactcctacaggagccctcatgtatttgtaaacattcatgttaatgaatcatgattaataaaaaggcaatacagggtttccctattttctgtgtgttcgttgttttgttttcatcaaacactgaccttgctttctattgaggatctgactggccggcttctcaccgtcgacgatcaccccgactctgatggcgaggacgcgggtcaggtgctcttcagcgaaaaggaggcccctgctcactcaaacaaggaagctgggcagaactcagccggggggagggcgtccagctcacggcaaccacaccgcagcaggcgcgagcgcgacggcaacggctccgacggcaagtcaggttcgtcccaagcggcaaaccgcaatgtgtccaaggacaaatgccggtactgtggcaaacttggtcactgggccaaggactgttgcaaggcgaagcgagaccgcgagaaactggctcaggcaaaccttctcatcaccgagcctgctcaagccgcggacgaaggggagccgacactgctgatggcgcaagtgtgcgagcttgcccctgctaccgatcctgtcattactgacggggaggtgacactgaaggaggaacgtgctcacgtttctcttcaggatgaaggaaagcccgttgatctagactggatccttgacacgggcgcttcaaatcacatgacgggctaccgtgatgtgttctccgagcttcacaccaccgtgcgcggcactgtcaagtttggtgatgcgtcgagagtctggattgaaggacgaggcatggtgctgttcgcttgcaagaatggtgaccactgcgcgctcactagcgtctactacatccccaagcttcggagcaacatggtcagccttggctagcttgatgaggcgcattgcaagacggtgatcgaggatggtgttctcactttgcatgatccacagcgacagctgctgtgtagggtgcgccaaggagttgggcgcctctacgttctccacgtcgagctggcgcaaccggtttcccttctcgcaaaggggaaggatcaagcctgggtctggcacgctagatacggtgtcacgcccagaaattttcgaatagaattccaagcagaatgtgcattaaaatccccgtccaggaccggccggggtacacaaacgacaaagttgacatacagatccacgtcttacaaacattataaaagttttacataaatgcagcggaaaaacaaaagataactggagctaagccttgacttgaactacagcgggaacaccactccacaggcatcctcgatggcacggacgaagcctactcctcggagaaaccaccatctgacgcatactcaaactctggggtttggggaaaatagagcaagactgagtattaccaactgtactcagcaagtcataccggaataggggtatgatgcagggaattatcaagggatagctataatggttcat

SEQ ID NO: 29874 - DNA, 1501 bp, Oryza sativa
tcaacatcgagacgcttgttatgacttcatcaatatgaagatatgtcggttgagtcttctgaatatgctcataagggtaggatgtgcatttgtgcatttataggggtgaatgtgcatgtgttgtgagcgcttatatttatactaacgataatacttctacgatatttttgaatactccatccgttctaaaatataagggatttttgtcagatatgacacatattagtactacgaatctagatggggagcttgtccaaaagtattaaaatatgatgtatcctagtactaagagatgagtcatatcggatcaaaattgcatatatttttggatagagggagatgtagtttgtcacatagaattgttgtgtgtttagttcatgccaaaattggaagtctgattgaaattagaacgatgtgacaaaaaagttagaagtttgtgtgtaggaaagttttgatgtgatgaaaaagttggaagtttcaagaaaaagttgggaactaatgccatgttttgaaagtttctagtatctataacttcttctataatcttcagctcttcaaacatattttaacataaattttatagctctccaaacaaattttaccatagattctatagctatagaatgcaaaaaataaattaaaagctaaagactagagaacccagctttttaatttcagattctcaaaaattagctactaatcaattgcttcttagaattggaagttaaaaaaaacactaaatagcatgccaacctcaaggacatactacaaatggaagtactactagtatttattttctttatgtacaacgcagtataaaaaaattgaaggggtgtacatgttttgccacatagtgggttagtaagctggttagacatagttgtcagggttacgggttaggtataccctttaccctttgatgtacgtcacatatcggtatggcatacccacgcgcatacggatactccccgcgtacactaaggaaatccttcacaaagtctacggaggggaagagttttactcggacaagactgggtcatcaatgtatcgtatagggtctgttatctccgagttctacttggaaaccgcctgacctgcgatataaaagggaccccccgaggaggacctggggcatcgaatctcagagccaacacaaccctcacagcctacgaagtcggagcctgcaaggagccaaatcgccgggatctagttgaaccaactcgaccacgatctcaccggatccgtcaagttccattattccctttgtaacctgtgttttccaccatataatcccatatcaactggattaaggctattacctatcaaggggcctgaaccagtataatcctcgtcttttgtttgcttgatgtcgtattacgtagatccttgtaccaacataccccaataccctctatatccggtctacgggtaccacccgtcgacagtggcgcgccaggtagggggacttggtactcaaggttctactactatgtcatccagc

SEQ ID NO: 29875 - DNA, 1501 bp, Oryza sativa
tacaaccaccgtactcaacaagacacacccacaagtgcataataaatgcaagggagtacaagggagttataatataaagggttagggttgcagtaaacagcatttaaagatacttagttgctcaaagctattttgtaaacacgattctagaactatacaatattatttatcaaggccgtgaacccacacgaacctgccttaacccaaggcctacgatgattcagaccgaaccggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacatgcaaccacgtgccacataccaccacggtatacagacggaagacgtgacatagtttccaacccatcctagccatagacaagagtaccgacccaatcccacctacggccggaacccccgggacaggtaggcaggactgagcccctagcagcaggacaccgaccctgtgccatgacatctcgactaccgggccgcagctcgtgtagccttcatttgccctggagatgtccatcgacccccgacttcgtccatctccatccgtgtacttttgtttataaccagactgagccacaaactaagccttacccactagacatgtgaaagtacggtagtgctttgcaacagaggcccgaagaccggtccttatttggccgaggtgctactatcaaaaccatgcaccccgagcccagcctaaaaccatttttggggattttgaatagagggggcggtgtgaatccaattccacaatactccaacaattccaaagtgtccaggtgatatgaatatcccaaagtctagagttgtaaaaccgcctaatgttacctaattaaatagcgaagcatctacctaaaatcatactagtggtaccatgagtagagtgtccactagctggggttttgtttattctagggtgaacaaggaaataataacaataacaataataaggtcataacaaaggtaaataggcatggctagataaaacagtgataacgcgggaatttaaataaagcgataatgcaataattttaaagcaacataattttataaactgggattcaatatgttcaaggatgatgtgacttgccttgctcgctttcccaaacgccggcttcaacttccacgaagagcggatcttccaaagctgcagcgtctacacgatcaacggaaaagaaaaggcttttactctaataaactccatataacaagcagaaacaaagcacaaaaatgggttcttggcttcttaaggaaaaattagagacttgaacggtccaattccgagttcaaatggccaagttatggccatttgaagtttatatgctctttaaatggatatttatgaatttct

SEQ ID NO: 29876 - DNA, 1501 bp, Oryza sativa
cgtcctcctgcttgtcaccaggtccctctgagcggctcctggagtctggcagatacgtctcgccgctgcccggctctgagccactggaactgctgctgctgtggtcgcggctgccactgggagtggcaggcaaccaaccgccgttgccactggctgggcccctgacggctgatgctggagcgaaggagagagcggacacgggagctgacactggaacatgagctgggactggctctggagctgcaggagctgcggcaactgtggggcagaactggaggagctgcgggagctgcaggcggaggtgggttcctgggcgcaagttgaatgcacacgggtgccgtcgtcgacttgccgggcgtggtgcggatcaggactcctcttggcgcggggagacccttcaactgagcattctccttcttcaggcgtgctatctcatccttcagagctatgatcctcacgagcttcccaccattcaaggccttagacgccttgtgcagatccgagtgcatcctgtccattcccctcatcacggtgcacatgtggccgaaggtggtgtcgttctcaccagctatcgggcggaaggtgctgatatcatcgccacttgctcgacgagggtggaagcggtacaccgtgttgcagaagatgtagttgtgctgatcacgaagcctggccatcagcagatatgctgcctcctgacaggcgtgatctgctgtgcctccggatgcctcaaccacaatgttagcgaggcaggtacccacatagccatggacctccaggcgaacacggtgaggaagctcgccactgagcggtggaacagtcgagtactctggcacgttggggtagcccaccaccagtgtcatgcgagccaattctgccacaaaatcatccatgccttctccgcggtggttgggtgggtgctcggccatctagagaagacaaaggggtaggatcaatgcatgctcaaatccaattttaaataaagcagtaaaggactcaaataagagaagcgaataagagcggaattttatgcatagatcatttgcatgagagcgaataaataagacagacttacatagcgataaaatagtgagaaaattaggtacatactaataataacaataaaagcataaacaccttgcaacccatattcctgagctaggacctaatgcataccacccatcaaatcccgactaactgtcgaatatatctcaaataattttactaaaaccctagacttacttgtttcgacaaatctcacttaaacgagcgaccaagatttttcccttgaaccacaagaacagatcccaatttctcacggaacaaatccaattgcaaagaacatatgcaatgaaaaggattcagagggctcttaggttttccatttggcttgtcctacggtcaaggtcggctctgataccaacttgtcacgcccagaaattcccgaatagaattccaagcagaatgtgcattaaaatccccgtccaggaccggccggggtaca

SEQ ID NO: 29877 - DNA, 1501 bp, Oryza sativa
tcctgaaccctatccaatggtcattactgcagttttcatgtatttttttattcataggatttgaagtactagtgcactctaattctgtattttatttatattttttttctaagtaaagatcgtgccaaacttatttgagtacttagagaccgatgggactagatagctagcttacaattccaattatattttttctccacaaatgaaaaaagagaaaggcccagggtcttctcagctagcaacgcaagctgcgagctagtcggttcgggttcgagcctcaccccctccttaattcaaaatcaatctagtcctttctagattggtcccattttcaggtttcaaaaaaacaaatgaaaaaagaaaagactcttgtctacagttggtgcttaaaatttttagataattatagtaggtgcttaataattaattaattttcataaggtatactagtgtacgtaactatttctggtcagatgatctcaaagactgatcatatcagattgtgtttttctacaagttgacaactccgattactttttaattattattaagaacccaacccactgggttgtagcaggtgaacaacaatattgttaggtactttaacctaatttgtatacaataaagattttcctttttttcctgatgacgaagcttggtccgattaatcatgatcgtgatagtagcgcaacttcaaaacatatataatatacaagaatatatatatatatatatatatatatatatatatatatatatatataaccagtctgttcgagacaggctccaacaaatggatgaataaaattttgagaaacacacacatattaccaacacaaaggtagttcgctaatatatccttttccccaactttagtttgttggatgtttaattatcggggagaaatttgttgagatgtatggtacttaattgacctttgaattttgatgagagtttggaggatcgatcatgtggcgcaaagcgtttggtagtgacagtgtgcaacagcacctgttggctagctatagggctgctaattttccagcatccaccttccaagccaattgatcggccctctatttcctttacaataattgtgtcatgttcttttatgtcataagttaaacaactattaataacaagattcatggtaggaggcacggcagatacgttattgcagctaccacgaggctaggttaggtacttaggtatgattaataaatatgaaaaccgtgttagttcctttaactatttgttcagaggacctgatcctttaaattaattttttgtttgcttattttaccttgtgaagtactaccctctaacttagcaatttagcatgagacaatgcctcactttaccttctaaatttcctgtcttctctcttcatacaagtatgcattttaattaagttggaatgattttattttaacattattgcttggctacttgttaccatttaaattgcaggcaattttgaattttagaactcattttcgga

SEQ ID NO: 29878 - DNA, 1501 bp, Oryza sativa; identical to SEQ ID NO: 29809

SEQ ID NO: 29879 - DNA, 1501 bp, Oryza sativa
gtcaacggcgttatacattaaaatacggaggaagtacttggtagatgacggggcacaaacacatagcatacacaaccaaaaaatgaaagtgacttcatagtctacttggtaagggggtcgacgattccatagcttctcaaatggtgagattcagctttaagggaggaaggaaattaaaaggatcctcatctgcgtagaaccaggtcatcgccctcgacgacgatccgctcgacgaagcacgccagtgcgagtctcaggccccggatcatcgcacggccctccaccacaccaaccgtccagtgctccgtggtctcggtgaaggcgaggcaccgccgcagtcgaagccacggatgatgccaccgatgctcgctcgccgagacccgtcgtggaacacggagccgtcgaagttcagcttgcaccaccccggcgtcggcagagcccacctcacgatcagccaggccagctggaacgacgatggtgaggacgggagagcggcatggagcagcggggagctgcggtgagagaaacatcgaagatgacagcggcggaagcagaagcaagagtgacgaaggtggggagtagaggaaaaagccatggtggtgattgaattgggcgggagagaaagggagggaatggagtgcgggtgacgtggctatttatcgtcagctgggctgggctgggcagaggcgatgcggagtccgactccgatttgaagaaggccgcgcgctacgatatcgtgtggcttaatccggtcccactataattcggcaaggcggcccactgtggcttaagccgcgataacgattcaggcctaacacttttatgggcttttggtccaagctacggaagcttctcagtacattagttgcgcctactgggccgaagagaagagaatttttagctgggcctacacgttttgctggtcttcacgatttaagtttctccacgacttagttccattatggatattcttttaaaaaaatattcttttaaaaaaatatagaaacatatttttgttccaaaatttaaagaagtgtactcctctctactatttttttgaaaaaggcactcctatctactatggaagagccattttgcttctaagagtaagcaaaatagtttttcacgccaaatacacttctatagatttgcactgcaaaatgctttgataatattctaattttatccgttatgaacatatacatgaacgagaattaggcctgtttaaatcccaccctaaaatttttcgccctgtcagatcaaacgttcaaacatctgtatgaagtactaaatataggctaaaaataactaattgtacatattgcgattaatttgcgagacaaattttttaagcataattgctccatgatttggcaatgtgatgctacagtaaacatttgctaatgatggattaattagacttaataaatttgtctcacggtttacggacgattctgtaattagctttttattagtgcccgaacaccccatgcgagtgcaa

SEQ ID NO: 29880 - DNA, 717 bp, Oryza sativa
ctgctctttgccgttgcagcagagggggcggcaacggtgggctcgcggcactgctgctcctactcctcactgttgcgtaagagaggaggaggcgacgaggggagtatttggccagctattggcaagtggctgtggctaaccaaatttagccagccgggaggaatatttgtgttggcaacttttttgacaagtcgacaagcacgatcgcaacacctaaacgccttgcggtgatatggagtcgccaaccacctcgatctagccaaagggccaaatcaagatgggttttgcaaaaagaaaagctaaaccagctagcggagccgatttagagatcaaaatcagcctctaggccgatttagattgatatgaggataactacccgtctcgtgggcacaacggaaggttttcaggacaaacctacaaagaggtaccgcactctcgtagcggcggcagacggtttacggcgcaaaccgacaaagatggactaaaactaaggtaaaatagaaaacatagtaaaagaacgattcaaatagattgtattcgggggttttacaatggaccggccttgtcccttaaataggggttggtcttgctctctacaggcccttctctacatccaactcgggatagaaaccaaagaaaacacaaaacctgccttcccgagtaaggaaacccgtcactttccaaactttaacaattttcccctatttcgtccatagg

SEQ ID NO: 29881 - DNA, 1501 bp, Oryza sativa
tccctctcggtatatttcgacaatactaaagggtggctattaagctggaaaagtggatgggttcagagacaagaaattttatacaggttcaggccttcttaatcaagaagtaataccctactcatgtccggggattgatccgccgagtgtattattgatcgtatgatctgggtgaaaatcgtgcccctagaggcaaccggacccctccttatatagggaaggaatccgtattacaaaatacagtccatatcctaacggaatatgtaattacagataaaatacaatcgtaaccgactaggatcttaggtatttccttgacatacaagtttggaatttacccgagtcctcttaaagatattctatctatacatggcaccccataaacagtcggactatacatgccgtgtagatataggttatccataatctccacagtagcacccgagacatttacagtcgacaaaatagccttttctcgtagcacaaaatgataatccgagtgcttcaatttcttctgcattgatctcccgagtaccaaaatcaaagattgtgaagggctaaaaataaataatcgggtgcatcgaatagatgcacctaattaggtgtaacccccgactatgtaagtagctaaaggctaaacatatagtcgaagtgcaaataatatccatccgagtggttttacaaccgaattacccaaagtaccacacagctaagcatatgcgacgtttaataaaacatccagccgactgctttagctttaatataccaaaaatgaagatataaagaggcccgagtaaaaaatactctaaaggtccataaaccaacacatatggcaagaatctaagtaaaaactctcaaaagatctatcaaatatggtataaatatgatatcatgataattgatgagtctaaatagcctaggctatgactcacgccataatcaaaataagcatatatcatgccgagagaatgactgttcaaaaaccaatcatctcaacaaaacccaaacagccttcgcaacctaaaaaggcttacaaaagtagtataacacctttctgtcgggtacctttttatttgcatcgtagtaattccaaggaattatctaactgcgtcaaaaaggattttaacagcattgggccatactgttgtgagcaaaaattgccgaagcaaaaatgcccaagtccctaaggatcacaactagccacgctgataataaaattggcctgaagtactgtacaggcccaggcccattagcactcctgataccctaataacagcagaaaaccaactgccgcttcgtcttccccgccgagactttcgtcatttttccccattctccgctacagtacgaaaccactccaacggaactagggttctccaattctcccaaatccatcttccaaaactccatagaaatcatttgcgcatccaccgcatcaatcccccatccattcccagccattcaccgaaccaaatcatattatccagatcgcatccatggc

SEQ ID NO: 29882 - DNA, 1501 bp, Oryza sativa; identical to SEQ ID NO: 29808

SEQ ID NO: 29883 - DNA, 1501 bp, Oryza sativa
gtacctcaaacttgctattgcggcaaattgttcaatgacttcatcgtacctaggatttgataaatggcaatttggtcgattaccacttactacttgatcaacaaaaagctcacatacaattctagtgttgtggtcattctaatcagcacaatccattgccatcttaacaccttttgaagactcattttgagccatccctgccatccacccaatcacacctttcttttttcaatactaacataaaaaaatatttatatttactgaacaaaggctagcagtactcatgtatgtgcataaaaaaattcactttgtcacaatatgaaatataaatgcaaaatcacccaaagtgttccctttttttccaacagaagtaacatgcattggacagatatatgcaaatcattgcttgcattcccttgcaagcattcataccattctgaatgcataaaccaatggcagcaattcatataatgaacaatcatctccattcttcatatccaaaaataggatcatcaacccctagatgaatgaaccctttatgaatgaaacaatcggcttatgttgcgatgttaatccttatcatatacaaagaagaatcaccctcaacatacatgcaaaatcagcctattttgttcttagtctagaactaaaatcgaaaataaatagaggaaaatagaggagatgtaccggatttgtaccttagggcaagccaccgaccgggagtcctaccgccgccgccgcgcgtcctgagccgccgccctaccatcgtcggccgttccgccgccgcctgcgtgtccccgaggcgccaccgccgtcctgtcacaccctaaaaatccaaaatatataaattgttgtctaaattggaattattagaatttattttaaaagcctagaagagaagatctagttttaattaataaattccaatataaaatggggccagataaaatttcattaaatactttgcttaattctataattcctagatttttctgggatttatttgagctaaggaagtatttttaataaatggaattgcatttcatgaataatttaaattggaaaaggttttaaaagttctcttttggctttgggccgaaagtcggcccaaaaccttctctctctctccccagcccaagccggcccagtccgcctggagccgccgcgtgcgcgcgccctcggacgctgacaggtggggcccgcctgtcaggtcgtcgtctacctccggccgcccgccgcccgagccctagcaccgcgccaccgccatctccttccaaatccggccgcccctttccgtttccgatgaaattagtagaggggaaatgatcttcgggatcccctctatcttttctcttatggaatcgtcggctaatttcgtttggaaatccgtggattcgagttcgattcggatcgatctctctcctccgaaccctagactttccttcgcatcgccggtcgccgtgggccttcgccgccgcctcctagccgctataaattgacc

SEQ ID NO: 29884 - DNA, 1501 bp, Oryza sativa
ccttctactagacataacgcaatgaacattataatgcacaaagtttcagaatcaattgtatagtagatgtgaatcttgagttgcctgaattttaagaagatatagaaatcatgtatagtggatagacagatatatttccgagttgagctcgcttccgtgtggaccgtgtaaaaaaatggcataacagtgaacccaaatccatcaccaattcacaatcggctcaaatctgatttgaggagctgggcatagccgcaaccagcagttgggttcttcatacgcaatcgacaagcagcaccatgttcaaggccttgttcttgatggtggatgaggaggagcccttgcagttggagacggagataaaccaagaaacaaggaccaagaaccaaaccctaggtaggataggaagaagagaggagaaggaagagagactcaaaagtgagaaggtggccagcggaggagacggtcgccggaggggagagcgccgcgtcgtcggagcgccgtcgaatcccagtcacgtccgtgtcaaggagcaaccactgtccgagggcgctaagtcagttgcagaagacgctggagatgatgctgattccggaaggagggaagatgaacttgaagcagctgaaggagaagtggtgcgccgtgcaacaaggcccgtcaagataaacctgaagtactatgggcctgactgggccgtgtaattaagtctaattcctgtaatagttcttcgtgcgagaggggaaagaactgagtaggtgaggaagataagagagagagaacacgaggtgaactctgtctttggcgaccatggtggcgtaggcggcggtggctccattcctgtcggaatcggagaaatatctcagtaatagagttgccaattccttcgtgttctaatccgtgcgttcattctggattgcttttcctgtgcaagttcgttaacaattggtatcagagcctctacgctccaagaattccttggcgcggttgtaaaattccagggggaggattggaattgttcttagaacagattccacaataaggcaacttgccttctcttggttaactgagttcgggaaggagcgggggattctagatctagttgggttcgctcacaaattccaggatgtcgcaggagagtaaacttgatgtcttgttgagaactattgaggagaatgagaagaagagaatggaggcggaggcgaggactcgggatgatctcgctgatctgaagaagatggtggagatttgtcttcccaagatggaggagaaggtggaaaaactcagcgagtccgtgcagacactaagccacaaggtggagctgatggaaggtggcgcgatcaaacaagaaaccgctgcagatgcttcagcacaaggaactccatggttgcatggtaagcggaatcctcctcccatctcacctagtccattttctccggattctactgtgcaatcaccaacttcttctagcatcacaccgatctgagtactagtcttcctcctatga

SEQ ID NO: 29885 - DNA, 1501 bp, Oryza sativa
aaaaaaaaatagaaaggtaaatatatttgtaccctactatgtaacaagttaaaatgggactataaattgagccccttctcaaatctattatgcagcatgaagaaaaggcaaaggagaaaaacttgcaaactgatgtggaagaacatcaagaatatgaagcaattagcagctatgctcaacttctactagtatgctgaccagtttcttcaaagataaatatatgtgctaacaaattattctaatttggatattatctttttttccctagggttctattgatgttgaagatgtcatcttatcttaaaagttcattcgaagaggtcaacagaacttagaaggcatcatgctgattttggaagcaaatgatgatctacttttggaccgtgaaagcttttctaattgggttaacctagcaatagcttagctagttgattttcaaagcttttgtctcagtggatgcatgacacccaattccagagaaaatagttaaactctagctcattttgtcaattctatgtgcaagatattatgaagttcaatataatgaaatgaagtatgtgtctattttgtttttttaactatatttggattttcttgaagttcaagaaaattcatatcaaaaggagtgaaattgcaggcaaaatttgaactgaagctattctgtgcttgatcaaattgctaaaatgatgcatgacacatgcacacagtaaaatctggactatcccttgtgtgctggatggttggatgattcggtactgccaaagttgtagtcactattgtgactgcacctgatcggaatccggagggggacgagtagaaagagttgattaggcaattaaaaggagaaatcatgtggattttttaatgtgtataatttgtgccattatatatagaagtcaccatttactattccttgtaagagtaaattgcacccacgatacaacaacttatcggatgggtgcgatatagtgcaagaacttgagaattgaccgttcgagtacaacaacttgacaagtgggtgcgttctagtacaaaacttgacaattttacatccaattacctttaagaatttttgtttttttcaccttcccaaatctcaattgaaatataataatttctacatccagtttaattgactttcatttattagttattagaataaaaatataaatatgcttatatataaatccacgctagtatattgtcaaaataagtacttaaaaattaaatatgtataaaaaaaagtgctccaaataattaagttgtcggataacttcttaacttattgtatcaaaatcgtacatatcttgcaagttgttgcatgtatgcaatcacttataaacttcttgtactaaattacacttacatgtcaagttgttgcactagaacactcatttttcaagttcttgcaccaaattatacccacctgccaagttaatacaccgtgggtgcaatttactcttcttatagatacaacacataacctaacctacacaatgtt

SEQ ID NO: 29886 - DNA, 1501 bp, Oryza sativa
tatgtccttgaccatattgtggacctcatctccggacaaatctttgggagcaggctgaagttctctcttaccattaaaaattttcttctttcttctaaatgtgtgacgtaccgggagcaacctccggtgacccatgtataccatctttcgtgatttcttcagccaccggtttcgtggatgttccttgcaatcggagcatgccttctttccttttatagtttgtccggaaagattaccgagtgcagggtagtcattaatggtgcagaacaatagaactcttagcttgaagttctcctgaccatatgcatcccaagtttccacactttctttccaaagaatctccagatcgtcgataacaggctccaggaatacatcgatatcattgccgggttgccttggaccttagattaacaagcacaacataatatatttctgtttaaagcataaccatagcgggaggttatagttcgcaataagaactggccaaatgctgtgagtactactcatgtcaccgaaaggattcatgccatccgtacaaagacatatcctcatgtttctagggtcggcagcaaagtctttgtgttttcgatctatattcctccattcaatcgaatccgctgggtgtctaagcataccatcattccttctttccgtggcgtgccaacgtactaacttcgcttcgttcgggttggcaaagattcttttgaaacgatcaatgataggtagataccacacaacctttgccggaccacccctctttgacttatttccttcgtcagcacttttctttcgcttgtatcgtgaaaccttgcagacaggacaagcatccaagtccgcatattgcttgtggtacaatatgcagtcgttgggacaagcgtgaattctacggacctctaaccccagtggacacagaacctgctttgcttcgtatgtcgtctcgggcaatgtgttctcaacaggatgcatagccttcaaaattcctaaaagatctgtgaaactcttgtctgtccatccactacttgcctttaccttcattaggttcaaggtaactgacaacttagtgtgttttgctttgcatccagcgtacaaaggcgtctcggaatcacttaccaacctgctgaatttcattccatctctctcattctgggctaggtcctcaacatcacgtaacatgtcttgcagcagatcgtgatccacatcaaccatttcaccgcccaatggagaaggtataaacatgtcatgctcattttcatcttcctgattatgcacacacttctgtctgctgctgctccacttcctgattcttgctctccatgcttcacccaacatgtatagccctccatgaatcctcgttgtatcagatgaccgtgtacgtcctctccgctatcaaacatattctcattcttgcaatctgcacatggacaacaaatgtaatcactgtttcttcttatccgatcctcctccgcggcgttcataaaatttattacgccctttcggtact

SEQ ID NO: 29887 - DNA, 1361 bp, Oryza sativa
cgaaattaacctgacacatgatgaaaatgaatcgctgttgaactggtgaatcgggaatacatctcaaggtgggaaagacaaagccaaagaaaaaaaaatcaatccacatgctggtagcatgggaaatattgtgtgagcggaacaggcgagtatttcaaaatcaagaaaaaaaccttgctgcagctactagacaagattcatgatgaagtcaaactatggagaatatgtggagcaacaaacactgcgagattatcggcctaagactctttgattgattagtggttttctccctcttctttttttcctcttcttttgctttttcttttctttttctttttatcttctttctctccttcaccgttggtgatcatgtaaatagtatatcccctacttaatataacaccagctgtgctggctcgttttttttttaaaaaaagaattattagcagagctagcactcgatcttatatatcttgatcgacgatcaccttgctccacacctctcaatagctctacatatatatagtaaagaacattcctttcaggattagttgtatgcaaaataagaaacgtgttatcgtatgattaaattagtattaattattaaaagtttgaaagattgatttatttgattttttgaagcacctgttatatatgaagtttttcataaaacacactatttagcaatttgaaaacatgctaatcaaaaagagtagctaagctcaattagctactcccttaattaatccaaaagtcttaagcatattttaacttttggttttctaaataaaattataatttttgtagtctatgttaatgtaggatgagtttttttttccgcgaacgctaatgtaggatgaattaatgtttccttgattttaatgacaaaagagatatctccatcgatggagggagtatttagaacatgccattagttttgacatgtttaccgggaaattgaagagcaatgtccccagatcgaattcgagtactggagaacaaccaatatttagatagcattacaactccaaacaaatctaggacaatgggcttggaattttaaactaactgttggacagcatagtttgcatggatatagagcactagtaacatttgttgagaaaaaaaatagttaatacaaacaatttatttgaattaatgattcctggggcaaagatcaattaaggaggtgggtaaactcttaagggagctaaccaactcaataatcgtacgtatttatatgcataataatcaatggcaggacccgtccgtcggtccgtgtttatgctaacagagactttacggattaatttttcatggtaattgaactaatcctatacaaaccttatataattcttagt

SEQ ID NO: 29888 - DNA, 1501 bp, Oryza sativa
agccctcttgaccaccctgctatcaagaatctgagaaggaacttgcagagcagagttagctttaggcaactgaagtgatgaaagctctttataacccttagccgcccttaactgagatacatgaaagacaggatgcacactggcagttgcaggaagctgaagtttatatgctactgtgccaattttccgtaacacctaaaagggaccaaaaaacttgaaggccaatttatgattagctcggagtgccactgaggattgccgataaggttgaagtttcaggtatacccaatctccaactgcaaaagatctgaaacttctcttcttgtcagccatatgcttcatttgctgatttgctctatgtaaatgctgttgcaccaatgcttgcatcagtttcctctcctttagccattcttgcaaatcaggaatttcacaagtgtccacattgattccaaaatgcctaggagagtgcccatataggacttcaaatggggaagtctttaaagaggaatggtaagaagtattgtaccaatattcagccaagtgcaaccatgtgacccatttagaaggattggcatgagcaaaacaccgcagataaatctcaaggcactggtttactcgttccgtctgtcgatcagactggggatggtaagaagtgctcagattaagttttgttccagaagcagagaaaagataagtccatagctggctagtaaaaattttgtcacgatctgatataatcaccaatggtagaccatgcaacttataaatattcaacatgaacaccttggctacttcaagagcagtgaaagggtgggccaaaggcaagaaatgtgcatatttagaaaatttatccaccacaaccattatgcagttataagatctttgacttaggcaaaccttcaataaagtccatgatgatgacttcccaagatccatcaggaacaggtaatggttgtagaagccctgggtacttagatctgtcaggttttgcttgcagacaagtttgacattgctgtacaaaatcctttacttgagatttcataccctgccaagcaaacagtttcttgatcttactgtaagtgactggaaaaccagagtgtccccccattggactagcatggaactcagcaatcaattgtgactagagagaaggatgattaccaatccaaatgcgccccttgtacttaataattccagactgcaactgaaatccaggtttgcagtcaagctgaacagacaaggctgaaagcagatcagaagaatagggatcatgttcataccccttagcaacctcttgcaaccaactgggaacacaactagagatgatggacaactcagaatcactttgaaactttcttgatagagcatctgcagcagcattgctggtccctttacgatagcaaattttatagtttaagcccaataacttggtgaaagccttgtgctgccatggggtatgtaaacgctgatcagataagtgcatcaagctatggtgatcagt

SEQ ID NO: 29889 - DNA, 1501 bp, Oryza sativa
aaatcggagtcggactccgcatcgcctctgcccagcccagcccagctgacgataaatagccacgtcacccgcactccattccctccctttctctcccgcccaattcaatcaccaccatggctttttcctctactccccaccttcgtcactcttgcttctgcttccgccgctgtcatcttcgatgtttctctcaccgcagctccccgctgctccatgccgctctcccgtcctcaccatcgtcgttccagctggcctggctgatcgtgaggtgggctctgccgacgccggggtggtgcaagctgaacttcgacggctccgtgttccacgacgggtctcggcgagcgagcatcggtggcatcatccgtggcttcgactgcggcggtgcctcgccttcaccgagaccacggagcactggacggttggtgtggtggagggccgtgcgatgatccggggcctgagactcgcactggcgtgcttcgtcgagcggatcgtcgtcgagggcgatgacctggttctacgcagatgaggatccttttaatttccttcctcccttaaagctgaatctcaccatttgagaagctatggaatcgtcgacccccttaccaagtagactatgaagtcactttcattttttggttgtgtatgctatgtgtttgtgccccgtcatctaccaagtacttcctccgtattttaatgtataacgccgttgactttttgacaaacgtttgacctttcgttttattcaaaaaatttatgtaattataatttattttattgtgacttgatttatcatcaaatgttctttaagcatgacataagtatttttatatttgcatagaatttttgaataagacgagtggtcaaacgttggtttaaaaatcaacggcgtcatacattaaaatatggagggagtaaattcgacaacaaagctatccgatgtatatttgtggccgccatgcacgaggagatcctctccttcctccgccgtttcaccgagttcgaggtgagacacatgtggagattatggataccccatatctacacggcatgtatagtccgactgggtatggggtgccatgtatagatagaatatctttaagatgactcgggttaaattccaaacttgtatgtcaaggaaatacctgagatcctagtcggttatggttgtattttatctgtaattacatattccgttaggatatggactgcattttgtaatacggactccttcccctatataaggaggggtccgggtgcctctaggggcacgattttcacccagatcatacgatcaataatacactcggcggatcaatccccggacaggagtagggtattacttcttgattaagaaggcctgaacctgtataaaattccttgtctctaaacccatccacttttccatcttgatagccacccccttttagtattgccgaaatcttgtttcgaaaattggcacgccaggtaggggctgcgtcaagttcttcgccaaccagtgcga

SEQ ID NO: 29890 - DNA, 1501 bp, Oryza sativa; identical to SEQ ID NO: 28548

SEQ ID NO: 29891 - DNA, 1501 bp, Oryza sativa; identical to SEQ ID NO: 29809

SEQ ID NO: 29892 - DNA, 1501 bp, Oryza sativa
aaagattggttaccgatcaatttgactggatcgaaactaataatgtcaacctcgttgatgaagtccgtgggtgcctgggcggcctacgttgctcgatctcgccgcggaggtagaagtcaacgagctcctcatccaagaccacgaagtggtggcctggagacaactgcagcttcggcaccagcttgtgtctccgccggcctccattgctcgccggcgctgccaccaccgagcagtcgccgccattgctctccgttttcatctgacgacgacgtagtattttgtgtggtacgctaggaagaaagaaagaaaaaagaaaaaagaaaaaagaggaacgtaggtattgatagatatatcaagacatgatgtaatcatgctcttttctctactatgtttcttaatgcttattctctctataggtgttgcacggcactgtaacagagaaacgttatgttctagtaggaatgcaagtgtagcattagtctgtttaaaaaatcttcattatagatggaatattttcatatatttttagtttcatatatttttagtagctaatattgctagttcttttgttgttgaacatggtacaaatttgtatccttgttctaaaatctgagattgtattaacacttgttttgcaatttgaatcttttgctttaaaattgaaaatctgagagtgctttttttgaaatttgatattgtactagcacttgtttccttgttgattttactgttatcaagttgtcatcgttgattgccaatacagtgtccctgatgccagctgcctcagcaaagtcagagcagtagtcagattacttgtttacattggcttacaaagataggcatgctggttcagagtaaaagtccatgaatcataagatatttttctcccaaaaagagtttacaaggagtacatgaatgaacatccagatagatattttcccctaaaaaaagttggatagttttacatgaacatgaattaactatattttgtccaattgctacaacgcttaaagattttgtcctgaagttaagctaaaactataattcaaaatgagtactgctgggctcaagttctcaacttttcaagttatggatataacctttcccctaggtgattttacttaatttaaattggcaaatgaagtgaatttgtccggttctttttttccgataatggaagctttattaaaactcactcaaatacaccaagatgataccttctaactgagctcagtcacggcctctgtatgaaatgcacacagccacaaaacatgatctaactagaccctcaacacaaaacaaagaaattagtgactatcaagccgtagactagatcgccgcgacgccacccatgttccaaggcaaaaaaaaaaaactcccgtgccacctgttccaaacgacacaataccaccataatagtatcctgaagaccctattgtggaggataggccaggtgcgtagctaccaggtgactaaagcaataacctgcaaaggagaagac

SEQ ID NO: 29893 - DNA, 1501 bp, Oryza sativa
catcaccggcaaggcctccaccgagtccgacatgtacagcttcggcatcgtcctgctcgaggtggcaagcgggaggcgaccaatggtagtgacacctcgtgcagccgctgccaccgcgggtggtgggaaggacgacgacgacggcggcggacaggtgttccgcctggtggagtgggcgtgggagctctacggccggggtgatgatgatcagtcgtcgctcgacgccatcgccgacacacggctcggcggcgcgttcgaccggtgggagatggagcgtgtggtgggcgtcgggctgtggtgcgcgcaccccgacccgaaggcgcggccggcgatcaggcaggcggcggaggcgttgcagtcgaggaagttcaggatgccggtgctgccgccgaggatgccggtggcagtgtacctgcagccgttcgcggcttccaccatgaagtactacggcgacagcatgacctccgttgggtcggaggttgttggttactcgtcgaccagccttgcgacggcgacgctgtcgtccagctctagcttgccatcggccatggctaacaatgacagcttgagcccaagagaatgagggttttggttatattagaagttggtcagttggtactgccgtactggtagatggcacatggtagataaaggatatactcccatgttgcaataactcattccaatctgcttgtaatatttgaatgaactggtgtccttctgctccactagtggtgaaatacccaaggcaaaatttgctacaagacacctaaagtttgtggcatttgctgtgagacatccaaagaacgtgtattttctcgtggacaccgtaaaaatgtggtaattagctgctggatatctgcctcattattttattatcccttttattattttcggtggaaatggagagagaaagagcattgaaagtaccaaaacacccctgacactgtttttcttccagcttctgttcttctttcttctcctctcacactgccatgccacagcagaccaacggctccatctggcaagggcaagcacgatggcatccaggtacatgctagccccgtgtagcagatgtccccgttggcctcgttctggaacgtatgtattgacacctgcagcagcagcaatgccaagccgagccgtgtgcaaactggaaaacggcgttgattcgataccccttagcgagtgcgagcagcaccagcaggagcaggaagggccccaaggggagtaggtatgcagtatgcccctgatttcgctcgcactactgctccttgcgaggtcaaggacggagaggaagaacagaagaggggatctcaaaagggaaaaaaaatgaaaaaatgagccatccctgtcgatccacccgtggcggaaatggcggacggggcatgcgtcccgcgcaaggatttggccgacggcggcggtgcccacttcgccgctaccccatccgaagcggagccctggggaggactcctagcagcggcgcgccgccccgtgctcc

SEQ ID NO: 29894 - DNA, 1501 bp, Oryza sativa
ttactagtgattagtttactagtaatttttaattcttaactttaaaatttaaaaatttggacttgaaactttttaaatctcgagttgaaaattttctaatctcaagttgaaagttttcaaatatttcaaatctggacttgaaagtttttaaatcttgagttgaaaattttcaaatctcaagttgaaagttttcaattttttcaaatcttggcttgaaagttttcgaatctaagttgaaagttttcaaattttttaaatctggacatgaaagttttcgaatctcaagttgaaagttttcgaatctgagttgaaagttttcgaatctgagttgaaagttttcaaatccgagtggaaagttttcaaaatttgacttttaaatttaaatcttaaatcaaaagttttcaaatctaacttaaaaattttcaatctgttggtacaaaaatctcccaaaaaagaaaaaaaaatcttgagaatcttccctaattactagtcattagtagttaagtgggtgttaactaatagtactatagataattagggaggtgaggtgctcgctgctggcgcgcacgcgccagctagcagccccctgaggtatatatttcgtatgtatgcaaagaaataaagaaaataaacgttattgatcaaaagaagcccaacaagaaagcctagcaggctgcctccctcaaattcgaacccaatttacaaggttgcctaatttgtacattaactgtgctgtgatggcatgatactaatcgatatatacttggttggtagattgtactgcatatgttctttcacaaagtacatcataataaatcaagaaatttgctaaaaatcttgtcgcaagttctaattcaataagcagtactaaaataccatattgttgatcatacgtatcaaatattatgctcgcgtgttgtaaaatttttttttaccccctttccatttcgaatacccaatctcaaaatcttgggcccgcccggtatgaaatcgattagtccgatggtagttatggccgtaatggccccattgttttgcttatttgtggaataagctaattaaacaacatatttgtaaacgaaaaataattcataaatacaacttttatatacttgctcttagcaatctaaaagtaaaggttgaataataaacttcgatgaaaaaaccctaaaattaacttcaaatttaaggttgaaaatttaaattttagcttctattaagcgttgacttagtccaacgttagttactcatacacaaattgatctgtgcgactaactttcaaatttgaaactttcaactctaacttgaaaactttgaactcaaaattaaaagtattaattcaaaactttaaaaacctctagccaaattttaaaattttcaattcaaaatttcaaactttcagcttcaaattctactcatattttaaaactttcaaaataatttattttttcgtttttctataatagttaaataaaacgctaagtatactaggctaattagt

SEQ ID NO: 29895 - DNA, 1501 bp, Oryza sativa
acatgcttaagctcctaatcttgtccaatcaggaattgatacgcgctgagttcatgaaagtattttcctatcacgcataatatgtccttacatatattataaatgctagctatacaaggacaaattgacccttttcaaaaacttatttcgaaactaacccctgccaaaaacttcaaccaaaattaggccgtcagctcagcaccaagcgcattggcgctgaggttggccgtgtcagcgccaacgggactggcgctgacattgtgcttaaatgattatcgatgcttaaataaaagttatacggttttacgatggagtgatgtgagcggtgggtggagggaccaatctccatcttagtagagatcatgtgttccttttatttggtgcctatatagtaaagcttccacttcgaaacaaaagatgattataaatttgaaaaattgatttttgaagaatattatagattcttttacttgttttcttagcaaacgctaagttcattaaaacttagagtaaaagacatggccaatttaagaccgctgtgtcactaatgtaatcgatcaacttgtaaatcatatatctagatctgtaattttagtttaatatacgactcgaggttgaaatcacctttaataggtcaagccttttctatttacccctgttcaaaacctactgtagaaacaaatatgcatttaatccattcgcttcaagttcatcctcaacccaaagttttcctctctcttctcctcttttgaattaggaaggggaaagcggcaatggctagggtggcacaaagtgcgacgagagtagggtgtactagagagaggaaggtggcacaactgttgtggtgtggtatcttcttcacgaagatgaggtccgtactggactcatgagatcaccctctcctactcttttttgatccgagaaccttcgactatcaataatcaccactgctctaatcattactccctacttcagggaggcggggaaccgaattggtggaatcgatttaggcatacaaaaggggctaaatacaaatttgttgccacggttatttatggtgtggactgaatgcaaaatgtttttctccgttgacaaccacggcagtacctttgattaaaggtagtttggaccacagttggtacattgaacaagatcgtggaccttgacttgcgatttataagttgatgaacctaagtgacaccgcagtccaagtcaccagtgtattttggtataataaatgcatttatattactactaaccttacacctactttctccgtcccaaaaagaatcaacatttctcaaaaagaatcaagctagaacaatgttgattctttttgggacagagggagtatataattagaaattaaaatatgtggcttataaaaatcgtagatgagcaggagcggtgtgttgagattggtagctgaaaggcctcttcttcatgacttccggcaccaaaactattaaacgccggcgaaaaactcaaagaccgcacgcca

SEQ ID NO: 29896 - DNA, 1501 bp, Oryza sativa
gtggtggtggtggcggcggcgccggcggtgctactggtggtggcgctggatcggggaatgcttctcctaattcaggtaaaaatgttgggctagcagattaccagctaattagttactcttaactctccatttagaaatatattcgatgtttgataagatttgattaaatctttaaaattttgacctgtttaagacaagaaataaaaagagtaaaatcggcttgaaaatcactatcattactccatccgtcccaatatgtcacgtctggagatgtagcggcaatttaaaattccaatcaaatttgttataaatatcaaataatatttctgaaggaagggttatttgtttttactatgctttacactggtcatctaaacattggtgtttgatgaatatgtgcccatgtaggctcacacgtggcggtaaagcgtccgggttatccgaccagcggagcagctgggcccactgtcagcctcacgagggtgttttcctctctgctaatcgtctgggctggaacaaggctgatggcctgattgattgctgctgttcgagcagcttttgactggacacaggcaaacgttgctgaagagttcaaagatgtgttgtgttttctttttaatttcctgaatagtgaatagtactgtagcatattgatattgatttctacaacccacgcaccagtgctgatttcatgtaacaacaatctgtaatttgtacgtcttttgatttgatgaataataaatttgatgcgtgtttgtttccttcaccttaatatcgacggttgagaaccggttttcttgatcgtccattcaggtcgaaaagtcgaattgatcttgtatttttgtattgcaatatgatacacaactctccaatagtacaatgcaaaagaaaggagttgaccttgttaatcatatttaccacatctttttcctcaaaaaaaatagaacatatttatccacggatataaacatatttattaagtgccacataaaaataatacaaatataaatcattctcaaaaggaaaaagtacaccgaaggtattgttccccaaccacaaaaacagatatatgacattccttaacttataaaaccgttcaccacaggtcttttggtgggtttgaccccgattttatctgatgtggtagctgagtcagcgtaggatccacgtggaccctaccagtgaacacatcatcatgctctccttctttcttctgtctctctcttgctctcttctcactcgcgccgagcaacgctcggcgcggcgaggcaacggtggtcaccagtcgcgactccggcggtgaagggcagcaaccggcgcagggctcagagaagtggcccccacgtgcaagcgagtggcggtcggaagagcagccttgggcggcggcgtgaaactccggatctggggtttggggcagcggcggtggccggatttagggaaaacaacagcggtggtcgttgggcgccggcgaggagtgaaatgggcatttggttgtgtcgtg

SEQ ID NO: 29897 - DNA, 1501 bp, Oryza sativa
attaaaagaaacatattactagaatttaaacaaaatattgctaagatggtgtttgaatctcctgaagatatcagattaagtgtttcacgcaaaacgaggtggtaataacgtgcgattaattgagttttaattattacaaacttagaaaacggattaatctgatattttaaaacaactttcatatagaaagttttcgcacaaaacacaccatttaatagtttgaaaaacgtgccataaaaatctttatcttcgtccaactcttgttggagaaacgaacgggacctaagtgagttctactactgtaatcacttcatgcttcctaagcttctatttattaagaaaaactatatgtatgagtttttttataatacttttaatagaaaaatagccgtgtgttccaacgggtgaagactattttaatcttattattgttatacgatttaactaggataaaattcgctatatgaattcgctaggatatatattttttagaaaattataagctgcaattagtagttcgactttcgtatcaagttagcatgcgagtttttttaaaaagaaatttcttatacgatttattttgtatttccaaaaatagataaatttaaaaaccgacccaaacaaaaattacgtaccaaagtaccggtaaaaaacatcttcaatttttataatagtagagagaaatcttctatttttcgttttgtaccctcgaatctctactattataaaaattaaagatgtttttactggtactttggtatgtcatcttgtttgagtcggtttttaaattcactcgcttttagaaatatagatcattgtttgagtcggttttaagttcattcgcttttggaaataaaaaagagtcgtataggaaatctctttaaaaaaaaacttgcatgctgattacttgagacgatcaaactcttaattgcaactcatgattttataaaagaaacaaattcaagcggattcttatagtgaatttcacattaactaaaccgtataataataagatgattaaaataatttttctattataacgcacggatattttttctaatattattagaattagatcatgcatcatctatttagaacaaaaatgaactcgtcagttgcgcgaaaattggtcctcatgtcgacatgtccctagcgccaaactacctaccctgtagaaacttcctaccaacatgaaaatcgccccctagaaaatcataaatttcaactcatacttatcccaaagatattccgcaactgaagggcaaaaccgtcaagcagcaatgttcgaaagcatcaccgaagctagcttactcctgccgccagcccgccatcagctaagcatccatccatgttctatatagaaagctctccggcttgctcaatcatcagcaattcagcattagcaatacacagtgtcagattgtcaccatatatagtagccatcaattgaaaccacataagagatcagagagttaattaatccggcagccatggagaacgt

SEQ ID NO: 29898 - DNA, 899 bp, Oryza sativa
ataaaaaccggaagtaaaaaacatctctagtcccgatttaaaagttgaggggtactttttaatctttagtttcggttggtattaccaactgcgactaaagatcttttttagtcccggttcaataagtcgtggggttcaagacagaccccaattatttttactcccggttggtataaacaaccgggactaaaaatagatctttagtcccggttgtttatactaaccgggagtaaagagtaccccgaaccgcatgccagatattatccgcgtgccaccaaaataattgtttataccaattatttttactcccggttgatataaacaactgggactaaaaatagatctttagtcccggttgtttataccaaccgggagtaaaaagtacaccgcgccaccaactcacatattatccgcgcactcctctcgatcttctcccctctcattactcctccatccctccctctcccatttcccctcccgttcctccccttcccctctttgagcggcggcccggcgagcggtagcgacggccgggcgggagcagcggcgcccggcgggagcggcggtggccagccgtctgggtgcggcaggcgggcgggcgggctggcgcggcaggcggccaggcgggcgggtgcagcggctggctagccaagctcacgcagaggccgtgaggacagtggccgggagtccggtggcgccctcctctctgctaccgatttttttttaatctgtgattcattggatttgatctgtgatgtatgtgatattggatctgatctgggagttgtgatgtatttcttttaggatttgtgatgtattttttgtttgagattttgtgatgtgatgtattgtgatctgtgatgcatttctttccaatatgtgatgtatttctttccaga

SEQ ID NO: 29899 - DNA, 1501 bp, Oryza sativa
atcttatatttgatggagctgagattcacccttttgacatcggcgcctgcctccaagctcgtcagcctctctcgttgatagctgaggcgtcagcggcatcattggccatgaaatgagagatccatccctggctgcaactttgtcttgttcatatgtttatttatacagaattgggtcttggataggacgcttctcaaaagcaggcagtttttaaagcttgatgggaagattttgtcatgccaaagtggttttttttttctcctccaaacaagaagttttctggattatttgtgatgaatgccaggtgaggttttcttacacaaatgaatcagctaatttgctgcgacatgacatgctctgttgaggtctacttgcattaggcaatagcacgttttgatgctttctggttgcatcctttgctagtttcaaaagttgttttttcttattcaaattggtatttgtgaataactcaacttttttctgatttgcagactaatgtttggagggatcactttagatgtttttctgtacttaattttccaacgtaggatcctaattaactgtatagttcatggtaacaggaattgtgcacattatcatttgatattggtacgatagaatacagatataatttgcacaaaaaagcaatcatgtatggtcaatatgtaattcttgaaatctgactgccgtgatccatttttttttatctgctcaatcctgccacgtccattttgctctctttaattttaaaacaaataacgagatgactgcttgctaaaatctctcaattgacggtttccatcaatgcttgagagtgtttttaattacatgttcctaatttatactccctcatttttttttcacgtgcccgcttaccaaactactcaaaaatactttttttcgaaaaaaaaatctaatagaaaagttgctttagaaatcatattaatctaaattttaagtttttatagctaatatttaattgttaatgcactaataagccaacctattttacatgcgtgagatagaagttcataaccttctctccctcccgaacaccactataaaaagtagacatccaagcctacatgagtttatgaaatggagttgtacttttttttttttagaaacagtacaaatatagacgctatgctcacttcgccagtagtaccatttctttgggtgaaagcttaatgtatgcttaccagcacaatgtatacctggttaccctgttactttgtgcttgccacctggttatgtaaaattggaatgtaattttataaggttgatttgagtaaagcgacctttatttggtctcctttgaaacacgggaatcttataaaaaataaaaataaaaaatagcaaaaatcttccattttagttggacgtatagataccgagttggcctgcatttgacaaacgataaaaaagattacacccatagctttgatcccatcccgtgcaattaaaatgtaggaaaaaaacataattgctaatcttcttt

SEQ ID NO: 29900 - DNA, 1501 bp, Oryza sativa
tgactgttacttttgcatcttgctccttttagcagacaaacattcatcatcaagaaaatatgtgaaactttttgaaatagtaatgcgatcattgatatcatctattcacagaacagctccataacaaaaataacagggctttgacatccatcctctgcatagctttgctattatgagatctattttgtgataacttcatattactgtctcagccaaagatctacatgatttagttaacagcatgtctaacatattacagttagtaatttcaagaaaaatagcctactacaatttcttttccattttacaagattacaaaattgtgtaattttgaggacaaacagtgtgtacaattaaataaacaagagttagtgtgaaccaccagttgttccaaatacgagcttaaaggaaaacaagaagaaaagtggaaccttcagattgctagatagtaaattggaatgcagtatgttggcaagcttggattggccgtaagcgaagattttgttatacctagcgggagagaataaaaataattaatttcgaatatgatgtttttgtgcagatctgttttcttacctttgatcgattgaaaaggtaaacaaatgtaaaaaggagtatacgttgggtcagaaagtaatacccagattcatcattgatcttatcaaaacgaatcccctctcgataagggtgcttgtagctgttagaagcaactatcacaacccttccttctatcccactttctatagctgtaactttcatcttctcaagtaaaagatcggtcagtagaaaatgccctgcattgcatgattaattgcacgatgcagttacacaataataacagaaattttgcacgtttgtaaccaaacatggttacaagatcagtcaagtgaaatatgaccacacacaaatgtgtaaagtacatctgtcttagtaacaaatagaaaataaaacaataatattctatgaattttggcaaaacctacttaaaataaaaaagttttagtatgcagtttaagggactgtaagagggggcctaccaaggtgatttgttgaaaaatgcagctcaatgccctcctctgatagcttaaatggtacaaacgcaatccctgcattattactttaaacagagaagactaaaactattttctcaaacataaaatggatgacgtattcctcgccaaaaaaaggcaatgtaaaaaaagaacacttcaacatagatggaataaaagttttttagtagaggtctgatggactgttttatcttccagaaaatgactgtactaatgacataacccagtaatacataaatactgtctattaagcatgctttgagtgtctgaatcccaatagccagctcaaatgctcattccagtttatttagcacccaaattctctatgttgcagaaggttttgctgctacaataattctgtaaaacagcataatgttttttttttctttttgcgaggaagcataatgttttgttctaccaaatatttccaa

SEQ ID NO: 29901 - DNA, 1501 bp, Oryza sativa
caccatccataatgttgaattgcaaatccatcacagagaatatggataattgacactttttccactcttctgtaccccataaaattctcagctagccattagggaggttttgtgcctccttcacaggattttgttaggtgcttgatttttccttgaaggacaatgcaaccagaaactcctatgactgaacaatctgccactcatttgcctcttccaaccaactcatgtatatattgttgaagtgtcactaggagagggaaaaaaagataaaaaggaaaattacaaataaagttgatgaacaggaaatatgggacagtcaaattcctgatgccctttgctccaaccaaaagatgagaacaaccattctgacatgaccgatataggggcatacctgaacctgatgttcagtatttataatgtccttttgggaattatgtgatggttgcacctctttccagctctctcttggcttagaatccaagaaaaagataagtttatcagcaattcagcattacttactgacatatatatgaatcaccaccaactacccttgttcagtaagcattggtatgattcagttgggatagttgcctagtaggttgcatttcattcctttccttttctgactcccatttttcttgttcttggttggccatgaattctaactgcccaaatcttgcttagctgtaggctacaatgccaaaaggagaaaagatggcctaatctttttgtttagtgataggaaaaaaatgcatttatttcttcggaacaattagccgctgaaatataattgaacttctataatactcccttcgttccaaaatataaaagattttgggtggatgtgacatatcctagtactacgactttgaacatgctacattcattcaaaatcccttatattttgtgacggagggagtataataggttatacttgcattggttgcttactttttaattgacagcctacttgatatagctagttagtaccaatctatactgcatccctgtagcctgtacatgttgatttatgcagagatgaaagctcacagaggtacagattgagcaggatcactgatgattgatgaaacaaccaacctacctgatctgatacacccatctaaactaaaagagcattactaatatttgtaataatatttcttcctacatatccacaatgactctcatttggatgttaattaaccaaacaatagatctctcagcctgccattaggcactgaaaatgttgcagattcatctcctcctgacacatgtagtgtgtggccaatactgacaatgactgtcaggtaacaaatcagctcaaacatctgtaatcacaattctgacagtgactaagcaacatttaaagagctcacacattattagcactaattaattttatttatcctaaaaaaaagtgcagtaattagctagcaaatccagcctatataatccccagccaaaactgatcatatcctccaagcttgaacgccaagatcga

SEQ ID NO: 29902 - DNA, 1501 bp, Oryza sativa
tttttgtagagatcaaacaatgcgcatgcatcttccttgttctcaattatttcactaagtttagaacccaactgcaaccgccgacaaattatttctgcagcatcttttgcctgtggtgacaaaatcttgctttcctggtacaaaattcaaggaaccacatatagtgggacacataaataagtgcaagaatggcacatattgtgaatttaagatgtattaagttgcagttaactcttgactagttaaagcgtgccttgggaatgggaggctgtaagacctcaacaatatgaaaatatagaggacaaaaagtatcagtgatttgatgttagaaaaatactttacttactttacgtgaagtaccaatagatagattcaggaaaaggggttcctcgtcgttaacctctttgactgaaggaacttgtccactcaatagatactcactgaacaccaaacctgtgagacaggagggcggcagataaattagttaatcttatcgattagtaatgaaaaccaaggaaagacagaataatcccactaaaactggatgattttatgacacaattgctgccttgcgagaggccacttatgcaattaatcctcactaaggctccgtatgccattgaggtgaattctgataatctaagttacaaacggtaatattaatacctactaaaaagttggaagttttgtgggaatgaaagttgcataattgtcttaaccttaaaatgattaataaaataatctacaatgattatatatttacatttctagatgacttagaaaagacacacatttatcacaacacaacaaactgcaaacagaggctaagcctagctgtagtcaatgccatctctcatccacagcaaaccaagacactaaataatctggaaaacacaagtgaccaagatttttcacagattagctccagcaaaatccctctccttgctgtctcatctcacgcggagccacaacatcattaatctgatcgttggatcagtaaagttaaaaccagatatctggcatgactttgctaatgcaaatacccttctttcagtgctgttggattgattcctaattgactgccaatttaatctacagagtagtccattttatattacaatgtatactgtgcaaagctgaccatcaagacctcacgagttttcaatcatccattcaaaaaaattacaattcaaaatatgatttcaaccatcaattctagaaaaacatacacatgttcagtgacaactgccatgcacttacaatggacaattttgcaggctatcattgcaagggagatatcgatatttacccaaaagaatagtgacaaaacgtgatttttttaaaaaaaaaatcgtgtgatgttttgctgagttcaatcagctacagtgcagttttggtatttgtatgtattgttaatatattgatccatccaccagtttatttgtgtttgaacatcaattaaacaacattattcatataaaaattgtgagttgtgatcata

SEQ ID NO: 29903 - DNA, 1501 bp, Oryza sativa
ttgcagttcataggtggagatttgacttggttgcaatctactaatgctcacgtagatttgataagttggggtgaattctgtgaggcagtttgtgctaagttcgggcgtgaggggtttcaaactctaattcgacagtttaataggctacgccaaactgggtatgtgcttagctatgctgaaaaatttagtgagttagtacacagcttccatgcacatcactgttgacggtcgttatcaattagttttgaccgtcaatattaccaaaatagaggagaactagtgatgcttgcaatgcatatatctgttagaataataatattccactagtattaggtatactaacctattgcagagaatgacaataaagtggaggagaatcgacatcaactcaaacgataaatcaatcaaacgatgtcgatgtcgcgcccagaaattcccgaatagaattctaagcagaatgtgcattaaattctccgtccaggaccggccggggtacacaaacgacaatattgacattcagatccacgtcttacaaacaccataaaagacttacataaatgcagcagaaaaacaaaagacaacaggagcaaagccttgactagatctgcagcgggaacaccactccataggcatcctcgacggcacggacgaagcctactcctcggagaaaccttcatctgacacgtactcgtgctctggggttgggaaaaatagagcaagactgagtactacccattgtacttagcaagtcataccggaataggggtatgatgcagggaattatcaaaggagagctagagtggttcatttgcataaaatgagcatttataaacagaagttgaaagatttaaacggttgtaataattaattaatattaactatccactgtccaacgctatcccacgttgcgacaggcccaaccatccacctaaactatccaaattcaaaagattacactagggtgagactaatcacggtgaatctggttgaccgcccataaccgcgggcacggcaattcgaatagttttactctgatcaaaggtgtacaactgtacccacaagacacagccccacgacacgttcccgtgcgccgacatgccaccacgacataccagaaagaggccgtgacaggacccttcgcataacccccctctaaccaagcacaccacacctcaggtttcacccccactcctcgcaaggcagcgggcagtcccctctcgtgcctaggtgaatccggaagccgcataggccgtcgcagggcccatccgaactccaccacgcccacccttgcctagatgcgtcggctagaggaaagctacactacaagcccagccgttgcccacgctggcttgtgataagtacgataagttcttccagggcatcccgcgaaccggtccttaactgccatggatgcgaccagcaaaaccatgcacccacaccaacacaaagcggtggcactaatccaacaataccattagaaccaacagtctaaacattaata

SEQ ID NO: 29904 - DNA, 1501 bp, Oryza sativa
agcaccaaccggggctaaagataaaaacatttataacattcttcttcctcttccaacccgagcaattgctgcaaagatttgtaggaggaagggaggtgctgccaaaattttttgtgtaagtgttttggtgataatatacaaatcagagggatctagaaggttagcaactctcgaatgatgtatgcttagcatattacatttatggaaaaattcgctactatacattaaaaaacgtgtatttagctggtggacatcgcaaaaacacgaatttggtgtcgggcatcacaaaaaatggtaattagctgatggacactcgcagccatatcttattatttccgggggaattggaaagagaaaatgatgtgagagtacgattttgcccctgcgcggcttcaatccatcaccgccatcgccgaaactggtcgtcgactacgccgccgctactacttcctcatgcctgtagtaccccaaggcgctcctattccagtcgccgcggttgccgagaccgagaacgcgatgtagtcgaatcgtctccacctccccttcaaggacagcgcccgcaccgccgtgccagtgccgcatctgggcctccacgtcgctcgtcggcgacgcctacctcctctccaacgacgacaaagacgatggcgaacggcgcccgcaccgccatgctgtccccatgctggcgccacagccgcatctgggcctccacgccactcgtcctcgacgatatagatggccaaaacgcccgaggcccgacggcccagcccacggcacagcgttttggcccggcccaagcacggcacggcccgtcaagggtcgggcccgtgccggcccggcccgactaccgggccgtgcctgggcctctctgccggcacgttgggccggcacggcacggccgggccggcatggcacgatgggccgcatgccaagcccaacacataaacaatagggagtaaaaatagacatattttatgccacagtcgaaagaatagggacgtaaaatagacttattttacctatatatatgtcagcccaaagaggagggacgaaaaatagacttattttcactatatatatgtcacagcccaaagtggagggacgaaaactagacttatttaaaaaaggaacgatgggccacccgcgccttcaggccggcccggcacggcccgacagctggtgggccgtgcctgggcgggaggcgcagcccatgggccggcacggccctgcacgaagtgccaatcgggccgtgcaggcccgatggctggtgggccgtgcctggccgtgtctgggccgggccttttggccatctatactccccgacgacgatgacgacgacgacggtggacggcgcccgcaccgccgtgttgtccccgtgctagcgccgctgccgcatcaggcctctacgctgctcatcctcgatgacaccgacctcctccccaacgatgacgatgacggcgaggaccggacggcacccacatcgtcgtgctgtcccgtgctgtcg

SEQ ID NO: 29905 - DNA, 1501 bp, Oryza sativa
caacagctagctgcttttctggtttacttccttatataacaaaatgggattacaatgaaatcaaaaccactaggaccgcttctcacgctggcaattcgctgcgtccatccccacagctgctcaacgtgcgtcacgctctcggtgcacgatgcgggctctatgagctaatctcgcgaccctcaactggagcacgactgccacaagtttcggcaagctcatgcaaagctgaatcaaacaaatgcagaaataactgaataactaactaactaactaaggcacacacgttgtatttgcaacaatgagtaatttggaaataatcactgccaacaaaagcttttggttgggggcggctagttgacgcaaattgagcttgtcctatgtctggcgaattgaatcagagtcacacacgagtcgcgagtagtgaggggacaatgcgctaacacacttttttttcttccccttgatgaaattgtataataattataaataaattactaagttaaaaaattcaaaatttgagttgaaaggttaaaagtttgtgttgaaagttcaaaatttggatagtgttttaaaaattttctgtgaatatttgaaattttgagttggattgggtaggtttaaaatattttggtaaaagttttaattttgagttgagagttccgaatttgggaggaagttttaaaatttatagttgaaagtgttaaattttgagttttgaagtgttaattgaagtcaaagatttcaaattttgagtatagtttttcaactggaccttgtgcaactaaaaaatttctatccaaatgttaaatcttttcaaaatcacttcaaaaatcaaattacttaaagaagtactcattgaatgctcattcgcacattgggagtcctctgtgcgagtcgtgtgatatgttaagagtcacctgaattaaaagaagtggtgctttagaatcagaagtagcgagcgtgcactaaataatatttccatcacctatgatgcctacactcaactacaaatacactcatcgttaattaaccaaagaacaaacggattaaggaaattcgtccattttactccttcaaactattattcagctcattttactcctaaactattaaaaatgtttcactttattcttagcatttctctttatggtttatattttatatgggttgtattttgaactgaaaattattaagccatttatgacacataaatgacatacgtatcaaagttccaaagtacttcacttttctttcatgattatttcattgaaatttaaaatttgtttgaatcagtcttaggtgttttcgacttatgcaaaaagtggccaaatttaaaaaaatattactaagaggtaagttgtaatatgcatctatcgatcgttttgaatttcaatgcaaaaatatgatttatgtgtgtcgacgtttgatgtttcgactacggtatttggacagtatggggatcgtcggtgctaggatatacgcgagactgaggtaaaagaaa

SEQ ID NO: 29906 - DNA, 179 bp, Oryza sativa
gcgtactgtagccgatccggcaacacaagaaagaaaggaagcagaagaattttggcgtagcgcaacagctagctgcttttctggtttacttccttatataacaaaatgggattacaatgaaatcaaaaccactaggaccgcttctcacgctggcaattcgctgcgtccatccccacagc

SEQ ID NO: 29907 - DNA, 1059 bp, Oryza sativa
acaggtgttgcagtcgtcggcgcagtcgcagagggcggtggtccacgcccctccagccgccggcgccatgcggcacgacaccacacgctccatcggcggagcagggtagaacatgccgacggggatcccggtcaccggctccggcgccgccgccgacgactcgccggacttggacggatcagggggatacatggccgtgtagaagttaatttgactagctagctaatggatggctacctgctgtccctgagatgtgatttaagtactggacgttctattcgttgatggatatatagatggggaatattagtcatgttagttaattaagtaattaattaattgactagttagcgattaagcagagggacatagtagttgctaggaaaatactgggtttgaaactttgacgcacgcatgcagcgggattggcctggcaaactatgtcctgcagtctgcaactggagtagtagttttcttacatgcaaatgtcaccattgacttgcagcaggagtattactggccaggtgcatctatctgcttacctatctctacagaaccgtaccatattataatgttttgttctctctatctcttgactattgtctagcttaattcactaacatctatataaatttaaatacatatatagatagcatatatacttgagataaagtctattttccttcatcgaactagttcactagatcatacaacccctaaactattttttccctcattatataacctatacaaacggtacacgttactctataatggtatttcttttttttctctccacattgtcatggttatggattgcacatacctaatagtagttgactaaatctcggaaggacccaccacatatcatgtcctatacggaaacaacctgcggatatggagggagttccggataaggaaagacaaccagagttctacatggaaacgacaaggactactcagattgtatccatattggtttcccacgttctacttgtacaaggggacacctatgggtataaatacaagaccccctaggaggagaggggagaaccacca

SEQ ID NO: 29908 - DNA, 168 bp, Oryza sativa
aatcgccctcccagagggcggtaggcgactacttccgtcaattttcaaaatggaaaattatttttgtaaaacttttaataaaaaaaattaaaaataaaaaaaattcgagatgcaagtatccctacagactacaaaaagctatattcataggtcttctttggcactagg

SEQ ID NO: 29909 - DNA, 1079 bp, Oryza sativa
cggcggggtcgggggcttcggcaaggccaaggcgggaggcaacggcgcgcgcttcccggaggcggccgcggcggaccaggcgggtgaggaggtcggcgcagtgcgaggcgtgggaggtggaggccgccgccacgcgggagcacatggagaattaatgggagcaggagacggagtcgtcgccggcatcgagcgcggcgggcgggggcagccgagggtggcgccgccgccgccgccgccggggaattcggggaggagaggaaggatttgacgagcgagcgatatccaccgttgattaccatccaacggtcacttgattattactctcctcttctcttatttggaatgaaatcattttttatgacgctattgtagtcttgtagatagtagagcagagtagaatactataattacttaaaatgggatactaacatatggttttttattatttattaattatagagaatgtgtatgtcttcattttattataaagattagccatgatgatgctctcctagctatgataataatatggacatagttcgaagggattagtgtgcacgtttcgtgagcgtccacatttgtgctgtgtttctaaacaaacaatatagatacaatgcatgatactatttgcagtttctttgatagcatgacgataaattgtgaatggtgcattttcgtatatgttaactggtgggaacattaaaagaacattgtagtgtacattaacacaaccttttgaaaaacgaacgttgttgtgttgtgtacacattgttcaagtgagacccacttgatgactataggcctgtttagtagagctacaaatttccgatcgtatatgtttatatgttaaattatagcggtctaaaattttattgttttatctaaaacatgaataaaatgatttattcaaatgttgatcgtaaatctaaatttatggatttgtagagccaggaatacccagcaaaaaatatcttaaatatgtagtctaagaagctgtgccaaatagggatgaaaacagatcgaatacggtcggaaactagctttatcatattcgttttcataatttttttcggaataga

SEQ ID NO: 29910 - DNA, 1501 bp, Oryza sativa
tcttgttagcttaggttagttagagtgttgtggttgtggttttcgtgcagtttcccctaattaactgtgcattgtaaggttttggtcccgttttctccttaaaatgggacacctttttctttatataaaaagtcggcaacagcctgaccgtttgaaaaaaaagagcacgagagtgagaatgagaggtaggagattaggttaacaaagagatgggctgcctgatgtaaaattggtcaaattgagtggttgtatagcctgagaaatgtgcggactatccgcgccaaactctatactggataattcgtttaaactatcagataatcagcatccgttggataccaccgataccacatttgactccatatctacatcctgcatccatatcacacggatatctaaaaacctttaccatgtcttcaatttggatggattcggagtggaatggatcggataatattcaatccgtgttcacccctagcccataattagtcatactgatattatatggcccaattgagacatattaatcaccgtattattactatagattatctacttaattatcttgattcattaaatattttgagaaataaattataattggtccaaactattacatataagaaagtgtgttgagaaaacatattcttatagacgtggagcagataatcggcgataataatttggtgaagtagggctctgtaatgtgtcgaagaaaatgagtagatgatgagcaccgaagaattgctccaagctcagatcgagctctaccaccactgttttgcctatatcaagtacgtggtactttgtactcggcgaagctttcccacatcgatccgacggctcatgcgtgtgctcactgtgtctatgtaccattgaatgtgatttatccaatttatatggacactatcttttttttctgaaggatataattgaggatctagcaccttcactctcaagttctataaaacattggaggaaaaaaaaaggacatgccccattgatcctagtgggtccaaatgaaaataatgtagaatgattgctacaagaccctttatatttgtaattgcatatttataaaaaaatacaagaatgagatttatagtaaatataattattctttggaatacattttatgtaccctttgtgcatgaaattcagttagttatgttcaatgtagggttgcacataagactgattaacttagacgcatacaaattattactataatatcatcgttggacgaaattcaaccatgtgtagacggttcagtttttccattttctgtgagtacaagtgagaaggcacgcacgcaccacactagcatcagttgcatcctagcatttgccaagattgtttagttaaataaacaatgttggctttatcttttatgaataatagaaagagctagtttttacaccttaagggaatgctcgctctatatactccttgcctctcaattctacatctatctattatatactaaaagtccatgaaactt

SEQ ID NO: 29911 - DNA, 1501 bp, Oryza sativa
ttgaattggcttgatacatttttaattcagcatgatatcagaacggataatcgaggcatctaatacatactatgtcgcttagataccatgtgacttaacatgtactgaccagtttaacccaatgaataaaaactaaagttgagggatgagcagtaagagcgataattcacttgtttcaactggttactatatgtcttgataagtttaggtaaatctaactacattaggttgttgttacggtaaatggatatcatataccgaagagcgacgacgattgacaaatgagggctttcttttgtacacagaaattattaatctatagtattttcatatatgagtcggttcaattttgactagtcctgcgacctcatatttaatgggcaagatgggattgtggctggtccacgtgactatgagagttttcatgggccagaatgggatttctgcggacgtgtactggcccacgctttgtaacaggcatgggctctcacacacgagcagatagatgaggcgactttttttttttaaaaaaaaaaagactggctggaggacccacctcccaaccatctaaggctaccaaatttcacatggcaagatccacgatgactgaattatcacacttacgtatggtgactattaatagagcgactcttagtcttatcttactaattaattaaaaaaagtcaaattggttgctagtttgatctcatcaggtaaactcaacttcgaaggtttcccctctcttgctgaggtacaacgaacagcagatggcacgaatttgatgatgctccacaaagaccacatgatatgtattttgtccgtgtctctcatcagctgtggtgcccttgaaatgaataaattttcatataagccttctttgcactagtttgtagaaaagataaaatgaccactgtaaataggggaaatctgaagaaagtccccttcctagatatggagcaatcactaaaacacatggaaaacatataagacatgtttaatagtatagatagcttctatctataatatatttccatgtcatcaggagctaatgttgtagataactcatacgacgtgatggctataggctgtcttcaattagagcatttaaacatttaatgcttgcatagatggtaatgatctccatctttgtgaccattttgatagtcactaacatgagtatacagttttcagtaatccaacatgactatacagttttcaataatcctaaaaaaatcagaaacgatcatatagggacgccacgtcaataagaaactataccccttccacgaaatcgatgttcggtcgatcgaagttaatctattctctctccaacaccccaacacggggatgacacgtcatacaccatgggcccacaagtcagtggctcaccaggaacccaaccacctctcatcacttcttctcccctccccctgactagtgacgagaagcaaggtgagatccatcgcatccggcattccatcagaattggcgaaaccctagc

SEQ ID NO: 29912 - DNA, 1501 bp, Oryza sativa
agtcaaagttctaaaatactagcaaaatgaccatgttttgctatgggtaaaagaaaatatattataatatgttatagataaaatacgtttttatcaaatatgttagtatcacttgtttggttatttaaatatatggtattcacttatttgaaacaaatactagactattccagaatatcataaaatattatggactaatttataaaagttacaaaagaatggtgggtggcagtggcaaattcactgccaccataactagtgccttctaaaggagtacaggttttcaaatattttcgtgattgtttgcttgaactctttaatcttgaagtttaaatcaataagagatgccatcctatgtaacaatgataaaaagtattctaaaaaatattgagaagtactcttaccaaatttcagggtaaaatatgacttatgtagagaaaaaaaagagaaatacttcgtggagtgaagtgaaacatttaaaatattttggggactaaaatgtgtcaacaaatagtttaggagattaagtgcgctgataaaatagttcgaggggagtaaaatggaccctttttttttctaaatccaaatactacattgaggattttccccactagatttaactcaagcaactttgaggtattattggtgtaccgtgttgcaaagggtcctctccttgccaaaattggtagactttcatgacagaatccctgtacattaattgcttatcaaaatgccaggcatgcattgcatcccaactgattatatatcccacccacagatgaaactcatcaggatagatagcactaaatataataatacaaccaaagaagttcccaagaaaatcacaaaagattaggccatataacaaaaaaagattcttctacagtgattggtcaatcagcacagtaactagtagtaaaaactttcccccttgtgagttctcagtttctcacatgagagcccatggatgcattgctagagacaaaaggacaggtaatgtctaatgtgtgagatactccaatgatgttttaaataaataataaatgtataataatccatttgatactataccaaataataatagtgtagtatctcatttctttattagacatactctgccaccactgcacacaatccactgcaaaatctctctctctctctctctctctcatgcaatgcaaatgcaacctgtcttatagagagagaaagaagagagaagaggagagaaagagggtgcagcaagacttgcaggtgcccataaaagaggtcaccaatggcaatggagtgagcttgctgctgcacctgcattcacaccaccaaatgcagaaaagataatctcctttctctctctattaaacccacacacacacacacaccaagaaggaaggcaagcaagcacagggcaaaccagagcattggaaagcaagaagcagagcacatcaagaagcaagcaaagccatggccgcctctcggtgcttcttgcttctcctgctgctgctgc

SEQ ID NO: 29913 - DNA, 1501 bp, Oryza sativa
ctagcatgaactccttgagtgtataacgtcaatgttaattagcatgtattatagttcaaaggttttttctactgaagatatcctatcttagtataaagttatcccccactaactccttaagcttaacatgcaaagatgctacaccatcatccactaacaagatgccacatcatcatacactaattaacaagatgccacatcatcatccactaacaatcatcacatttaaatatcatgcaaacatgctatatctttatagtttttataatttaagagcttttcaaatacaaacatgttaaattatcatccagcataattcatataatgtttcaatgcatatatttattatgttttatgatattctatggtccaaattatatttctcattttttcctctaattcagttggttttagcctttagatgattaatctacggtccaaactatctccctacttttcttcttccataaagtcataccaccttactttttacgtttgaatcatcattttacatactatttaaatttatattatcataaaccacattaatttacttaatctgatgttatctaactatcttacacttttttttattgttatcgtactaaattcctgcagcaatacgcggggtttcacatagtaacacaaacacttgtgtcttttctgccttttcctaattacgagatcagcaatttcaccattttggctgtgtttgtgctcaagatgccaaatttcaccatacaaatcaggcatttaccatattaccatccatggtacctccaaagcatgcatctttttttttaacaaaaatataaacaatgtacatgtacattaggaaaaaaaaacttgtgattgcaggttggcaaatctatcacataagttaaatgccctggtcttcaaaatctcccccatacagatcatggcatctgtaatttcaaaaattctgaacatattgattactattattgcagtccaaaatgaaatcatatgaagaaatcagatgatcataggcaagacgaaacggtggctcgtcagtcgtcaagctgtacgattaaactaatagagtgatgtgtatttcactttcatccctttagcatatacctaatgaagattctctaaaagccagcagatagatagcctggtaaccacagtatctgcccatgttgcttctcttttatatatatattgtccatcataggaagtgatgaatacaccgcatctgcataaaaaccacgtcaggattcactataaacccatatatgttgtgccaataaagtgcaaaacaactgacaaggcacgcagtaatcctgcaaaactgtgtgtgtctgattagtggagacactaacaataatacttgtatcttcttcagaaaccattcaatctcaagcacacctggatggcatattctctcttcaattttttttttcagtcttaaagaactctacttaagcagctgaacagatttcaagaaatacagactagcttgagttatcacagtgca

SEQ ID NO: 29914 - DNA, 1501 bp, Oryza sativa
tttggttcttctaagaatcatcatagataaagaagccgtttctgcggcatcaatcgtgcccttaaaaagtgtatcctcactaagataaaaaaaaagttactactccaattaattgcaattggatagattagacgcattcccttcccccaaaagtagttcgtatacaatgtattcataataaaggagagggggcataaatcacaaaaaggtgaataccactggcaatcgcagcatcatctccctcggcaccggcgctaccgctcggggggcgcggcggcggaggaggaggcggcggcccctggcgcgcggcggcgtggtgaagcgcgagggcgacctcggtgacggggaagtaatgctggaggtggaggacgggggcccagtggtgccgcctgcgctggacggcggcggcaacggcgtcgaacccggcgggatcggcggcgtcgcgggcgtgggcgaggaggaggtcgatgatggcgttggccgccgcgaactcgccgcgcagccacgcgacgaggccgtcccggccgtccaccaccaccgcctgctgctgctgctgcggctgcggctgcggcggcggcggcaccacccaccccggccccggcgcggccatcgtcggcgggctcagagcatggcggggcaatctgctgctagggtttcgccaattctgatggaatgccggatgcgatggatctcaccttgcttctcgtcactagtcagggggaggggagaagaagtgatgagaggtggttgggttcctggtgagccactgacttgtgggcccatggtgtatgacgtgtcatccccgtgttggggtgttggagagagaatagattaacttcgatcgaccgaacatcgatttcgtggaaggggtatagtttcttattgacgtggcgtccctatatgatcgtttctgatttttttaggattattgaaaactgtatagtcatgttggattactgaaaactgtatactcatgttagtgactatcaaaatggtcacaaagatggagatcattaccatctatgcaagcattaaatgtttaaatgctctaattgaagacagcctatagccatcacgtcgtatgagttatctacaacattagctcctgatgacatggaaatatattatagatagaagctatctatactattaaacatgtcttatatgttttccatgtgttttagtgattgctccatatctaggaaggggactttcttcagatttcccctatttacagtggtcattttatcttttctacaaactagtgcaaagaaggcttatatgaaaatttattcatttcaagggcaccacagctgatgagagacacggacaaaatacatatcatgtggtctttgtggagcatcatcaaattcgtgccatctgctgttcgttgtacctcagcaagagaggggaaaccttcgaagttgagtttacctgatgagatcaaactagcaaccaatttgactttttttaattaattagtaagataagactaagagtc

SEQ ID NO: 29915 - DNA, 1501 bp, Oryza sativa
tatgtgtgtatctgtgtgccgtagatcccgtgaagctagctagatactccatccgtttcgaaatatttgactctgttgactttttattacatgtttgaccgttcgtcttatttaaaaaatttaagtaattattaattcttttcctatcatttgattcattgttaaatatatttttatgtaggcatataattttacatatctaacaaaagtttttgaataatacgaacagtcaaacatgtgctaaaaagtcaacggtgtcaaatatttcgaaacggagggagtatatatattgggtaccattagccacactggctagctagcagccgcatgcatgatccatataactccactatttaattacttaatcgatcaaatagacataatatgatatgattaagctagtagtactatgatctctcgtgatcgagtttgcatgtatagctagctagggaccttccttgtcaagttgtctcagattatataaccttcgttacaatcttaactaaggtttggttcatgcatctcacggtgttctccctccggttcttttttttaattgatgttttggatacgattttaaataccaataaataattaattaggattcttattcttttttctcatattaaatatattgggggtgacacaattaaccaacagtcccttgcatctcaccttgttacagtcttggtataactccagtttttataggatcatgcatattgaagccatgaagagtagatatttaatttcacgggattttcgttcgcgagactttgcagtgcttattttttttcctcgcgtgttgaactttcgtgagcctattttttgtttgtttgtgtttggtaatgatttttttttgtgtgtgttttgccactggttttgagtattttggcatatgttgctatgcccttttggcgattaaacatccttcctaatacttctctatttaaacccatgtaacctaggagtaagaacacaacaacatgcacttgaacccaaccagagaaactaagtagcatggacttgagccgccagggggaatttggggctgaaccaaaagaagaaatgatcgctgagatcgatctaaacatggacgtatattattgatgacggcattggtaagtgttatatacttcttgttcttggcaatacaaccatgtgcttgtttgtgcaaccacaaattttacgcaatcctttttgagctaacaattgcttcttcttcttttttttttgtttgtggggggggggggggggatgacgatatgtcaatgctcttgtaggtggttttgatctgaactttgaaccaccccatgttggacttaacttgaacttggagctggtagattatgagaattttgtctaaggttggatcgtaataatgagcatgcaatccatccaagctatcgccaacaacaatgttatccaaggtaaaagatgacatgaatcttgtttttctattttgttgtgccttgttgccccatgttaatggtttcgtaca

SEQ ID NO: 29916 - DNA, 1501 bp, Oryza sativa
ggtatagtgatttattaacacgttcaagtctagcacttacagaagagggaatgcatatcggagaaatagacttggagtagacaaggcccgctccagaagatgttctcccctattgatagcattaaaattagatgctcaagatggatgatagtaacaacaaaagtaagtggttaagtcctccattgtttcatcatttacggaggagttcataaggtaagcgaacgtgaaactgtaaccagatttttgtgttagtcatgtatcctctttccaattttgtgagatttttttactgcatttcatctcagcaaatgatgtgaataatatgagccgtttgatgatatttctttgtatacattttcatttaactactgttaagctttgaatattattaacagacagttatggttatttcaacagtttactatatattatctatactaatataaaaatactaatataatctgctggcttgccccagtctctctcgcggcaatggtctgcgtgtgctacaatctgcatccctccacacctgagtaatcacctccgtgtccatgttgaccgacgcggctgccgctgtctcctccaaagcagcagtggtccaagccgaattggccatccccaccgccaaacaccatcgctggcgccggcagcctcaatccgcgtcgagttttcgtctccaccagcacagtggtctctacacatgaggttggtctcaggcttcaactttgaactcttattttccatcttttaatcgaactcgatgcgagcacgggcttaatgcattcaggccacagtctggttgctcttgatgtgcatgtcaggtacttggaggttttttatttccctcatgacgaggacttgttttctcttatctttcaggcctcaagtgacaaatcagagcagcaatcatgctttcttgtggcttttatctccaccgatctcacggcaatctatcgacatgtacatttgtattttgtagttggataaaaaaaagtagcaatagttgccatctttttctctaggaaaaactgatttgtttatatgctttttcagtttatgttagaggaaatggttagttgagcttgtctcctgtactgaatgtgcttggggttaactgagctttcagtccgtaagcatggtaacagactcttcattgagttaagtagtccaataattattttttataaagcatttcagtcagagtagaaacatttatggtttttctctactgcctgcatctggtattttttggtaattagctggcatcacgtacttatatatatagtcatatgggcatcaagcatgtttgtgggctaatataagctgctctaggcagagtagaaacatttatattttacattcctaaggtgactgcaattatctattttcgtgacagcaataaatggtatgtcatttgttaggaagacaaatacgtactgattaattcagaattaatcatcagttgggaaggataaatattagctacacatatagattcaga

SEQ ID NO: 29917 - DNA, 578 bp, Oryza sativa
tacatatttacaatgggatgattaatggcctttgtagagccaataagatggatgatgcttacagcctcttatctgtgatggaccaaactggtattcttcccaatcatgtgacgtatactatactcatgaataatcaaataagattaggagacatcaaccatgctatccaactatttaactcattgaacagtgacggatgtgtctttgataagataacatacaacacttttattaaggggctttctcttgctggacgaatgaaagaagcactttcgtttttattgatgatgcacaaaagaggctttgttcctagtaaggcttcctatgacaaactaatggagcttcttcttgctgaaaatgcaattgatattgtcctacagttatttgaagatatgcttttccagggttatactccacgatatgccaactacacttctttgctattggtacttgcaaaagatggacgatggagtgaggctgacaggatttttacaatgatgctgaagaaaaggaagtatcttgataaaaaaacaaagaaatgtttagaggagctatgctataaacagggggaacttgat

SEQ ID NO: 29918 - DNA, 1501 bp, Oryza sativa
actatgaacaatcgatccatccatgaaagcttggaatgtaccatctgaaatacaatgcttcctgaagcttagattcatatatactacttgtgttgtcatttgtattgttggagaagagtagttcaacttaataaaagttatccatattttggcattataaggcaatatattggttgacatggattttccatgccattttgaatgtgaagtgtctgtgaactggggatagaagagaaaagaaatgatacaggggaataggggatggcacgttagagcatctccagtgatgaaccgattcatgcagccacattggttgctctaataaaccaaaacaaaagtcaaaattttaaattttaaacttaattttgaagttgatttaaaaatatttttaacgtgttttttttctgcattgacttttaagtcgttaaaacacatatataaaagttttatctataaattaattttttatttcctaataagctattttggcttattagggaatataagcaatcgatgaagacctaagatgacttctaattcctgaaagaacaatagcatgggcccaacttaaaaatagaaaaaatcccacatatctcaccaactcatttaactgtgtgttttaaacttgtatggcccattttgaaataaaaactccatttagagagatgagaacgatggccgactttgtgactcaaaattgagagtcgttgtctctagctcctcgtatgcatcagtacgtcaatccatgtatcgatcactagagatgctcttacatcgatctatctttatttttcctatatctttaaacaatcatttactacagaccgtttattttatcaaatacaaatttatagcccatcctgcagctcatattttgcaacctctgctgcgaagaaaagcttgtgtgttccattccatcagtcaacaaggaggagagcccatgctacaacaacatgaatcatgaagaacaaacaaaggcacatccaagtgcccctgaacccgaagataatgaaacagacaagtagataacgttaattaggagtagatcacgattgctctttagaactctagagtagataaataagttttgatttatctgtcatcatgaattcatgatgtttttttttaataatgaaatagaatcccggcctttgctcaaagagttacaaccaaatgaattcatgatgtatccattttgttgcgttatatctgtactttactttttatatatagttagtacctattattttctaaagctcaacatgtaaaaaatatcacatcgtcacacactaacaattattatctacaatattttaaatcacatataaatatatcacatcatcactcactgacaattattatctaattattttaaatctcatacaaacatgatatatcatttatgattttgttgtatttttagatcttaatatataagcgatgtcaaatcatcatctccacattatttaaacatatacatatatgatttatatgatgtaac

SEQ ID NO: 29919 - DNA, 1501 bp, Oryza sativa
tcaactatgaacaatcgatccatccatgaaagcttggaatgtaccatctgaaatacaatgcttcctgaagcttagattcatatatactacttgtgttgtcatttgtattgttggagaagagtagttcaacttaataaaagttatccatattttggcattataaggcaatatattggttgacatggattttccatgccattttgaatgtgaagtgtctgtgaactggggatagaagagaaaagaaatgatacaggggaataggggatggcacgttagagcatctccagtgatgaaccgattcatgcagccacattggttgctctaataaaccaaaacaaaagtcaaaattttaaattttaaacttaattttgaagttgatttaaaaatatttttaacgtgttttttttctgcattgacttttaagtcgttaaaacacatatataaaagttttatctataaattaattttttatttcctaataagctattttggcttattagggaatataagcaatcgatgaagacctaagatgacttctaattcctgaaagaacaatagcatgggcccaacttaaaaatagaaaaaatcccacatatctcaccaactcatttaactgtgtgttttaaacttgtatggcccattttgaaataaaaactccatttagagagatgagaacgatggccgactttgtgactcaaaattgagagtcgttgtctctagctcctcgtatgcatcagtacgtcaatccatgtatcgatcactagagatgctcttacatcgatctatctttatttttcctatatctttaaacaatcatttactacagaccgtttattttatcaaatacaaatttatagcccatcctgcagctcatattttgcaacctctgctgcgaagaaaagcttgtgtgttccattccatcagtcaacaaggaggagagcccatgctacaacaacatgaatcatgaagaacaaacaaaggcacatccaagtgcccctgaacccgaagataatgaaacagacaagtagataacgttaattaggagtagatcacgattgctctttagaactctagagtagataaataagttttgatttatctgtcatcatgaattcatgatgtttttttttaataatgaaatagaatcccggcctttgctcaaagagttacaaccaaatgaattcatgatgtatccattttgttgcgttatatctgtactttactttttatatatagttagtacctattattttctaaagctcaacatgtaaaaaatatcacatcgtcacacactaacaattattatctacaatattttaaatcacatataaatatatcacatcatcactcactgacaattattatctaattattttaaatctcatacaaacatgatatatcatttatgattttgttgtatttttagatcttaatatataagcgatgtcaaatcatcatctccacattatttaaacatatacatatatgatttatatgatgt

SEQ ID NO: 29920 - DNA, 1501 bp, Oryza sativa
aaatcaactatgaacaatcgatccatccatgaaagcttggaatgtaccatctgaaatacaatgcttcctgaagcttagattcatatatactacttgtgttgtcatttgtattgttggagaagagtagttcaacttaataaaagttatccatattttggcattataaggcaatatattggttgacatggattttccatgccattttgaatgtgaagtgtctgtgaactggggatagaagagaaaagaaatgatacaggggaataggggatggcacgttagagcatctccagtgatgaaccgattcatgcagccacattggttgctctaataaaccaaaacaaaagtcaaaattttaaattttaaacttaattttgaagttgatttaaaaatatttttaacgtgttttttttctgcattgacttttaagtcgttaaaacacatatataaaagttttatctataaattaattttttatttcctaataagctattttggcttattagggaatataagcaatcgatgaagacctaagatgacttctaattcctgaaagaacaatagcatgggcccaacttaaaaatagaaaaaatcccacatatctcaccaactcatttaactgtgtgttttaaacttgtatggcccattttgaaataaaaactccatttagagagatgagaacgatggccgactttgtgactcaaaattgagagtcgttgtctctagctcctcgtatgcatcagtacgtcaatccatgtatcgatcactagagatgctcttacatcgatctatctttatttttcctatatctttaaacaatcatttactacagaccgtttattttatcaaatacaaatttatagcccatcctgcagctcatattttgcaacctctgctgcgaagaaaagcttgtgtgttccattccatcagtcaacaaggaggagagcccatgctacaacaacatgaatcatgaagaacaaacaaaggcacatccaagtgcccctgaacccgaagataatgaaacagacaagtagataacgttaattaggagtagatcacgattgctctttagaactctagagtagataaataagttttgatttatctgtcatcatgaattcatgatgtttttttttaataatgaaatagaatcccggcctttgctcaaagagttacaaccaaatgaattcatgatgtatccattttgttgcgttatatctgtactttactttttatatatagttagtacctattattttctaaagctcaacatgtaaaaaatatcacatcgtcacacactaacaattattatctacaatattttaaatcacatataaatatatcacatcatcactcactgacaattattatctaattattttaaatctcatacaaacatgatatatcatttatgattttgttgtatttttagatcttaatatataagcgatgtcaaatcatcatctccacattatttaaacatatacatatatgatttatatga

SEQ ID NO: 29921 - DNA, 1501 bp, Oryza sativa
ttgtatattgcaaggccagtgaacttatttaagaacaaatgttaatttagctcataaaagctgaaatgtaaagcattctagactattctgaagatgtaaagcccaatataaattaagcagggaccagtatatatcaatatatgtataccataccgaaatagcaaggcagtaattacctcagagatatccctcaatgtcaacaagattagatgcatactatttttcatttggatgtatacatataaaactaatcacatagtgcaacttaggaaaactgaatttcagtttggatcacattgtttctaagctttctgaaatggaattgacatactgtaagaaaattcacaagaatcaattcacactcagtttcaacaaaactgtggagattatgggtaccccatacccacacggcgtggttatccgactgatataggggataacttatatctatgaaatatgtaacggatcatgacttgggtattacgtttccttgtatattatggaacggcctaaaatcctggtttgataagattgtaaagtagatttatgaaaccgataccgtattggttaaggtttctatcttgtaatcctgccccccatcctatataaggtgggtagaaggccctctagggggcatgagacaactagatcgtcagatctatactacacccggtggattcaaatccccaaacaggagtagggtattacctctcatcgagagggcctgaatctgtctaaatcctttgtctccgcattcatccacttttaggtctcgtgcgctaccctcttttattattgccgaattcttgtttcgacagttggcgccccaggtacgtgttgcgtcgagtattccgtcgagaagtgcgatggaaccaatttttctggagatgtgatgagatcgatctcgatgagttcgacggtttcaattttctactcaggtttgctgttccgatcaaacttttatcagattaatttttcattactctatttgatctcttgatactttctggttctatatatgcaactatgagatcaaggcgaagcggtcggcgacctcgcacgtcgggccgccaatccgaacaccgtcatgttgtccaacagccgtccctgcacgcggagcagtgctgaacatcaagctgtcgtcggctacaggggcttatatacgctgcatcgcgcgtcgtcggctgtcactcatgattcagcctcattgcccgatccgagtttttcgtttcttatccatatatattatatttctaattgcagattgatctgttccagcattacttttttgacagtaccgtcgatgccaagcgatagcttattttttggcagtactcgtgcgtactccacctcggctatggaggctcaacggccacgtcatcaagtcgttacaagctgtacatgtatatatgtacaaatatatatatgcttgggctggcatacgaacacatggatctgcatctggagtacataatggcggttgtttatcaaatcgcctccg

SEQ ID NO: 29922 - DNA, 1501 bp, Oryza sativa
tatactttttctttttttacttatgtattaaattaaaccaataaccaattacatcataatacatataatccatcgattctttgatcgattcaaacgtaggcgtttgtaaggaaaacgtgccatgatgactttggctgtgtttagatccaagggtgaaaatttttaccgtgtcacatcagatatacaaacacacatttgaagtattaaatatagtctaataacaaaacaacttaccacctgtaaactgtgagatgaatttattaagcctaatttagcaaatgtttactgtagcaccgcattgtcaaatcatggagcaattaggcttaaaagattcgtctcgcaatttacacgcaatttttttgtctatatttaataattcatgcatgtggccaaacattcgatgtgatagggtgaaaaaacttgttagatccgtccctttgagaaaatacattggctttgtttagattccaaaaatttttgacaaaaaacatcacatcaaatgtttggacacatacatagagcattaaatgtgaatgaaaaaaaaaccaattgcacagtttgcatgtaaattgcgagacgaatctcttgagactaattacgccatgatttgataatgtgatgctacagtaaacatttgctaatgacggattaattaggcttaataaattcgtctcgcaatttacaggcggaatctgtaatttgttttgttattagtatacgtttaatacttcaaatgtatgtctgtatgcttcaaaaactttaaaaaaaactaaacacacccattgtatgatatcaaccatgggaaacgggacggcttatggtatcgggctatgggcctaatagcatcactttgttagggacagattaatttagattaaattgaatacagtaaataaataaaaaaacagtaattcaaggtttacgtcgtttttcaccatcctaatatactaccttcttaatatataatagtccatattatagtacacccccatcctaagataatactatgaatatgtatccttatttttgatctggagggttaggtggttgtactcaaacacaccaaagccgtgttcaaagttccaaaagaaacagtccaaagtacaatggtctgagagaaaatggaaaatgaccttttaggattttgtatgatatgaaggggaaagaaaattgagagaagattgatgtttgttaacaagacattctaataatatacagcataatactatccatactactgcacaccagggtttacaaaactgtacgaaccgtacgattatcgcgcatttatccaggttatcacatgcgataaccttttcagtttttaaaccacgggatacctcgcggttaccgtagtaaccgtcaaaccgtagtgttaacccaaatggtttggtaaaccctgctacacactagtaagcgtgtacatgcaatgcacgtcattagtgtcagggttacggataaggtataccctctacccttggatatacgtcatatatcgata

SEQ ID NO: 29923 - DNA, 1501 bp, Oryza sativa
atgacgctcatgagacctacatgttaatgagaaaaattaaaataataacagcccccgcctctcccaggccaggcccacttacatttggcaactttcatatgttgtagactgtcctcacagaccaacacaagtcttttctgcacactaggccaagcacgcttaacctcagagttctttagatatcggtttctggaaaataagttgcaacttgttgatgtaagtattctattaattctattaagccttgggccaagatgtcacaatccatgagccctgcgctgcatccgctggccttcgacccggttgccgaggtcgctagggtggtagacggcggccgacatcggcgagctcgcagggagtgcgggtaggaatagcgaggagctactatcctgaaattgttgtcgccgtccgacaaggcatcgttgccttgctcctctcctgacattcgatgggagtttcccggactaggatgccacatcagtcaaatcagctatccatattgtcttactacttcagggcctgtttagttcactaacgaaaatttttagcgtgtcacatcggcgatacggacacacatttaaagtattaaatatagactaataacaaaacaaattacagattccgcctaaaaattgcgagacgaatttattaagcctaattaatccatcattagtaaatgtttactgtagcaccacgttgtcaaatcatggcgtaattaggcttaaaagattcgtctcgcaatttacacgtaacctgtgtaattattatttttatttatatttaatactccatgcatatgccgaaacattcaatgtgacagggtgaaaaatttttgtttgggaactacacagggccttatttaacccggttttgaaagatggatgtttaataatttctgaagataaaggacctacagtgaacttattccatcccaaaacagtgtggtggtgtggcttggatgggccgggctgggcctcctacagtccggctcggtccaactatatatctctcccacctttatctattctattaacaaaaaagtgaaaaataaagaaaaattcattcttcttctccttctccttcttctcttcttggaggatatttcttccccctccgtctccggcgccgatctgcatccacccgccgagcagagaccagcgccgccgccgccgccgtccgttcctcctgtatcgcgtcctggtgagcatccgcccctcgttacgcacatttttttattcgaatttttttttcaagaatgaatttctgtgcgttaaccctagatagtacgtagcttccgttgtagatctggatctggaaagcttttctcttgatttgttcgtaatgtgatactaatagcagtttctttgcttgtttgtttgtttccctaaagaaatttcttttttctgggatgtccgacgttggagacgcccctgtgcagcgccgctcttgttcgaatccggccggtggtctgtaggattgggcggctgcggcggcggcgaga

SEQ ID NO: 29924 - DNA, 392 bp, Oryza sativa
gcttcatggaaatagtatgctactacgtatcacttatcacaggatctttgaaaagttacatacaatttgtattataattatatacatacaatttacaaataattacattgtattatatttacatatatcaatttttttctaaaaaggttttatgacaaaatgtattagctggtcccttaaatgaaatgggccgtggaggtgggccggtccagtaggagtggaacgttctagagggccctggagaggggcaagcccgtaaattcgccgccgcgtcgcctccaccttaaaaccctaaaccccacgagcgcggcggaggcgatcgaagagtgtagaacttttgctcggtcttttttgcttgcttcgcaagaagaagaagaagagggcggcggcga

SEQ ID NO: 29925 - DNA, 288 bp, Oryza sativa
taattttcatggtgtgtaggagagcagctctcatcatcacttccgagaggcctggagtctatatttgttttcagttcccacagtttgaaataagtccaaagtcatgcggataccagcaaggaactcctgcaaatgcaaaagggagttcagacttcaaaggtttcaagaaaccaaattacaatgacaaatggacaacactgattgttaattcagggcctcaggggtaatgaattgataaaaaggatgaacaagatctcacctgacttatctttttttcaccgggaaagg

SEQ ID NO: 29926 - DNA, 343 bp, Oryza sativa
ttcatgctgctcatcatctgttcaagctcgtgcctatgttcagccgacaatttgtctagtgtgactagaataatatttccttcgtgaacttcagacccagctggatttggagcttgttttgacgatctgttgacttcaaagcttgcttgtcccctgacaagtttatcggatcccgctgggcgtgccaaaagcgtgttgatgcaaaaacacgaagcctggaagatctgcttaacttcagtgcaggtccaaaaatcttgccttttaagttcgtgagcgtgccacttgatttgatcctgcaatcaataagaaataaagacaaataaaccgcggctaaatccataaa

SEQ ID NO: 29927 - DNA, 509 bp, Oryza sativa
tcaaataaggcttggaggatttttgtatatttcctaaaagcctaaaatgcgtaaataaattttagtggaattttcagagcacaaataataattgagaagaaataaacaaagttgaaaaggttttataaaaagaaaaatccctaaaagaagtcttcttttcccccccttcccttcttgggccggctcggcccaattccctccctctctctcctctcccccgcggcccatcggcctcccccgcgcgagcgccgctgacaggcgggcccgcccgccaccctcgctgacgggtgggacccacctgtcatcgcctacctcgcgccgcgcccgccgcccgctcgtgccctagcgccgccgccgccgcgaatctcgccgtttcccgccgtccccgcgcgcaataaagagggggaaatcacccccgtgattccctctcccgtttccccctcttttccctctctccctccctcggattcgtccgatttgaaacccgcaatcgtcgccggcgtcttcaa

SEQ ID NO: 29928 - DNA, 401 bp, Oryza sativa
actttgatgtactgccttgcaaagttaaaattctgaattccgtcaactccatttttctcttgcattgcaaagatttgttggactgactagggatggatgaaagtttaagtggttggaaagcgtttgcactgaggagcttggctctcgcactcgcatattaggctttctgcaaattgataaggtaaatgaatataaagtttctatagaagtggtgcagtgggaacacaatgtgaacattcagaattgcatatgcactgaaccttcatggctcgcactgatccaggagccatgtgcaatttgcattgggtgccgtgcaccttcatggttgtctgtgggtttcatcaaaccggttgtgtgtgtgtgtgtatgtcctttttgctgtgctgagcagtctgttgtca

SEQ ID NO: 29929 - DNA, 738 bp, Oryza sativa
aaaatcagctgtgactagatactaaatgactgtctccactcctttttaacatgatgatcatgaattaaaggtcatagcatagcatctaccatctatagattactccatcatctctgaatttggtgttacatatgagttcaactgaaaaatgtgatacgttctgtgcatatataactgttgcttgggcagtaccaaactgggttttcattacactaatcatgtagttttaggaccacttttaccttgtcccttttgggaaccacttgcaactcagacattgtcattctagtacgtcagtacaatgaatggtccatgtttcacaggatcaaacaaaatggcggggttttcattttgtgcatatatgtcgtcatgtaactcttatgccccatttcattctgtccttcatgtctgcttctataaccaggaggctatgctgctttgtgtaacatagtaactatcaatctatcatttatctggagatagctcttccgtggaacacaaaagttagatctgagcatgatatactcaagtttatttctatttgtgcagtggacaaatatgaacaatcttatttacaaactagaacctctcatcagtacattaacttgtttgggtgtatttttgctctgggcacaatgctgcattgcacttcataacgccagatttttgctgtttccttatcatggggccaacacttacaaacattctaatgatttgtggcagctgattatgatctta

SEQ ID NO: 29930 - DNA, 324 bp, Oryza sativa
gaaattcttcttggcctctgcaaacctttgctcatgcagagttaccttccgtgcatggtgagataagctttcaaactactgggatgagaatttctctttaatcggagctatcaaaccctgaaaagctaaatcggctagctgagaatctgttagagccaagctgtagcacctattccttgtttccctaaatctctgaatgtagtcctgcacagattcaacatgcctttgccgaattgctgtcaagtcagaaagtttcatctcatgaattccactgtaaaaatagctgtgaaattatttctccaaatcggcccaaccattgacaga

SEQ ID NO: 29931 - DNA, 277 bp, Oryza sativa
gagaatcaaacactgatcagccatagctgccgcaacattctgcagcaacccaaccaacaaacccaccctccgctttgactggcggtttcatttagcaaccctgcaagccgcaacgctttttgtcgccttcccaagaatagaagtccggaccattcaaacccagtccagtctccctctctgccacctgcccccacctgtccctgctgccacactgcgccgcgacgccatcggagagcagctcggagctcagagatgcttcttgtacatgtcctctcgc

SEQ ID NO: 29932 - DNA, 257 bp, Oryza sativa
tgctagtgcaaagttgggaattttttcgaggcttaccaggaggacaggaggatgaaaccgccggagtggagggagtggggttttgctgcgggagatggaaccgggacatgttcactttgatgcgaaaaaaaaaaatcttactaaaatttagcattatcaaaattttaacaagatttcttatatagttaactaaatatagccacttttttagcaactttactaaaatttgataaggttgaaaatatcattaaagtgaa

SEQ ID NO: 29933 - DNA, 1501 bp, Oryza sativa
acctttgttttgacgtgttcgatcatctcgctcacagctaataatgaaaatggggggtggggatgaactgcaaaggaatatgtcattttcagccaattgctacctcctgtatgcactgaaacttaatttatctttgaagagaatctactctagtttatcgtcacaagtatgtacaagtctacaagatgataataaattgaaagttaattcatcaagtcgcatatgtaaacgctccaaaatctccaaggatctgtgcttgtccgatccatagcaatcagaagaagcgaagatgaaacaagtcggctctgaactttggccgtctgacttaattagccaagctccaagatgagataagccatcagccatttgttaattagatcgcaatccacttggttatgacattttgtggcgagacaataaagtggtgtgcaatgcatgtctgcatgttttgtcgcctgcaaattaaataaccatgcaatattctttttattttggcctgcatattgattacagatacagtagataatactgtacaatatacaattagggcaccgagtaatttatacgtacaagttgggggttttgtttatgtgcgatcattgcgtgtgtgctgattttcggggaggatgcatcatgagtgtacacattttgttattcagacggctcacattttattgtgttttgtttttaagtaagggtggcttgagccaattattgtatcgtcaaagtaggtaaaatatcgaatgagtgatgttgataagtgaatacaattggaatgctacgtacgtaagggattgactgtgctaaaagaatcttaattgtatagttgtatcctgatgtcaaccctctattgctgcaggagggtttgtccgagacaaatggtttcttcaagaagttagatgggttaacacccaatatataccccaagaataaaatcgtatttcaaacaaaaaatctcagcccacgaacttttcaaacaaaagtccttgaatcctatatatctataaatttcatccccactaaatatagttaatgctcttctctcatgaagccatatcatcttaattgtttttagctcttctctcatgcatcatagagtaatgaaaaaaagagggttatttgaaatgtttttctctcctcagaaattcgacatgttcagcacgcatgagcacgaagctctccaaaaacgagagcccataaaggcccaccttttgtctcagcccactagatacgtcatcttggtggcccatgccatgagcgcaatctctcggcccagtatcatcctgggggcccataccgtgaccacaaacggctcgtcggctcgcacgtgagccgcacgcgctgccagccatgaagccgaaagaaattcgaccgttgagcgatccacccacgtcttaaaagcggcctcctcccccaaatcccccaaatcccccattcgaatctctccgcctcgtcgccgttgcggccgctcctcccctcccctctctctcttgttccccca

SEQ ID NO: 29934 - DNA, 1501 bp, Oryza sativa
ataaactaaatactacagggtcccacctcagcataggtgcgtacctacgtgcgcgggttcgtacgcctcccatcccttttttcatttttctctttcttccttttttcccatgcatatgcttaactccctttattactatatcatgcgtattcatgagacgatttaatcaaagattttgagtatcttgcactcgcattttttatttgcggccatactacatgatatgtatatagatggaatgcatgataattaactaccaatagtttcttatttactcgagaaaaaaaaacatgattcaaaagttgtaaatacttaatccatctcctactcaaaagttcgtgaatggttttctaagataccttaagaaaaatagaacccttaaattattataaaataacattatccaaactttagtttgtcctaaatctatgagacaaaatttctgaacaaacaataattttatatttcaataatataagtgtctgcgtatacgcgcgggccaccttcctagtttaaataaagaacttagcccctcagataaagatttaaactcaggaccttaagttgctactcagcttactacaaccactagagtatatgcctttgggtaaactgctactgcaaagatgcaggaggagtagatgggttgagatagaagtgtgtataataagcgaaaagagcaaacgggatatatgatgaaaccacgtcggccagtttgatcgtccatcaattggtggcaaaaaatgtgcctgcctgcaaacgctgcaactacgcctgcatgcttgtcggggtaaacgcaaggtgttcttcttcacgccggctgcaactacacctcttgcattcttgttactacaaactgttcacagaccaatacaggtataggagtagtatacaaagaagtagaactagatactcctactccactgatgtaaacaaaaccatactccactccattgcctgtcattagcactagtagattctcataacactagcagttcagtagtaccattgcctgtcagcgaaaatattggagtactcgcagtactccaattgagagaatagagtactggagtactttgtcgcgtccttgcgtctgtactagtactgtttgtagtactctgaacaagaaaaacggaagcctgcacagctgcagcctgcaggcgagaatcaaagatcgaaacgggaaacaaacgccactctgcactgcagcctctgctgctgaagctgaaccctctcggtcactgcacctcggcctccttttccacacttttcaccgtgttcctcctctctctttctcccacccagcgcgcgatttccccctttttttttttttttttttataagaccttgcagacgacgagacgaggacacagcaagaggacaggacacggcgcgggtacaatacaatacaagtagcctccacttcttgcttgcgtcttcttgtccctcccttgtcatccagaggagatcgaggaggtgttgtgttggtgtgtgtggagga

SEQ ID NO: 29935 - DNA, 1501 bp, Oryza sativa
atatcatgtagtatggccgcaaataaaaaatgcgagtgcaagatactcaaaatctttgattaaatcgtctcatgaatacgcatgatatagtaataaagggagttaagcatatgcatgggaaaaaaggaagaaagagaaaaatgaaaaaagggatgggaggcgtacgaacccgcgcacgtaggtacgcacctatgctgaggtgggaccctgtagtatttagtttattctaagatcaatttaatctaacggtttataatattggacctaccgatttaagtggaaagtaagtaatagatactttgattttttttcttataatttctaatatttgccctaatttattagagcaccacgtggtagcttgagagcattttaaggaattttaaatgactaattagaatattaactgcgcaatatatatgtatgggacatatggtagtatttagcttcgtccatgtttatatacatgtatagagaaattaattttgtggctagcaagccattagatgtctaattaatagaaattaattttgacacatatttacaattgttcagagtaactcttacatattcaatttacgacttcgatgatccgttgatcaccaatttactaatcaccatgacttgcatgaaaaaaaatgtagtaaggtttaggatagatgaaattgatgaattatataatttatgtgatagctatttgagggtataaacgaatgaattgctaaaaagttataatgttgtttaaagaagacaccatttagaaacttagaaagcatgcaaacaaaaatccaaaatatggaatcgggaaaaaaaacagagtgccttaaactccatttatcacccttgtcgtagtaagagttctatggatattcgtcaatattacgctcacatttataacataatgattcctttcacctgtacgaatagatagtacaaaatccaaatacgacataacacaaatacattacaattattatgtaatcaattcttggtttcaacttaaatagagctaattagtgttgagaaaaacataacccatggtacttaattattctctcgctacatcacacctttcattttcttttcatgttattaacaaaattaatcatctccatatatgatttaatatgtggcaaagcggtagcgctacatcggttgtgatcaccttagatgtctcagacactacgctttgtcacacgtgtgaaaggaaaaggtgcagacgtgcattgtgcagcgggcaaaaagagaatttcggacgctttattcattagcaaataatagatctgatgattataataatatgtccgtcagttctagtgtaagtataaattagttaatatatattttaaattgttattttaatgggtacacatggtgtgcatcttattttaaagggggctgctatataacggaatctcattttcgaacgggatgatcccgagtaggtattaggtgtgatacctatcaggtatcagacgattctacaaaacaggatgatccc

SEQ ID NO: 29936 - DNA, 242 bp, Oryza sativa
ttcaacataccgtaaatccaatcataccttcttggttcatgttccacatgatagttgtatactgatctttcatggtgtttctttgttatgtgatttaactctattctgtccgagaaatcaagtcttttcctctctggtgtgtggtaaaacatctatattttccttcaattctcgtcttcaaattgctaaagcttcatataatgctgttgttgcttattaagcatgcactgttctgatcacag

SEQ ID NO: 29937 - DNA, 253 bp, Oryza sativa
actttctactcttttggtcccactagtcatagaccattttcttagccaaagtttgccacaagtgtggccatcaaattttgagccacacaatttgcatcttgccacacctttggtaaaaaaaactatggtaaattgaggtgggccttccaacagcccctaaatcaaacggatagggtggcaagcagccacaaaagcccaccaaactcaccaggatcctagtcgtggttgacatgtgaggagtcaacagcatcca

SEQ ID NO: 29938 - DNA, 488 bp, Oryza sativa
ggctaaattgcgaagcgtgcagcacttttgcttcgctagctgcctctcctcaagtcgctgcgagtgcgagtccacacaacactgtgaactcccccctctcgagcaaaaaaaaagatccaaaattttttcgccctggggttcgaaatcttcgtgccttcctcctcctcgcggcctccaattcgaacgccccagttgctcgcgccgccgcggattccccagatcccacctcctccccagctcgcgcggcccaattcgaagccggttctagggtttcccggcacgaatttagggtttcgggggagcttcggggggtgttgttccttgttccgcctagggtttggaatttggggggcgtggagagatgggataaggagggtgttgggagggtgggagctttgcttggggtgtgtgtgtgtttgggtggtgctgagctgagctagggtttggtggtgaggtgctgaggaagggaggtggggggtggaaaatgt

SEQ ID NO: 29939 - DNA, 683 bp, Oryza sativa
tctcttcctcgtcgtgccctagtgggaactgggaacccccgccgcgcccagctggtaagcgtcgcgctcctaatctgttcatcaaattggtcgagaatttggtcgcaatcacggagtcctcttggagctggagagagatcgtggtgctcgggggagttgtgaggctttcctctcctcgcctgctcgatccgccgccgcaaccgccgccgccttcctcctcacgccacatcctcccgccgttctcgggcagggggcctttccttgtcgccccttcctctttgctgctcttccgcctcgcctcccatctccgcctcgccttcttctccatgacttggtcggcctggaggtgttcgtgaatcgtgagagacgctaacctgccccgctgccgtagaggtctcagttggtacctgttgtgcttcggtttctattttcctagccaggaacttttaaattttgcatttcagtttagggtttccgattaaaattacctatgacgtttcaacagataaataggtgttgggatcaaatctcggctaagttaaatccatgttgaattttacttggcaatctaaggttttagtgttacctatatgcgttacttcaatgaggactggagaatgtgaaacattgttattgcaatttgcaactttcaatttcaggaggtagaaaatctctcttgaaga

SEQ ID NO: 29940 - DNA, 770 bp, Oryza sativa
  unsure (1)..(770): unsure at all n locations
cccctttttccgcaacatgcccacgcatcgatggagaaagaaaaccgcgacgcatcgggtgcccatatgaaatgaatgaatattccgccgccgctccagcttccggtgcaagccgcagcttggtgccaattttacggtgaggtgaccgttgctntccacagccccaacctccgcgcggcctcaaccctcacctgcggcgaggatcggtgctctactctagtagtagtactctagagtctagtctagtctactctagttgctgcgttcgctagcattcggaggcgatctgaggaggagaagtggggagcagcgaaggttttgatcttttggaaggagttggattcggctttctgggttctgtctgtcgcttgattccaattcggatttcttgctgttgttgttggggtgttcgcggccgatttgaccccggggaatcgctgcttttttatttttttgaaaagataattctacgcggattagatttggtcaagaagtcgtagtacgaacgcgaggtttgatcttggtttcgatccgaagggtctcggttggctgcgtgggaagggggaggaggaagaaggcgacctgctatctaatcctctaccccctctgctgcgaaaattctctgctgtttgctcaagcatcttgctgcttggagccttggatcgaagagagttttagttcttggagttctgagaattgtgttgcttgagccgaattcgatcccaaaaaggctcttttttgggaggctttgaggaggaagaagaacaaca

SEQ ID NO: 29941 - DNA, 264 bp, Oryza sativa
agttgaaccaccttctagacataatattattggaaacaagtgggttttcaaaaataaacaaaacgaggatggattgattgtgataaataaagctagacttgttgctcaaggatttacgcaggtggagggtttggattttgatgaaacttttgctcctgttacttgaattgaggcaattagacttttgctggcttttgctgcttcaaaaggttttaaattgtatcaaatggatgtaaaaagtacttttctaaatggttttataca

SEQ ID NO: 29942 - DNA, 527 bp, Oryza sativa
gatggtttgggctagcccagcacacatgcatgacgtcatcaatggcggcagcccaacatctacagtacagcctaatactgttggagcccatgcggagagttcgagagctattgggaaacctgacttttccccaagtttatcccctcggtagagcagtggatttgggtgaagcaaggagaggtgcaaccaaagctagggttccctgcgagaggtgaggaagtccggtgatttggtagtggtgctcgccggatctggagagttccagagcgcaagcgcgaccatcgttcatacacagaggtggtgatggacaagcgccctccaaattcggccggagtggcaagtcaacaagcgaagggtgacggatccgattagaggtggagattaggggaaccgtgatgcgcgcgaagaggatgagcttcgacgccaacttctcgctcaaaatccaacggggaatctaggtgcaagatctcaagggcgtcaaggtggcgaggcagatcgtggtgcgagagcggcggatcgaggtgagg

SEQ ID NO: 29943 - DNA, 1501 bp, Oryza sativa
  unsure (1)..(1501): unsure at all n locations
taaataggcaggtaatgacggttatggtggctggaaaggtcggtaataccctccaaccgccatagggaggaaatccacaccgtccatcgccaaccctgcatctagcggctacacggcgggtcggccgaaccaggggacgacccaatccagcccaatttcggctggcggcctcctcttctgttgctcacttcagacttgtgaattttggcaaaattcatcgtgtcatttctgagttcttggcccattcatacataagtccgatcctcgacatcgtccgattgatttatcgtctgatttgatgtcgattctccttcactttataggtattctctgtaaaaggttagtgaaccagatactagtggaatattattattctaacatgtatatgcattgcaagataactagttcttctctattttggtaatattgacggtcaaaacntgatcgctaacgacaatcaacaacaggtccgacccctaagcaaagagggggcagccgccactccaccccaggccggacccttcttggggaagtgccacgtgggtttgggggcggcctcctccctctaaacatgataccgccgggcccatatcacagacgcagtcagacttatataggtgtgttccttctaaaatgttatgtaggccaacatgtctactttatggtaaacattaaggtatgcaccaacttgccatatagatgaggagagaagtacatcaaagaaatgagcctctcctcctagctacccaatagcttatttcaacatcctaattcacgccatctctaaccatatacgataggttactactattgtgtaactcaaaagggtcttaaacccatctcactcgatgcactgcctatcacattttgcgatagtccctcaatgaactgatctgctagatttttagcaatctggacatatggctgcgttcgaatctccaacaaaagttggatgaaaactttgatattcatatcatgcttttcaaaatattaaatggtgtgtttcatgcgaaaacattctatgtggaagttgctctaaaatatcatataaatctattttctaagtttgtaataattaaaacttaattaatcgtacgttaataccacattgttatgcgtaaaacacttcatcttcatttacatgagtttcaaacacatagtctaattctatcactccgaagtattttaggattctcatagacttcaatcttctttttatatgtctgtatgactttatgttgtcctttaaactgttcaccttaataatcgtcatttgattatcacggttcataagtcactggtttttcaaccacggttaatccatcggaggcccatgaagtactcgatctcaatagtggcagtgctacgtcaaattattttgatttaatgactgaccctcaatcgttcgcaagttgttatacgttgcacacgtgtataccgtgagcgcaacttatccattttttttgtttaaccacattttaattttctctctttaattagg

SEQ ID NO: 29944 - DNA, 1501 bp, Oryza sativa
ctctctcgagctgctctgcaagcatctgcgcggcctctccgggatccagatcagacacctccagcgtctcaaggaggtcgcactcgattctcgagtgagcgagggcacgaagcgagagtgggaggcagaggccaggaggcatccgaacaggcccagcatcttgctcctgaagaacagttacagtactgtcctgcctgacgacactgacagattggatgatcagatggacggggagcttgctcgggagaaatctgcacctgatgatgatgctggcaaccaggagcagattgcggaggtggaatcagaaagcagtgcatttcaattggcgaattccactatgaataattcagtcgctggaaaggaatcaacagctgatgatgctgatgaagaaggattgggaagcactaatgcagtgcccatggagcagataaattctactggctccatcaatgagaccgaggtctccaatagagggaaattcacaatgtcatattttgaggactgctgtccctaccatgaggtaataaactataaatttggcacatattatgtgaattcaactgcatttgagatattatttaattaaggttagagtttcaagatttgatcaaactttttacataacacaacttttaaaactaatgacggaaaaaatgttcaaacaactcgttagaattataataccatacaaaatatttctcaaaacacgtgattatgcaagtttataaaatatgatttccctcctaaaagcttgggttaattggatccatgccattataaattcttctgttttgaaatataccattaatatttacctatttgaagtcatgccattataactttataggtatttgaaatatgccactatataccctttcaacacacttaacaaaaactttagaccaaattgcccttatcttctttctttttcttctcccagctttcctgttcatcttcttctccctttcttccccttctgcatctggcagcttgacttcttccttcccatctctctcattttctactggtgaaccttggccaagggcactctccaacttcactctgacgccatcctccgaacccagtgagaaggaaataaacaggcattgagggccggatcggggcagtatcatggctcggcgtgggcgctgtgaagcgcgacgaggcatgggcatagtgctggcgttgcagcggctcgcatgggaagagtggttggtgcagacttaccgtggctgaggagatcagtggacagtgggtgggtaggcatgggctttggtctatccatggcagcagagatgaacatgagagattgggagaagaaaagaaagaagatgagggcaatttggtctaaagtttttgtcaagtgtgttgaaaggtatatagtggtatatttcaaatacttataaagttataatgtcatgacttcaaataggtaaatattaatggtatatttcaaaacatgaaaatttataatggcatgaatccaattcaatttcttata

SEQ ID NO: 29945 - DNA, 808 bp, Oryza sativa
gcgcacgcgcgcgcggcgcgcgggcgaggcggagcggagctgagcggggggagggagagcggagcacgccggggaggggagagggccggggagagggggagagagagagagagagagagagcgcccgggagagagagggccggggaagagatgggccgagcggaattcggcccatcgaacccgggggaggcaaactagacttttgcggagggattcgatttggaaggaattggattcggaattgaactcgatgatagatcgggaattgagatcttgagatggcacggacactagacaacaatcaaagaaacaaatttcgcaattaggatttttcggagataattttcccgctaggcgccacgacggaacgggcgctacaaacaaacatcacaattatacataaatcccaatataacataagtctcaacttaaacataagtcacaatttaacataggtgccaatttaacaaaagtcccaattatacataaatctcaatttaacaaaagtcccaattatacataaatcccaatttaacataagtcccaatttaaacataagtcccaatttaaacataaatctccatttaacaatccacaattaaaccttctcaaaattaaacaatccacaattgcacatatcacaatccacgatgcacaattaaacaatccacaatccacaattgcacatttcacatttctttttttaaaagtaaatgttaccgagcgacggcggggacgacctggcggcggggacgacctggcggcggcgatggcaacggcgaggggggagaggtccgtgcggcggcga

SEQ ID NO: 29946 - DNA, 1501 bp, Oryza sativa
aagtgatgaatataaaaaatctatttaaaacatcattatgattgtaaagatatatctgctaagacataagatcggacctaaccgagatagtcccagctaaaccgatgtatctttaaacacaatgcaattaaacatagaattgaaatatcatgtagacaaatataccaaccaaatcagaacaatcgaagagatcgaagagacgcagtcttgaacaatgtcatatagcctatacaattatcagggccaacataacttaggacttaccccttcgctggagatcgaaacgatgcaaccctgcgtcaagtgctaagttccgccagtgataaaaaccttggaaaagagggtggtgatatgccaagagatgtattgattgagagatagattacaaagaccttgaatgtacatatttatccccgtggataaatattagtccttattagatagatatttgtcgctccgttttacgtacgcgggaggtgagttcacagccttaattaaaaccaccctaaataccaccaagggagttattttgtaccgattttaatagttggagctaggttaaaaatatgtaaagaatttgaaccagattggacttatatttgaacgaatcaaactggatattcccattcaataccaccactcgtcgtcccgtcgtcccttgcagctttgctaggctttcagaccgctctgtacgtgacgtggcctactcatagcagcgaagccttccggccgcgcgcgctgaagacctacggcccgtccgtgcagcagcctcgagcggccgtgtcgtgcagcacacgctcgcatcgcggctgcctttggacctcggactcggagagccgcgcgcgcgatcgatttctacgtacggcggcgccaaacacacagtcgatcgaacggacggccgggcacttggccccagttggtaatcatatcaccgttcggtggctgtctcctctctcgccgccgggccgcgcgcgtcagacaactgagcaggctgcgccgtgttagtttcgcggagaactagctagcgtgcggtgacacactacaaggacgttcatgtgcaagcttcaacacgaggtgagccgcgcgcgcgcgtatagcaccggtcgccggtcgtattcgcggacttccaggagtattccacaggcaacagtaaactgcgtgcaatcggtccacgaacaagcgagaagatatcgagtaattatgatcgattctcgtgtcaatgtgtgttttttgtggatcttcttggtttggagttccctagcgtgcgtccgtattggaagatatctcaggtttgcgccctgtacatgcagcggcgacgttggaaacacggcccgccattgcgtgttttcctacgcaacctttgtctataaaacggccggtgcaaactgaaccctgcaagtcagcttcagttcgctgcatctctcctgcaagaattaatatatctttcagactcccagagattacacctgatcgatcgaattgatcgcgatgacgacgatgg

SEQ ID NO: 29947 - DNA, 1146 bp, Oryza sativa
gaggtatgcacgtaccagtcagtttgattctgcaattgacaagatagataaactaataatcaaagagtccatgggtcaataagccgatgtagcgatattagcccatgtcaatagggttaatcggctatatattcgatgtagattctgacatgtagataaaaataatggaagaacttgaataaacaatccaatcgaccgatgataatatgatgaagtagatgtccaatgaaccaatcggacaatattgaaacaaaatattaaacgtaggctcgatggttaaagaatacatcggttggaagatcgatgtaaagataacttatctgctagcattccgataaaacaatatacgtgagttaccaggctagctagattagatctattaatcaacagtaaacctaactaataggtcggaccaaaccgatgcataagtttacatcaacaaataaacctaataaactagtaaagtcgataaatcatattaaagtgatgaatataaaaaatctatttaaaacatcattatgattgtaaagatatatctgctaagacataagatcggacctaaccgagatagtcccagctaaaccgatgtatctttaaacacaatgcaattaaacatagaattgaaatatcatgtagacaaatataccaaccaaatcagaacaatcgaagagatcgaagagacgcagtcttgaacaatgtcatatagcctatacaattatcagggccaacataacttaggacttaccccttcgctggagatcgaaacgatgcaaccctgcgtcaagtgctaagttccgccagtgataaaaaccttggaaaagagggtggtgatatgccaagagatgtattgattgagagatagattacaaagaccttgaatgtacatatttatccccgtggataaatattagtccttattagatagatatttgtcgctccgttttacgtacgcgggaggtgagttcacagccttaattaaaaccaccctaaataccaccaagggagttattttgtaccgattttaatagttggagctaggttaaaaatatgtaaagaatttgaaccagattggacttatatttgaacgaatcaaactggatattcccattcaataccaccactcgtcgtcccgtcgtcccttgcagc

SEQ ID NO: 29948 - DNA, 1501 bp, Oryza sativa
ttgccatggtctcgctggtcgcagggagttcagggactgcgactttctacacgcctccttacacacgttgagcttcttatcgatccttaatactcctctgaaactaaaatttctccaacctgtaaacgaaaacacgcaatgctgcatagatatatagtagatatattttttttctttctcagaagggagggcatgtgtccactgtccagttgcatttcattcttcagagagatatatatttttttactactgattaaaccgcgtgtataacatttgtctgtaattcagtagctttaattatcgtgcgagcttataacattttggctggccgtgcatgcgtgcagcgtcggcgtgcttcgggttccaggagcaggggacgatgaccgcggcggcgagcgacgtgttctggaacggcggcgcggcgtgcgggaagcggctggcggtgacctgcaccggcgcgacgaaccagggggtgccgcagccgtgcaccggccggagcgtcaccgtcaagatcgtcgactactgccccgcggggtgccgtggcaccatcgacctctcgcaggaggccttcgccgccatcgccaaccccgacgccggcaagatcctcgtcgaataccacgagtacgtgatcatcatagttatagactgtaacttaattttacgcctcattttcattttaggatgattttttcttatcagatttattcacgataagctgtgctcatttgcagggtctaagatcaaaatcaggatggcttgaaggcaagcgaacgtgtgtccttctggtcatcagtagcataagatggatttaagggaagaataaaggatgcctcgattccactgtggttgagaagaaaccatacgtctgagacattagatttaaattcaagtaatctagttttggagtattagtgactgtttggtaccgctccaactcctaaatataacttcaggagttaagtctcctaaatataactccaggagttaagtctggagtggagttatagagctgcttaaatccagcttcacaactctagtacattttgtaatagagctccacccaactccactcccagttttagtggagctgaaactgtttggctgaactccaggaggagctggagcagtgccaaacagacccttactaatcaaacacttgtaatacagaaaatgcttgtactagtatatcaggcatttattggaaatccacaattaatttgtgattcacaatggatgcctcatgaacagtttgtctcagttgtctgatgcatgttggcaaaacatctggcactatcaagcagaatgaaagaaaagggaatcagatcaggttctcttgcaactgtaggcctgatcttgctgaagtttgaaaacaaacaccaaatggaaaggagttctttctacacttacattcgtgttcataaattgctcggatatgaaaaccaatggtacgataaccattgtttaacatgttaaacgtttgtagtgttaaaagtgttatttc

SEQ ID NO: 29949 - DNA, 1501 bp, Oryza sativa
tacgcgcggtgcgacttgcgccgggcgggcgaggggaactctggatcgcgtacgcgtaggcgactcgaaccatatcgcgcggggtcacgctcacgcggagcaatgcgctgtgcgcgagggcgggtcgcacagcgttggcttccgcgaagaccttcgatttactatatactctatccgtgattctgctacccccgtctatctgacaagtagaggccaccatctatcttatgggcctatcattgttgaccaataatgtattcaagtgagaaactctatttgcttcatgtacactgtacaacacactgttttatcctatcatcgttaatcaaaacttgagagtgatgatttagtttaattagctcatctaatataattagagctcgttgcaacacacaggtattttgctagctagttaaaaaatagttgtataagaaatagaagcaatgtttgcctattaaattaaaatgcaactctacttgtaaataaactataatctagttgtatgagcccatgcacgctttgatgatcactagttaggacaaagttaataaccaagtgtccaagtgggatctttcctgtcagcattgccgcattggcacaaaacaatgtgaacttaactttcgccgagccggccggctgcgcgatatgatcagcatcccgcggcgtcagctcttgcacgtttctgccgcagaagccaaaccggcaatatccaaggacgtgcaacttgcaatttctacacggttaatcgctgcaaagcccggccataacgtcacaatcgtggggcatgcagagcagagcaacgcatagaatttctccatgatgagaagagaactgataaacattgtgtgcatgcttgctaccttgtaccactagaatgttgagattagtattttactctacttgtcaagcaaacaacagtactgggatcctgagaaatccagtagtacaactcacaacgacgaccaagttactaacatctgtcatcaacctagagcagagtgtggatattaggagtagcatcttggacgttttctctgtcctatcctgttgcattttagtatgaaccaataggacaacctaccaaatcttgcatgtgcttagctggtgatgtgccctgtcccaagtgtgtttacactatctatgtacacctctgtcgttcatgtcatgctcgtgtgagatcatcctctggatgaatgagatgggggcggactgacgaatgatggttagttaatctcgatgctaagaaactgcaatagcgatagcaatcttcagtaatagtgacagatggtttgtacggtggcaccttaatagaatgtggtatatgctggtacatcgtggaagtaacttccaagtgcacacagtaaaatctctcgcctatataatgtggcttaaccagtgtaacattcactactacacctcttgcacaaatccatcttctgcacgggcttaacactgatcatttgtgcaagggtgattagttagtagccgatcgctagtgtta

SEQ ID NO: 29950 - DNA, 384 bp, Oryza sativa
cccgttcaatctagtagagctgtttgtactacttgagttatcgacactgcaatctactgcaatctactcaagcaattgcctaaaattgctcccgttcaatggcatttatttgaattctgactaataatcgttgagttatgtgggttcattggacacatttgaaggaacaagaatggcagttattttcttgatagctgaaaacatgtaaagtttaagatcacataatgtatgttcatgcaactattgcagtagatgaactaatgctatttattactaaaattttattgtaggatccctagatgactctttaatttaattgtttcacttcaattatatgattgcacgctggaatcagacatgctaatttgattgtctttcaacagt

SEQ ID NO: 29951 - DNA, 1501 bp, Oryza sativa
tcccctgctcctggaacccgaagcacgccgacgctgcacgcatgcacggccagccaaaatgttataagctcgcacgataattaaagctactgaattacagacaaatgttatacacgcggtttaatcagtagtaaaaaaatatatatctctctgaagaatgaaatgcaactggacagtggacacatgccctcccttctgagaaagaaaaaaaatatatctactatatatctatgcagcattgcgtgttttcgtttacaggttggagaaattttagtttcagaggagtattaaggatcgataagaagctcaacgtgtgtaaggaggcgtgtagaaagtcgcagtccctgaactccctgcgaccagcgagaccatggcaaggctcactacaatcgccacaacaactgagcctatcttaggcgccataacactagcgatcggctactaactaatcacccttgcacaaatgatcagtgttaagcccgtgcagaagatggatttgtgcaagaggtgtagtagtgaatgttacactggttaagccacattatataggcgagagattttactgtgtgcacttggaagttacttccacgatgtaccagcatataccacattctattaaggtgccaccgtacaaaccatctgtcactattactgaagattgctatcgctattgcagtttcttagcatcgagattaactaaccatcattcgtcagtccgcccccatctcattcatccagaggatgatctcacacgagcatgacatgaacgacagaggtgtacatagatagtgtaaacacacttgggacagggcacatcaccagctaagcacatgcaagatttggtaggttgtcctattggttcatactaaaatgcaacaggataggacagagaaaacgtccaagatgctactcctaatatccacactctgctctaggttgatgacagatgttagtaacttggtcgtcgttgtgagttgtactactggatttctcaggatcccagtactgttgtttgcttgacaagtagagtaaaatactaatctcaacattctagtggtacaaggtagcaagcatgcacacaatgtttatcagttctcttctcatcatggagaaattctatgcgttgctctgctctgcatgccccacgattgtgacgttatggccgggctttgcagcgattaaccgtgtagaaattgcaagttgcacgtccttggatattgccggtttggcttctgcggcagaaacgtgcaagagctgacgccgcgggatgctgatcatatcgcgcagccggccggctcggcgaaagttaagttcacattgttttgtgccaatgcggcaatgctgacaggaaagatcccacttggacacttggttattaactttgtcctaactagtgatcatcaaagcgtgcatgggctcatacaactagattatagtttatttacaagtagagttgcattttaatttaataggcaaacattgcttctatttcttatacaac

SEQ ID NO: 29952 - DNA, 307 bp, Oryza sativa
taatcacctaaagttgtcatgattcatcatgacccatcatcgccaatgagttctctctcctctaggtcctctatctccatcacttcgtctgtgagactgaatatgtctggctggaggctgaagacaatatatacactgtctagacagagagatatcatcacaacagggttagtatgtggtcaaatgacatatatcaacatatgtttataactttatattattgtgtgctgattgctgaacacacatgtcgcttttctggatttcctcataagcgatcaacttacctgtctgtatatgtcactgcagt

SEQ ID NO: 29953 - DNA, 1501 bp, Oryza sativa
ttcaatctaatggattcagtttttccagtatttgtagcggttatactcagaaaagagaacatagtaacctgatttgttttgtttctgtggataatttgaccatcataactaatctaatccaaaatctactatgacaaatagttgcagcggagcatgatgtatttaggtcatgtttatgttttcttttgctgaactaatgctcgtgaagatcatatataagaaaaagcactctaactcagctaatgtgccatttttacctttttagatgaaatctattgcctcaaggagctgaaccttccatacttccatataagaataaaacaatgtacataaggtatatgagatgtaaaaccctaaaagttgccaaggttgactaaatgggaaatttacaatacaaacagctaatatcggcagaatagtacaagtaaacataacattcatacaactacaagtgcatcgaactatcacctgatacgtgtgattcactacacttgcatctacattaagtgtctgaaggaagctctggcatcaaatggtgcgccttctgctatgcatatggtgcatgagaaggcatgcctccaacaacaatctcattcctgaaaatgaaaaggaagaattggcaacatttcaagggaatggtagttgattactatttactacatggcagagcttgatcaaacgagaataaacaaggtgaatcaaaaaggttgctgaattatctcagacaagtatgggaactaaaaacagttttgcagggcttacaacaaatctgtaatgttgaatatcatggcaaatgctagattgctagttcgtgccccttttactaatactctaatagagtggcctttatcatatggttgaacacgacgccttcatatagcaaagttgcctaaataaacacaaagttgccaaatgtgaaattcctagcttttgtcgttttaatgagcggtagattatccatctaacaggagaatcagatttctgattatcaactccacttctcgtctgttgcttatttttttccctgagcaacaaaaatatgcccacctaacagcacggaacagctcaaaaggcccctaaagaaatagcctttgccaccatgcgtaatctgacaacacatattcttcaaaccaaagagacaacaggtaggcacaatcttcagggaataccaatccaggatgtttcactggacggaccacctaccaagcagtaaatcacaagtaagggcaaggatactggcatctggtaaatgctacggtgaagattctaatgtggcgcgacagaataaaatgccagggaatccagttcaacatccatagatcattccattgcaccagtacccgcctctacgttaggggaacatggcgctcgagcgaattgttgccccccaattccacccaaaataattaaactaatgcgtgtccgcgtcaggggaacacgacgctagagcaaatttatcacccaaaatgatacgcaccgaggggggttgtggcggcggtga

SEQ ID NO: 29954 - DNA, 1501 bp, Oryza sativa
tgaaaaggtttggctatgataatacacctttttcctgaatgatgctgatgtctaactcatttctgaacattctgcagggtcagattcatgtcgttgaatatatagttgagtgtattcaccgagctaaaatccgacctgatcaatcaacgctttggtacacattttgtgcctacgtggatcaggaactgtacaatactgcaattgaagcattgcaagtcctcagtgtgagaatgatatctgaggaggccgatgttcttaaggaaaaaggagtaattgtagaagatctaatcctcagcgaagagccagatgctgaattaaagatcatgaagacatttgaagcaactgaacatcttgcgacagccttactgaacttgaggtggtgtgcaacaatgggttccacaatatcctggtcacccgaggatagcctctgggcaaggaggttggcatcttcttatgacggtaacagaagaccacatatatttaccagtattgtgcctaaacagtttgtggtttgaccagttcttcccaaaggatctgtatatacatattgagtgtcttgtgactctctcctgagggctgaggcatcagttcacatccattgatggactggtctcatgcaattctcccagctccacctgctgctggcaatagcggtgttcagagcatcagcagcacaaattctgtaccaatttcattgatggtgacgaaaagatcgaaccgcacagcagcaatagttttttcctaagattttggagacaataatgagaggtttttacaagagcaagagttgagagtgctgttccttgtagcaagacctgctgcttatgagcctctgacgtgaattctttctgatacatgttgtaacaaaaccttagtctgacacactgataaaaatgttgtagtttatccctcttggagaggcccctaaaaatgagagctgcaccaagcatttttcatcggccattttgtcaagtataccatcaaatataatcatattttctttaggttgtcttttgacatcatatttttcttctaatttctgtaggctgttgtaagttgtaacatgttaattactccattagcatggataatcagataattgcttgttactggcagtcggtcctcgattatttaacatcaatcctggctcactatcatatactcagatagccccacgtatcatattcaaaagtgtcaatataatcaaatttagccaataaaaggtttagattgtcaaattttacttatgtgaaatttctcttatgatttgtttgtctgatactctgtctgatcggtttgtcatctggtgcccaccgcttggcctccgtgagatggcacgagcgctcgtccaggtggtcggctcgccgcctcctcgcccgcgctcgccgcgccgcgtgtcgcgccaccgcctccctctcttctcacccccccccccccctccttcctctctctccgctgcctacgatataggcatcggcgagggcgaccagggggatcggag

SEQ ID NO: 29955 - DNA, 1501 bp, Oryza sativa
cttaactatttgccgcaagaagtgatcataagtgaagaactgatcagcgttacgcgactgaaaccaaagctgaacccagtaaattcagataaattctgcaagaaaaacgtcactagtaggcagtagcaatgctctcactggaatccatcttggtcatgcacgcgtagcgccgcagcttctcgttgaacagcacgagggggtccttctccctgagatcgccgtcgccgccgtacgcgtccctgaggaacacggcccagttcatctccgtgccggcgaggtagaaggcgcggctctgcttccgcagcgacgcgtgcatgtgccgcgtgaggccgagctcctccttgaactcgaagatgtggtggatcagcgcgcgcttctccagcgtcaggctgaggaactcgtgcaccacgccgacgcggtacttctccgcctccggcgtccacggcctcagcagcgcgccgctggtgtacggcgagaccagcgggaacgtggtcgccgcgtccaggcggtcggcgtcctccgcgtccagcggcatcgaccggctgtgcgggacggcgaagcggaacgtgcgccggacccggcgctcgtccaccacgaagtcgcgctccagcgcgctcacggcgagggccgggtcccaccgcgccagctcgaggacgtcgcggccgtcggggtcgacggcgacgcggaagtcgccggggaactcgcggacgcggtcccggaagtcgtccggtaggccgagcaccgcgcggcagtggtggagcttcgcgagcgggatgcggcggtggtcggcgagcatcaggagcttccggacggcccgcaccctcgtcgggaggagctggtcgtgcaggcggcgctcctcctccaggagcgagcacatgagcggcgtgagcgcgaggtgcgggacggagtccaccctggggaggtggaagagcagcgggtggcgcgcggcggcgcgggacacgctgcggccgcgggggaacccgagctcgcggtacagcttcccggcctccgcgagggggatccggtgcggcggcgggagggaggccaggaacgacctcgcgcgggcgaggaaccggaaggcggcttcgcggtcgaggacggcgtcgagctccggcacgcggcgcgcggcctccggctcgatcggcgcgacgcgcgggctgctcagcttcttccggagcttcctccgccgcttgcagggcagcagcggcaggagcgaggccgccgcggccgccgccgccgcagaagaagaaggagacggagatggaacggctcggagtagcgctctcgtggcggagaagaggcggcgcgccatcggcggcggcggcgccgtggtggaacgaacctgaggcgagttcagtctatttcgatcaaccccacgcacgaatattaaagcgacagtaaccgttggatctgaaagcctagtagcgttcggcgttagcgtagagcacaccacatcacactcccctcccctctctctctctcgtctcctccctctgaatcc

SEQ ID NO: 29956 - DNA, 344 bp, Oryza sativa
atctagcctatttggggctagcaagggggatggggcacaacccgcggcgaccaaggcaatggcactgatatgtcagatctcttcttccttgccctcaatgcctctgcctagggcctagtacgagctgaatctagagtgcctcattctcttcatcacaattagcaacactaatgaagtggaggatggaggcattagcactaggcaggaagcctcgtccttgtcattgatctgatccgccaccctcgagtccaacaccaacatccaaggttaacgtccattcaccatcttcctccatccgcgcctttccctctcatcctcctcatcctaccccctctctcttcagc

SEQ ID NO: 29957 - DNA, 432 bp, Oryza sativa
ttaaatctgccctttatgttaagatcttgctgcatttaggaatattaggcttttgtttgatatattctatttgctttgatatcttagtatagagtggtatcagagtattagctgatacatgctagatctatctgatcggctatactatgaatatatataatctcattattaatatatatttcgatctaagtgatttatactgtctcggcatggcgaccgatctatcccaatcacttggtttaagtatatatcgatataaggatcatatatcattaatatctatagccgatcgagtagatttagttctgttttatttattgatacttgccgatcgatgcatatatgacatcggctcaaagataaataatatgtcatcggcacctagccgatcgtctatcgtttatggatttaaccacggtttctttgtccttg

SEQ ID NO: 29958 - DNA, 946 bp, Oryza sativa
aacgaacgagagcgagaacgagaacgatcgaacgaagacaagcgagaacgagggaacgaacgtgaacgagctagggaacgtgaacgagcgaacgaacgaggacgaacgttaacgtgaaatgcaatatatatatatatatgttacttcgcatttatcctaatatatttttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcccgaaacacttagcatacatgactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatgtcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 29959 - DNA, 303 bp, Oryza sativa
atgcagcattaaatatgaaaagaagaacaatatctagacaatcaagccactagatgcttcatagagtggtaaatatcctatataatctaagccaacgtcgctatttaacctaatcggctaccttctactaacagatgttagccgattgtaggttagataacgatattaccgaagattatataagatatatgataactcgacgaattacataaataagattagagtatcataaagatggaagcactaatcccgagaacgcaagctgctataacaagtttacctcttgttgaagatcgaaatcga

SEQ ID NO: 29960 - DNA, 1501 bp, Oryza sativa
gagatctgcttaactctagtgcaggtccaaaactcgccttcgggtatgctagcgtaccagttgatttgatcctgcaatcaacaagaaacaaggacaaagaaaccgtggttaaatccataaacgatagccgatcggctaggtgccgatgacatattatttatctttgagccgatgtcatatatgcatcgatcggcaagtatcaataaataaaacagaactaaatctactcgatcggctgtagatattaacgatatatgatccttatatcgatatatacttaaaaccaagtgattgggatagatcggtcgccatgccgagacagtataaatcacttagatcgaaatatatattaataatgagattatatatattcatagcatagccgatcagatagatctagcatgtatcgactaatactccgatacaactctatactaagatatcaaagcaaatagaatatatcaaacaaaagcctaatatacctaaatgcaacaagatcttaacataaagggcagatataacatatcaacgaagcatatagagtaaaactagttaaatcaggtaagatcggctgaaaccccgatgctaccctaatcgtcaaccagaaggcaggctagagattgatattctaagcacgacttaatagatcaaactcaactgatgcagcattaagtatgaaaaaaagaacaatatctagacaatcaagccactggatgcttcatagagtggtaaatatcctatataatctaagccaacgtcactatttaacctaatcggctgccttctaccaacagatgttagccgattgtaggttagataacaatattactgaagattatataagatatatgataactcgacaaattacataaacaagattagagtatcataaagatggaagcactaatcccgagaacgcaagctgccataacaagtttacctcttgttgaagatcgaaatcgatgcagctcaacccgaaagtaagaacttgtcgaaacaaaacgaaagtaaaaagagtggcgatgcgccgagattgtattgaacgtgtgttaaattgattacatggggctcggggtctatttatacccgagaattacaaaacatgtccgtatcggacacgactcttatctctaacaaactctaagataccataagtctttgcggcagacttttgcccgaatatatctctaaggaaattacataaaatatcctaattaatatatacaattgccttctcaagactctatccatgtgtggcaatcatcacgaagcacattaactcaacccgatgatgtataccgagtcgtattgtcggaatcggctgtatcagcttacccaatctgactcggactcagccgatcctgattgtagctgatttggattccagccgattcttactctgttcccgaatcgatcttcgtctttgattccgcttcgatctaatcttcatcttcgatactgacactggtggagaaaccctttgtagtcccggttcgtaacc

SEQ ID NO: 29961 - DNA, 585 bp, Oryza sativa
atctaaaaaataagtgagggagtgatgccgcgtgcatggtctggggccactctcttttggattgagatcctcttccttaagtcagatgacattaaattctttgacatgtggacccatagaactagaaaaaaaacgggtaatttagaaccatgccattataattttgcaaagtttgagatatgccatcggtatctcaataacatgtaggacccacatgagtcaatgacatgtgggtcacgatggcatatctcaaattttgcaaaattataatggcatagttccaattttcccaaaaaaaaaaggatccatagtaggcagaggctttggccatagccttgtgggctgtggtgcaaattctgtggaggcggccggtcaaaggcgaccttgtctacctgcgtgtggagtcgtggagctagacgacgtcacctcgcctcgtggtttggagtcaaacatcgaccggggtggatggtgcgcgccgcaaatagaagaggtggtgtggagtttacaaactctggaggaggctactccgccgcagcgcagctaacaagcaaccaagacgacatcaagcttcgccgctacaacagg

SEQ ID NO: 29962 - DNA, 505 bp, Oryza sativa
aaaaaaatgttccctatttaatcaaattttgttcaacattccaaataattttgaaccgaaatttcagctatatcagtacttatagaaatagagaaaccaagccgttataccctgctccagatatttaagtacatcacttcgagataccaaaattcatacgtcgatactttttcaagtatcgtaaaatttgcccttccaattaccatagacctgtcactatacatcaaagtatcaaacgaccggttctgcgaagcctccctggtgtcatttcaataacaacatgcatgcatccaacataagcagagagagtcttatttaggccagtgcatgcacccaaccaagcaacccattttaatataaagctacggcatcatatgccttggactgacacacaagttcttaatttgtcattagaatatcacataagtcctttcacttgcttgctctttgtgtacatctttcgccggagcagccagagccatcgccatcgccatcaggccgctaa

SEQ ID NO: 29963 - DNA, 1501 bp, Oryza sativa
gatgtatacaacttgagtgtgcttaatatagaataagcatcaacatagacaagagaacgcaataatattgcgaccgacagttgtaggaaacgaagaacgaacggtaagagtgaaacgttataccccgaaaatggccctccgctggagtttgagacagtattgcctccgttggtgttgacgggaggctcctccttgtctctagtgttgttgttgtcgccggttgtcgacatgttggtgaagatgatgcagagtagtcgcgcttgaagcgctactcaaaaacttgatcgcccgcctacccgtgcaggttctcaagcggacggagtttcggaggcacctgctcgttccaatcacccatgtgcgcgggatgaacagaaccggggaaacagagagacagcgcaggaacagaaggagagtatcgccaaggaacaatgcaggaggaagacacacactttgagagcctctgccttgcgttatatatacgtaaaatctaaactgagaggcttctcgctttagtcgtatcacgcgacgcatctcatagccgatcgatcgcgcctatcgtccatccacgtggccgcgctgtaatggcacaatgagaaggattgacacagtgtgtgccttgtttctcaatagacatgtatatctttttcctattcaaataaagttttctcttaaattacttatccgatctataatccgattacaccattgtgttcgttacaattaaatcttcacaacaagatcttacatgattatattacgatgaaaaaatatttatatttataaattacttttattatatatgtaagttacttttatcatatatatataagttacttttagatatgactaaattatttcttagtcatataaaagtaaattcaataaggtctaaaagtaatttacatatattataaaagtaacttaaaacaaaatggaagtaactttgtcacgacattagaagtaatatgtgatctaaaagatataagcttttttttgaaatgaatactaccagacatttgcccacagtgtaccttttttaaaagatataagttattaaagagattaaaaaaggatacatactattgcatttttcaagttcaaaggagagactagatggagtacaaaccagctaccactagctgtgtagtcacgtccaatgaaaaaagacatacattaaagttacactcttttttgttataagttacttctataatatatgcaaattaattttaggttttattgaatttatttttatatgtctaagaagtaatttagtgaaatttaaaagtaatttagatatactataaaagtaatttatgttttttcatcaaaatataatcatgtgagatcttgttataaagatttaattgttacgaacacaacggtgtaatcggatcgtagatcggataagtagtttaagataaatttttatttgaagcataggtggatagggtctcagctggtttagacaatacagctaccactagctgtgtagtcacat

SEQ ID NO: 29964 - DNA, 175 bp, Oryza sativa
tggaccaattgaaaaataaatgtattccaagcaaaatccaatatttcaaaaataataaagcaatttcctatggactagtttttgctttatatgttgctcacaaaaatagtgtatgttgtacatacagtatatattaattaatatctatttttaagattttataaatttatgtcac

SEQ ID NO: 29965 - DNA, 1501 bp, Oryza sativa
aaatttcactaaattacttcttagacatataaaaataaattcaataaaacctaaaattaatttgcatatattatagaagtaacttataacaaaaaagagtgtaactttaatgtatgtcttttttcattggacgtgactacacagctagtggtagctggtttgtactccatctagtctctcctttgaacttgaaaaatgcaatagtatgtatccttttttaatctctttaataacttatatcttttaaaaaaggtacactgtgggcaaatgtctggtagtattcatttcaaaaaaaagcttatatcttttagatcacatattacttctaatgtcgtgacaaagttacttccattttgttttaagttacttttataatatatgtaaattacttttagaccttattgaatttacttttatatgactaagaaataatttagtcatatctaaaagtaacttatatatatatgataaaagtaacttacatatataataaaagtaatttataaatataaatattttttcatcgtaatataatcatgtaagatcttgttgtgaagatttaattgtaacgaacacaatggtgtaatcggattatagatcggataagtaatttaagagaaaactttatttgaataggaaaaagatatacatgtctattgagaaacaaggcacacactgtgtcaatccttctcattgtgccattacagcgcggccacgtggatggacgataggcgcgatcgatcggctatgagatgcgtcgcgtgatacgactaaagcgagaagcctctcagtttagattttacgtatatataacgcaaggcagaggctctcaaagtgtgtgtcttcctcctgcattgttccttggcgatactctccttctgttcctgcgctgtctctctgtttccccggttctgttcatcccgcgcacatgggtgattggaacgagcaggtgcctccgaaactccgtccgcttgagaacctgcacgggtaggcgggcgatcaagtttttgagtagcgcttcaagcgcgactactctgcatcatcttcaccaacatgtcgacaaccggcgacaacaacaacactagagacaaggaggagcctcccgtcaacaccaacggaggcaatactgtctcaaactccagcggagggccattttcggggtataacgtttcactcttaccgttcgttcttcgtttcctacaactgtcggtcgcaatattattgcgttctcttgtctatgttgatgcttattctatattaagcacactcaagttgtatacatctagcactgtcactagatctactcatattgcaaatgtcatgtttattgtcttaatattttggattaaaatatgtcgaattatgaccaaatttccaacaatccaaaaacttgataggtctttttcggtagttggctttgctgcatcactaaaaccacatgctttcgatggttcaaattataaaagatggaaagcacgtgcacttttgtggttgacggcga

SEQ ID NO: 29966 - DNA, 1501 bp, Oryza sativa
taagcctatctccctcgatgcacagtctatcacattacgtggtagccccttggtaaactgatctgccaaatttttagccatctggacatagtccaatgctatcactccggagtttttctgctttctgacagacttcagtcttcttttaacatgcctggatgacttcatgttgtcctttgaactgttcactttaataatcactgtttgattatcacagttcatcaggattgctggtactagtttttcaaccaccggcaagtccatcaggagctcacgaagccatttggcctcaactgtggcagtatctaaagatgcgagttctgcttccattgttgacctcgttaagatggtctgcttgcaagacttccaggaaacggcgccccttccaagtgtgaacacatacccacttgtggcctttatctaatcagcatcagatatccagtttgaattactatagccctccagtacttttgggtacccagcgtagtgaactccaaagctcattgtcccttttagatagcacattactctttcaagagcatgccaatgatcatctcccggatttgaaacaaaccggctcaacttgctcacagcaaatgagatgcaggcctcgttgcactagctaagtacatcaatgaaccaataatctgggagtatctcaattgatcccttgctattcttcggtttttccttaatagcacactaggatcaaaaggagtaggagctgccttgcagtcactataaccaaagcgactcaggaccttgtccacatagtgagattgcacaagtgtaatcccaccctcatctcctctcagtagtttaatgtgaagaataacatcagccactcccaaatccttcatttcaaagcttttggatagaaagtccttgacctcctcaatcacattaaggctggacccaaagatcaatatgtcatcgacatataaacacaagatcactccctctcccccaccatagcgatagtacacacatttgtcagcttcgttcacaacaaagccaacatatgtaagtgtattgtcaaacttctcatgccattgcttaggcgcttgtttgagaccatacaaggacttcaacagcttgcacaccattccctcctgaccttctagtacatacccatctggttgatccatatagatctcctcctccaactctccattgaggaaagctgtcttaacattcatctgatggacaagtagaccatgagaggctgccagagcaagtagtactcgaatcgtggtcaagcgagcaaccggtgaataagtgtcgaaaaagtcctcgccttctttttgggtacaactgtcacgcccagaaattcacgaaccagaatttctaagctgaatgtgtattaaacccctatccaggaccagccagggtacacaaacgacaattgttgacatacagatccacgtcttacaaaaacataaaggattacaaatgcagcggaaaaggtaaaagcgagctaagcctgaagacttgactcctg

SEQ ID NO: 29967 - DNA, 840 bp, Oryza sativa
agttccttcgaacacgtgagtaccacgctcctttcatattattgaggagatcaaactcataagaaaccatgagggcggatccaacattgtagagatggtgccacatgacatcaattaatttttactacacataaatgtaggtcagaacttgtacaatgtatggtttaaaaatatatattgccaatttctacagaacttatggataaacagaaacaaaataaggcttatgaatgaaaaaaaagaaaataattggctggtagaacattttagtatattcatagctagaaaatgtgtaacatagttctgatgttctatagatggcacatctcagttttgataatgaaaggttgctagcacgggtgcaaaacaaaagagtaaatcaagacacctcacagatactctagtctggcctaccaagtccaatagaattcataagcgaaaaatatatgctacaactacgtatgaatatacaagagaacacagttcgtaagtacattctatcagcttgcaattgagttccctctgtagatcagaatcttacctttttccatagggtgttttcaaagtttcaacttcatgtcaaaaaagagaggaaccattcaaaacaaatgatcatatgatatgttactgaagatccatttgaaaagaagttgaataaaaaaggaactaaatgaagcttactggcatcttcttccccgccagggtagggatgcaagcgggccgacccgcgagttcacttataggtcaaataaatcatattttatgggttttcgcgtcggtccagtttaccgcatcatagatatgaaaactcatttatagatcaaattgataggtaacccg

SEQ ID NO: 29968 - DNA, 426 bp, Oryza sativa
accccaatgcctgcgaaaatagttgattttcgcaggtgcgcgctaggtccgcctgcgaaaatagcttcgagcgctaaaaaaaaattgggcagccacccccgtttccggcggtagcttcccgttctcaatccagttcccaccccttccccatccaatccattcaattcatccagttcatccaaaaaaacaccgaatcaattcatcaacagttcatccaaaatcacctaatcaattctaaaagaaagcaaataaaaacattcaacaaatcacggccgctgcccagccttcgtccgccgctgctgcacgtccgcgccgcgccgtcgtccgccaccgccgcacagccgcggcccaccgttgtccgcgctgctgccgcacggccatggcccaccgtcgtcaatgcggatctgggagggaggggcggccggg

SEQ ID NO: 29969 - DNA, 1397 bp, Oryza sativa
acaatctctttttactgaggtctaaagctcagtacttttttcacgtagaatgaatgccctgctgctacactatagatggctgttggctgatgatgaggaatttttttgctttgtgacttcgtatatcaggggatagtggagaagggaaagctggagtcattcaatttaccaatatatgggccctccattgatgaagtgaagacagtaatcacacggaacaagctcttttgtattgaccatatcgagctgtttgagtccaattgggatccctacgatgacttggaacatgatggcatgcacattagccctcaccgtgggatgaacgtcgccaagtgcatcagagcagtgtctgagcccttgctggcaagccattttggcgaatatatacttgacaaactctttcagaggtttgcgcagattgtggagaggcaccttgcgaaggagaacgtgaagtactcggtcatagtcttgtcattgaaccgaagagattagagaagacacatggcacttgagatgattttgtcttttcaagagtctaaagggaaatcatgtttttgttttttgaggaatctaaatagagaaggctatcactcaggatggctatggagtttcgatgcgtgtttaattcttttcttcaatccaaacaacaaataaacaccactgactcctgtaggattttgatttacgaatattacgcaaattatgcatcccctccctgccccactcatccacacacagaaagaaactttgatacaaacaagctctaaatggttaatattgatgaaaatacacattatagcagaatacagcgtatttgattgatgttcatattcatatctatatgtatccgcttagaccggagaactttagatttagttgattcccctccccccccaaaaaaaaaatttaaccatatagtaccattgttcaaccagctaatggtggcaataaccgtctaatcgcactaaattcgacagcacaatttgatatttacaggtgtgtagcgaaaggaaccttcacatcgatccgagcatcttccaaatcctgcatcctgaggtggtaaattgtggttcctgctgctatgctgcacgccgatgtcctcagctagtgaccgatctccatggcgacatttcatcgagcacctagccagcttgtatcagggaacacaaacccagtaagacaaaccaaatcactgctacatataccatagtagtggattttcattagtcccactcagcatcctatgatgttcactaacttctgaagctcaacatgtaagtgtgtcacattatcactcactagtaatttttatctagagtattttaaatcacatgcaagtgtgccacatcatcattcactagcaattattatctataatattttaaatatcatgcata

SEQ ID NO: 29970 - DNA, 383 bp, Oryza sativa
ctaaaagtttcttgcctttggtgtaggatacccaatgaacatgtattaatttgttggaggtgtaatagcccaaattttagctatagtcttaatcatgctaatgacttggtcacactgtttgaaagcagtgttgatcgagccactgtgatgtctaggaccagcctattaatatattgaattgtacaaagtacatgaagatattgaatgagaggtgattgataatatgattgatttaaatgagatgtgatgtagctgaatttcgatatgattaagtttctatattactatatataagagtgtattatactttttttcataaatgaaaaggaatactcactcactcccaaaatatgtagctatctagaaatagctgtatgttagga

SEQ ID NO: 29971 - DNA, 199 bp, Oryza sativa
ttgcatctgatggactattatattgttcggttaaaagtaaaatgagtgtgagggtatggtattttaaaaataaatattagtaggattttattggtgagtgattctcgtaccattttttttctacattattcgctacgcatcttaaatatttcctcctccaactataaaccccccctccctttccttccctctcctccaa

SEQ ID NO: 29972 - DNA, 306 bp, Oryza sativa
tacacattttctagctatgaatatactaaaatgttctaccagccaattattttcttttttttcattcataagccttattttgtttctgtttatccataagttctgtagaaattggcaatatatatttttaaaccatacattgtacaagttctgacctacatttatgtgtagtaaaaattaattgatgtcatgtggcaccatctctacaatgttggatccgccctcatggtttcttatgagtttgatctcctcaataatatgaaaggagcgtggtactcacgtgttcgaaggaactgcatatacaaa

SEQ ID NO: 29973 - DNA, 231 bp, Oryza sativa
taccccacggaggcttacccttacgcctaaaaattgtagaacacccgcttctcaccaccttaggcaattgagagacagaacagatcaactggagcagggaactttatactttgtaaccattgcctactcataggttgcacaggagaaactttaatggtgcccaggcctaagagggggggactctggagagaaaagagaaaagaaaaaaagaaaggggactctggagggagg

SEQ ID NO: 29974 - DNA, 521 bp, Oryza sativa
ttaaaaatataccttttttccctgaatttacattaatatatgacttctaattagcgtgcacaaatataccatgttgtcttcagcatgcggggactattgcttgagaacgcgagggtcagtttaaagacggcatcatataactcagcaaacttgtgagctactacctccgtttcaggttataagacgttttaattttggtcaaagtcaaattattttaagtttgattaagtttgtagaaaaaagaatattttcaactcaagaaaaatttattatgaaaatatatttaattattgatttaatgaagctaatttggtgttacaaatattattatatttatctataaacttagtcaaacttgaagtagtttaatagtcaaaacatcttatagcctgaaacggatggagtactttgctgcatttgagttggcaaatgccgagccaacataataaaccagtgtaataatgtaattaaatccacctacctttctgtataattgtgatcatatttgattgacgacatca

SEQ ID NO: 29975 - DNA, 364 bp, Oryza sativa
atgtcttgcacgggaaaagcggcaataaggtttttggaagcgcttcgcgcgactgctccctgttcgttcgctacggctcgccttcctctctgctcgcgtgctgcgcgccttcgtcaacgcccgcaaccgcgagtagtacctgccgagcaaccggtttttccgccacctcggtacgtgttcgacatgttgtgcatatttgatccgttcatgttttactgcttagtttacatgtgtagatctaatgatgtgttcatgctagtttacatctgcaatgtcatgatttatttatggaataaattaaatcattatgtgcttataatttctacaatccaaaaaccttattataggcgctgtgattttacta

SEQ ID NO: 29976 - DNA, 427 bp, Oryza sativa
ttcagtgcatcccacaactccttagcgtcagtcaaatgcatatacacctcgaccagacgatcgccaagaacgctaagaatgcatcccacaaagagagtagtggcttcctcgaattgcttctgctgatcagcagtaagaactccttcaggtttgccagtactcacccagaagcatttcatagctgtcaaccacagagtgaccctgatctgccatctcttaaagtgcacaccggtgaatttatccggcctcagtgcatcggcaaaaccagccatagtaaaatcacagcgcctataataaggtttttggattgtagaaattataagcacataatgatttaatttattccataaataaatcatgacattgcagatgtaaactagcatgaacacatcattagatctacacatgtaaactaagcagtaaaaca

SEQ ID NO: 29977 - DNA, 212 bp, Oryza sativa
tgaatggctcaattcggagttcgaatgaatagatatgaattttagaaggttttgagccattaaattaatatctataattattaccaaattattgcgcaattattaaatattttcacaaaggaaaaggactgccgctgacgttagcaagagagggggccggcgccgacaggcgggtcccaggcatcattggctcaagggggctcggtccacca

SEQ ID NO: 29978 - DNA, 159 bp, Oryza sativa
tcctccgtttcacaatgtaagtaattctaccatttctcacattaatattaatgttaatgctgtaatgacttacattgtggaacggaaggagtagaataaatagccgaaaatgatctaactttaactcatgccacctattatttgacctcctaatccagc

SEQ ID NO: 29979 - DNA, 1501 bp, Oryza sativa
ctgtgaccatgccatgacatctgaaaacacagaggaccaggttggttagctatatttcatactcgttgccctctgaacaatcaatagcgaatcacttctagcaatctgttatgattcatttctagatgcattaatctattctctttcttagtatttttcttggtattttaggttttcttgggacttagttatagaataggattttggagtgtgtttgtggaaaaatttagaagcttcacatactggatgaatttttttagtagttagcgtattggttattggcagtcaaatttttttagtacaactggtaggaggatgagcttatatttggcactattattcaaaagatgttaatctcaatctcccattttactgtacttaatgtttcttaaatgttaaatacttaaaatgggactgcagttggtcactgatggttgcttgatagccataaggaaaagagagacaaaaataattaattcatgcagaggtttcagtcaattgcaaataatatgagattggttgacttaaaattgaggatggtgtggtatgatgagcctctgttgatctgatcattttcctttttcatgtcaggtttgacacctttggattgcataccagaattttccatgttcttcagctctcaataattcatcttcaggtaatatgatggtagtccaggtttttagatgatttgcatcaaggggtgaaaataaattgatcagcactgcaacattgatctttcttatgggttgtcgctttagctaccacaatgcttatttgcaagctcgtgatgtgttgcaaggtctagagtagtctagtgaaacctatgtcataagcgccacaattccaaaccgaacctcccccagtgtactgttcgatgtggctgctatagttcttttactaaaagtatgtaaatttatttgttctatggcttgtgtagaggagaaagggaagtgaggaaaatttgtaagtgaagaatttgacagattgcgacgggcaccagttatgctggtaattttcttgaacctgacactaatttcagggtacgtacattcttaatccaagccacaacaatgtctgagtggttttatatgtcgaccatctgtagtgtcttcttaactgttgattctgtctcaccaagactgaagaatgcatttctcttttacctatgtgtattcagtactatgaggtcagatatgcagatatacttcttctacttcataaatttgtggaatacagataagctagggcgaagataaatatggcaggttaaactatccgtggatataaaatatgtcatcaagccttagatttttcaagattatcaggaagtgtatatttcagactatgtatttactttattttgtttcaagtgatgcaaagccagatgatttttggtcttgtttacattgtatcggtccagaggttttgttccttagaatcatcttcaattgtatgagcaacatattccaagctgctcctttaaaggaatcactcgctt

SEQ ID NO: 29980 - DNA, 269 bp, Oryza sativa
caatgcttattcaaaggattatatgtcttccatagtgaagcagtcttgcactaatactagaagctgctttagagatggagacatcccatcaaaaatctgcaattacccaatgagtgagccattttttccccatgataacttactatttcagatatgtatttctatacatgtggcaccttttcattctagtgtttttttgactgggcttttcattccagtgttgtgcctgaggatcatataaatgactctgatcaatcctccaccttagc

SEQ ID NO: 29981 - DNA, 1501 bp, Oryza sativa
caattcatctgtaggacaggcatataataaaatctgtcagccatcggcaatggcagtgtgagcatttctattttctttacttaccaaacactgtgaggctctcaacagaactggatagggctctctcaatcatttcatggccaaggtacaacaatcctcatctaacttagatgcttcactttcctgattacaagtttacaacatctccttaaaagttttgaaccataagcaaaatttatgtatatgctatatggaaccaaaaccttcaagatcaaactaaaaggtagtctaaggaacaaaatctatgccaaaacggtaacgataactactatatttgaaaaaatacttgataattccaaaaaaaaatatccacgagattcatttgagtaaataatgagatggaaataaaatgtagccttgaaagctattgtaccaatcaacagcattctgtttactcatgttcaaatgaaaaggagcacataccatgcccagagatttggaagtataaaacaactgaagcatcactcaccatggcttccacaatgtccttgactgtttcaaggctgaaatatttttctatagcctccagcctatagtaacacagaacaaatgagatatacatgaacaaataatacatttttcctaatcagtgacatgaacaatgtggatgctatacatacattcacatgaaaattcatcattatttaagaatataaaaaagcatgcaaggtgaccccattctcagcacattcaaagtgcaaccaatgtatattactaccagtcaattatattaccaagcgaacctagctcccaaagaaatatataaaccacagctttacaggtaatgcaaagattcatgaaccacacaaaatagcactcggcttgattaaatgaattaagaactatatgccttataaatatagaactatctattccatatttccatgacagttttgtgtgtctttctgcagaataatgtaattacactgaaatagatgatggtctgagttctgaaatgcagtccaaaacatttttaccaagcaaaggaaagcatcttgattctactataattcccatgctatgtttaaaagaggacaagattatctagcattccagcaacttctgcatatgacatgttaaagcacttaataatacattctcagtttataaattagaaatatatttacttcttatatgtcttacctacaaataatgctattcttatccggatacacaatatcctcatgtatagaaataatgctgtcatcatgctgagagagagagagaggtcatttgtgaagaagagcaatactgattcagaactaatcatcagctgagaaaaataaatcatattatagtttcaggtttgtcactctatttagtaaataatgttgttccacttttttttgttaatgcgtaagttccaatcttagcatacctttgtcgagttaaaatgataactacacaagtttcttctgtctttgacaccttggtctccaca

SEQ ID NO: 29982 - DNA, 222 bp, Oryza sativa
ttggttaatactgattaattactacaactgttttactgctttgaactaccgtctttaaatgcccgctttatgcaaatgaacctttctagccataccttgattataccctgcatcataccccctattccggtatgacttgctgagtacggtggttgtactcagccttactctattttccccaaaaccccagagtttgagtacatgtcagatggtggcttctcc

SEQ ID NO: 29983 - DNA, 243 bp, Oryza sativa
ctaatcacgaaaaacattgttcaacctgcccatgatcgcgggcacggctattcgaatagttttactctggccagaggtgtatcaccactgtacccacaagacacagctccacgacatgtcaccatgcgcctcaataccaccacggtaccttggaaaggaactgtgacagtacccctcgcacaacacaactcaccacagtgcaccattcctggatcataatcaccccctctacaaccagaggca

SEQ ID NO: 29984 - DNA, 337 bp, Oryza sativa
tccaaaatttagttgtaatttgatgagagagaaatagtatgtggggaagaaaggatatatagaaatttggttcatttgcttaacaaggttttataaaatagttgagaaggaaaactctagtgaaagttaatcttaaataatagaaaccaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtaga

SEQ ID NO: 29985 - DNA, 556 bp, Oryza sativa
catcaacactacaggcatatcaatattgtaggaagaagtaattaattatttatttggcttaaaacccaacgggatttctgtacagtagaactctgagtgacataatagtcagtacatgaaaagtattttaaacattacactgttcgacatagtacacttaaaatgagaaggcaccaattacataccacttctggtatttttgtgatattgttaacaagaggctccaatagctctggcttataacatgatgtgacaaaattaaccatgacttctggagctccagtggtgatatttctggaaaattaacaaaaaaccaatgttcaaaagtgttcatcatgcaaaaaaaaaaggtaagaaaagaaatgttcaattggtaacaaaaggttaaaaatttatttgtttggggagggaaacaacatgacttgtttggtcatccctgtcctatcaaataaatttacttttaactgaacaattatagagaatgtgtttgtagaccgagatatttggcagcagctaatgaagccaaatgcactaacttcagtaacatgtttaaata

SEQ ID NO: 29986 - DNA, 350 bp, Oryza sativa
aattctagagttaaaaattattatattttgagatggagggagcatgggtttctagaaagcgtgaccaaaacttgagcaagtaacttcatggaatcttcacgttaaacaatccaaattggagtatttgaaaagattccccatttcaaaaggtagtactccgagtagtaatgattttgctaaacagcagggttcatggccataatgtgacttctgtgattctgtcaagtgggccctcttggacagagcaccttaccaccggtgacaccagcatcatcgtcggttttctctccctccgcgccatctccaccgtccattctccatccgaaccgcgccaccacccgccgccctca

SEQ ID NO: 29987 - DNA, 488 bp, Oryza sativa
tcattatagctatgcatttattttatgcattaatttattgattagccagttgcatcagtatcctcatttgagttcatgaaaaatgttctatgcataaaaatcatcatgctcgagtatttatttgagtcatttgttgctttgtttaatttggatttgagcatgaattggttcctatcccttgtctactttagatgtcagtcctattcctcgatcgcaagcgccgctccgagcttcagagtcgccgcccttagctttattgccttcttagtctgtttgcttgctagttttctgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagcccctgttttcttccttttctcatatttctacctatccccttcaga

SEQ ID NO: 29988 - DNA, 360 bp, Oryza sativa
ttttttttctaaaaccctacactgagctaaaaaaacccgatccgaatgaacgaccaagatttttcccacaagccaaagaggcaaaaccccaaattttcctgaaacaaatccaagcgcaaaagggcatatgcatatgaaaaaaaaaggggttcagagggctcttaggtttccagttggcttgtcctacggtcaaggtcggctctgataccaacttgtcacgcccagaaattcgcgaaccagaatttctaagctgaatgtgtattaaacccctgtccaggaccagccagggtacacaaacgataattgttgacatacagatccacgtcttacaaaaacataaaggattacaaatgcagcgga

SEQ ID NO: 29989 - DNA, 304 bp, Oryza sativa
tttctgcctcaaagcgcttctcttgtaagattgctcacactgcaagcttccttccgcgataagttattttctatgtaagttttcttccggcgtaagcttccttctgtactgagctttttacttacatcttaaatcatccacgttaaaatagattttataacacctacatctgtcgtcaagaaatccacgttattctttaggaatatactatttgttatagcaaaattatactcgaggcgggttgcgctttatttactcctagtctcctactgccaatgcgtgtcgcgtgatcccgtcctctaga

SEQ ID NO: 29990 - DNA, 1501 bp, Oryza sativa
tgttgttctttcatccggccggtacatctcctggaccgtttgatttgaaccggtacctcgagtacttacctcaagttactgcttcaaggatgataaaaaaactcattgatttagaaaaacgatctcttttttatttctttcccgccgaatcacgtacaaaggccgatctcctctcacgtccttaagtgctatgcagcacagcataggagactcttttgggaactaaaactctccgtcaaaaacataaaaccgattctatctacaattctaacaatggtataaaaaagacaagtcttcctcgtactttggtcataattttttgaatacctgccatgaaagaaggctataagcactatccttctcctccatccctatcgctggcagccttctccatgaaagaaggctacaagctcccgtcatcgtcatcgccaggatgactcgggaggagcctgtggaaaaattgggcgctgacacttttaaactgttgtttctcttaaattatttttccaaatcatgattcaattgcaccattaaattcgttgcaattaaatctttaaaacaatttcatacatggatatattccgatgaaaagttttttttaacttactattgaattatgtttaaatgttgcacgatgttccaccaagtatatcggaattgtttcactaagtagatcgaaaatgtttcaatcatttaaatcggacgttgtttcacctaatataataacaatgtttcagcaaataatgaaagaatgttccagttcattgcgacatttgattcatacatagtgaaacattataagtgcactaggttaatcttttttggtggaacaaaaaatgaaacgaattcccttaatagagggtttatgtgtgtgatttgttgcaaaaaatgtttcaattcactgcaacattagatctatatatagtgaaacattgtgagtacactaggtgaaacatttttggtggaataaaaaatgaaacgaattctattaatagagggtttccaaaatatgttggtgatttgttagcggtgttgtcacagaagaaacattgctctcctgcttcggcaccggcaacattagtggtggggagttcaaactcaaagccatggccgttggtggagaaagattttctcgcgacggacatggtgttgtacggctgtatatatcggtcgaggctatccgtgttcgaggcaatctgcccatcagttgaaaactcgagaacactttaatcatcactttttttattcgcctttttccctaatatattagtagtgcaaataaatagaagttcatcgattgctagctttccatatataacttcgtatcagtatgattagaaatacatattagcatggacatgaaattagaaaaaaaaggatgggtatggattaatggataaatatatgtataggcgtgaacatcagagtggaaaaaaaaggtgtattcgaatcggcatgaacagaacatcagaaggaaaaaaaatgcgtattcctatcggca

SEQ ID NO: 29991 - DNA, 1332 bp, Oryza sativa
ttgtaagcaaaataagcaatactaaattatctgggtttctatggttgaattatgcatgtgaaagtagagtattgagtagaaaggttataaataaataacttgtaaaatataggcttaaacgatcaaaatgtgtatagtaacttgccttgctcgatgtcctgagattgactgatattatctaatgtgtcataagattcctcaagaccaagggttaaacatgtaaaattcaaattcaaaagggattcaaataaaatccaaaaataggtaaaaataaaataaaatataaaaatagcaaaagtggtctcaaaagatagagaatgattttagaagaattttggttcaagtttcactggaaatgaatctatattttaaaatatatgggcttctaaagtttgaaaatcaaattaaatgttaaatggtattgtgtgtgggtcccaccgatcagtctctccctctcttctcttcttcaacctccaactgttccccatttacggccggcggcgctagggttagggattatggcagtaataaagggggaaaggtgttgcggccgaagaggggaggtagatagggttccccggcgacggcgagcggcgccggaggggttaatttggtgtgtgagtaacctagcggctagggtggcggtgacatggatgagctgagaaggtgatcggggtggtgagagttaggcatggctcagggaaggttcctagagcatctatgaggtgtctagaaggatttaagtagcttgccgacgttcggcaaggtatggaagatacttgctgacttgcgcctccattggcggtggtcgagctcacgtcggcagtcaagagggtgatgttagtgctaaccaattacgaaaatggaatctaaggagtatgtcgatggttaaaatggaagaactcaccgagataggttgaaccgacggattgcgaccgaaaaatcctctcgccagcaaagaccatagcagagcatgggcgccagtgctcgcctcggtgtcactaggtgtcaacccagagcttcggttagcctttagtatgctagaacatggttgaatataggtgttctatgggttggtcagggtagagggtgcatgaagtggtgtgaagtcgctcgcgcacaaggtgttcgaccggcgggccaggatggttgatcagatggattggtaaagcagagctttggggttgtggggttatggttggtgatactcgatgatggacaaggaaggtattggggtcatacttatagggtcacaagatgtcgatgagctcgggcgccatcaacgccattgatgagctcgaaaattgggtatggcaggggtggtagaggtta

SEQ ID NO: 29992 - DNA, 989 bp, Oryza sativa
atcatggatggattaagtgagctttaaactattttttctcataaaatatttatccaaatcatgatccaattgcaccattaaatccgttgcaattaaatctttaaaacaagaccacacatgaatataacccgatgaaaaaaaagcttattattgaattgtttataaatgttgcatgatgttgcgccaagtatatcggaattgtttcactaggtagatcaaaaatgtttcatcggacgttgtttcaccttatatgaaaataatgtttcagcgaatagcgaaaggatgattcaattcactgcaacatttgatccatacatagtgaacgttacgagtacactaggtgaaacattttaaattgataaaaaaaaatcagatggtcaaatgttgcagttgaccaataagtgaaaaattaagttacatatggtgaaacaaaaaaatagcaactggaacatttaaatattttatgaaacatggtgaagatacacgttgaaacatgtcgctgatacatttgaaacaataagtattaacagactgaaacatatgcttttcttttatcaaaatataatcatacgatatcttgttgtaaagatttaattacaacgaatacaacggtgtgatcggatcatagattgaataagtaatttaagagaaaaatcattttaaagcttgctaaaatacatgcatatatgtatgaatgaggtggagagagagtagtagcaggtagtttcagaaattttgtgaaacacactgaagacgcacattgaaacatatccctatcacatatgaaacatttagttttagcggtttgaaacacatgtttttcttttgacataatataatcatatgataacttgttgtaatgatttaattacaacgaatacaacggtatgatcggttcgtagatcggataagtaatttaggaggaaaaatatttaaagagaggtggaaagaatgaaaagaaacagctaggcatgcatgttacggtaaca

SEQ ID NO: 29993 - DNA, 1501 bp, Oryza sativa
gtggaccgagcccccttgagccactgatgcctgggacccgcctgtcggcgccggccccctctcttgctaacgtcagcggcagtccttttcctttgtgaaaatatttaataattgcgcaataatttggtaataattatagatattaatttaatggctcaaaaccttctaaaattcatatctaattcattcgaactccgaattgagccattcaacttgcaaaattcatctaaaattgagctctacatgtttgtttactttttatataccgttttcttggtttttattagagtttttccttgttttgcgtgccagcgtgtagttctcgtcgtttcggaagtccgcggtcacgaggaaaagagttcggaagatcaaagtgaagaagcaaggcaagtcacacattcccctttagcatgttgatcccaatttacaaatgttttactatttgcaaataaatatgcgtgttttgctaattacatgggatcagggtttacctatctgctcgcttgtgccatatttacttgatatatgtcctttgtcaacattgggtaataaatcgactagctcatgttacttatgtgacctagctagaactatatgcttagccatgcttaattaccactagctcagttgatgggataattacaatattagaccttttagtatcagaatgagctgcgtgctcgagacatctggccatgcttcatggtcataattatccaactaaaatgcgactgaagggtgggctgtgggtgcatggttttgctagtcgcacccatggcaattaaggaccggttcacgggaaaccctggaagaatttctcgtacttaccacaagccagcgtgggcaacggctgggcttgtagtgtagctttcctctagccgacgcatccaggcaagggtgggtgtgatggagcggggcgggccctgcgacggcctctgtcgcttccggattcacctaggcacgagaggggattgcccgctgccttgcgaggagtgggggtgaaacctgaggtgtggtgtgcttggctagagagggtatgcgaaggatcctgtcacgacctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccaccttaatgaatcgactcaatgcactgtagttcaggtgggttggttgggcctgttcatcgtggtgtagcgttgatcagtggagatttaatattaccttaattactcaacagttttagtattttgctcaataaaatgttttacaactgcctttatgcaaatagccacaaaccgtccttgtgtccccttgcacgtctgcatcgttggtgtggcttgctgagtacggtggttgtactcagtcttgctattattcccccttttcagaagtgtagtgcttctgagctgaa

SEQ ID NO: 29994 - DNA, 1501 bp, Oryza sativa
ctatctccaaaccaggaatgtaccattccaaactaggagctaaattaattgccatcaattatcacattattattaatgagtggtgtgggactaatcacgaaagacattgttagacccgcccataaccgcgggcacggctattcgaatagttttactctggccagagatgtaccactgtacccacaagacacaacccactgtcatgtcactgtgtccgcgcagacacgtcaccatggcgagtgattgtgacaagacccctcgcataactcaactcaaagtaatacaccgttcctggatcataatcacccccatataaaacaaggcatagactccccaacgacccccgtgggcttatctccgccacttctcagtctggcacaccacaatgagtcttgctatacaaagtgtccagccgttgcccactctggcttgtggttggcacggttaatgtttcacaaccgaaactcgtgaaccggtccttaattgttatgagcacgaccatcaaaaccatgtgctcacaacccaccattatcaagttttagttggcacattaattaattaaccaatcacgattgaccatcgtgagctacctttaccatgtacatcattaagtaatggtgaaacattagttatcccaatagtgtgctaatgtttctaagcatggctaagcaattagatctaatacatctagttgaaccaatatataaatccaactagtcaaattataacccgaggtaatcaagaaatagggtaatcaatgcaaattggccataacaaagggaataggggttcacaccacccggtgacattcgaaaataaatgtacagttgaaataaatagagaatttaaatataggatcaacatgctcaaaggaattgtgtttgggatctgtgtgacttgccttgcaacattcggtcttcaattaatcttcttgaacacttccggcgcacttgcgaaccttcgaaacgacggaaacgacaagctaacacgcaaaacgaggaaaaatactaagaaactccaaataaacaatacatataaagtaaacaaacatgtagatcatgattttagatgaattatgagacttgaacggcctcattctgacttcatatgaattaattaccaattttacaagattaaacctaattaaaggattaaataaatttaacacaatttatggataattttactatatagatctttattttctacaacttttgcaacttgaaccacattaaaccgagttgcaatgaattagttatgaatttttaaacattaaaccgaattaaagcatttatatagattttaattgaattatgacgcaataaagtattatttttaaaaggaaaagagatttttgcgtcatcaaggacagtccacggtaaaccgggttcacagaagcggtccacggatccaacgcccaagatctaattgacctaaaattgaccgaatcggacgaccgagatcgatccggactaccacgggtctacggctgacaaagcgc

SEQ ID NO: 29995 - DNA, 1501 bp, Oryza sativa
ccggccacacctcactgctctcagccaccccgcggccgccattagctttaccaccgcgagggcaagctcggccgcccatccatttttcccctccaccaccagaaccaccttcctgccataccaccctaccggccgcctttttccgcctccggtcgccgttcggcttcaccctggctgtcgccgcaacgcatcccccggcttcgccgcgtcccgctcttccccgtccgccgcccgatcgccgccttccgccgccgggagccccttctcattgtcgacctgtggagcgccgccgcctccctccgccggctgctctcgccgtcgccgtgcccctcggtgagctccgccacctccctctccctcactgcctccgtttcctctcgccgcttcccgcgctgcgcgccgctgctccctgtgccgcccgccccccgccgttgctggtgactgcgcgccgccgccctctgtggtcggtcgggccagccccggctgtgcccgtgcccggccaccgctctcctcagccgcccgatcggcttgggccgatctgggccgtccatcccgtggacgggcggtggaccgcccttgtggtcccggtccatggtggaccgagcccccttgagccactgatgcctgggacccgcctgtcggcgccggccccctctcttgctaacgtcagcggcagtccttttcctttgtgaaaatatttaataattgcgcaataatttggtaataattatagatattaatttaatggctcaaaaccttctaaaattcatatctaattcattcgaactccgaattgagccattcaacttgcaaaattcatctaaaattgagctctacatgtttgtttactttttatataccgttttcttggtttttattagagtttttccttgttttgcgtgccagcgtgtagttctcgtcgtttcggaagtccgcggtcacgaggaaaagagttcggaagatcaaagtgaagaagcaaggcaagtcacacattcccctttagcatgttgatcccaatttacaaatgttttactatttgcaaataaatatgcgtgttttgctaattacatgggatcagggtttacctatctgctcgcttgtgccatatttacttgatatatgtcctttgtcaacattgggtaataaatcgactagctcatgttacttatgtgacctagctagaactatatgcttagccatgcttaattaccactagctcagttgatgggataattacaatattagaccttttagtatcagaatgagctgcgtgctcgagacatctggccatgcttcatggtcataattatccaactaaaatgcgactgaagggtgggctgtgggtgcatggttttgctagtcgcacccatggcaattaaggaccggttcacgggaaaccctggaagaatttctcgtacttaccacaagccagcgtgggcaacggctgggcttgtagtgtagctttcctctagccgacgcatccaggcaagggtgggtgtga

SEQ ID NO: 29996 - DNA, 390 bp, Oryza sativa
cgaggtacacaaactgacaatttaatatacagattcatcaataatacaacgttacatacttacaaatgaaaagaaaacagcagcggaataacggtctagcgaagctctggctccactcccacaggtagctcaactggggtataagtcaaacgtcttctccttcgcaacttaacttcaactgaggtttgattgattattacaaggtgagcatatgacatactcagcaagccacacagcaaatatgcaagtgcacaaggataccaaaggatagcataatatagggctcatttgcaaaagcaacatttagcaaacagttaataattgtaaaacagtagagtaattaatcatcaatattaatcaacgctgaacaacacacccatgctgcacagg

SEQ ID NO: 29997 - DNA, 863 bp, Oryza sativa
tccagactattttgtgtattaaatccctgtccaggaccagccagggtacacaaaacaataagtaatatacagttccaaacgtaaataaagcgtaaaatacttacagaagatgcacttagtcctcacaccgaaacaaaagcagcagcagtggaaaaaggcgatcctagcggggcttcagctccactccacaggcaaaactcgactggggtctgagccttggtcttctaacctcgtcttcagctcagaagcactacacttctgaaaagggggaataatagcaagactgagtacaaccaccgtactcagcaagccacaccaacgatgcagacgtgcaaggggacacaaggacggtttgtggctatttgcataaaggcagttgtaaaacattttattgagcaaaatactaaaactgttgagtaattaaggtaatattaaatctccactgatcaacgctacaccacgatgaacaggcccaaccaacccacctgaactacagtgcattgagtcgattcattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggtcgtgacaggatccttcgcataccctctctagccaagcacaccacacctcaggtttcacccccactcctcgcaaggcagcgggcaatcccctctcgtgcctaggtgaatccggaagcgacagaggccgtcgcagggcccgccccgctccatcacacccacccttgcctggatgcgtcggctaga

SEQ ID NO: 29998 - DNA, 1501 bp, Oryza sativa
cgctggcgccgcactggtacgccgggaaggagaggaccatgatgctggcacagtgcctgttccggtgcggcggggcagccgtgctgctcagcaacgacccggcccaccgcggccgcgccaagatggagctccgccgcttgtgcgctccaccaccgcggccagcgacgacgcctactcctgcatcatgcagcgcgaggacgacgatggcctccgcggggtcagcatcagcaaggccctccccaaggccgcgctccgcgcgttcgccgccaacctgcagcgcctcctgccgcgcgtcctcccggccatggaaatcgcccggctcgccgccgacctggcatggcagaatctgttgcagcgccgccgccaccgagggcagaccaagctgaagatcaacctcaaggcaggggtggaccacatctgcctccacgccggcggggtggcggtgatcgacgcggtgaagaagagtttcgggctggaggagcgagacgtcgagccgttgaggatgacgttgcacaggtgggggaacacgtcggcgagcagcgtgtggtacgtgctgtcgtacatggaggcgaaggggaggttgaggcgaggcgacaaggtgctgatggtgacgttcgggtcggggttcaagtgcaacagctgcgtgtgggaggtggccggcgacatggccgacaagggcgcgtgggccgactgcatcgacgcgtacccaccggagagcaagcccagcccgttcttggagaagttcgcttggatcaacgacgaagcagccgatgaatcctcctcgccgttctagaggacgtgagacgcattaattggcagtaggagtaaagcgcaacccgcctcgagtatagtttcgctataaaagctcacaaacaatatattccaagataataagggtgtgtttagatcacaccaaacttcccccaaactctaaacttttcatcacatcaaaaacttttctactcacataaactcccaactttttttccaaactaccaactttctccaaacttatccctaaacttcggaactaaacacagcctaacttggagaagcaagctttgcccaaaaagccagcttgcaggggaagcaattttacagtggaaacctctgtcacagcctgattttccgtttcaggatttataaattatttaataaattattaatagaatttatattaaatgttcattaatttacaagtgaagttaaatgtgggaaataaaatttcctaaatttagagcatggatggatttaatttttattaaattctccatgattaattatactctctgaaattttctcggatttttcagagctcaattcctaaatgatacaaagaacagctcagtaattagttaatcaattaatgatctaattataattatgttaagtgcttttcttgtttaaaaatccttaaattataaattgttgtttaaaagaaattattagaaataatcttaaaagcctaaaagagaagatctaattttaatttaataaatct

SEQ ID NO: 29999 - DNA, 841 bp, Oryza sativa
ccacatctgtagcagttatcctgctttcccccagatgtgtcacctataaccttcttgagttcgtcgttaccttaggacttacccttactcttacccttggacatgatacttcccttaccctgcatctcttctcaatgtggccccattcgttcacctaagtccccccatcatcattggcttgtacttcagacactgccatagacccagtaggtcgagtggaatgattcattaaaagaacctcattctacatttctacaactagcaatactaagaagtagtactaagataagctcagagtacatagagtactttgagttcctatattgttattgcaactccatgttgttggggtggaagcagtggcggatccagaaaatcgactcgttggtgtcataacgtgtctattagtgtcatatagtatgttaattatgcttaggtcatagtgttataacatatgaataagcagttttgctataggttttgctgaaagtcgttgatgttgcctgacaccgctcatactactgtagatctgcccctaggtggaaggtggataaggttttctcgatcatcttagcgtcagtgaacttctggtcacataaatgtagagttatatgctactatagacttgtagtcttggaagcgtagggtgatccagtcatgttgtgcctttggggcacaattgatccttgctagtcgaaatgatcattcatggattgccataataccaatggatctttctcggtcatatactcagacttccggtcttggtggagatggtggcgcaagaaatgcaatggccttcctaggctactttgtgccagcctcgggcaacataatagta

SEQ ID NO: 30000 - DNA, 1501 bp, Oryza sativa
cttttatttaatttctggaaaatacattatttaatgatttttaatcccaacgaaaatcggggcgttacagctaggcccatctggcctggctctttgcgcatcttcccccctgaccttctctacctatttctcaggattttgggttgactctcgggtattttgatgaagttcataacccatccttgtatggatacataattctcctcactttagtctagatttcctcccaacatcgaggtttatcacctgctgacggagcatgggggtcctcaccgggagaccgcgcaggcccccctttgccggttcggccgggggcgctaagtgaggttcttcgccctcgatctgaggaacgtccgcgagagaggaagtgcacaagacacgggcgacgtagataggttcgggccgctgggaagcgtaacaccctactcctgtgttctggtggatctgtgcgtgaaggaatacagagagctggagagcgagccagagttcagggtctagcacccattccccttttttctcctccctccagagtcccctttctttttttcttttctcttttctctccagagtcccccccttttaggcctgggcaccctttttatctggtcaggggtcaccacaagggcctccagctgcctaagaaaggaaacatgctttttacaatgagggctagtctacagccggaagtgacctctgacaagcagagcacacgcctcctgccccgctcgcccgcttttccggtggacgcccatttcaaccttcatttaatggccagcgacttccttgccatacttgcgctgaagcctggaatggttctgaccgggactaacataccaactccaggagttagcacgccggctccggctagggacgagagccaggaagctctcatcattccgacgggacggggcgaggcgtgtgacaggccgcctgttgccacctaacccgtgatctgaccggtctgtgaccggtcacacaccgcgactggtcacggaccggataagcgtgcgctgcgtcgcattaaatgcggcgtggcgcgctcgtccaacctgttataaatgcggttaggtgagccccgcagtgctcacctaactcacacacgtggcgccaaaaccacagggggtcggggcgtcgcagccctcggggccgaaacgggggcgccccagccctcagggccgaaacgggagcggcccgacccctcggggagacagagggaggggtggccacttcaccctagggcccgaccccccccccccccgagggggtcaggccacgtgggtgaccgcggctacccaagcctctagtcacgatacccctggccccatgtcaccgacagtagcccccggcgttacgccagggcgatcgcccccctcgagggaagcgctcgggcgtgacgccactccttaggcccggtgacaggtggggccggtccctacaggcgggcagaaacccagcggtcgcaaatcgcgcgcatcagcaagggaaaaccgaccgacaataa

SEQ ID NO: 30001 - DNA, 1467 bp, Oryza sativa
accccgaggtccaatacggtgacaaacactctccgacacctcctatcttccttcttgtagcttgttctcaaatcagaagaaataaagcttccactctcgcccatattttttgtgtttgcctgcttgtgtgctgatgagtagaatagaccgatttctcaacgtcatgagcatgagtctctaccgaccaaaataggtaaacatgtgagaaaatcagtttgttttgatcattttgttctttacatgcaaatcatcattctgctatagttgaaataagcataagaacatcatgataattgaagtaccatcctccgacattatcttagcaattaatacccagtggtggagctggagaggaattgaggggggtgcaccactttgttgtgcataaagcgggataaaaataatacttaagcaaatgaccatataacgagggattgcaatttcggtaattttggacacctcagcaagtgattatctcggccaaaatttttgtttttctcaaaattttatgaagttgattaaaatttagtcaaattcagttaaattatgttaaaatatgccaaaaatcctgaaatttcggtaaaaccaaaatgagtgaaattttagccgaaatcgaaatcgaaaaccctgcatataacacgaacaatttaactgttcataattacagcaccaaataagaagcaataacaaaatgcttaccaaaatatagcgaaagaagttaatatcatatacactcaaatcatcagcccacctgagtatacttaaatcacctacagcataaaagtgagtaaaatcatcaaaatttgcaactgaataaccgtcaaaaaataatttaatgttagatgcattttcctttctcgttgattagggtggtacttgtgaacatattattggtattttgtggtgatttgcttttgagaaatttctccaatacatccgcctgtcatttatagccatgatgcaaaaggagaatagcgatataataaagtcatagccccaaatatgttaatagtgctgtacagttttgcttcaaactgacaaatcctaaccctacaacctagaaaattaataacaacaaaataatttcaaatcttctattctaatttcactaaattcgcttgcaaagatcagattaattaatttatagaaaaaaaaatagagctgaggaaacaagacacaagaaaatttttgaggtcttgcctgttgcgctcaagatcttgaagggaaagaaacatgggtggaattaaatggcgtggcagctagcgagagagacggtcttgggcacagccagaagatgaaccactccggtggcgaaactcatggccggaggtgtccacaccagttcaccgagaggagagaaggaaaggggaaaaagatgcgaacaagaaccacttgccgtcgtgcggcatctgaaacgataaaaaggaaaccctccatccaggcgtgcaaacatttgctcttcctaaa

SEQ ID NO: 30002 - DNA, 438 bp, Oryza sativa
aacccagcggtcgcaaatcgcgcgcatcagcaaagggaaaaccgaccgacaataatgagcggcttcttttaagactgctacattactcgagcagcgcgcgaatcgggacgagccggttcgtttcgcctggagacatgatgatggcgcttttcacggttggcgagcgtagttaatgcgcgcacgatctgccccatctcaaccgccacggccgcacatctgccgcgtgcgccgcaaacgagcgagtgggttagtggaggcgtgggcgcgagaagccgggtatagcattggcaagggtgtaaagacgtcgaggaagggattcgttcctttcctctcgccactctcccccttgccttcgccacttgtgctctaactcttcgtttcctgtgccctacccttgccgcactcgctcgctctcaagctcctcctccgccggcgtca

SEQ ID NO: 30003 - DNA, 227 bp, Oryza sativa
atgacatgcttatcgatgctaaggatggtgcagacgtccatatggacgatgatgaggacaaaccttcttgaagaagagaatggcatatttaaggacctgaagtaatctcctatatgtctcttatatgtgccctacatgcgcagaacatgtagaacttagtcatgaataatgctcctaaagagcatgctaatacaatattaagaaaaactagatattttcatacctta

SEQ ID NO: 30004 - DNA, 174 bp, Oryza sativa
ttgctttacattataaataatgtggtagcgttagaacgaccatattctaagtaaaataagttttactaagtggaagaaacataaagccctgtattactaatctttttaatatacactcaaatcttagtttacatctgctaatatacaatcatgtggccaataccccctaacagt

SEQ ID NO: 30005 - DNA, 1501 bp, Oryza sativa
ggagctcggcgcgcggcgggcacggcgacggccggcggcggcgaccctcccccctcgtcaacgctgcagccacatccccgatccacgccgcatctgccgcatcaccggcctgccctcctggctggaggaggcgaggtcgggccttctcttcgggggcagcagggaggtccggaggtagtgcgtccgcgtcgcagtcccctgccgcatcggtgaatcagcggcggcgtcgcggcgagccgctgggcaggagggtgctcaagtggcttcccgtggagcgccgatgggtcgagcactcatccgccatcatcgagccacaacagtaagctttaatctctgtctgtctctgttgaatgatggttgatcctacgattcatccggtagcactgttccctcgatctgcaagttctggatgcatttacttgcgtatgatgatacttagatctaagtacagttgcaactcctctcagcaatggtaattcttggcatgtgtacttaagtcttattcccctgtcctacagaaagtaaatcaatttatgtagcagagctttcttgccacgctacataggtagagactaaatattctgaacttgtttcattgcatattcatttggagctgtaagtttctgatgaaaagagaaggatgcaagcttgcagttgctctgttgcagatatgaattgcaagctacagagggttgtgtgccactgcgttcaaagatcccattgactagaaagataagtgtcattttcccaccttcttcttactaccttttcctattcttgaacacaaacatttgctacctcaaaatgattttttattcatgtgatccctaagaatattggcatgcagtctgcatacattagatgcttacaccaatactttaattagtagttattaagaaccgcctgtaaaaaaattacattcatgtaggtgatgactgatgaatgagagtgagtgcatcatgcactgtgcatgtttatgctcaatttctaggcaaagagatcaacttgcatctggcaatcaaactagatatctattccattatctaaacatcttgccatgagctaatctgctaaaacagagaagtaatctgctacttctactgtatcttctttcacactgtaattcatttagttcagttcagtgcgctttacagaagcaagcaatttagcattcagcatttctgcttcaattagctggtgaagaatctgatcctgatcagaggctaccctttagactttagcttgctggtttgattccaatccttggttggatgagtggtccaaatttacccagttgcaccagtagttttaacttagcctgaaattaattaacttaagagtttctttcctgtagtgctgcattcagtactgcatttctctgtacttctctctctactgtatactatgtcagtttgttgagaactagattagatttctctctactgtatactgcatttcagtactgcatttctctgtacttacaatgatgtctgttgagtag

SEQ ID NO: 30006 - DNA, 1501 bp, Oryza sativa
ttataaactatataagggatatgtacattttgtgaataatgttataaatcactttgtcggatgaaagaatgacccaaataaaagttataggtcttgatgagttatagaactttgttattgataacattttcagttgaaatcatttagtacttgtaaaatgtcgtttgaatttatcataatatgaaattcaaattgaaactgtgcatacaaagtcatatagaaaaatgatgaaaataaaagttatagatcttgataagttatacaattttgttgttaacaacttttccatttgaaatcatttactacctgaaagattttcttatattttaaaattcaaattttatatagttaaatcaaaatcggatggcgaaatgacaaaaaaaaatttttcacataagtttatttagtatgataaaattcgattagaaattttaatattttaaaattaaattttttccctcctcctccattcaaaatttttcctctcctcttctctcccccctcctctcctgatattttaacttccaccgtccttatcctatcctatcctctcctctcctctcagcctctcactctttcctcctctcctctctctctctctctctcaccgacgggagctgtgcggcgtggcgggctcggcggcgactcgctcggcaccggcggcggccttcgttccccgacctcccatgcgcggcggtggcctcccttccccgacagcggcgggcggcgggctcggcgacggcctgcggcggcggatccggcggcgccgtcctcgggaggcccggatccgccgccctacggaggagctcggcgcgcggcgggcacggcgacggccggcggcggcgaccctcccccctcgtcaacgctgcagccacatccccgatccacgccgcatctgccgcatcaccggcctgccctcctggctggaggaggcgaggtcgggccttctcttcgggggcagcagggaggtccggaggtagtgcgtccgcgtcgcagtcccctgccgcatcggtgaatcagcggcggcgtcgcggcgagccgctgggcaggagggtgctcaagtggcttcccgtggagcgccgatgggtcgagcactcatccgccatcatcgagccacaacagtaagctttaatctctgtctgtctctgttgaatgatggttgatcctacgattcatccggtagcactgttccctcgatctgcaagttctggatgcatttacttgcgtatgatgatacttagatctaagtacagttgcaactcctctcagcaatggtaattcttggcatgtgtacttaagtcttattcccctgtcctacagaaagtaaatcaatttatgtagcagagctttcttgccacgctacataggtagagactaaatattctgaacttgtttcattgcatattcatttggagctgtaagtttctgatgaaaagagaaggatgcaagcttgcagttgctctgttgcagatatgaattgcaagctacagagggttgtgtg

SEQ ID NO: 30007 - DNA, 1501 bp, Oryza sativa
cactaaaatacgtgcaagaaaaaatttgattgtgacccaaagtatttttcataaattctcctcggtttaaaatatgtcctggatgtttacttgaattttcaaagcaccgaaatatttactaagcaaaaaaacaattaacagaatttattaaaaagaaaaactaaaaacaatcctcctttgtcatttgggccaaatccgtactaaagtctgattcaaatccccgccagcccgctcggcctttttcctcctcccattcccttccctctccctcctttctccctcggcccacctcggcccaagctgtgcaaccctcctctactcctccatgggccgcgccactgaactagccggcccagccgccaagctgccccttcccctcctccctccaaccagaagttcatattgcctccctcctctcaattaatttcaaaatattaaaacatcaaatcgaattttatcatactaattgaacttatgtaaaaaaattgtcaaaaacaaaggtatataatttattgagatctaccaattttattttggttatttatccatctaagtttgattgacttatgacaacttcaaataacattttcaaatattaaataatttcaactaaaaaagtcatcaacaacaaagttatataaatcatcaatatctacaacttttgttttggtaattttgctatatgactctgtttcaataatttgaatttgaatttcaaattatgacaacttcaaacaatatttttaaatactaaatgatttcaactgaaaaagtcatcaacatcaaagttgtataactcatcagtatctataacttttattttggttatttcttcatccgacaaagtaatagtaacattgttcacaaaatttacatatctctcctatagtttataaactatataagggatatgtacattttgtgaataatgttataaatcactttgtcggatgaaagaatgacccaaataaaagttataggtcttgatgagttatagaactttgttattgataacattttcagttgaaatcatttagtacttgtaaaatgtcgtttgaatttatcataatatgaaattcaaattgaaactgtgcatacaaagtcatatagaaaaatgatgaaaataaaagttatagatcttgataagttatacaattttgttgttaacaacttttccatttgaaatcatttactacctgaaagattttcttatattttaaaattcaaattttatatagttaaatcaaaatcggatggcgaaatgacaaaaaaaaatttttcacataagtttatttagtatgataaaattcgattagaaattttaatattttaaaattaaattttttccctcctcctccattcaaaatttttcctctcctcttctctcccccctcctctcctgatattttaacttccaccgtccttatcctatcctatcctctcctctcctctcagcctctcactctttcctcctctcctctctctctctctctctcaccga

SEQ ID NO: 30008 - DNA, 1501 bp, Oryza sativa
atggtagctgtgaactaagcagcatgcttggaatggaccaagggtgtgccctggttaactctcttgaggccagtggtggattgagttgaaaacttgagttacttgaggcatacccgctgacattctttcctttttctctgttaaacatctgttacagggattgaggtgagagaggaaacaagccaggaaagaatagaccagaactagagacaggaccttaaaggaactaactcttcttgctgatgtgttgtttgtttcacgtattctgcaagttgattaagcaaacaacctagcatggttacatcacaacccgctgatgcaaaccacgcgctacacacacaagcaaggaaacacacgactaacgactctaccctagagggtggcttaggttctgtgacgggttctcaagatcttcactcctgcttcacagctggcttcactgcttcctccacttcgctagcggatcctgcagtcttctggagtttcggcagacaattgacgacatcttcttcttcacaaagctgaccaactagtactagttgaaatttgaagaaggaagaaagagtaaacattttgcaaatagcacaggggaaaggaggaaaaaggaactttcgcaaatagtttcatttataaaatatgtccttaggttttatccacttggcttatcctacagtcgagatggttctgataccagcttgtcgcgaccgagaaaattaccttttcccgaacgctagtgtactaatccccgtcccaggaaaagccggggtacaccgaacaaacatgatacaaaaggcacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaaggggggggaaaagattgagcaagaatgagtacaaccacagtactcagcaagccacaccggagatgcgtaattaatgcaagggagtacaaggggataataataagggttaagttttgcagtaaaccgcatttaaaagtcacttagttgcccaaagccattttaaaaagacgatcctagagctacacagtgttattaatcaaggtcgtgaaccctcacgaacctgccttaacccaaggcctacgatgattcagaccgaactggcaacccgaccctgggtcccagctcgtcccaagccaacccaggccaaccattccacattttagttgttaagcaaattttaagaattaaaacactaacttgggtacattgctaggcttgcccataaccgagggcgtggctattcgaatagattatactctgatcagaggtgtacatctttacccacaagacacatcttcctcacgtgtaaccacgtgccacataccaccacggtatacggacggaagacatgacatatttcccaacccatccta

SEQ ID NO: 30009 - DNA, 873 bp, Oryza sativa
tttaaaacataagcatttttaaccgttttagtagaaattaaaattgagctacacaaaattaaatgaaaactggttgcggttgaatggttaaggtgaattgaataggttgtgaaattgctataaatttaaaatccttatattttgaaaacttgacataaatatatagtatgaaagaaaagattaaaataagctacatatacagtcatcgaatcgaatctctactattataaaaattaaaaatatttccgtggtccgtcatccgtgtttaatcggttataaaaattgaagatatttccgtggttcatcatccgtgtttgagtcggttttacttttatgtttcggttttaatctatatcttttctcttatctatctcttctctattgttataaaaattgaagatgtttttgccggtattttggtacgtcatccgtgtttgagttggtttttaaatttgttgacttttagaaatatatatccatatttgagttggattttaagctcatttaatttggaaaatacaaaaggagtcgtacaataaatttctttaaaaaaactcgcgtgctaacttgagattaactacggactcctaattgtagcttatgattttctaaaaagaatatccaagcagattcccatagtgaattaattttacgctagttaaatcgtataacaacaataaaattaaaatagcatttacctgttgcaacgcactggcacttttttctactatatctaaaaatccaaactttagcaaaaagatgtaattgagaactctaaaccgactttaattgcttgtggaatcggagtgacgaattagaaaggatagcttcttggatcgtcgaccatgttaattagcagctctatcttgcaga

SEQ ID NO: 30010 - DNA, 1501 bp, Oryza sativa
tatgatttgatcactcttttaaaactttgaccatcaattttatattaagataattctataatatcatttattcttttagaataagcatatgtgatcaaaattttgaaagttttaccaaatcttatactccctccatcacaaataatcatcatataattttttttgtgttattcagaagtgatcaccatatttggtactctctcctacgtgaccttttgtttttcttgcagtactaaatgatcatttgcatgcattattctatctaccattcaactaattgtaattatgatgcatgtatacatcaagcaatatcattggccggcacactacccttgatgcatgcgccggacacaatgttgatccatgccaatttaattaagtggcatgcggggatatactggtatcgctatacataccatatatgatgattatttgtgaatggagcactactagagcgaatcttttgacgtggtatccaatatcacaaatatctcggttagattaaaaactgatactaaagatgatttagtatcggttctaaaagtttaagtccatagaaacatgtatatttagtctggattggtgttactaattgatactaaaaatgtatttttaagtaccgattggtgtaccaaccggtgctaaagatgtcttcagggttagttcaaaagaaaagcatttttattctagttagatgtgtgtagtaggtggaatggttagatgcaatggttagacgcatgagggctaaggtgagagattttgagttaaaatcccacatcccacatatttttttcacttgctatgcatctttaggtcgagatctttcgttccgattctttttttttcatttgctatgcatcttcatatttttttcacttgctatgcatctttaagtcgagatctttagtcccgattcattcatctcggttgctacaaccgatagaaagggagttgttaaccgggactaatcgtttccccttagtggagggagtactaatcattacttcttctatagacttgcaagtatttggaaaaataaatattagtaatttataacttttgactaaatgattacttatgaaagttatatactaaagaccatgtcaaaaaacttatatgctaattttggaaagatgctaattttgggagtatgactgcaggatacagcaaatagcgctgcacgagtttattacccaaaacaacgacaagggtacaaacagggcacggcaagttgcacacatgacgtgtcattttccaaattgcgaaaggaaacatctacagtaatccatatttctatttagggtaaatttagttttttgaccaaaattaattaatactatccgccaccttctctcaactctgaccgctttaatttgcgtgcaaaccaaaccggcctatataaacacacacacactctctccgcaccaaaaccactaaaaccaaaacaccaccactgatcatcactagctttctacttgtagaaggagagagagatcagcaa

SEQ ID NO: 30011 - DNA, 832 bp, Oryza sativa
aatactagtaaagattatctgattttaatttgagacgggggaattatttaccccaaagcacacaaagtagctgcgagatgacactgaaacccacccaccaaccaacacgcttgtcccttttcggtcattattggaaattaatgtaggagtagctaagcttaagcttgcttgtactatatatctagctagatagcgtgtttgcacatgcatatgctccgtacatataccatgaatccaatcagtttctttctgttaagcgacgaccgccgccatgcatttgtctgctagctagctgtccggatcgatcttcgccggcgagcgatcgagctaggaacacgaaggccagctgctaattaccttttatgtagctgcgatctacttcactctccattctctccgtcttactttaatgatcataaaatatctctaagtgattatattatgatttaatgtaagttgtatagttatacttactacgctacatatacttttgataatatataacatattttgaggtattttaaaatcttatgaaaataaacaagagcgatcaaattttgagcttaaatataatatgttaacgtcaattgtttaattagtttttatatatagaaaggttccggtaattacctcgaaactttaatatctcagaacatgatcagcgtatatatatatatatatatatatagtcggaaagaacttcattattctttgcatatatatggaccactgaaacaacacatggccggcatccgagaagtctaattaagagctaatcaacaaaacacacacatgtttttcctaattaacaatcgttgaaacccgtaaatat

SEQ ID NO: 30012 - DNA, 1501 bp, Oryza sativa
acggcgtgcgccaggaggagcacggtgaccaaggcaagcagctccattgctgatctctctctccttctacaagtagaaagctagtgatgatcagtggtggtgttttggttttagtggttttggtgcggagagagtgtgtgtgtgtttatataggccggtttggtttgcacgcaaattaaagcggtcagagttgagagaaggtggcggatagtattaattaattttggtcaaaaaactaaatttaccctaaatagaaatatggattactgtagatgtttcctttcgcaatttggaaaatgacacgtcatgtgtgcaacttgccgtgccctgtttgtacccttgtcgttgttttgggtaataaactcgtgcagcgctatttgctgtatcctgcagtcatactcccaaaattagcatctttccaaaattagcatataagttttttgacatggtctttagtatataactttcataagtaatcatttagtcaaaagttataaattactaatatttatttttccaaatacttgcaagtctatagaagaagtaatgattagtactccctccactaaggggaaacgattagtcccggttaacaactccctttctatcggttgtagcaaccgagatgaatgaatcgggactaaagatctcgacttaaagatgcatagcaagtgaaaaaaatatgaagatgcatagcaaatgaaaaaaaaagaatcggaacgaaagatctcgacctaaagatgcatagcaagtgaaaaaaatatgtgggatgtgggattttaactcaaaatctctcaccttagccctcatgcgtctaaccattgcatctaaccattccacctactacacacatctaactagaataaaaatgcttttcttttgaactaaccctgaagacatctttagcaccggttggtacaccaatcggtacttaaaaatacatttttagtatcaattagtaacaccaatccagactaaatatacatgtttctatggacttaaacttttagaaccgatactaaatcatctttagtatcagtttttaatctaaccgagatatttgtgatattggataccacgtcaaaagattcgctctagtagtgctccattcacaaataatcatcatatatggtatgtatagcgataccagtatatccccgcatgccacttaattaaattggcatggatcaacattgtgtccggcgcatgcatcaagggtagtgtgccggccaatgatattgcttgatgtatacatgcatcataattacaattagttgaatggtagatagaataatgcatgcaaatgatcatttagtactgcaagaaaaacaaaaggtcacgtaggagagagtaccaaatatggtgatcacttctgaataacacaaaaaaaattatatgatgattatttgtgatggagggagtataagatttggtaaaactttcaaaattttgatcacatatgcttattctaaaagaataaatgatattatagaattatctt

SEQ ID NO: 30013 - DNA, 315 bp, Oryza sativa
aaaatgaaatctcttggttatatgtgtttttcttttttcaaccttgccctgtgatttactcgatttgtctgcatattggtgcttgtgtgatggatttggaggggaacttgtagccattagttgcttagaagtcgagggtaactgattgaccagcttgcttgttctgtagtttaacgaattttgcaccgattgcaatcaaaatttgtttcgggtgtacttagaattgggagaatgacaagggaggtaaccttgaatcatagatcaacaaggtaaccatggtgttgtttgagctaatgaacagtattcccttagcac

SEQ ID NO: 30014 - DNA, 1501 bp, Oryza sativa
actttgttgcgatatagttgtagcctatagcgacgggatgcatgttgatgccataacctagaagcatatagccacaatccatacttagttgcgatatccttcgagcgtatagccaccggttacatgttgaacttagttgcgatatccttcgagcgtacagccacgggttacatgttgttacgatacacgtttggtgtatggcaacgactctaacttcgttgcgatatccttcaagcgaatagcgacgatttactttgttgtgatatcctttaattgtatagcgacgagtcctacgtcgatgtgatatcctttaagcatattgcaacaccgtacgtgttattgccacttgcaaatatcgttgcaatatacaggattgcaacgaaactgaaacgttgtgataattcttgtttgcaactatctaacgttgttgcgataacaactattgcaatgtcaactcgaacgctaaatatcgttgcttcttcaatctttccccatgcttcgtctcgttgcaacagcccgattttatggcaacgcgtgagcactcgttgcgataccctatcgcatcagaggtacttgcaacgcatgccaatgaaattttttcgttgtgatttctctgtattgcaacgaaaacacccatatcgcaacgatttggcgccgtggtgctaggccgatttccttgtagtgtgtgctcttgctctttctgcagtcatgaagagaagaatcacgggtttgttcaagaagggatcaagctcatgttcaagtcatcaccaagataagtcgagtacacactcttccaccgatgtctccatggaggaggtggacacctcgccaaggcttctcgatgactccaacctcgacctcataggagaccgggagatgcagggctatcacatgctcaaggatcggccatttgctgacaccccagcatacgacctagaacttcttcagaaaataggtacggatgttgattttcgtattgtttggaaggctataggatgggagaaatttgctgtggtagatgagccaggttctcgcttacttacctagaaattttttatgtaccttgctactttgctagaagtagatgatggcatttctttttggtttttctgtaaggagttctatctctcttttaaagaattgagtctgcttttaggttttgacaaaacttgcaaaattaatttttggaaggcagcttccaactctgagaaaaacaagttatgtagaaggcctagatggcatccataatcctactcttagactcatgtataaatggcttggcatgactttatttcctagagctaatcttagacccattcgtgaagataagttgattatcttatttgacatggttagaaagataaaagtttctcttatgtaatacatgattcgccaatggttagaaaatttcaagttttccggtcctattgagtgcacttctttggtttctcgcatagaaaatgcacttggggtaataaggggtgatcaagtcttacttagt

SEQ ID NO: 30015 - DNA, 1142 bp, Oryza sativa
taaagaatcctcatagttccgtccgattagtttcacttccttgtgcaagaaccataaccgccttagggtcctcatctctatcatgtttagaaggttggttgtggatgcttttatttatcataaatattgcaaatcttgtatgtgtctgtggcactaatcttgcagcgagatgtctccatggtcgagcttgtgaccataaacaaagcaatgccgggagatatcccggattatcttggtaacttttctttccaataaaagtaagaatcagtttttaggatattatgcaccttcgggtattcttagtcagtaaccatttcaggctgagattaagaatgagggacgtacgatgcctaagaacataggaactacatcaactgctcattttggtgatccttggtgttggtacacaccttataaagatcccagtctcacacacttgatttttgacgtctcataacgcaaaagtccaagtgtgggggaggaatgtcgacgagcttgcatgacaagttccatcaaccaaggccaccttgtttgcagttggcgttagtcttaccttgcagataaaaaaagaaaaaaaagaagaaaaaaagaaaaaaagagagacagaagataaaaaaaagaaatgaaagatgggacaagaggaagagagcaagagggctgacgggctacatctagttcaaagaccgcattatgtgcgagtttttaaaataggccatacacctcgctagtagcgatcatgctacctcgctacaccaagcccctctcttgagctcatgtgccaccttggcttagccttcatccactcctagttgtgcacaacctctcgctcctgcaacacctacacacatacaagcaagaggagatgccctcttctttcctaggtgtttgctgctacactctagttggcacttgcatctttgcctaagaagagatgcatcctacgtctctacaaaattttgccaacggaacacgccttcaaggcacaaggttcttgcacccgagatgtgggcataaccgaaccacttgcttgagttggtgtggtcaaagtaccttccttcgccacaacccacatcaagacggaggagagattgacaatcacatgtgaccatgccaccgctctagagatttcaacatatacatca

SEQ ID NO: 30016 - DNA, 1501 bp, Oryza sativa
ttgtttttcctcatgtttcgatcagttgtgacaagaaatgatgaatatcctttatagttcaaaaataataaccgtcgcttgaatagaagatcactctttgaggatggctgtgaaaaaacaatagaaacacgaggaaaagaaattgtggaaaatctaaaaatcctgtacatcttcgcatgggaaatctagttgctgagcttaatggttaagaactgtgcaggtcctgctattagcaaaagcacaaaaaaaagaaaggctccacccaaataaagatcctgatatatagaatcgtgtgcgtactgcgtagtgaataaaattcttaaatgccaacctgcaacttataccaatccatgcaaacttgccagcttcttgtgtaactacaaatagatgggaatcaaggaagtccagtagaaggggatttttgtaccctcatggagtccctctagaatcaaatgcaattgtggtgaacagaatacctcatgaagaattggtttgttcattttgaaagcaacgaactattaagctccacttgaagcacatatattcagagtaaaaaaaaaagatgtcaattctccagttcagatactgtagatgtaaaaacacgacagcctaggagatctgcttaactccagtacaggtctaagcccccgactatgtggttagttaaataaaactaaacatatagtcaagaaccgagtggttttacaaccaagcatcatatagcaaagcatatgcggcgttcaataaaacatccagccgactgcttttagctttaatataccaaaaatgaaaatatggaaaggcctgcgtgaaaaacactctaaaggtccataaattcacacatttgataagaatctgagtaagaactctcaaaaagatccatcaaatgtgatataaatgtgataacataacaagtgataagtcaaaatagcctaggctatgactcacaccagaagaataagcatataatatgccgagcacataactgttcaaaaaccagttatctcaacaaacccaaacaacttttgcagcctaaaaagacttacaaaattagtataacacttttctgttgggcacctttttatttgcatcgtagtaattccaaagaatcatctaactgcttcaaaaaggattttgacagcattgggccatattgttgtgagcaaaaatgcctaagtccctaaggatcacaactagccacgctggtaatagaattgggctgaagtactgtacaggcccaggcccattagcactcctgaaaccctagcgaaataaacgccgcaggcacagtgtcgtttcgtcttccctgctgaaactctcgccattttcccccattctcttgctacagtgcaaaaccacaccggcggaaactagggttaacaaatcctcttcgatccatcctcctgagctccacaaaaaccttccgcgcagccaccacatcaagttcccatccattcctagccatatctcgaaccaaatcacaccatctaattcactgtca

SEQ ID NO: 30017 - DNA, 1501 bp, Oryza sativa
gatcgagatgacgtggtgtcatatgatcagttccccttaaatacctcgcgaacgccagaactcctcttgctgctgttaacaatacgtttagagcatatgaggatataagttcatggaacaggtgccacaattgttaataacttaatactgggccatgactaaagccgatgattatcagcaagtcgtggactgcgggtaaagcgtacatctgctgcagtagaatatctttgaaactattcgaatagccgtactcatggagttgagtaccgggactcatatggtacactggttagaaatttaaagtctatatatttataaattcttgctataactcttccagattgtttattactgctttttgcaaagaaccctactatatgccagtgcataacatatttccatgataacttgctgagtattgtgaatactcatccttgctcttataacccctttttcagttatgagtcaagaggagaacccctatggctattactaggatgaccccgataatttagaaaatccctaaaggttatacctccctagtcagaatgtatagaaacttccgctatgtattaattctagttgatcaatttggtgagtacctattattgtaaaacccttagtattgtgaaactttaacgtatgtaatgaagaagcagttatattgtatgtatcaatatttactgatccggggattgatacattaatcatagtcggatccaagtaattaattttgggacccgagaggactggtatcagagcatatgttttgactataggatgaaccttaaggactactaactaagttaagtttgaatttacctcaaccttatttttttaaggggggtagatttaatccacgagcatgcattataatgtcatctgtgtattttaggacaatggcagaagggcatgagcaaaaagttatagaaattgcgattactatccatgataatgactacactgatcaactaatcagcttgatgactaagctgaagataaatgagaagccggaattctattcacatgcctatcaatggggagaacgttgggagtgtgatatgactgtgaagatcaatcccccaagaggtgaacgtgatatgtattacttccgaacacgtcataggtgggataccgtatgagctgcattatatgatgtgtccagggaggcttttctacgtcttaatcatatctatcaagataagctgcaacactctcgctattcttaccatcctatgcgaaagccgggcgaagattactgtactcttcaagacgtggattatcatgaacaaccagtaaaagcaactatgtctatctggatggaagctgcagatgacatgtatgaagaagccctagaacacatggatgtacaacgtaaacgtttggaggaagctgaacgcagagaagctgttctcaaacacaaatatcgtatacttcacgaattatatgaggaaagagaaaaacataattctatcctcaatatttgtgttgcaagagcagc

SEQ ID NO: 30018 - DNA, 1501 bp, Oryza sativa
ctcgctctttatcagcttctacaatttcagcaggggtcaaaggtagcgaagtaattttcttttcattatgcacaaaagtgtatttattactcctaccattgtgtgtagcataattatcatgttcccaaggacgactcaacaaaagtgaacaagcttgcattggaaccacatcacaatcaacagaatatgcatatgagccaatagaaaacgaaaccctgcaaacctgtgttacctttgctcttccggaaacgtttaaccactgaatatggtaaggatgtggatgtgtacgtgcggtcaagccaagcttcttgaccaaatcagaactcaccaagttgttgcagctacctccatcaatgatcacacgtgcacgacggttgttgatgatgaagaaaatctggaacaaattatggcgttgcaacctctcaggctgctgtacctgcgtgctgagcacccgctttacaatgatggtcctataggccgttgtgtcatcacgaccaaagacttcgccgtcctcatcctcaacttctccttcttcctcttcctcttccacgttggaggtggtgatgtagccatcttctgtagcaacatatgcctgttgactagggcaatctttctacacatgcccaaacccttggcaacggtggcactgaatgcgtcccgtcgaggcaacagatgaggcactcttggcgggtacctgcgaagaatttttacctgactctgcttatcatggtggagatggttttggtgccgcagaagctccggatgcagctggtcgcttgctcgctagctgggaaggcacccgaaaagagacggctttgggcagtcccgcagatggcgtcgtgcacggagtgtatgtactcgccttgtccttgccctactgctcacgcccctgcaataacagcattaaacttcggatgatcatatcttgatcatacgaaccctgaattgacccattcaagtctcctaatgtttcttataacctaaagaaccgtgtgctttctttttatgtattgttattgcttctttataaggttgtagctttgcttgtgtgcaacaagaacaattattaagcaacaacaacaattaagaaagtttattaaaaaggaaactaaacataatcctccttttcctttgggccaagtccgtcccaaagttcctttcctctctccctcggcccgcggccgaagtctctcttccccccctctctttttcatcccctctttctcccaggcctcccctcctcctcccggtccacctcttccctcctcttccgcttgggccacccctgccctgtgccggcccagccgaccagccaccccaggccgcctccctcctcccctcgcgcccctctgcacgcgcggcgcacgtgcgcgcctcgcgcctgaccggtgggtccacccacccggtcgtcttcaacctccagccggccgctcctctctgtccctctcctgaaccctagcgccgccatccttcgatcccgctccactgcgcaagttccggc

SEQ ID NO: 30019 - DNA, 1501 bp, Oryza sativa
aaataaataccaaattatgcgaaaaatacaaaattctctaaaatgaatgttttgtgcgcagtgggaaggttctgtccttatatgaatttaggtaaaagaatttctattttatctcatttattttgggagataggaattttacaagtcctaggctacaattatgtcatttaggctttattcgaatttaaaggtagtttctaaccatgttctgtacaatttcatttttttaacaggaaaggtcatgatatactaagttcaacataattggattcatcatttttggagctaaaatgaatttcttatgcattctacaaattataatgcgttctatgttagtagtttcctatatatatagttttagatgtttatctgtacatgatgtgttacttgctgtctatacaaatgaagaaaaatattttattaatctaacaaaaccgagttcataatatttaaagctaatataaatttcctatgaattctagaagttggattacgtgtgtggtgatcacttaactatacaaattattagttctcttcagggtaaggagttattgtgtttataaaactttatgctcatgacaatgtccagggaagtgtgtccaatttaatatattagagtttgccactgattaggctggaatatttaagttgaatgacctttagggaataaagttattaagtcattctacaaaattagttgcctccagtttttaattaatgccatgatacctattatgcaatgcaattaaattccaaaaacacttaaaaggactcaaatcacacaccacactttgtgctaatgcaaacatgaaatatattacgtgtcaaattaaattagaatggaaaagttttaaattgtcctaaattgttatttgagttctagctatgatgggctcatttagatgtctgatgcaaaaattctaggattcctagataggaaaaagtcattctaattctttaggtgcaaaattttaaattttaaattttgggtatgttacagcccacaaggggttcggctgaaccggcaaagcaacggtcagctgtgccactttcaaacaacttgtgggccccatgtaacaccctaaaaattttgactctaaaatatggaattaaaaattcggaataaccaaaaatcttttgaactccggtccccatcggttgcccacttcttattataagccataacggtttattagcgattaaaaaaataatatgcgagtaaaacttttgtatgtatgttcttagtgattgaaaagccaaagttgaaaaaaaaacaatgttgaaaaaatattaaaatcaaattcaaaatcaagttttaaaattcaaattttggctttggtttataagctatagggcaaccgatgaggccctcccttgcatgctagaatttatttgattttatttttcgttttccggttatgtatgggctaaatgaggaacttctaagaatatgcgtgtattttgatttcaaatattatttaattaaagaaccatgattatg

SEQ ID NO: 30020 - DNA, 422 bp, Oryza sativa
atatttaattgtagctcacggtggttaatagtgattggttaattaattaatttgccaactaaaacttgataatggtgggttgtgagcacatggttttgatggtcatgctcatgacaattaaggaccggttcacgagtttcggttgtgaaacattaaccgtgccaaccacatgcccgcatgggcaacggttttaccttttgtatagcatggttcattgcggggcaccagactgagaagtggcggagataagcccacgggggtcgctggggagtccatgccttgtttataagggggtgattatgatcaaggaatggtgcgttgtggtggattgtgttatgcgaggggtactgtcacagctcctttccgaggtaccgtggtggtattgcggcgcatggtgacatattgtggggctgtgtcttgtg

SEQ ID NO: 30021 - DNA, 331 bp, Oryza sativa
cactagcataatatcttcaaatcttggcctcctgtgtcacaccctgaagttcttttcccaagcctaaattgaatttataattgttctcgagaaaataccggtgtaaaagcaagagtgaaaccctaataaattaatgcaaataataatcagaattggcatgtggaatttttcttgagttctacatgtcgaaatgtgctaacaagatttttagtggaattttcagagctctagaaataattttaaccaattaaaattgagcacaagcaatatttaatccctggaaattcatttctgtctttttctttttctttttcccccttttcttttcgaa

SEQ ID NO: 30022 - DNA, 1501 bp, Oryza sativa; identical to SEQ ID NO: 29638

SEQ ID NO: 30023 - DNA, 309 bp, Oryza sativa
gttgcccacgctggcttgtggtaagtacgataagttctcccagggcatcccgcgaatcggtcctccttaaattccatgggtgcgaccatcaaaaccatgcatccacagcccaccatatggtatattttaattgactaacaccaagacggtggctttaatccaacactaacactagaacctgaagtctatgcattaatgtgattcccccattgtgtgctagttgaactaagcatggctaagcaatccctagtccaatatctagtcatgttatatcccaagctagcaaaggagcatggtacaaaaatagca

SEQ ID NO: 30024 - DNA, 203 bp, Oryza sativa
tggttgatggttgtgtagtggaggatggttcatggctaattgatgagaattagttactctattcctctttctattccatgactcttactcttcatcttccatttctcatataaaatgagaatggatttgatctccctaagaagaagtgagacacactttcatccatttccaaggctgttgctgctacggtaatcccatcccga

SEQ ID NO: 30025 - DNA, 1501 bp, Oryza sativa
caagtgatcggcataggtgactgtatgcgaaaatcctatttttgcttgctgttgcgctgccagcatagaaagatgttgattttcgcatatacctaggtgcatgcgggccacccagccgacaacaaaaacctgttttagccatttgcaaaaattattttttactagcgtgttgggctagaattagctgcccgtttaagtgtacagtgatgatgatgtgtagataactttatcgtgacgttttaaattattatatttattgaactcgaagtatatgaagcaactagttaagtgtttgttggtatcaacatttgttgagcattgtaacacactcaaaaattaattttagaaaaaaaaacatgttaaaagttttatatttaaatgaacgtttggctttctatcatgtgttgtaaggcttcctttcattttttttgtttggtgtatgagaaaatattgaattaagcctaaaggagccaaaagccgctacagaaaaatgcagtaataatgatgatttcgccagtgtttggggtggggaattcctcaccaaaggcggaacaccaacagatgatctcctggaaaggaaaaatgttgtcttgctccatctctagcaggtccttctccgcattagacatgtcggggatttctctctcctctgtcagttggaaaggaaaggggaagctccgatctaggttttttgggtgaagattgacgtgggagctaaaggagtatggaatgaggtgctgcgccgcgcgatttgtgtgaggtttcggaggtggaggcaaaccctatgattttggtttcagcaactgaatgcaggcggtgaacaagagtgcggaaggggaaattttcggagagaagatgaagcggtggagaaaacggagatttatacacgtgtcaaggtttcggctgttgtactggaccaaggcttggtgcgtttgcatcacattcaatgaacaggtgcggtagagctgcatccttattgggccttggtggttattgcttcggcgatacatgtgcagtatgagcttgataccttaaagaattccttattccctgcaaagtggttttctatcaaggtcaatgcaatgtgatttttgagggaccaaaatcctttttctataaagttcggtgctgattgatgatatttcttttatataagcgatagttgccgactgctacgcgtattttatgcacggttggcctagcgctacatgatttttttctgttaattaagtcgtagttgactttgaactatgcacggttggcctagtgttatgcgtgtcaaattattaataggagaatggtatatcactcgagcaatagcactcagtgattggcaccacatatgctttaatgcaatatgaaaccactcgaatggttatctctttaggattttttactatatgtttagttgagtttcaactaatcatatagtcggagctatacctattaggtgcatctatttagagctagtatgggtaactatgctttaaaagaatctagg

SEQ ID NO: 30026 - DNA, 871 bp, Oryza sativa
ggggctgtcttgtgggtacagttgggcacctctgatcaaagtaaaactattcgaatagccgtgcccgcagttacgggcgggctaccagactcaccgtgattagactcaccctagcttagtctaatggaattgaatagttcagatcgatggttgggcctgttgcaacgaggggtagcgttgaacagtggatagttaatattgatgaattattacaactgttttactgctttcaactaccgttttaaatgctcgctttatgcaaatgaaccgctctagctatcctttgattataccctgcatcatacccctattccggtatgacttgctgagtacggttgttgtactcagtcttgctccattttccccaaaacccccagagtttgagtacgtgtcagatggtggtttctccgaggagtaggctttgtccgtgtcgtcgaggatgcctgtggagtggcgttcccgctgcagttcaagtcaaggcttagctccatttatcttttattttttccgctgcatttatgtaagatttttatgatgtttgtaagacgtggatctgtatgtcaactttgtcgtttgtgtaccccggctggtcctggatgggggttttaatgcacattctacttggaattctattcgggaatttctgggtgtgacattctgccactgtcaaaacttggcctgattggtacaaaagggtattggctagtaaacaaacccactgagaagaattagggatttcacaatgcttagcccttactctagctaacatggattaggatgagccaatgatctcagctgctacttatttctggtccaataccttgaatgcattcttgttcaatcaaggaccgatgacctcatctgctaatca

SEQ ID NO: 30027 - DNA, 1280 bp, Oryza sativa
aaagaaacttttctaaagataaaaggaaaacataatgtccttattggacactaaacatactttcctaaagataaaaggaaactaacaaatactgcctaattaatagataaattgccatgccgcatcctccttgaactcggtcccttatggataagcttccttgaatagattaatttccttaaccgaatcctccaagaatccgactgctagcaacttgataattcccatcggtcgattccaagactctgaaaccgatactgactctaggccgatgatgacttcgggcttaccaaattttggtgttaacaatatccttatgtttctgaatctgaagaagatgatgtctccgaagtagcagcagcagccgaatgggcgagaaacaagaaggttttaacatgttagtcggtcaagaattcggggaaagatgagagatgattttgacatcaccaaggctgataaaatatttaatctactacttcggggaaagcagatccaacttcctactggccactcaatcccatcggttgatgaattagagaaaagaaaatattgtaattggcataacactgggtctcatactaccaatgactgcaaggttttcaggcagcagatccagtcggctattgaacaagggaagataaagtttgatgattcaaagaggccgatgaaggttgatgatcatccttttcctgttaacatggtccatacatctgggacagcagccgatgggaggagtcatcggaattcacagcttaactcagttaggattatcaacaaatatcagaggaggtatgagagacaggaagaaaaatattgtgaagatgatggtggttttgatccgcattgggactacgaattttttaggttttgttggaatgaagagatgagactaccgtcaatagaagactgtccaggatgtagtgaatctaacagggattctgcagggagtttgagccgatcttataaaagggaaagtcggctaagatagaaaaagttgcctgttcatcagagattgggtcggatacatcaggattgctttcagaataaggatgagggcaggaattcgcaatggtgcccttatggcattttcaccaagaatcagaagagaagggtccagaggataaggaacagggagcgttttcaggaagtacagtaggaaatcaaccatcaactgaagaaaacaaggcaagagtggcgtgttaagagtaaggttctaacagccgatgaagttgaagccgacaaagcaaaaaggttaatgaagggtaaagctgttgcatctt

SEQ ID NO: 30028 - DNA, 1501 bp, Oryza sativa
catctgtgacggacaataaacttatctcaatctggcctctagttggagcccgtcagaaatgaccctcatctgtgacgggtttcttttaggcccgattgagatatggaaccctcatctcaatcgggcctcaactatagcccgtcacagataagtgtcatccgtgacgggctttagttttatgccgatataccatggctgtgcgaccatatctcaatcgggcgaaacttcggcccgattgagattacttccttatgacggcccgcaaattccagtcttgttatgggccgtcacagatggaaggatctgtactagtgaggtcagatctatggcgcatggctggtgatgtgcgatggtgatgggtcaaccgatgtgtggactaggagcctgggacgcacggcgtcaaggccgaccacgtcgtcacgtggtgaagcaagccaggatagatgcttactatcgccggctatccaatgctgggccagctgttcttcctcactcctagaagaacatatttcttgtttttgtgggctagcttgatgtgtaatattttttcacccgcatagtgacttctacaatgtttgtattatttactcataatcaaattttcatggttcaaggtaacaaaacgaacggtaacatattgctatttcacatattattctaagataaatgaagcaacaaatgagaattcatgggagtaaaagagaacatgtagtaaaatacatgagtaaaattattactatgaggacatgagtaaaaatattactatgagaacatacgagtaaaaatattactacgaggaaaatatatccgagtaaaaatattactatgacaactcgcaaaatatatgcaagtagaagaattaatgtgagaactatatgggagtaaaaattttactaactttggagagatttttaccaaataagttatgtcacgcccagaaattcacttataatttccgaactaatttgtgcataaaatcctcgtccaggaatcagccgaggtacacaaactgacaatttaatattcaaatccatcataataataataacgttacatacttacaaaagaaaagaaaacagcagcggaattaacggtttagcaatggcttcagctccactcccacaggcagctcaactggggtataagccaaacgtcttctacttctggatccttttttttcaactgaggtttgatgattattgcaaggtgagcatatgacatactcaacaagccacacagcaaatatgcaagtgcacaaggataccaaaggatggcataatataggctcatttgcaaaagcagcatttagcaaagatttaagagtaaaccagtagagtaattaatcagaaatattaatcaacactgaacagcacacccatgctgctcaggcccaaccatccagaacaaccatacccggctgtacagatctaactccaaaccaggagctaaacaaattattaccagttattgcatcaataattatttgtgagaggtatgagac

SEQ ID NO: 30029 - DNA, 1501 bp, Oryza sativa
ctatcccaatcacttgatttaaacatatatcgacgaaagcattatataccattgatatctacagccgattgaatagattaagttctttcttgcctatttataactgccgatcgactcaaatatgacatcggctcaaagataaatgatacgtcatcgacgactggctgatcggctatcgtttatagatttaaccgctattttcctgtctttatttcttgttaattgcaggatcaaatcaactggcacgctcacaaacttaaaggcaagattttttggacctgcactggagttaagcagatctcccaggcctcgtgtttttcgcatcaacaagacccccagtttaatacaccggaaaccccatgtgtcttgcaataccactccctgaatcaataggtggtacacatgtagcacaattgaatatcacaagctgacattgtttacaggtatttctacattaataatactagggtagcccaaacaggtcccaaaatagaccaagcatggtcatatacattacaagataccaaaagaaatagatagggtagcggaagcgaagcagcggcgatccatcgtactccacaggcaacgactggtgaacctagggtctcaaatccattgtcttcgacatgcactcgacagcattgcataaatataatcgactccaattcctttctaaaagatttaaattaagcaagggtgagtacatacgtactcagcaaaccaccactacaaaatgcatctggtgctcacaggggaccaccactacaaaatgcatctggtgctcacaggggttcaaggatggcttggtttagttgcataaagctagttttcacaattcatttcataatcctatgacttagcagttttaactgaaaaacaatgttaatgttgaagttgtcattaatcgagggttcatccaccttcccacgcctcgcattccattttacaccaactctaccatattcccgcacatcgggcaaggttactcatgtcttctcttctctaaactaagcaatgttaaaatctactagtagcatacccgtgctaacgctacggtgacaactaatattgcaaatgaaacaaccaaatgacagcgacacaatatatgcttcatgaatggtacatagaacagatagttaggctaaaaaagcgatagagttattagaaaaaaaattaatcaacatatctatccacaataccatctaggaacaagccatcccttgcaatgctataaagtacaggtattactcctctcaaatacacaatataataaatatctaaaattagcttgacttaagccatccatttcgcttgatgtggtcctgattatctggacaaggttacaaaacaaccaaaacgtatattgtcactctagttatttgtatttacacaaaaaagaatattggtcatttcataacttgaagataaactactgtgataagcaaggtggactcgcttggatgactaacaaatgaacctctgaactaaaattgacgctcat

SEQ ID NO: 30030 - DNA, 1501 bp, Oryza sativa
aaatagtatttgttttaatgactatcccaccgagggtgtccatccataatagtaatatataattttatttacagagcaaatataccagaggggctctattatatagagaagggtttttaggaagataactagtattagggcctgttcactttgataaaaaaaaaccttattaaaatttggcattgccaaaattttggcaactatgccaaaattttggcaacttatcaaaatttttgcagaatttcttatatagttaccaaaatttaacagcaaactaaatatagccacttttttagcaactttaccaaaatttggtaaggttgaaaatggcatcaaagtgaacaggcccttaatatatttcataatcatggttctttaattaaataatatttgaaatcaaaatacacgcatattcttagaagttcctcatttagcccatacataaccggaaaacgaaaaataaaatcaaataaattctagcatgcaagggagggcctcatcggttgccctatagcttataaaccaaagccaaaatttgaattttaaaacttgattttgaatttgattttaatattttttcaacattgtttttttttcaactttggcttttcaatcactaagaacatacatacaaaagttttactcgcatattatttttttaatcgctaataaaccgttatggcttataataagaagtgggcaaccgatggggaccggagttcaaaagatttttggttattccgaatttttaattccatattttagagtcaaaatttttagggtgttacatggggcccacaagttgtttgaaagtggcacagctgaccgttgctttgccggttcagccgaaccccttgtgggctgtaacatacccaaaatttaaaatttaaaattttgcacctaaagaattagaatgactttttcctatctaggaatcctagaatttttgcatcagacatctaaatgagcccatcatagctagaactcaaataacaatttaggacaatttaaaacttttccattctaatttaatttgacacgtaatatatttcatgtttgcattagcacaaagtgtggtgtgtgatttgagtccttttaagtgtttttggaatttaattgcattgcataataggtatcatggcattaattaaaaactggaggcaactaattttgtagaatgacttaataactttattccctaaaggtcattcaacttaaatattccagcctaatcagtggcaaactctaatatattaaattggacacacttccctggacattgtcatgagcataaagttttataaacacaataactccttaccctgaagagaactaataatttgtatagttaagtgatcaccacacacgtaatccaacttctagaattcataggaaatttatattagctttaaatattatgaactcggttttgttagattaataaaatatttttcttcatttgtatagacagcaagtaacacatcatgtacagataaacatc

SEQ ID NO: 30031 - DNA, 436 bp, Oryza sativa
cgatacacagtctagaatacgcgagaaaaaaaaaccaatattcaagcaacaatcaaatatgcacaaacaaaatatatttgttgaggtcgaacctaaggttgctcatattattcgcgcttgctaatggattccaacatgctaagggctaaagtttcttaatctttatgttgtcatgatggtctatataggagctaaccaatgtagtatgaatgagatacgtatctggctactatgtggtttagtctagcaaatggctattcatgcatctatctaaatagaacggttatacactagaggttctgttgccggatggatttggatcggtcaaataattactgtgaatcatttgtattattattttattgatggaggctttattttaattatgtacatattttacttgtcaaaataaattataaaggttaacaattaccca

SEQ ID NO: 30032 - DNA, 1501 bp, Oryza sativa
cgggatcccttccccacggtccacgcccatgaccaggggccgtatgcgggaggagaatgggccatgtcagcgcctcagcggcttctttcctcgctgtcatctcagcgtagatctggcgggtggagttccatcgctaggctgacccaaccgcatgagtgcaagctgcatgtaacatccatttggaaactcataaattagaatggaagcctgaaacaaggaagtaacagagtatttttagtttgtcctacattgaacatgtttttggtttctttgtttgggcaccatcttagcttgtcctacattaaccattggacattcttattctaaagggtgcgttttgtcatgcttatctcaggttttgaaggatgaagataagcgtgaaacatacgaccgggttattaactattttctgtgactatgcatgtgctttttaagtttccgcagagacataaatctatcttcctggtagtttgttttataaatcaaacgaaggaaaagagttatccaaacaacaaaataatatttaaaagcagttgcaccaaacaggactatgataatctgcctcaatgccaaatggtgccttccttactactgacataaatagtgaatatgtgatttgtctttttcgatttgcgatcgattgttctactggattttctgagcgccaagcgtcaggtggtggcccagatgacttctctgggagtcatccatttggtgacattttcactcacgtaagagtggacattcctttagtatccgtaaattgcactggcccgtttttaggttttcaatgtgaattcactctatcttgaaatcatgcatgaggtccatcatttataggataaaatgtgtgatatgcatgcttgattacctgttattctagggctttgaaacacaacgggaatgatattccaccatctcttatggttgatttatctgcttttccaagtgagcaagactaggaggctacctaacagatacgctctccattccgatgccaccagaactctctccaccacgctgtggacaaggtaagcattgctagatctcgttctttcaaccattacaattcaaatgcaaatttgcgaaaatagtggttgtgaaacactgagcaaaccaactaaaggaactccccccaatggcttagacttgaaaaacttgggcaggatggatgggttaggtcaaacgaaatggtctttgtatagtgtaaagaacaagagatgatattgattcttttgtttattgagcttgcaatttagttgagatcttgttggcataagaaactgatgttcgatgaccaggtaatgcttcactatcgagttctgctccatcattggggattttcacacttttgttccccacctcgatgccatatccttcctaaactatataatgctatcttcagatcaattgcacataacttctgattaagtgctgctctatttttcttaatgcattaaattctcgagtcagagcgattttagtgatcaatacaaccagc

SEQ ID NO: 30033 - DNA, 480 bp, Oryza sativa
tgctcttaatcccctaaccaagccaaaacaaccacaccaccgagcgcttcctgcagaatctcctaggacaagtaaggttgcagttctttcctgctgcagggaagagagggagggggaagagaatagatagatgagagatggagtcctcttctcctgctgctattgttgttcttgtgctgttgcagtagaaggaggtgggaagcaatctgacaacaagaaggaaggaagaagaaatccatggctttaaattgtttgtttgattcagaatggttgcaccaagaaagtgggaaatctgggtgttgtgctgaactgatcttagtttgtgaacttactgtagtaaatcgttgagtaatcctctgtttattttgtggtttcttcggtgctgtgagtgtaaaaaacttcactgcagcatacgaaagaatgctatgcagaaacaaatgttcattttttcctattccttgtcttgctaaattataaagt

SEQ ID NO: 30034 - DNA, 632 bp, Oryza sativa
tttacaggtattatttttatttctcaacattttttagtttcttatgctaggcagccttatctgacaaacaatactattcactaattatgttagcatcaagagcaatagtggttaactgattattctatcttttcttaatggcctctaatttacatccccgattgtaagtccaatgtactaactatttcaacacctccttgcaaacgcgcctactagttctttccatttttctaatattctttactagcgttgtttttatttgtgtttagaactttgtaaataacttggacacaatctatactcctttaaaagaagatagtggtggtggcagtgaatctgctaccccacctactcccattgtaaattttgcaaactaccctttgaacttcttaatgttaagaaacaatcaaatctaaatgtatagccatatataagatcaaattaaggttactattattccctatagaaaaatgatgggtaacatcataacacttcatgataaatatatttatttttatgtattttaggcaatataatgtatattttcccgtagcaaagcatgggcatttagctataaacaatatgactgtagttataaatttgattctgttcgtaactgcatatgttttagg

SEQ ID NO: 30035 - DNA, 800 bp, Oryza sativa
cttcgaagacatcatcttcttcggattcaaaaacataaggatattgttaggaccaaaatttggtaagccccgaagtcatcatcggcctagagtcagtatcggtttcagagtcttggaatcgaccgatgggaattatcaagttgctagcagtcggattcttggaggattcggttaaggaaattaatctattcaaggaagcttatccataagggaccgagttcaaggaggatgcggcatggcaatttatctattaattaggcagtatttgttagtttccttttatctttaggaaagtatgtttagtgtccaataaggacattatgttttccttttatctttagaaaagtttctttcttgtccgacaaggactagtatttccccatgggtataaatatgtacacctggagtcattgtaaaatatatctctcgatcaatacaactactctcagagcatcgccaccctctttaccgaggtttttactaatcttctcatggaatttggcacctgacgcggggctgcatcggttcagtttgatctccggcgaaggggtaagtcctacgttccgctggccctggtgaatctaccggctacgttggtattgttctaggctgcaatgcttcgatctcttggatcgctctgttttggttgatatatttgcctatctgatatctcatttctatctctaattacactgtgtttagatacacatcggtttagttgggactgtctcagttaggtctgacctcctgtcttagccaatatatctcaacaatcacaatgctgatgtaaatagatttgt

SEQ ID NO: 30036 - DNA, 188 bp, Oryza sativa
agatacaagaggttgcgcgacgactaacagatgcagtggaagcctcctctcagggcacgttccgaccagacagagatagggacgagctgacactcgccctgcagactccagagcatccaggacgaactcgagggaaaggggtgattccttggaagattggtttcaaggaggacatccacacgtacagg

SEQ ID NO: 30037 - DNA, 683 bp, Oryza sativa
atacactgtgagaggtctttcttgaaaggaagattactatgatctcattaagaacaacaatagtagtgcggcatacacattttttctcaagtttctagtttgcatgaaataaatatcagttatcaatgttgataattcgaaaccacaaacaaaactacatacttattatgccgtaaggctgcactatcaggtcacttcttgctattttttgggttttaaagaaaaaatcatcatacacatggagggtctatattcttattactatgtgaatttggaatgtgagtcttatcctataaattattggaagcatacactaataaaccattttattttatttgcactgtacctcaactctgtagccaagttaaacacagaagtatttaatacagtaatgaccttttcaattcagagcttcgaggcaacattctgccgcggcagggtgatcggttgctgctcggcgcggggtcgtgtcgtcgggggccagctcccatgatccggtggcaactgcagagggcgaggagggaggagagccagtgtggggtcgtgtcgtcgagggccggctgctgcgatccggtggtaggagaggagggtggtaggagaggagggagggaggcgcagagggccggctgccacgatccggtggtaggagaggagggagggaggcgcaggcggcgatgggggtg

SEQ ID NO: 30038 - DNA, 686 bp, Oryza sativa
ggtgacactatagaatactcaagcttgacctcctcaggaaacacttggatgacgacaagaaacgaccacaagtaaccgttaaggccttggactcacacgttacatacgaggtatgcagcaacatgggtcattctgggaatgactgcccagaaactcgtgaggaggcgatgtacatgggcaacaacaacaacgggcatcatccacaaggaggtcaggggtggaaccagccacgcccagattattaggaggtaacaacaatggtaacttctctaaccaacccttcttgaaggatctcgtttctgcgcacaccaaaactactgatgctttaagcaaaaagctagctgctaatgacaagatcctagagaacataaatgcttagttagatggctttgcctccgctttccaaaaccagctgagattccataaaatgatagaaacccaactagatcagttagcttccttagtccctgcaaatgaaactaggaggattctagggcaacccgactcctccgtagaaaatgtcaaggcgatcacgacgaggggaggtaagtccactcgtgattcgccatatcctaaccctgcaggaactaatgggatagccaaagaagcgccatctaatgactcagctgacaaagaggttcagccagaaaagaccgtgccgcagatatactgcgacacacgattgc

SEQ ID NO: 30039 - DNA, 359 bp, Oryza sativa
cccaaaagaattggagagagaaacacctatttaagtacaattctacccttcaatttttttcttttttctttattgttccttatcttttctctctctcattctttctctatttctatttgctccttattcaagcgagctcgaggatggcagtgcagcgaggtgcgggccggtgcggtgccttgactagggagacccagcgcggttgtgcgcgggggatggggcctacttggtgcggcggaggtggcgctagagtaggaggggaggtggtgccgacgcggttagcgttgtcggcctaatgctagggcagctgtggctgcgaggagagcagctttggcctagcgggcacagggcaactgcga

SEQ ID NO: 30040 - DNA, 1278 bp, Oryza sativa
atatatatatatatatatatatatatatatatatatatatatatatatatatatatatatatgtatatatgtatatatatatatatatgtatatatgtatatatatatatatgtatatatatatatatatatgtatatatatatgtgtatatatatgtatatatatgtatatatatgtatatatatatgtatatatgttacttcgcatttatcctaatacatttttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactagggaattggtgcgactcctagcaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttaatcttagcttgtaatattatttgagttttaatataagattattttatttgtaattagatttagtatataattatttactagctagggttgtataatatacgtcacctagacttagcttatatcacgattcgtaattagacttagcacgtaaggttgtgtagggttctaatgtacgacatttacacttagcatacatgacttagattgttaaaacataaatgtctcatgacttagcatatacgcacgaaacacttagcatatacatgactattttagtcttagcatgtaatattatttgagttttaatataagattattttatttgtaattagatttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 30041 - DNA, 1501 bp, Oryza sativa
agcctggcgttggtgctttgtcacgtccagaaatttaacccaaatttccagactattttgcgtattaaatccctgtccaggaccagccagggtacacaaaacgacaagtaatatacagttccaaacgtaaataaagcgtaaaatacttacggaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaagactgagtacaaccaccgtactcagcaagccacaccaacgatgcagacatgcaaggggatacaaggaggggtttgtggctatttgcataaaggcggttgtaaaacattttattgagcaaaacagtaaaactgttgagtaattaaagtaacatttaatctccactgatcaacgctacaccacgttgaacaggcccaaccaacccacctgaactacagtgtattgggtcgatttattaagatgggactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcatgcctaggtgaatccggaagccgcataggccttcgcagggcccatccaaactccatcacgcccacccttgcctgattgcgtcggctagaggaaagctacgttacaagcccagtcgttgcccacgctggcttgtggtaagtacgataagttcttccagggcatcccgcgaaccggtccttaactgccatgggtgcgaccaacaaaaccatgcacccacagcccaccattcagtcgcgttttagttggataattacgaccatgaagcatggccagatgtctcgagcacgcagctcaacaagatactagaaaaggtctaatactgtaattatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaatacccggatcccatgtaattagcaaaacatgcatatttctttgtaaacggtaaaacatttataaattgggatcaacatgctcaaggggaatgtgtgacttgccttgcttcttcacttggatcttctgaactcttatccttgcgaacgcgatcttccgaaacgacgggaactacacgctggcacgcaaaacgacgaaaaact

SEQ ID NO: 30042 - DNA, 1501 bp, Oryza sativa
ggcatagtagggttgcatttgcaaaagcagcatttaacaaacatttgagaatttaataaaacagttaagtattaaacaatattaatccaacgctatacaacataccctgttgtataggcccaaccattctgaacaaccatcccggctgcacagttctatctccaaaccaggaatgtaccattccaaaccaggagctaatcaaattattaccaattatagcatcatttactatggtgagaagggtgagactaatcacgaaagactttgttagacccgcccttaaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccattacagcgcacctttcctggatcataatcacccccttataaacaaggcatggactccccagcgacccccgtgggcttatctctgccacttctcagtctggtgctccgcaatgaaccatgctatacaaaagataaagccgttgcccacgctggcttgtggttggcacggttaatatttcacaaccgaaactcgtgaactggtccttaattgtcatgagcacgaccatcaaaaccatgtgctcacaacccaccattatcaggttttagttggcacattaattaattaatcaatcacgattgaccatcgtgaactatcattaagccatcattagataatagtgagtcataagttatcccaatagtgtgctaatgtttctaagcagggctaagcaattatacctaatatctagttgaaccagtatacacagcccaactagtcaagttataataacccaaggtatcaaggaacaaagtaatcaagatcaaaaagggctataacaaacaataggttaattccacccaatgacattcgaaaataaatgcaatagttgaatagaaaccatagctttaaatgggatcaacatgttcaaagggttgtttgggatctgtgtgacttgccttgctggtcttggaactcttcaaactcttctccggcgaaaacggactctccggaaacgacggaatctaagcagaaaagagcaaaatcaccaaaacagcacataaacaagcatgaaaagtacatgtggatatttttaatatgtagatctcaattttagaaaaatttagagacttgaacgaactaaatccgagctaagatgaattagttatgaatttttaaagattaaactggattaaaacacttaaattgattttaattgaattatgatgcaataatgaattatttttgaaaaggaaaaaaggatttattgcgtcagcgggctagggtttcggtggaccgggcgcacgggcgacggttcacgcgaacggacggccgagatcgatttgatccaaaacggacggccgagatcgatcggtccacgaccggctcacagcgaacggccccga

SEQ ID NO: 30043 - DNA, 1501 bp, Oryza sativa
taaccattctttgtcgttttccgcgcatactttttgaactgcggtgtattttttgtaaaaattttctatacaaaagttgtttaaaaaaatcaaattaatctattttcgaaaaaaattaactaatacttaattaatcacgtgttaatggaccgctctattttttttacggagagaaagagttcctatacaagatctccgaacgcagctatagtactgtttagctgaccattcgccataagtaaattgggcgatgctccggtgctctctgtattatactacaagtagaaaagatttgtaccgttcattattaaagataaattagtaatttattaatataataagggtaacttagccattttccatttttccacctcatggatcggcaggtcgatggcatcaagcccatgcaccttgacttgctagttggctgtgagcctgtggctagctcggcacatcgtccagatcgattccatccagaaattaaattggatcgcaagttatggcggcggcgagtggcaagtcctccgcccggcggcgcgtgttgatcctgccggcgatgacgcactccggtggcgtttgaatcttataaatatgaagatgaaaattaagtgtttcatataaaataaggtggtaataacatgtgattaattaagttataattattacaaactaaaaaaaatagattaattttatattttagagtaactttcatatagaaagttttcacacgaaacatttttttagcagtttaaaaagcgtgccacaaatattcaaaattttattctctcttcacagaggattcgagcggggcctccaccgtgcccctttcttctcgtccacccatccccggcaacccatctgtgccaattttgcacgcatgagcatctctccgatccgttccacgcggcagcggcgcatgggctactaggattagtgagtgtaaatgacaactatacccttccacaaataatttttcctgaacaataatacccctccacgattctactaccgttaagtgaggtggtagtagaaataaatttaaaccctttgatcaagcagtccattagcgcgtgatcaactaagtattagttttgtatcaaactgcgcacggaaaaaggattaatttgatttttaagcaactttgtatcgaaatttttttttaaaaaaggcaccgtttagcagtttgaaaaacgtgcgcgtgaaaaatgagggagaggggttggtaacagcatgaaacgaacgcatctgccctgttcagtcaactgatggatgaagattatatacataaaacgagaacactattaacatattgattaatttttaattattttatacataaaaaagaaataatttatctaatattttgttaaaaagttttcgcataaaatacaccgttcaaaaatatgctaaaaaaatcaaaataaaatacgtttctttggctgtgtttagatctaggaataaaaatttttgccgtgtcacatcagatatacggaaacacatt

SEQ ID NO: 30044 - DNA, 1501 bp, Oryza sativa
cgaggccctcactcggcttccacgtggtggctgagtgggcggagggagaggcgctgccaaacgtcttaaatgagcggtgccccaaccgtccctcgtcgcgtttaatgtgacgtgggcgggcgtgaggcgccgcccgattgacgtgcgtcaatcgggcttgattggtctgtgaccggtcataggcagatgggtggcagcgcacccacgtcctgccccctgtcaggcagagtgggggtaggtatgcctgtcccatcggcacgtagccgagcgtgtccctcgtacacgaatccagaaaagtctccatggaattaagagggaatgataaggatgtctcccgtgtcagccggaggacggcgttgggacccacctgggggcgaacgaccgccttgctttcggtcgaaggcaaggacgacggcttgacccaggacatgtgggccccatccaatgatggactatgtaagacggtgcatgtggtatccccttaaactataaaaggatgaccttgtccacttaaagaaaggacgccacttgagaagcttgagcctagggttagaactcccttgtaacagcacaagcctaataccacgcacaggagtagggtgatacgcttcctagcggctcgaacatatataatcccttgtctctcattctcttgcaaacgacctggtaagctagatccatagcggagatacgctcttgattatcgcgccttatctcccggccgaactcacaaagggcctcgcgacctcccgcttgagaggatcactcctcgacaccggcgttgccgccagacgctggtagtagccgcgcgtgttgctgccgtgcgcggggccacaatgtcccctccgcgagaaggcagagccgctactgagcagaggcgtacctccttcgccgccaacctcataggccaggaccattgccgcgtgagccatttcctctgacaccgggcatagcggtggccagtggcaggctggcagcatggaagcacggaacagctttttctttgttcgcttgactgcgtggccgggtaaatccatgctcttcgaacttttcatgcttgaatgtgggatcccatgctgtttgaatagggactgcaagcttagcagttttagaccttcagtgccgttagatcaaaggatccaacgatcaggatatacgtaggccctgtttggtaggactccaaactccaaggagctggaggttatgtgaaaagtgtttggcaagcttggtctgctccagaactctagaaacagaggatatgagggaggttaacaaaagtacccttgtggttttttctgtttttgtgatgtatgactgataactgtttatttttctttacaatttcagcaacaaaatgcaaggttaaaaattaatccacaaaataattgacataattagtgaaagcaccaagtgttttcttggtttagatctgaaatttgtatagtctaccattttgttctcacttcaatttgtataaacacataatttttcacttctacat

SEQ ID NO: 30045 - DNA, 1501 bp, Oryza sativa
catgccctttgtggcaaggctctcgcctcgcggccttcaaccattcgcccctccaacagggtccatctttggcgaagcttgtcaaattgatgctgcggctttcgcctatgttgtcccttcgaccttcgccgcttgcctccgtcccatgcctttgcctatctcctcggttttggtaggcctggtcgaaggtcctcgtggtatacctccaacaagcccctcacggcaagggtgagtagggagcttcggccgaggctgtgcaaatcgtgtggtataccatgaggcgcctccttccggccgatgttcctgccgaaacctatattttgtacttgcgaaaaagtctggcgttttgcattagcagatctggtgatcaatgttctttcctttcctcgcttattattggtgaaatggttgaatatgttgggattctcgtgaacagtaatgggctagatgagccggtctgccgttactttcggcctttcactgttcggcctgccttaacgtggcagtcccttactgggtggtaggcgaaccgtcgcacgggtgggttatatatatacttccctcccggcgtcactttcacttttacctctagtcactttttccatctcctctgtggctggtatcgctttgtttctccttgcgttcacgggcttttgtcacctacttcggccagcgtgaccttggctcttacatcgggctttccggacttttcgcccatggcccctcataaacctgctcttgctttggccattggtcctgatctggggaagattggcagagatcacaccggatatctcggcgcttcacttatcaatgagacggagttgacgaagctggttttggctagggtcgtggccgaaggacaagccttcgctcctggcaaggtggtggtgaagcttggggacaaccaaaccgtggtctttgctgcattttcgatgcggggcttcgatttctgtgcaacatcttgctgcttgagatacttcggctcttcgagatcgaattgccccaacttagcccgtgcgctctggttcgggtcgccatcttcgactgggcatgtcgaaccgcgggtttcgagccgaccgctgagctttttggggcgatcttttatgttattgtcaactcgaagacggtggtcaccctggccggcacctggaggacggtcttcgggagcacaaactttaatttccgccctgagctctccgatttgtggcccgtgaatgcatcgatgcctaagtgggatcgccattggatgccgaaaaggttttacaacagcattccttttgaggccgcatcggatgcagccaaggccatgaagtggcagcgtagggccatcgtgcgtattcggaagcccaaagtggcgatcgacagtgcaatggaggctcacttcgccccacttcggaagactgctctttggcttagctgtcgtgtcttggtggaagagttttgtatgctttagattcttcccctttcatggacatggcaagtcgaagttgacaaggag

SEQ ID NO: 30046 - DNA, 1501 bp, Oryza sativa
ccgagccttatgtaatcaatctaacactcgttcaatacatcgcccgactcccttttactttcattttgtttcaacgagttcttgctttcgggttgagctgcatcgatttcgatcttcaattagaggtaaaacttgttatggtggcttgcgttctcgggattagtgcttccatctttatgatactctaatctcatttatgtaattcgtcgagttatcatatatcctatatagtctctggcaatatcgttatctaacccccaatcggctaacatctgtcactagaaggcagccgattaggttaaatactgatgttgactttgattatataagatatttaccactgtatgaaacatccaacggcttgattgtctagatattgtccttcttttcatacttatagctgcatcagttgagtttgatcttatacgtcgtgattagaatctcaatctttagcctgcttttggttgccgattacggtagtatcagggtttcagccgatcttacctaatttaactacttcgtactctatatgcttgattgacatgttaaatctgccctttatattacgatcttgttgcatttaagtatattaggcttttgtttagtatattcaacttgctttaatatcttaatatagagtagtatcagagtattagccgatacatgctagatctatctgatcggctatgttatgaacatatatagtcttgttgtgaatatatatttcgatctaagtgatttatactgtctcggcatggcgaccgatctatcccaatcacttgatttaagtatatatcgacataagaattatatattgtaaatgtctatagccgatcgagtagatttagttctttcttacttattcatgattgccgatcgatctacatatgacatcggttcagagataaatgatacgtcatcggcaactagccgatcggctatcatttatggatttaaccgcggtttctttgtctttatttcttgttgattgtaggatcaaatcagctggcatgctcacacacctaaaggcaagcttttggacctacactggagttaagcagatctcccaggcctcgtgtttttacatcaacaccttgtagaagaaacgggagaaaggtgggatcagccctgccatggtgaaggacagaaggtgcacggaccgatccaggtaccgcggccgcggctgcggttcccttgccctcacgacggagccgtccggcatgatcttgcggatgaggctcaagtgtcgctcttccgtgatgtgcgaagacgggagaacaacattcccggcgtgttgagccatggcggccggtgagtatgagcgagaaactgagtaagcgaagcgcggtggtcggaggttgcaacgatagggcgctgaggagcgcgagtgtgagagaaagaatggcgaaaggatgtagatgaattctcctcctccctcactttttattctcgcgtcggccgcgcccgcctcctcgtttttcgtgcccactcgtcctgcttc

SEQ ID NO: 30047 - DNA, 1501 bp, Oryza sativa
tggcacaaaggagagggcatatgctggagttggcgctggagcaggagcttggactggagctggagctgcgggaggaggtggaggcgggttcctgggcgcgagctggatgcgcacgggagctgtggccaacttccttggcatggtgcggatgcgggctcctcctggcggtgggcacccctgcagcctggctacctgcttcttgaggcaactgttctcatcctgcagctcggcgatcctcacaagcttcttgtcgttgagcctcttggtcgcccggtgaagcatagcgtgcagcttgttgtagccttccatcacctcactcatgtggccgaaggtgacgtcgttctctcgccaagctgacttgaaggtgccggtgttggagctggaaccgcgacaagggtggaagcagtaggcggtggtgttcagggtgtcgtcgtgcagctccctcaaatgggccatcatcctgagggcggcctcctcacaagcatgctcaaatgtgccccggcaagctgtcacctccatgttgggtaggtaggaggggatgccgtgaagctccaagcggacctggtgtgggaactcgccactgagagggtggatgctgctgtgctgcggctcccatggaaaaccgatcacaaacgccatgcgggacagctctgcgatgaatcctcccatagtctgaccttggtgtgttaggggacagccggccatctatagaagacaaaggatggagagtcaatgcatgctcaaacccaattataaaattaacggtaaaggactcaaataaaataagcgaataagagcggaattttgtgcatagatcatttttgcatgagagcaaataaataagactgacatacatagcaacaaaataatgaggaattagatacataataataataatagtaataataataataataataataataataataataataataataataataataataataataataataataataataataataataataataataataacaagagcataaataacctgcaacccatattccttagttaggacctaaggcatacctcccattaaatcccgatatgtcccagataattttactaaaaccataggctgacctcatttgaacaaatttcaatgaaacgagcgatcatgaatttttccatgaacccaaggaacaaatccaaattttcccgaaacaaatccaattgcaaagaacatatgccaatgaaaaggattgggagggctcttagggtttctatttggcttatcctactgtaaaggtcggctctgataccaacttgtcatgcccagaaattcccaaatagaatttcaagcagaatgtgcattaaacacctgttcaggaccggccagggtacacaaacgacaaagttgatatacagatccacgtcttacaaacattataaaagtcttacataaatgcagcggaaattaaaagataactggagctaagccttgacttggatagcagcgggaacaacactccacagg

SEQ ID NO: 30048 - DNA, 1501 bp, Oryza sativa
gcctttaggttcgtgagtgtgccagttgatttgatcctacaatcaacaagaaataaagacaggaaaatagcagttaaatctataaaagatagccgatcagctagtcgctgatgacgtatcatttatctttgagccgatgtcatattagaatcgatcggcaatcataaataagcaagaaagaactaaatcttttcgatcggctgtagatattaatggtatataatacttccatcaatatatacttaaatcaagtgattaggatagatcggtcgccatgctgagactgtataaatcacttagatcaaaatatatatattaacaagaagattataagcattcatagcatagccgatcagatagatctagcatgtatcggctagtactccgataccactctatattaagatattaaagcaagcaaaatatatcaaacaggaagcttaatatacctaaatgcaacaagatcttaacataaagtagttaaattaggtaagatcggctgaaacccggatgaaaccctaatcggcaaccaaaaagcaggctagagattgagattctaatcatgacttataaggtcaaactcaactgatgcagctataagtatgaaaagaaggacaatatctagacaatcaagccgttcagtgtttcatagggtggtggatatcttatataatctaggtcaacgttggtatttaacctaatcggctgccttccaatgatagatgttagccgattgaaggttaaataacaaaattgtcaaagattatataagatatatgacaactcgacgaattacataaacaagattagagtatcataaagttggaagcactaatcccaagaacgcaagccgccataacaagttttacctgtagctgaagatcgaaaccgatgcagctcaacttgaaagcaataactcgtgaaaagtaaatgaaagtaagagggtggtgatgcgccgagattgtattgaacatgtgttatttgattacatgggtccgggacatatttatacccgagatacaaaatatgtccttatcggacacgactcttatctctaacaaactctaagattccataagtctttgcggcagacttttgcccaaacttatctctaaggaaattacataaaatgtcctaactaatagatacaattgccttttcaggacttaatccgtgcgtggcaatccatatgaagcacattaactcaacccgacaacgtgtaccgagtcacattgtcgaaatcggctcaatcggctaaccttgtccgactcgaactctaccaattctggtcgtggccgattcggactttagctgattcttgctctgtttccagaacgatctccatcttggattccgcttcggttccatctccgatacttgaattaccaaatttggtcgataacacatgccccccaagtccggaatatttggtaatgtttcggatttgccatttctgcttctccaagaatatcgctcattgccgtttttctgactgtaaccg

SEQ ID NO: 30049 - DNA, 1501 bp, Oryza sativa
tgccctaagcattaaatatggtctctatagttgtttacctatcacaacctgatcactggaaagcaagatacagtcttcgttttcacgttgcattcaggtggagtttacaaatcctgcactagagagacaagaagattggagatggtggcaaagggtttaacagttttggaatgttaatagtcagattagagttccttcaagtctgttagggggcaaatacagccaccgttatcaccgaaggaaaagcgctctgcgccttgtgacctgaacttttcgcagcctaaagaagaggccctatcagggacatgttcagtacatccacttttggcatgccaaattgccaatgccccatcgatgattttcctttgaccggtgatctacacaggcgcttcacaaacacaatcttcaaaatccaacactttgccagttgttaccaacaagcaacgccgttcctgcccatgtgatcaccagcagaaaccatttgggccccgacagccatatcttctgtcatatacaatgactagttagaataatagttgatagctgtaacaaatttgaggcatcagacaaggacgacacaagtgggtggccagtactacgaaagactgacaaattttcgatcaaaacatactgagtcacatccaaaatttctcaatgtttgggcagaatttgaagttccaggtttcactctttctaattatttggttgtgcattataaaaccaaatatactaatgtggctaatactcatcacccttcaaagatactgttaacagtgcaagtagagtctgccagtaacttaccactttcactatctgatgcatcgtcaagtctggctatagcatcgagtaatgactgctcctggtcctacaaggacaaccatttgacctcacaactctcagacgaaggatatctataaggagcttttctccatcatacataattctgtagaaaactgcataacaacagacaagccaactcacttgcgaaagtttcttggccttttcgatctcacccacatttggattgggtgagatccacctcattttgtgtataacacttaatcttcatcttcatctcacctacataagttttaaacaccaccaaaatctgtatcttattgagaaaagaattttgttcttgcactgcttattatctgatgaatccaattgatctctggatggcagtaactgatcgctaactgaattctggtttgtgtaccttgaggcacatgttgaggcaatctctgcagaatcctgcacggatttgagcggttttattgctgctaacacatgcatgttgaatgcagaacacaagaacgtcctttacatgaagtgaataaacgagaatctgatgcagaagctagcacacgaatttcatggcgatttctatagatatatgcaggtggtcaagttcagtgcagatcatcacagtagcttgcattgctgccaaaaaaaaccctaaaaacccaagaaaatggccaatgcaacagtagtagcctcg

SEQ ID NO: 30050 - DNA, 403 bp, Oryza sativa
atcatttttaacttggataatatttagtgtgaagtaatttaaactactcccaaaactttgaatttagtgattttcatcaatctagcaattttttttatttcagtcattatagtgaaggggtatatataatactgaacactaccatctaggtgtattcccgtagaaactagaaagtaagcaaaataattatttttattatataagtttgtgttactcttaatttccctgttctattctcacacaatctatgatacatgttctgcctatgttccaaaaaaattgtgaaacagtttgccttttttttccttgccaattcgtggtggtattctgtaggacttgacattgtaaaatcaccattgcttgatgacacctttttgatttttctgtgtactggcctgacaga

SEQ ID NO: 30051 - DNA, 724 bp, Oryza sativa
ggcttagctggttatcacgacgctgtcatttcttctctgaacgatgacgtactcatttagatgggattcagctctgaacttgtgcagtttttaccacacaatgtttgctggagtagcttttctggccacaaattgaagtttggaattctttggagtatatgatgctccttctgataatgttcagaaggaattttggattagctcaaatcagatgcacatgagttctgttctgtgaaaatgatgagcactatagatgggtgaacaactggacattagaggttgaattgtcatgcttgtggtaaattgatatattcacagacaaacaagatgcagttacatgattttcttgttgtttccaaaaaggaacctgtcatggtttgtgaacctgttgtgtgacatggcttcttgatcttctgatgaggctgaccatccaaaactactccattttctgttagtgttagttacccacttgtgtggctgacaacataccatccacattttgtattcttgaaaatggattgatgtttcattcgtaaggctgaaatgttcctatcactattgctgttggaaatgtccacctactcctattggacatggtttgaatctttatgataactatactgtttatagtagaattgatattgctcccagtttcacctttcttatgctgactactggttacttctttacttttcagtgtttaaccactgcttctccacggatt

SEQ ID NO: 30052 - DNA, 638 bp, Oryza sativa
tgtccttttctttttggctaaataaatccaatgccaaaaaataattggtaaaaaatatattttccacctttctaaaagaggaaaataggagagaaaggaaataggtggtattccttttttacttggacaaataatttaatagtagaaaacaatgggtccatcgtatattacagaaaatcgatggccaaatgttttatttattctcaaattttttgtgatttttctaatttattaaaatgtcatgtggcgacgtaggagcatttgtaggagtgatacgtggtgtcctgagtacgtttgtaggatgtttaatggactatcaatatataatagatgatattaacaggaagcgggctaaggtataaaataacatatccataaatttaaatatagtgctacgtgagattatacagtgccacgtgatggcctaagagcgcttatcgaagcaccacatggctatatttgtagagtaataaattttattgtttatagtatagaagatgatattttaaaaaaccgtctattttttttccgatggttataacatcgtacatatattttccattagggctttatagcatgttcctttgtatttttccatcaagtgagcagtttatcaatgtttgttttttctctatagg

SEQ ID NO: 30053 - DNA, 871 bp, Oryza sativa
tgtgatcaaatggagaggttctcctggggatttgtttcttcttcttcctctcgctctgtttcttctctgttctggttactctgacgaaatggcttagcctgctcttgtgttcttgagcttgctccagacgtgttcttggttttttgtttccttggcgtctgctcttgcattgcaggttcttgtgttgtacaaacaggaaagaaataaagattcaagtgttgtttatctgatgatagtagaagaggtttgcttttcaagtgaaaaatattttctttgctgtgtgctttgctttgcattttcatgattagtgtacccaccaaaaatgaattttatttttcaagtcatcgaagcagttctactgtgatcttgagatgtggggctaactactgctcaaagtgctcgtgagctacgtgggtttctctgcacggcattttgaccaaggcgacctcacttttgctctgaaaaaagctggtgtttcccttttggctgtacaaacaaaacatggcaggcatagtagtagtagtagtagtagttgttgttgcgataagatcaaaataatctctttttttataactaacttgcaatccttgggccttgataaaaatgtttcttgctttctgctctcctctccctttgcatagaaccaaccaacctggccacgcccactggatcttgcagagagtgacataattaaaacagcaaaatgcatttgttaattttttaattttggttgaagtatatgtggctatgtgcatgtctggacctaagcaagaatattcaggcatgcagcttgcagccaagaaagatgtgttctttagagcatttgattagtgaagttaatctgaacatcttactgctgtacattgctagg

SEQ ID NO: 30054 - DNA, 1501 bp, Oryza sativa
agtcttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttccgtaagtattttacgctttatttacgtttggaactgtatattacttgtcgttttgtgtaccctggctggtcctggacagggatttaatacgcaaaatagtctggaaatttgggttaaatttctggacgtgacaaagcaccaacgccaggcttcagagcaaaccaagcaccaaaccaggtcgccatgacatggccacagccaactttcgacccatccatggcggctcagcaagcatcaccaatcgaagccgggcagccgaatgccatggcccaacctcacgcgcaagccgtgatttcgcccttcaccacgctgtacccgcagcaaggtgctgtgaatagggcagggggcgaaaaggggctactgctgagtcggggaatcaagacccgtccgatcccaccccagttcaagttcccacccttcccacgctactcaggtgaaactgacccaaaggaattcctctccatttatgagtctgcgatcgaagcggctcatggcgatgaaaataccaaggcaaaggtaatacatctcgctctagactgcatcgcccgttcttgatatttcaatttgccagctaatagcatttactcatgggagcaattgcgcgatgtctttgtccttaactttcgaggcacctatgaggagccgaagacgcaacaacatctactcggcattcgccagaggccgggggagtcgataagggagtacatgcgtcacttctcgcaagcccggtgctaagtccaagacataaccgaggcgtctgtcataaacgccgctgcggccggtttactcgagggcgaactcacaaggaaaatcgccaacaatgagccacagacgcttgagcacctacttcgcatcattgatgggtacgcaaggggcgaagaggattccaagcgacggcaagcaatacaagctgagtatgataaggctttcatcactgctgcccaagcccaagcacaatcccaggttgccgaaccaccttctctcgctgttcgccaacctcagccggtgatccaaggacaatcaccaaggctaggccaagcccccatgacctggaggaagttcagaattgaccgtgcgggcaaggctgtgatggctgtcgaagaagtgcaagccctccgcaaggagttcgacgcccaacaagcaagcaatcatcagcagccggtccgcaagaaggtctgaaaagacctctactgccccttccacggacgctcttcgcacaccacggagcaatgccgaaacattaggcaacgtggcaacgcgcaagatccaaggccgcagcagggagcaactgtcgaagcaagtcgtgaagtagttcaagaac

SEQ ID NO: 30055 - DNA, 1501 bp, Oryza sativa
acgattatcactactactctagctcatcgccattgctgatggaccaagctctctctctcctttcccctgtacacatgcaatgcaatgccagcgcgctagctagactacgagacggagtagcgccgattcctcgacgacgagctcgacgacttggacgccggcggcttcgccgacgacctcgggctctgcgagctccccgacgtgtcggagctcttgctgaccacctcgccgccgggcggcttcccgccggcccacagcctgtcgaacatccgccgcgaccgcgacgacagcgacagcctgctgctctggttcgccacgctgctcaccctcgccagctgccgcccgtcgtcgccgccgccgccctcgtcgccggcggcggcgagcttcaggctcccgagctgcttcttgagcagcgacggcgtcggcgtcggcagcgcgcgggacttgctccagtccccaccgcctccgccgccgacatcgtcgtcgtcatcgtcctcctcctccaccagaagccgcgcaatgccgccgctcgccgccgccgccgccgccgccgggttgttgccccccgccgcggcgcgcagctgctcgaagaagagcacctgcacgacgacgcggagcgggaggcgatcgttctgcgccgcgtggatgcatgcctccttggacagcttcttcacgtccatcaagctcgagatcttcctcttctccgccttcggcaaattcggatgcaactgacaaagtgacaacagattgcaacatgttcatgtcaaaaataatagtttagaaatcatatagttaacttggaggatgaaaatatgcatcaacatgcaaaataaatcaaattcaagaacaaaaaaaaagatggaaaatgatcactgtttgcatcatgattcttgtcaagcaaatataccttgagaaagacatcaatggcggtgtacagtccatcatgggttgctcttgctgcatcaggcatggaggtcgccactgcaacgaagctcgagaccgacaggtttggatcagaggcgacctcagccaagtatccatcaacaatcttggacagtgcgagcaaagattcatcgtcgacgtcggtctcgaacatctcttgatcaaggttgttgaggaagatcccatcttcagtcactccggctcgcctcatgaacctgccgacgagcgtcagcaccagctgtatgtcgtaggtggtcaacgccggtggccttgccgggatcaggaggtcacagacagaggccttgtgcagctgaaggatcaccctgtccatgagctcctccttcagcatctcaccggagccgatcaggacggcgaccttcagaagcttgaggaagaaccggcatgagcagcacgatgaccccttgtctgacggcagcagccagacgatcgtctcgagcagatggttgtacgccatggagtaggcgtcgtcatcgattgccgcggtgtcgaagcattcaggaagccaccttgaagcataggccttgagagcttccccaac

SEQ ID NO: 30056 - DNA, 192 bp, Oryza sativa
aatggcccagcccaaacattcttcaggaaatttgtactcctaccaaatggattaaggactgtcaacctgtcatcaccaggaatggatcactaatcacttaattaatcagttcatctcagctcaccggtcaggaccagtacttagtaagtacactgtacacgaaacagtggtaggttttccatctcttcaaga

SEQ ID NO: 30057 - DNA, 1501 bp, Oryza sativa
tcgcgtgaaccgtcgcccgtgcgcccggtccaccgaaaccctagcccgctgacgcaataaatccttttttccttttcaaaaataattcattattgcatcataattcaattaaaatcaatttaagtgttttaatccagtttaatctttaaaaattcataactaattcatcttagctcggatttagttcgttcaagtctctaaatttttctaaaattgagatctacatattaaaaatatccacatgtacttttcatgcttgtttatgtgctgttttggtgattttgctcttttctgcttagattccgtcgtttccggagagtccgttttcgccggagaagagtttgaagagttccaagaccagcaaggcaagtcacacagatcccaaacaaccctttgaacatgttgatcccatttaaagctatggtttctattcaactattgcatttattttcgaatgtcattgggtggaattaacctattgtttgttatagccctttttgatcttgattactttgttccttgataccttgggttattataacttgactagttgggctgtgtatactggttcaactagatattaggtataattgcttagccctgcttagaaacattagcacactattgggataacttatgactcactattatctaatgatggcttaatgatagttcacgatggtcaatcgtgattgattaattaattaatgtgccaactaaaacctgataatggtgggttgtgagcacatggttttgatggtcgtgctcatgacaattaaggaccagttcacgagtttcggttgtgaaatattaaccgtgccaaccacaagccagcgtgggcaacggctttatcttttgtatagcatggttcattgcggagcaccagactgagaagtggcagagataagcccacgggggtcgctggggagtccatgccttgtttataagggggtgattatgatccaggaaaggtgcgctgtaatggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttaagggcgggtctaacaaagtctttcgtgattagtctcacccttctcaccatagtaaatgatgctataattggtaataatttgattagctcctggtttggaatggtacattcctggtttggagatagaactgtgcagccgggatggttgttcagaatggttgggcctatacaacagggtatgttgtatagcgttggattaatattgtttaatacttaactgttttattaaattctcaaatgtttgttaaatgctgcttttgcaaatgcaaccctactatgccatcctttgttattctgtgcacttgcatatttgctgcgtgacttgctgagtatgtcatatactcaccttgcaatcattcatca

SEQ ID NO: 30058 - DNA, 211 bp, Oryza sativa
catgtttactcacgacagcagaaaatgcttgatctggctcgtgcttaaatctgacagatcaaatcagctacgtcaaacctgtcactgttcacgaaatcatcttacaattattactgcctctttcaagtttcaaccaaaaaataaatggaacttgagcaacatttccatttttcttctcaactttttgtgtattgttcatgttattttcagc

SEQ ID NO: 30059 - DNA, 1501 bp, Oryza sativa
caggcatacataaagatcatatcggctgaacctctagtgtatacttgtatgaacccctttgcctcacgatatcgattaagctcaaggctagatatgtgccatcctctaatagctcaatcattcactcgaacctgttttgatagattatataacttgtgattgactcctgaatcacctttggcatagccatacacttccataatctacaacatcgaggggcctagagatatctctccataggaggggcaaatcccatcttgattattcctatctcactacatgtttcatagcatacccgaaaactatttttataactacccaattacggagtagtgtttagcagtccctaagtaagctactacacatgttgggaaccatgataatctcaggtctaaggattcaacaccaacactaaatgagattactgatgacacaacacatatgactcttgcaatggctcatgttgggtctatccaacaacatgttcactaacatgtgtctatattattaatttggtatctctataccatgatccatgagacatgatcattaattaatacatgtgctgatcatctaataatttttgttccacatataatatttgatcagggatcctttagaaatagcaacacacaatatacagagtctcgtgaaagaatcatatattcattaaccactatttcaaggagcaaagtcggataaatatgtaaacatactatgttatacaatcatctctatgattgcctctagtgcatatcactaacattaacatactcatgtcattttgttctctatgtattatataatagttagcagtcagagtaaaacaatggcatatatctgtgccagctaatcgagccatatgtttcacgtaaattccactcctaataacaatgttcagcgatataacttatgattttatctggcaatatattccatgtatctttaagttttttcctataggatatatggttattgccataatgcaattacgaaaatattaggtggattagtatggtctaatataattttcatgttctgcttatttcctcttatggatgcaaaattattggtcatgccttcactgcattatatattatgagctcaatctttagtccaaatcgatgtatctaaatttcattaataaatatgaagttgtatccatcttgaatatttcattttatttatttaataacgaaattcaaagttaccaattggtaacatatgattacatttttaaattttataatacaaagaaattgcataatttagtatttataatatataagtgatatatagcccgtgcaaggcacgggttggcggctagtgtaaatctaatataaaaagcatgcaccattagttgatcaagatagccataatcatatcccagctggtcctcatcacaaaaagataggtgctcaagggataaaacttcatagtttgtcgcacattttggataggtaagagtagtttaaaccatgagttttattttttttgcaca

SEQ ID NO: 30060 - DNA, 1501 bp, Oryza sativa
aaacgccgctgcggccggtttactcgagggcgaactcacaaggaaaatcgccaacaatgagccacagacgcttgagcacctacttcgcatcattgatgggtacgcaaggggcgaagaggattccaagcgacggcaagcaatacaagctgagtatgataaggctttcatcactgctgcccaagcccaagcacaatcccaggttgccgaaccaccttctctcgctgttcgccaacctcagccggtgatccaaggacaatcaccaaggctaggccaagcccccatgacctggaggaagttcagaattgaccgtgcgggcaaggctgtgatggctgtcgaagaagtgcaagccctccgcaaggagttcgacgcccaacaagcaagcaatcatcagcagccggtccgcaagaaggtctgaaaagacctctactgccccttccacggacgctcttcgcacaccacggagcaatgccgaaacattaggcaacgtggcaacgcgcaagatccaaggccgcagcagggagcaactgtcgaagcaagtcgtgaagtagttcaagaacaagcacccctagccgaacagcgccaagatgcgtagcgaagagtaatccaagtgattacaagggccgacccgccaagccagttgtccaaacggcagaataagatgcagatccgaacggtccacaacatcacttcggcgggtgcaggggccccgcagtatctaaactagctaatttcttttgggccaaaagacgccgaaggagtaatgttcccgcatcaagatcctttagtgatctcagccgagatagctggcttcgagatccgacgaatcctggttgacagagggagttcggccgatgttatcttcgccgaagcatatgccaagatgggattgcccaccctagcccttaccccagcaccggcctcgctccgtggtttcggtggagaagcagttcaagttctacgccaagcacatttgctggtagccttcggaacgggcgaaaatagacgcgaagagcaagtattgttcgacgttgtcgacatcccatacaactacaatgccatattcggctgggcaaccttgaacaagtttgaaaccatttcccatcacaattatctcaaactcaagatgccgggcccagcaggagtgatcgtggtcaaggggcttcagccttcggttgcctcaaaaggcgatctggccataatcaacagagcagtgcacaatgttgaggccgaaccgcatgaccgggcgaagcacgcggcaaagcccacccctcacggtaggataatcaagatacagattgatgatgccgaccccacaaagctcgtatcgctggagggcgacatgggcaaagaagaagctgagatcatcctagaggtactcaagaagaacattgatatcttcgcctagggccttgatgaagtgggaggtgtttcgacagatctcatcatgcatcacctggcagtcaagccggatgccaagccaaggaaatagaagctacgcaag

SEQ ID NO: 30061 - DNA, 373 bp, Oryza sativa
ttaaagcatgatatttcacatttatagattcatcaaatatagcatacgatacatgcccgcgcaaatgcatgggctacctttcttgttacttataaaaagctcatgcaagtatgcaataccatcaactccctcaattccattttaaatgcaattataagttttactgcctaacagctgaccgtccgtcttatctaaaaaatatgaaaaaataaaaaaataaatcacgcataaaataatattaatgttttatcatctaataatattaatcataaaaaaaaattaaataagatggagaatacaacttcacttaaaatcagacggaggtggtacctttctactgcccaacttgagactattctcatgttgcttcaga

SEQ ID NO: 30062 - DNA, 648 bp, Oryza sativa
cagcagtgcgtggtttcagagaccaagtctcccaacgtgtgtgcacgcactcttcgggatgggattaccgtagcagcaacagccttggaaatggatgaaagtgtgtctgacttcttcttagggagatcaaatccattctcattttatatgtggaatggaagatgaagagtaagagtcatggaatagaaagaggaaaagagtaactaattctcatcaattagccatgaaccatcctccactacacaaccatcaaccaaccatcaattatgagtaattgatgtaggttaccaatggaataggaaaaggaatagagcaactaattgtcattaactagtcatgaaccatcctccactacacaagcatcaaccatccatcaattaggcgtaattgatataagttatcaattccctaatcaaatggattaattctgaaaactcctcatcccattgatatcccataagagaatgaatgcacatgaattcctaacataatgaggcttggaatttatttgatttaattgatttaaatggatcaattacccaattaaatataacactgttgaccaaagccgatgttgctcttattctttagaattacgcaagcacaatatttgagataacctacctagtcgtcgtcgacttggtggca

SEQ ID NO: 30063 - DNA, 1237 bp, Oryza sativa
ttcagtgaaaccttgaagtgtttcgccaaaagctatactaactatcgttgcctttgatccgaaaaagacacatctgaaactcttagtccaaacaaatgtctctttggttactcgcttgattttcttttccatcagcaggttggttattaactcgaggttagaacatggttcctctgaaatgagaccctaggtctcctttgacagtaaacaattatacacataatcccatatcagcatcttccgaaagagtcctcatagaacttgtttttgttacacatttctcccttattacatgaatacaaggccctaccttaaacaaaaagggaaggtgcttaacatcggtacattgcatcctcaacatgaatcatccataaacatagcaaaaaacatgaatatatttatttattacatgattgctgcaaactcccgattacagtgataagtagcgaactgaaaatcacaaacatggatactcattctgattctggagagatatagctggcattgttctagtgactgcatccttgattggttctgtgatgatgtgataggactgcatattgctatcattcacaggagaagcttccttctgattgctgtttgaagcggatgacggtcttttgcttggtatcgccctcctgaggttgattgccctttgctcggcctggagtaggtcggggagagacacaacttcttccatcgacgacaattctttgttgaggctgtcggtgtagagaatggttggtgctgaagatattattgctatgatttattgcagggtcaggtgcagcaggaggagcattggtgctgtggatgatatcgtcgatgttgctgttggagctgactagctgatgagacaatcgtagggttgttcgttggatttctgcggtcttggtcaacaacacactgagttggcaatccttgggcacatggtttgtaccttcgcacagaaaacatgtcaccttgcgggtgggacactccccgggtggatggtcttcttcacaatgagggcagagtgtgagacacctgctagcaacgtgtccaatttctccacaacgggtgcatgcctttgattccatctcttcctcaccaagatgtcggggagactcatcttcatcatccgaggagacttgatctgacccttcactatcagatactctgccaccatggcttaggaggtgctgggtcaactgtcgtgcacctcggaaggtatttcctctttgacgtctaggaatag

SEQ ID NO: 30064 - DNA, 1501 bp, Oryza sativa
taaactctacaggccgccgtcgcagcagggaggcagcggggcaccacacaggcacctgttgcgagcgtagcaatccgcaccgtgcgccgccatgaacctccccgccggaatctcgccgcagagctcgttgtcgctgacgttgaggtgctccagcctgacgtccatcagcgacttggccaccttcccggtgatccggttgtggctgaggtcgaggtacctgaggtggtgcgggaacctcaccccggtcatgtcgaacgccagctcgttccacgacaggtcgatcttggccgccggcgccgcgatcccgaacaggtgcggcgacgggtcgccggtgaggcggttgtgcgagaggtcgacggtgtccacgtcgccgtagcagcgcggtatctcgccggtgagctggttgtgggagaggatcaagaacctgaagctgccgtgcaccagccccggcgggatggcgccggtgaggaagttgccgctgaggtcgaggtaccggaggttggggtggtcgccggcgagggacggcgggatcggcccggcgagcctgctgtcggcgatgacgagggtacggaggttggtggcgccggcgaggtaggacgccggcaccgggccggagatggaggtgccggtgatgtcgaggtcctcgagcagcgagaggttggcgaaggagggcgggatgggccccgacatgccccggacggacgcgatctggaggacggcgagccccgtcagctcgccgagcgccggcggcacgggcgcggcgacgccggcgagggagaagagcgccagcccggtgacgcggccgggctcgccggagcagaacacggcgggctcccacgcgcagcagttggtcgacggccgccacgacgacagcctgacggggtcgcccagctgcgccttcaccctcagcagcgcggcgcggtcgtcgccgttgcactccaccgccgacgagacggcggtgcaggcggacaggacgacgacgacgaggcagagcagtggaatccacgacgaggctactactgttgcattggccattttcttgggtttttagggttttttttggcagcaatgcaagctactgtgatgatctgcactgaacttgaccacctgcatatatctatagaaatcgccatgaaattcgtgtgctagcttctgcatcagattctcgtttattcacttcatgtaaaggacgttcttgtgttctgcattcaacatgcatgtgttagcagcaataaaaccgctcaaatccgtgcaggattctgcagagattgcctcaacatgtgcctcaaggtacacaaaccagaattcagttagcgatcagttactgccatccagagatcaattggattcatcagataataagcagtgcaagaacaaaattcttttctcaataagatacagattttggtggtgtttaaaacttatgtaggtgagatgaagatgaagattaagtgttatacacaaaatgaggtggatctcacccaatccaaatgtgggtgag

SEQ ID NO: 30065 - DNA, 1501 bp, Oryza sativa
ggagaaaattcttgctctaattccaaaccgcaaatttgatacgcagtactctctctataaaaaaaaactcagcatatccagatttgttgtactataattccatcccaaaataaactcgttatgtacaaattcgttatactaggatatatctctatatccaattcgttgtaatatgtccaattctagtacgaggtttattattattttttttacagagggagtaagttttttttagaaaaaaattgattcacagtaaacgtgtaaacgatctaagcaaagtcagaccgtgcactttctttcttttttgacacggacggcaacaaaatgcttgatcctgaaggtgcatgatcctataaagtatgccaagaattcatcaggatgcggattagcccgtgagctgacacgtgggatctgaataattttggcccggattatcggctgcgttggattggtacgggtgaactgtttgactgggcctccttgatgattcgccaatgaacctgtccttgcttccgtgctgaacccgtgtcttcactgtgcggttacaagaaaaagatttgaacgaacagggcatgccactcgtcagaattcatagtttcaaactagtattccctaaattctcaaattcattcatgccgaatgcaaaagctggcactctgtttatcatcaattttttgtttaggaactttgatcaaaggtacaagcacagagataatgatcatatggattgaaattgtaataaggatgatctggaaaactaaagcgtttcatacatctcaatggagctgaaacttcaactaacaaaagagcgagtttatacatggcgaattggagataaataatactactagtagcagtctagcacaagcaacggcctggaaaataaggcgagattattacatcaccttatgagaattccatttgcttccctggggaagcaaactgcacctaccaaatgtattattgagcgcaaaattttaaccaagcagccatgtcaagttgcagtattgcagggggttgcaatttcagcaaattctgatacttcttcacttccggcgagcctccagtgccttcttcaactcctcgctcgcctcattcgacaccggcttcggtccactgtccaccatctccttgccgttcccgtggcgatctggcttcgccaggaatggttgtggtggtggtggtgccagggacgacggcatccttcgggcgtcgcctttaccgggcattgaggcggctctatttccaccgatctcggcacgcaggtcctccacggtacgccgcagcatgatgctctctgcattgagcacctcgagctgcctcttgacgagcgagaacccttcagtctgaaattccggcgcatccttcttcttccccttgtcggcatcggaatgtggaggattccgcagcgtgtgctcaattgtgatcttgttcatgaccagcagcggcaacttgttgatggccaggttacccgccttgcggccgtacccgtcgtcggcga

SEQ ID NO: 30066 - DNA, 1501 bp, Oryza sativa
gccgccagagcgctgcaggcgctgacggggcggtactactccggccgtcctatcattgtcgagttctcgccggtgtccgatttccgggaggccacctgccggcaatatgaagagaacagctgcaaccgtggtgggtactgcaacttcatgcacgtcaaggagatcggcagagacctgaggaagaggttgtttgggcacctgcataggtcccggagaagccatagccatggccggagccgcagcccgagcccgtaccattaccggagggactatgatcggaggagctcatcgcggtccagggaccacgacgattactaccgtggaggtagccacgattactaccgtggaggtagccggaggagcagcgagaggcaccgcagcagctacgacagcgatggcagcaggcggcggcacaggtccaggactaggagtcctgtcagggatggtagcgaggagaggagagctcaaattgagcagtggaaccgtgaaagggaggctgcacaagtgtgatctctggattagttgctgtttgcaatggcccatgtttctcatcttgtactggtagccctagattaaattagcatcatatcttatcttaatgatctgagcttggatgtactcgagattttccttactgaacttgaattttctgtcagatgcatgtgttaactgaacctatttggtgttaaattatatttgtactgatggttgtgtgctttcggttttgttcagcattcggtatgtttttgtgcatgtggtcaggactagctgaatggttgagtaaatctcgagtgatcacgatccacaatgcattccccattcggtagtatgctattgtgcatgtgatcaggtctagctgcagtagaatttgttgacttgtaatgataattgcagcttggagcaccaattgttttttgttttcattcagaggtttcagcacgttgcatcttttagcacctgttagtgagatgaaatgatttacaggtgagatcatttaagttatcattcaaatgtagtagttgatcattcagacgtttcagtatgttgcatcagtgcaggtaaaactaagatgcaggtgggaagagcgacgtaccagctatatttctgaattttctgatatttcggatcttttcatttgtaacctctgaacttatgtttcgcatattttagcaccgtgagttgttatgatacactgccgaactacacatcttcagcgactaggagcaagctagcagcggcctcgtccatgataccagtatatgtttcctacaactgattgttccactgataggatatattgcctatttctcatatctcagacaaccgaagaacccacaaagaagacatctactgcaaataacaatcatctgaacgaaagagctcgataacagatgacaggaaaaggaaaaagaaaaatcatgaacaaaaggaacatgagaaagaaatcagggagcacaagcatgcacaacagattaacagcactgcaaatactgagcaagct

SEQ ID NO: 30067 - DNA, 1501 bp, Oryza sativa
tgaacctattccattcatatttgacatatctcaaaaacacatgctgctgacacttgctacatgggagtgtgttaacacgccaggttttatatgccaagacggatgggaataatcaccgacttaaaaaaaaagagaacaggaatcaagtcacaatatatgatgtactatggagagagagagagagagagagagcacgctaaaaagagcccccattttcactatagaagcataaaaacatcatatgttacttgacaaaaatcagagagacatacacacgttggccgtggtaaatctagtaatgatgtaggttgatcaataatgttgtatagaaaataaattgtgtatataaagagagtaagggttacgcatcaaatctatttctacttttaaaatctaactctgtataaaactgcataagaaatactagtgtagcattatgtcctattattatctatccctaatgtttgtttttacttatccgtcccaatcaaaatttatattttaagttgtctttttatattttgttatcataatttttttcagcgtttgcttttagatcgtgaagaacccacatatataaaagttttacctataattaatttatatgtctaataagcattttagtttataatcaactatgaacgaaatgttggaactgattgtgtcatcatccaagtggcagggtcaacctcttgatgaagaccctcctggccaggtctgggaggactagtggctgcttcttggctgcccagccggtgtcaaacccaaccgtatcacctcctattccctccttttttaggactttatgccgtgagagaccaccctcccaaactctccaaagtgtggccatgtttttgtctcttgttggctcaccaacaaaagcagagggagccacactgcctgcctttcttttttccttgctcacctttttcctgcctctcatttctgcatggataatggaacagtaaaacacaagcttagcacaaagtaggagagaagattggttatagagagattaagagagagagagggatagaacatttagcattggagacacatgtggagccacatggttcacaagatcttgtgagttgggtgaaaaggatggcattttcctttgattccttcagatggaatcaaatggggagaagagtttgattaatcgcaccgagggagatggcagcagggcaggagtagttgattacttgattgcagtgtcatcaactcattatgatcaatatactatttagttaagccagatccagcctcttttgtagtacagggtaggaccaagattgttatggattaagaattaatgaggctacaagtacatccaagtcgcccttgataagatgacagcatctctaaacaagtactagtactactctagtcttagtttgcttagaaccagttctttccaggctatgtaaatgaaaatatgcgtaccactgttctcaaactatttttttaataaaactctctacatcaatatttgcttaga

SEQ ID NO: 30068 - DNA, 1501 bp, Oryza sativa
gaagctcagccaaacagtttcagctccaccaaaactgggagtggagctgtgtggagctctctcacaaaataaactagagttatggagctgggtttagacagctccacaactccactccagactcaactcctagagctaaattgaggagttggagctgtaccaaacaggccacacttcaggctccaaaattcgcccaaatcatacccaaggggtacatttgcgatggctgtgaaagttgcagggctatttggctgaccaccttagggcctgtttagttcgcgaacgaaattttttggcgtgtcacattggatatacggacacacatttaaagtattaaatgtagactaataacaaaacaaactacatattccgcctgaaaactgcgagacaaatttatgaagcctaattaatctgtcattagcaaatgttttctgtagcaccacattatcaaatcatggcgcaattatgcttaaaatattcatctcgcaatttacacgcaatccgtgaaattattaattttccatatataatactccttgcatgtgtccaaacattcgatgtgacatggtgaaaattttttgtttggaaactaaacaagaccttaatttgtctaagcttgtcataatttgttttgactgacctgccaaagggcttggctaacaaaactgaatccatactttagttagttttaggcaagtttgccttctctctctctctctcttttcaattgcatatgggacgaaaaaaggaaatttatcataaatgtggctacaaatcaaacgtgtgtctatcttgatcaatttatctaacttaagctatggtaaacttagataaattgtgtctatcaagcaagcaacccttagtagtagtaacatataaagagcgatatatgattgtattgtgatgagacaacaacattacaaaatgttcactagggttctctctctagatgatggaaaaacctgatctttattttaacaaaagaaataagtaattattactataaagtttgcagcaccaacaactacatcccacattcaatgtgaagacaagaaccaactaacacaggatgaaaaaacattattcacgaaatcctatcgctaattaaatctccatccatgatgataaatttttgtatgactattgtcagcggaattcctgcatacaagctgaacattgtccttatccttctcacatttttatagttgggttcaaaaccaaagtcagtatgtgaccaaaactacactaaggaagcagtataaattagagaaaaatgtaattggcaaaaataaaagacatactaagatatatggtttgagttatgcagtgattttgtttgacaacagaggagctctaaaacattgaattaactaaagatttatcaacaaaggctgcattttgattggattctcggctaggctactccatcattgtccgtgagtacgtttcctgaagacccaaactactaaacggtgtatttgtacaaaaactttttatatag

SEQ ID NO: 30069 - DNA, 1227 bp, Oryza sativa
gagcaactaattgtcatcaactagtgatgaaccatcctccactatacaactatcaaccatccatcaattaggagtaattgatataagttaccaattccctaatcaaatggattaattctcaaaactcctcgtctcattgatatcccacaagagaatgaatacacatgaattcctagcataatgagccttggaatttatttaatttaattgatttaaatggatcaattaaccaattaaatctaacaatccccaccaaattttaaggctcttgagaatgctccctattccatagcagcttttatataccactgtttcggtgaagactgttaatgtcacagcctgaatttcctgtctcaggatttataaattatttaataaattaatattagaatttatattaaatgttcattaatttacaagtgaagttaaatgtgggaagtaaaaattcctaaatataaagcatggttggatttaatttttattaaattctccatgattaattgtactctctggaattttctcggatttttaataattttaataatacaaagaacatttcagtaattattcacatattaaattaatcattaaatgagctggttacagttttgttaaatactttgagtgtccaagtatgttcaagaattttcttggaactatttgtgcattggaagtatttttaacaattgaaagatcatctcattggttaatatatttggaaaagtaataaaatcttcctcctcagcttgggcccttttcaacccatttccttctcttctctctcccttcctctcagcccgcatagaagtctgtttttcttccctctcgctacagtgttgtcttcaacatctggacagcgcccgagccgtcccgagctgcagccgtgccgatccccttccgaatccggcctccccgttgctcctttttccaaattagttgcgggaacggaatcctctcaatctcctctacaatttccccacgaaatccccaaaagtttctatggaaatcctttccaatttcgcggttcaatctatcctttttccgacgaagatcctaaactttccagagtttttcccgttgatgtgggctcgatcctgggctcccatggctatataaaggaccccctagtcgtcctctacctatcctctcaagtcccgtcttcctccatcgccggaatcgctctccctgcgagctccctctctctccacctccggccgccgctccagc

SEQ ID NO: 30070 - DNA, 581 bp, Oryza sativa
taagctccgaccggcagagagttctgacttctattcttgtactgccttgcctcacgctcgattaatgattgcccaaaaagctatggatcgtatctgtttttctactaacccgttattaccaacgtgttgtgttggtatcaaaggaagtgacagaaattccatgtgaactgcatgatgctgttcattgacaacaacgtttttcccttttcttgaaaagaaaaaaaaatgaatagctgaagaattgttctaacagcctactctgcatttgcttttctaatcattctgttttctgtgaagatggagagcatagcaaaggcctataaagtcaagtttgtggtggatgttgctcagctaggggaggaagacccactttggcaaaatgtaagcaactaacttgttctgacagtacactaagtagtaataggtacaatggagttttgagctggtccaagtaattcaaccaagggtgtgtttagttcacgccaaaattggaagtttgattgaaattggaatgatgtgacggaaaagttggaagtttatgtgtgtagaaaagttttgatgtgatggaaaagtttgaagtt

SEQ ID NO: 30071 - DNA, 943 bp, Oryza sativa
agttttattatttaaaaaaacttaggataaacatgttcatttccacatggctactttttattaggaattactcatcgacagatcaaagctacaaaatgtattcatattgggattttctcctattattggagaggtatacatctcatacttgacatatatgtctccttttatcttacaggttggaataggatttagaaacttacttcgccatcgaaatataaatctatatatgtacaatattacatacaaatgtatctttcctgagatttcttggtgagattgttagcttgataataatttttcctgtgcaacaggcatccatacagtgtgatattccagcagtgagcaccattgcaatgtacccatagcgaggcaccattaacaccaataccgttatacaattttttcctaatgcctcttattactacagcattgtgttgatcgacattgtttttgaaccacgttgtttataggtatattttctctctgcaggggaagaagaaaggaattataacaacgatattaagaaggaatgagatgagaatatataagggagaagttataatagagaatagtagatatgtggaggttttgatcgatgcttttattacagctgacgtcaggaactgccttgattgttcagggagtagatgttgggttagaaatggtctttgtcactaaagaaaatgtatttactaaactacattcgcatgaaaaattggaagcaatgtctgaaaattttcttctcactgatcagcattgtggtctatgctcctgtataggggtaaaaacagtcacagaaattcccgattaaccgggcgttgtttccgtttaaggggtacattttccgaccgtaccgtttttgttatttttaaatttctttttgtctaatttctttctgcatcatattaatgtcgatactgagtagtttaaataataaata

SEQ ID NO: 30072 - DNA, 1492 bp, Oryza sativa
ttcagttaattcttttaaaaaaaataattttatgatcacacaatgataacagtggaattaatgccataaaaatactttcattcagttaattcttttaaaaaaataattttatgatcacactattaggcgtttgcgaaaaaaagatcacactattagaatttagaaaagataacgataacaatatatcataaatgtagaaaaagaaagtaggaaaacaaagtaaatttcatataactaccagttgtttgtgaaaactggcactaaagtctaatcacaagtagcaagaattttcggataaccgcacattttcatcgatatgtaccactttttctatatatgttgcctattgtgatattgtctaatctaacacggtaaaatagtactggtaggaaacaaaacaaaagagaagtttttttttggttccctctagtattcacatttggaattcatattttaaataggatgtcaattcagaaacaaccaatatgttcaagcatagagtttggcttgaaggagctatatatgtgactacactgccgccattaaaagctcacttaagacagcttgttctcaaataaaaaggctcgatgacgatattttggacaataccacataataacaattttcattgagacgaaaaaaataataatcaagagatagtacaagaattattgaccggcaagatttgattccactagtatcataaataagtactacctctatttcaggttataagactttatagcattgaccacattcatatatatgttaatgaatctagcgacacatatatgtttagattaattaacatatatataaatatgagtaatgctataaagtcttataatatgaaacgaaggaagtaggagacattagttgatagttttttttagaacataaaggaatccactaagatttccgttatctttatcagtttatgcatatcgatacattttatcaacttatgtatattaacaattttttcccatattaataatgtgcccatgctttaaaatgcccagatccatataattgaagattgaatgggtgaatagattaatgataatatacgggatagtctcatataatgagattgactatatgggtggattggatcctttagccattacctacacacgaagagcacacaagcttctacgttggatgagaagcaccagaatgaagacgaatactcccttaaaaaaaacaatctaaatattggatgagatattttctaatacaagattcattgtaataggaaatgtgtaataaatgttttttttaacggagggtgcatgatgtcacgactacggtatttgcacagtatggggatcgttggtgctaggatatacgcgagactgaggtaaaagagatggagacatggatttttatacaggttcgggcccctgagctattagataatagccctacatcctgttggccggagccgatattgctttttattcaccataatcacaccagtacaatatgt

SEQ ID NO: 30073 - DNA, 793 bp, Oryza sativa
ttcttttataaaagaaagggtatggcataagttttatataatacttcgccatttcaatctaaatctatatatgtataatattccatacaaatgtttcttttctgagattaattaatttctttgtgagtttgttagactgataatattatttccactgcaacatgcagccatacagtgcgatattccagccagccccattgcaatgaaccgacagcacagggcaccattaacgccaatattgttatacattttttcctaatgccacttattcctgctgcattgtgttgatcaaccctcttttttttaaccacgttgtttattggcatattatctccgccgcggatgaagaaaggaattataacaatgatatttaagaaggaatgagatgagatataagggagaagttttaacagagtagtagaggtgtggagttttcgatcgatgcttttatcacaggcggcgtttgatcggagctagcacaagaagaagagccctacgtcacaggcgtttgtcagccacgctatagaacgatatcaacttcgcaaccaagataaaatagcacattgatacaataaggcccggtttagttccaaaaatatcccattgaatctttaaacataagtaagaatcattaaatatagattaaaacaactaactgtacagtttgcatagaaatcgtgagacgaatattttgagcctaattagtccataattagctataagtgctacagtaactcacatatactaatgacgaattaattagactcaaaagattcatctcgcggtttccagg

SEQ ID NO: 30074 - DNA, 1501 bp, Oryza sativa
actaaacatgccctcaatataagtgcaacttagtacagatgtacttcctccgtcccaaaatactgctacctaggatagaatttaacccatcctaggtagcaacattttgggatggatgtagtaatatattctactgaatataagggagcaatctacccatcggacgtccgatgacccaaaaaaaatcagacggtcaaatgttgcagttggccaacaggtgaaacattaagttatatatggtgaaaaaaaattcagcaactgaaacatttaaatattttatgaaacatggtgaagatatatgttgaaacatgtcgctgtcatgtatgaaacaagtattaacggatcgaaacatatgtttttcttttatcaaaatataatcattcgatatcttgttgtaaagatttaattaaaacgaatacaatgatgtgatcggatcatagattggataagtaatttaagagaaaaatcattttgaagcttgctaaaatatatgcatgtatgtatggatgaggtggagagagaggagagtagtggcagttagtttcaggaattttgtgaaacacactgaagatgcacgttgaaacatatcactatcaagtatgaaacatttagttttaacggtttgaaattcatgtttttcttttgaaataatataatcatatgatatcttgttgtaaagatttaattgcaacgaatacaacggtgtgatcggttcgtagatcggataagtaattagaagaaaaaatatttaaagagaggagggaaaaaaatgaaaagaaacaggtagcatacatgttacagtgaggttcctccgatccatcaggctttttagtagggtagacgaggcgtccgatatttccgtttcgtcggacgtgtgatacaaagcattttctgaatataagacaaggttatacttgcattgggacgtagggaatagaagaaaacaaattctactgaatgttgcctatatctgtgacctttaaattagacccctctctattctctgtccaaaattgctttcctagctacaaattaagagggtctcattgcaaactagctaggtttctattaaaaaggcaaaaagaaaaaaaaaccatattattactatccccattttaaatatataacgctgctacataaaacaacccgttgttaattagctttcatttgtgtcggatcctgactggaacaataacacacataggggcaccgatgagccccctatcactgccgattaattttgaaatagcacttatgaggttgacgagctgcaaagaaaaagattaattcgagccagctcgttcaaatcaatacatagacgcatgcccagatcaataccaaatgtccatatcatcaaatccaagtaaacatcaatatttcacagatcaatacacatcgatgtacacactcacaaataaatatgcacagatcaataactgagaaatccaaatcaacatcacatataaaaactaatcgatgtatgcaccaccacaactacaga

SEQ ID NO: 30075 - DNA, 928 bp, Oryza sativa
  unsure (1)..(928): unsure at all n locations
gccactcggagatgttgtgttttctgtatgctactctttgttttatatgctgttatttattgaggtgttgtacctgtcgtgagctatgtcttcctgccctcttttcttcgagtgcattctgcttcgttctcctctatccttttcaccacggtagcgtgcctgctgctgcttctgttgtcatgcaatcacacggtttcttcgttgctccctgtttgctccaattgtttggttatgctctgcagatgtcgcaacagagtatagatagggtccgaagggtacgtgcaagccgtgaaaggcgagccaccaatgtcttgctgcggccctttgcaatggacatacagagcacggtgggaacatcgtctgaacctttgcggtagatcggagtaagaggccgcgttcccttatggatttttcagatggcttatccaagctgcatagacagcaccgttgtttactgcggtcaaagctgcctcctttgccgccaccacacgctccttgtggtatggtaganagttattttcatagacatgttatccttctgttatacccacgccgattaagacatggttatgatctgcctgtattgcagcttctgctagcaggccaagcactgcctcatcagcaacagatagggaatacatccagtcgctcaagggttcgtatcctgcgataggaaaaacaacctatgctttgtttaatgaaaaaaacatgtctgtctcacaatggtaaaatgtgtgtcttacagcgtcctacccaggccggtcatactatggtcctccaacgcatgagtgtccatattgtggtgctgtcttttggttccaggagagggttaagtcactctctgctgtctcaaagaggaaaattgtctataatctatgttgcaagagcggcaaaatacaagtgcctcgttttgagcagcccccagagc

SEQ ID NO: 30076 - DNA, 1501 bp, Oryza sativa
aaaaaaggatttttgcagacggccaaatcagatttttgcatgcggatgaccggacctgtctgcacgagaaggtatgcgaaaatagtgattttcgcatgtggctgcttacatgggctgcatgtaaaactaaaaatccaaaataaaaaaaaatcacaccggctgctcccgccatcggcgtcgtgctctccactcctgctgtcgcgggagccgctaccgtccgctcccactgccgctgctctcgccgtcgtccgctcctgccgccggattcgggcgggggatagtcaccgccgctggatccgtgtgggaggaggctcgtggcctagcgtcgacaactactgtcgagccgtcgccgccgccaccggatttgggtgggagaaggccctaatctgctttgagaaacttgcccttttttcgtatttggatatgctttgagaaacatgtgcaggacaagaaaagaaaataaaaatcaaacggcgcatgcaggggacaaggttaaaacccacgacacactccaccactgtgttgcgtgacttagaataagttataatgtaattacatccaacttatatcatagttatgtgcgagttataatgtaaatatttaaagttaccattgtactatgggactatctacacaccatttgataggaacgctctaaaaaatttcgtaaattctggaccactcgattgctttaagatttatacagggcaaccaaaccctaaaaccctgttctcatcccctttctcttggctctcctcacaatgccgctcaccatgcaagatcacgactatgtcgcctccgccaccgtagccctagcattgccgtcgctcgggctcatgagctggctggtgccagtgagcctcctccccctcccccttctctccttttcctcaagctgctggcagcgagcttcctccgtatcgttctcttccccatcttcggtgactccccactgttggatccaccaccaccggcctcctcctcctcctaatgtccttctactttaccctcgctaccagcaccagccacgcggcaccgacagtgtcaacgccaccttgccacctgcccaatccgctgctcaccgccggactgccacctcacgtggccatccctctaaaataggcaaactccccccccctcttcccccttccaccttgaccccaaccgagaccctaatctgtaggtccctaccaaagtttagggatgccgctagcgccggagaagataaggaggttgcctgagctgaaaaagaagggcaggagcacgaatcgcaaagtacatcaaatggcacaaaatctgcaacatttggagatggattttctgtcaaatgacatttggcaattccaatgtagtactatagtttcttaacggagtgtaacatcccggcctagggcttaataggattaatagaatactcatatcaacaagttgcaacttcttttccggaagccaatatctaaagaactccagggttaagcgtgcttggcctggagcaatttgg

SEQ ID NO: 30077 - DNA, 1501 bp, Oryza sativa
gttgtgtgtatatggatgaattgtacgtctttccatgaatgtaaaccaacgttgcatttgtccaccatcacaataaacgcatattgtacaggttgatttcctatgtcaaaatattgtcaacaattattgatctagaaagaaaatattgtctacaaattcatgatagacgacttatatacaccggcacgagaagcgaatctcctttacgaccatgcattccatcggtttcttttcttcagctttctatctaacatgctagctagacgttaagagtattgtggcactgcacgatcgatatcattatccaatattgtcttgtttgtatcttccattatctctttcaattcatcttcaagtttaatatatatatcagccaaataattctgtcggttgcatgttgttcacaaatgttggatgtttgaaaaattattttcttgcgaggaaaaaattgtgtatgtttcataagttttataagatgagttccatactatgtacccccttcatctttatcaagttgcgtgaaatataggataaacctgctatttgtcaattctgcataaatatttcaaaaaaaaactttttcattaatagccctaacaaaagttagtgccaaggttgtctttcgaataagtcatgcatatacaatgatttgtcaacacctttctgcacaatgtatatatcatctgtccaccatgcacaatctttgaatacctaaagacttcattctagcccccgattgctcgcttctccgcttttcgggctgtcgtggatgctgtcggggcgcggcacgtcatccggcgctgggagcgctggggctggccatctctccttgcctgctgtgctgtccgttcgatcgagcttgtgcggtgttgacggcctgcggtagctgccgtgctgggcgatcggcgtttgcgttcgctctgctgcgttgcttctgtgcggctcgtcagctcagcgcgctcgtgtgcttggtccatgtgttttggctctctgccgtgtgggccgtgcggctggttcccgtttcttacctactgtgagctgtgtccatggtttgttgctgctgcggtggcaccagtgctgccgttttttgttctttgtctggtgggatcgttcctccatgtgttcctctctgatgcgtgggtcctttgccttttgttgctcctgctttcctgtgcgctgtgtctaccggtgtttgtgttgcgcgtccgtgctctgggtggttggaggagcaggcgtgggtgtggttggcagctgctcagtttgtccggtgcgttttgattgggtcgtctgccctcggttgactcggctgttgcgccttcgttttgcaccgaggctgtgctagcctgtgtgcactttcggtgggcctattgcctatgggccccacagcctttgcttccttgttggtgggtgcattgttgttcacattccggatccctgcatcccttctacactctttttccccttccttccagcgatagtgcttcttcctgctcttcgtttc

SEQ ID NO: 30078 - DNA, 280 bp, Oryza sativa
acaaccactaaaaacatggcgaacaatgcacggatccgctaacacagacagagatggaaaggaaggaagcgagaaataacctcggacgaagaggcccgcgaacgccgtgggacaacaaggacgaagcaagtacgagaggaggacgagacagagaagacacgaacgagtcgatccagaaagcgaaggaaagataggggggtccgcactgaaacaaacaaagcaatgtaatcaggacatatgaagcacaaaacataggcaggggatacataggggcctgcca

SEQ ID NO: 30079 - DNA, 1501 bp, Oryza sativa
ttgtaaggcagaaccttctttttttaatttttggcaaaagtattaattgcaccagttatgtaaaggtatctgtgtcgtatggtaagtactttattccggttaattatatgataccagaggtactactatatgtatactgcgattttccttcttttctgtttgaattttgaaaggtaacatcttgattatatttcgttggcagctaggatatgataacttatactgtactatgttaattagattgtgctcgacatggcatcttaatatataaaaatggcgaaccatatattagtatatagatttattaattaagaacataatttattttctacctatagaaatatccaccgcaaatatataaggaccataatttgtctgttcggaaggcccgtatttggcccaaaaccggcataaattttgggctcgtatatggtatgcatgcactcgaataaatataccctgatttcaaatataccctgatttctgcatgtttcaacatctcaccgcctctcttgtctcttctcttgtacacttacaaaatttgaatccaagagctaaaattttgatcgatcttattgtgtccatatatgcttaaaatcctccttctcccaagcaattcctcgacgagagattctgattcactggtattaattagttccgtgaaaaataattataggtatattttcttcacaaggaaaaaaaaaagaattcccaggtctatgcttatatttgcaagtctatctttcctaaagcaaaatctaggaggacacataggaagacaaagttttgctcgttatccatgccaatctgccatcgcatttctgttgtttttacaacaataattcaataactttattcattactatgtgcttttaggaggcacaaatactccattttggtgacccgcatatctgttggtttaattttgtcttaatttcattgttttaatttatgttcctttttttttctcatgtctagcttgttcggttctcttcgatcaatcgatcgcgtgtttcatcttattatgtctttcagttggtggttctgctcatttctggcattccaagctaggtaggttcactgctgaattcattaattaataacgcgtgccattcataacattcaaacgaagacgatacgagaagccaatgataaatcaaaacaacctacgctatatatattccattatccatgcaatcatgacaataaaccacactttttattgaaatatcttgataattaacaaaacttgcgtacatgctcacttgatgctagctcaagatcgatcagataaacatcgagatctgatacgcattgaatcatcaatctagcacatcagcatgtaatgcaaaagtacgtgcttcaaactagggtagcccactcatggagaaggttgatgattgtgtatcgggttcgggccgctaggaacatcatgcatgattctgactcgagacgagctaggtggatgatggggaggagggtggtcattgtgtatcgggtt

SEQ ID NO: 30080 - DNA, 1501 bp, Oryza sativa
gcaagcggtggccctccatgaggcagagaggaagggtgtggaagtgagggagatggcatcagtgctgggctcatcagcctcgtctccaccgcttgtcgggttcctgctgctatctgcaaaagaaagaagaaagagaagaataagagtgggctatgacaagtgggcaccacagttgtttactttcttttgtaccacttacacttgaatcctctatctatttttggttcatcttatgactagactgccattagatgccaaatcactgaaaactatcctcaaaacagtcaagggggttattttaaaatattttaataattaaagtggtagataactagatataccaagttttgcacttgaaatgtactcctatatgagaactcacattagacttttcccccgccgaacaaaatcgagcctcttctcttctcgggccaccaaagaccaaacaaagctgggcctccgtgtgggcctcctcggaataggatcgctaccatatccgaagggtccacctgaaccgtccgatctaccatgcgcggtggatatcgattaggcgtcgtctcatcgtcttcctcctcgcgtgcggcggcggcgcgccagtggccgtgactgactctgcgccggcggcggcggcggcgtgcaccggcgaatcccctcgcgggaacggaggtctaaagcctctcccgccaccactatcccttcctcttcggctcacgctcccgtccccaataacctccgctttcgtcagctccattcttgcaggcgtctctcctcggctccgctcgcttcggacagtccgaaggctaaggtgcggattttacttcattatcctctgcaatttgtgactaatttgagttactactatcttccaatttatctgctctcccgggtgaggggaatggtttgggtgcattggcacttgctgaattcaattgtgcatataatgcattattttccaccagcttagggttgtagtcttgtgaattcgggcatgggaatggcctggtagcacgaaatctcggcttcgcggccaagacaggaacttaaataatcttaatgagaatagttttctagtgattcgctgctgcccatgccctcgaatgctcgggatttgggagggcaatttctccctgtagcacatcctgagaagttcacgaggataatatggattctctacgcaagtgtgacaaagaaaaggaggacaaattgcttttgttctagcaagtgtgcgcttatgatttagcatgcccatccttcccattgttttgtcgaatctcagcagaaagtggtcgattgctagaggttggagacattcagtcttttatgctcactaataactatctgccacacatttatttcctggatatgtcaacgatgaaactattttttgtgctgaaaaataatttaatcctcttcaattgatactaatgttgacatcaatcatatctatcataggtccgttgtgtcatggtggatcttctacttcattgtggtggtggcttgc

SEQ ID NO: 30081 - DNA, 1501 bp, Oryza sativa
gaaagttaattaagacgctgatcgggttagcggtggtggcagcggttattaattgacatgatgatgagtcatgggctcatcaagcatgtggagtggaagacatgcgtacacagatcgatgacagtaggcagttccttgtgcttgcggggggaggggactgaaggggatgccaatggccgttgagctcaccttgactcgcctgccgattgttgccaacaaccacaacctgccaagaacgcctctcgcaacctgattcccagctagccgctatctcgcaacctgattgcctgcaccgctagctgcacgtatggaaatacatattctaacttaatatcctttaactttaaaaggtttatatgtgagtcccacagattatggatccacatgccggcgatccatattacagaaccgacgtcggaggagcctctccttgaacgcacttacataggagaaaaatggcttggaaatggactaacaccaactctgccatatctgtttttatatctttttggaatcggaattgaaataaaaaccgtagataaaaaacataatatgatactgatgaatatagatacggagcgaatattgtaactaatatttatcggaatatgaaaatagaggttgttgcttcttctttagcgaagagatgtgcctcactatttttttctaaaacaataaattaaaattcctattttttatcaattaataatatataactagttttacactttacttttcatgaaaattacaataagcaagaactatatattagtcagtacggcatggtctaataaaaaatagttattagacaagagaaaagcatatctaaagcattggtagaaaaaaaaatccattcaactaaccacctcagtactgtgtacaaatctgagcatctaaagtagagaatgatcaagctaatcagctacataaaaataatttgtttatgtttgtgagaaaaaaaatacaaattcgtttttggaaagcttgcaaccgattctggtttccaacgaatattagccttactatattcgttttcgtttttgagaaaaaaaaatctaaatgcatttctgtttccgagaaaaaaaatccagattttggaaagtatctaaccaattccagcttttgacgggcagtagtcttcctgtattcgtttttgttttcaagaaaaaaaagaatttctaaatcgttgttgttttcaaagctttaaaagaaattccaacacttttcgttcgaaaaacactagttgaagccgaaaacttttcgaaccgtttgcaccctacgtgcgtacacgctcgatcgagagcattgcgtcgccaccaaaccatcggacttgggtccgtcagaactcagatcgatcgatcgatgcccgcagctaagctcccaaattaacctacctaggtcgggtacgttcgtgctacctgcctgtacgacgctaccaatcaaattggctactgatcatcaatagaatctactacatgcgtagtgacgcctagcttctctc

SEQ ID NO: 30082 - DNA, 1501 bp, Oryza sativa
atccactcataattttcatcctttgagaaaatttcattggatttgcttatcctgtgaagcctaactaaactaagataaccaactgtgcccaactcgactctactggacagattatataatagcgaagacaaatttaatattttctcctcaggtaaatccatgctggctactgtggatgcaattgacccatcagcatttttcaggggtaacgggacatcaacggtgacaaggtttccagtttcatcaagatcatttaagctcaatggctgcactataacagcagaatgctttgtcattgagttcaggtaatgcagcagaaggcttccctttactaaattcccttcgaactttcctcctaatccacccaccacagattgatcccaagaccatatcaacgccttttcgcagctggctaatggttcaggcagcatcctcaaacggtgtcctttcataaacacagcagatactgggccacaactcccagatgtatacagtgcaagcttcatccaaggtgtcatggaagagtaagaaggtggaccaaaatgtactaggccggcagtgctgggtagaagtactgatgaatatggaagaggaatcatagacaccataatgtcatagtccctgacaagtaatctttcaagtgttgttgcggacagtgaagccaagctctcgcagcgaagaatattgatccggtaacttcttttagttttcgacaaggaactactgtcagttgatccatctggtagaggggttttgctcgtatcagaatcatttttgtctgtgctttccttactttcagagacaatacttgagggtgatgatgtactcgcatctgcaacatctgagtcaaccattgggtggtctgcttgtgacagttcattatgatgatcagtatctgcagtgtcgacggtttcaagtgaacctccattactcttaacaacattactaatgccctcatcaatgctttccttggataaagttttggagaaattctcctgcaggcagaattcctggctgttcggttcaatagcttcatctggtgatgtccctccagacagcaaacactcaaggaagcatctgaggctaaaagcatgatttgcaaattcctggagcacaccttcaaacctctttccttctaaactagcaaggtccttgcatagatcagcaatgcaagaatcaccaagctttccggcctcgtatagtgtcacagcatgagacttcagacctgtgatacgtatgtgagaaaattattaccaatcaatgacattgaacagttccctgcctagaagtagaaaattagtaacaaatggaatataacctggagataatgaacccatcatcaagtacgaagttacattggcatcaacaatgaaacccacataagaagccccagatattctcctgggtccatcggaatcactggtgagcaatgcatgacctgacctttctgagttgatactcgtaagtgaaccttcgtcatcatcactaagaatattactag

SEQ ID NO: 30083 - DNA, 1501 bp, Oryza sativa
gccgacgataaatttttatactgcaacatgctcgcctgctccatcgagatggcctcttgaatgtaccttaacgtcatctacctccttaccggcatcgagcgtctgctccgaaagcacctcgacatctgcaagcatctcaagattaccaaccaccgatcccgcaagttggggaaagaaaaaggggagaaagaaagagaggattgttgatgaggagggcagaatctccaatttatgaggattgtgctacagggaagctattcactcttttattataagcatgttttcccatattgctaaatggtatttttttttcaaaaccatctatatcgacattttttaaaaataaatcaatttttcaagtttataatatcaccaattgtgttttctgtctcggtgagttgctactacagaaactcataccattcaaagcacggatgactggtcatttcacccacaactagggctccatatcaagccagttcagctcggctcgttatcctacgagccaaaagcctcgctcagttcgaaccaacatcatttcaaagttacaaatgtttgcatacaatataagtattaaatcatcacaaatttagcaaatgcaccattaatttcatactttcatataatcatctaaagtcagtctaaatatttaggcctatgaccaagtggagtggtgtgacaatgagtggatgggggatgagttaagttgagatttacgagtaggttaaactttagttttgacttgttaacaaacccaaacaagccgagctgtgcgagctaaagtgccatcatccttttttccagccctatccacgacccatccaacctgtgcaaccttggcaccgcattctctgatgttagaaaaactatgttagagggcagtggtgtatcaattcattgtcctccgagtatggaatgctccaaaaaaaaaagccaatgatgccatcgctcgcagtcactatcatgttcgctagcgtgcgagcaaggacaacattggatttttcttgggagcgttccatatttgagaaacggtcgatcgatgggctactgacgtactctctctgttttttttaaaaaagacaacctctgtatccagattcgttgtaatatgttgtctttttttagaatgaagggagtagttttcccaacttcagaggatctggttccgtgcaacctcgtgccacaactctcaaacttgtacaggcaaccaagaacacctgtgatctacattttgagatcaggtagtatgattgatccatgaatcccattatccatcatcctcgagtgagagtccagcacgaaagctgcagctaccactccagcttatccatctcatcatccattcccctcgcaacgaactccctgcctctcgctccgatcgtccgcgccacggcggcgacacgatgaaaccccgatccaactgacaaaattcccaagcgaatcctgtgcagctcgagtagaagagaagagagagtgcttcttggcgagcgagtcaacgtca

SEQ ID NO: 30084 - DNA, 312 bp, Oryza sativa
ggggcggcctcggcgcgtggcatcacgcgcgtcgcccgtgagcccccgggccccgtcgatcgggtcacgtccctcggcgttggtcggcctgcctcctgcgtacctacaaccaactttatcagtgacgtaaaaaataggcaaaatttactacagagcatctaaaaaacgtgtaattagcttgttggacaccgtaagattgcgaatttgctatagggcaccatcaaaaagtggtaattagctggtagacacttagaccattattttattatttttagaggaaaagagatgagagaatttttgaattgccgagaa

SEQ ID NO: 30085 - DNA, 1501 bp, Oryza sativa
gctaatttaatagcatattcatataatagttgcttactatactattaacatatatagtccatctgtcatatacacattgcgtcttgaagtccgtgctgcagctggctacagattcgtagtctgctgcttttctctcttatcttttatcttattaaaatatgtttatagttagctaatagctcgttattgtacctgctcttatgtttccgttttcttttgggttttgggtggtttcggcgagaggatgggagagaaaaaaattagtgattaggaggtgatttgtggcacgtttaacactaaaccgaggggaatttgttccatctgatgacgttgggggaaggggggttaattcggtcgcgctccgcgtgtgttgattcgttcacacgctggcttgtgggcggtttcttctcgttcgtaatggttagacgcgggagtcaagctgcttatacgggcttggttttcttgttttcttaagaaaaaggggggccttggttttctttggaaaaagttacggggaatatgcatatttcgttcacacgcaagtgcgtggaaacatgacattggctacttcagtccttttccatcacatcaacatgtcatacacacaaattttcagtcacatcatctccaatttcaatcaaaatctaaactttgcgctgaactaaacacatccattgttctaagagaaggagagcgtttgataaatcacatagcaccttcatcaaaaaatagtttcagatttttttttcacatttgaatgtgaacatgctaatcatgtgactgaggctgcgttaacttttaattcttggatgttcaccgacaatttatcctattttaatcttgataaaaatctttatttatctttggatggtggcctcttccgttatttccccctactatttcaaagacgtgtgtacagggtttacatttcaatgaaatattaatgcgaatatggtatcgcaatatgccaataacaaataaggactcatcggttttattttccaaataagttaatacttattatacatagaacatgagaatacacaaatctactttaaaccctagtgtaatgcagagcaagaccatctcaagcccgcatggctacttaactacgagctttaggttagacttacaattttacaatatactatatatgttttaaaatatatggcattgttgaattttagacatgatgtttgactattcaccttattgaaaaaaactatgtaagtatttaccatgacttattttattattaaagctaggtactttacgggaatgctactgggcgagcgatccgctcgctcgcccagggcgatcagttttgcacacccccctccctccctccacatctccaccttgtttccttttttggcaccgcattacttttctattttagtaaatttatacacctaaagtttacacatctaaagtttagagacaaaaaatttataagtcaaaagtttatatatccgattcaaatttgaatttgaattcaaat

SEQ ID NO: 30086 - DNA, 280 bp, Oryza sativa
aaaacccatttcataatattggactaattcgcgagatgaatcttttgagtctaattacgccataattttgacaatgtgatgctacagtaaacttttgataattatggattaattaggcttaaaaaattcatctcgcggattagctctcatttatgaaattagttttttttattagtttatgtttaatactctaaattagcgtccaaacatccgatataatatgggctaaaaagtttttagccccatctaaacacccctcagtaagggtatcaaactgtga

SEQ ID NO: 30087 - DNA, 296 bp, Oryza sativa
cgcaagttggtcggcgcacttatgcgtatggaaactctgattgaattttgtccggttcatgaattcgttttagtttatttacccctctattttcattaccaccatttttttcttgattttctaccataaaaaaatgggtctagctatacaattttcgatagaaaatccgttaagaaactatagtactacattggaattgccaaatgtcatttgacagaaaatccatctccaaatgttgcagattttgtgccatttgatgtactttgcgattcgtgctcctgcccttctttttcagc

SEQ ID NO: 30088 - DNA, 1019 bp, Oryza sativa
aggtaaccttgcatgagcataggtcggcggaagtcaggaaaagctctaagaaggttaatcaagtttttccatacatgtatgggtcggatgatgaggaagatgattctgaaatagctgcagccgaatgggtgaggagtaaaaaggtcataccatgccaatgggtaaaaagtcctggaaaagaggagaagtatgactttgatattaccaaagctgacaagatctttgatctactactccgagagaagcaaattcaacttcctgttggccatacaatcccatcggctgaggaattaagcaaaaagagatattgcaaatggcctaattctggatctcattctactaacgattgcaaggtttttagacagcaaattcaagttgccattgaggggggaaagattaggtttgatgattccaaaaagccgatgaaagtcgatggtaatccttttcctgttaatatggtgcatacggctggtcaaacagccgatagggtccgtgcaaagggttttcaagtaaattcggctaagattatcaacaaatatcagaggaagtatgacaagcagcagaatacgatgatggttttgatcctcattggggttgtgagttctttagattctgctggaatgaagggatgagattgccatctatcgaaaactgccctgggtgcagtgatatcgtcgagagctcgaaccggtcatataataggggtaatcggctaaggcaggcaagactttctgttcatcaaagattgggtccggtgaataaagatcgtggccaagaggatgaggtaatcaggaagaattaatggtgtccttctggtattttcatgaagaatcagaagagaagggttcaaagattgaggaacagggagcgcctccaggaggttgaacaagaaattaaccattgtctgaggaaaccaaatccaagacaggagtggtgtgttaagaatcaggttcctgtagccgatgatgttgcagctgatgaggcaaaaaggttggcaaacgggaagagtgttgtagcgg

SEQ ID NO: 30089 - DNA, 1501 bp, Oryza sativa
agcgatcagatagatctaacatgtatcggctaatactccgatactactctatatcaggatattaaaacaggtataatatatcaaacaaaggcctaatatacttagatacagcaatatcttgacatgaagggcagatttaacatgtcaatgaagcatatagagcaaatatagttaaatcagataagatcggctgaaactccgatgctaccctaatcggcaactagaaagcaggctagagattgatattctaagcacgacttaacatatcaaactcaactgatgcagtattaagtatgaaaagaagaacaatatctagacaatcaagccgctggaagtctcatagagtggtagatatcttacataatctgaaccaacgtcaaaatctaacctaatcggctgccctctttgatagatgttagccgattgtaggttagatagcgatattgccagagattatgtaagatatatgataactcgacgaattacataaacaagattagagtgtcataaagatggaagcactaatcccaagaatacaagtcatcataataagttttacctcttgttgaagatcgaaaccaatgcagctcaacccgaaagcaagaactcgtcgaaacaaaactaaagcaaaagggtggcgatgcgccgaaatagtattgaacgtgtgtgttaaaagttacataggactcgggtctatttatacccaagaattaaaagatacgtccataacggacatgactactatctctaacaaactctaagataccataagtctttgctgcaaacttttgcccaaacctatctctaaggaaattacataaaacatcctaattaatagatacaattgcctcctcaggactctatccatgtgcggcaatcaccttgaagcaccttgatccaacccgacatcacacatcaagttgtattgtcgggatcggctacatcggcttacctagcccgactcagactcagccgatcttttcgtagccgatctggactccagccgattcatgctctgttttcgaactcgatctccgcctccaactttgctttgatctgatctgatcttctttcccaatgccgatgttaccaaatttggttgttaacaacagcctcgagttaacaaggcgtgtatctattatgggcgtaggatatatgcacgtacgggactcgctgctttggcttcccacacgtaggtagctgtctacggattcaagtgaacgaccagcgaaactatttctatacctaatcttaactaattaaaagattagtatttttccaatcgtcaccaaaattagtattagtattttttcgtccgtatgcgctatttttttcactcgtctgtgtgcgatctcctcccaaaattttggttcgtcagtccacgcgagatcgagagactgcatcgctcccgtcccgtacgcgcgtacaagcccagaactatgcacggaaacaagagaaactgaatcacaaatccaacaacaataaagcaaaaccatcccaa

SEQ ID NO: 30090 - DNA, 1501 bp, Oryza sativa
agctcaaagataatgatttcacaaacatgtctgaattcatgcaaaaatatagcagcagcatcaattaatgccacagggtgaggatgccaccctcacaattaggcccttgacgtttctcataattagaatgtctggtcatccaagaacataagcctcacaaacccctcaagccagtacactcaccccatcaccttcacaatagcccgtttcatctggatcatgaacaaagatcttattagttgtcaaggtcagctagatgcttaccacaaacagttggataaaattgtgcttgagcaagaaaaacccatgcttcaattaagtgacctaggaaacagccaataaaataaaacatccaagatcagacagatcaaaacaaaaaaaaagttctattccacactgacatcctaggaagttgcttggaacacatcagccctcacaagttataaacatgcataatgtccttatttccactcatacacaatctggtaaatttagtataattatctaattaaattcttattttgccactcctagtatatacccagtttaattacataaaaaagagtatttgcccaaattgtatagtgattgcacttttactgtcagcaaatgtggccaaagttcagagacataccttgaggatgtctcaccatagtattaaaagaaatctgcagcaaatacttattaaaaatcttctcccactatattgctactatactttcagtaatcgtccaaatgattttctaaggagaacgaagcagaattaaattgcaatatgtttagaattaaattatcttctcccacttttgatttttcactaatcaacacaggctcaggtagcggcactggcccatcctcagtaccgagcagcgaggatggttgtcggggtgagccaggaacacaagctcgaagaaaaccctaggtcatggccacccacatggaagaggagaggggaaggaagagagactcaccggtgataaggtggccaccggaggggagagcgccacctcgccgtcgccgtcgcctttgagtcgcccgccgccgcacgcgctgcatcctgcgccatctcgtggatattttccacatgtttttcccggcccagaatgaggggaaaggccggggtaggcctggatccaatccttcccaggcttaactgaacgcaatttttttgttggccgggctttaatccaagccgagccgagtgcctgaccccgcccaaaactaacaaggccgtacggaattacggatgactaggaaaactttccaaaatctaacctctccttgtacgaggaggattcgttttcaccccctcaattcaaatcttctccgtgtccgttttcaccgcctctccctccctccctcccgccttttttttttttgcaacactttccacttcataaactccttgcgcgccgccgccgccgctatcaccgcaccgccgcgccgcatccttcagtttagggaagaagcagcgccgccgcgcgccggcgagcgatggttc

SEQ ID NO: 30091 - DNA, 706 bp, Oryza sativa
acacgggggcgggcgcgtagcagcggctgcggaggacggcgtcgtcgacgagggatgacgacgggtcggtgagggtgtacgggtggttggcctcggagaagacgaggacggcgacggccgcaccggtgaggatggagagctccgaggccttcctgaacagcccggcccgcctcttggtgaaggtgacgtgccgccgggcttgtcctcgatgcggcggatcccgatcgcctgccgccccttgctcggcctcccgcgcggatgaaccatcgctcgccggcgcgcggcggcgctgcttcttccctaaactgaaggatgcggcgcggcggtgcggtgatagcggcggcggcggcgcgcaaggagtttatgaagtggaaagtgttgcaaaaaaaaaaaaggcgggagggagggagggagaggcggtgaaaacggacacggagaagatttgaattgagggggtgaaaacgaatcctcctcgtacaaggagaggttagattttggaaagttttcctagtcatccgtaattccgtacggccttgttagttttgggcggggtcaggcactcggctcggcttggattaaagcccggccaacaaaaaaattgcgttcagttaagcctgggaaggattggatccaggcctaccccggcctttcccctcattctgggccgggaaaaacatgtggaaaatatccacgagatggcgcagga

SEQ ID NO: 30092 - DNA, 1501 bp, Oryza sativa
attaaagaccaacgacaactctcagacctccattggaagtgcactcgcgtgtatgtaatattcgtgggcataaggatctgaaccgtactttccaaaaacacgccaaagtttgagtagaagagaagctgaacatggatgatcagctgtacaatgatagttacattcaaattcaaaagagcgttgggctcaattcctccatttcaaaatgcgccacaattttgattcgataagtagtagtatttattcttgcttctcatagtaaggatcacaaaacaacaggcttaacctcatcaaaatcaaggctgctcaattacgcactactccatccattctaaaatataagagattttaggtggatatgacacaacataatactacaatttagataagcttactaaccagattcataatactagaatgtgtcacatccactaaaaatttattatactactctgttaaaaaaaatcaaatactatgtttgaatatagacaatatgtgtccaaattcaaactctgagtttgatttattctttttgggatggaggggtattttagaacataagagtactacaaaacaatgcattggatcaagcaatcagctatccagaaaagcattcagatttaattagctcttgcaatcaagcaatgtcttgcacagttggcaccgtccgatcctctgatccgacggctcgaggcagctagctccagctcccgaggaagatcctgccaacctagcagtgcagctctcttttccaaacagaacaaaacgacggcgacgcagtgctgcactgcactgccgtgtggtgtactacgcctatcctacctaccaccacactgcccttcactcgaaattccctgccggtgcagcccctgctctgccctgctgtgccggtgaggcagccacgcgcgggcggtgacagtggtcgatcagtaaaagttgcagaaatttttcacagaatgacagtgcccctttttgaaacgcaaaaggtaaaaatggaagcttttgtaccagcttcttcccctgttcatcccaacatgggttgctcgcgcccggagttaattcccccctccctgcaccctcccaatcactccccccgctgggaccatccgtcgatcgcaaattagcggttcatgcaacccaaaataatcgcattagaaccagccatcaaacttcaaattctataatatggatgatcatatttatgaatattccctccgtctcaaaataaataagtgtagttttacagtgttcatgttcaacttttaaccattcgtcttatttgaaatttttttatgattagtatttttattgttattagatgataaaatatgaatagtaatttatgtgtgactaatttttttaaaatttttcaaacaagacgaacggtcaaacgtcggacacggttccccacgactgcacttattctgggacggaggtagtattttttctagttggtgatataaccgtcgacaggaaaacatccgtgatgaattcattaatt

SEQ ID NO: 30093 - DNA, 255 bp, Oryza sativa
ctcattgtgtaacactatatgacaatatatctgaaaatcgaaatttggttgagtttgcccaagtgtgcgattatctggacaaaaggggggaacagggatcaaaggagtggagcaggcagcgaattgggatcaaacctgagtggagcactgggtgtggatggagcttgtagttatcaaatcaatccggtagggcatgagggtctctaccgttggtggagagggatccggtagggccgaaggtgggatcgtcgccga

SEQ ID NO: 30094 - DNA, 1501 bp, Oryza sativa
cattgcagtggcacagtgccaggctctagattttcgaggtacaggctgggacatggtggccgaaaattgtacgtaatttgggatttagtagtactgctttaaataactgaattcaaacttcagggtctgtagggttaaccacggaccctggctcagtgttttagtgaaattcagatcataccctcatttggacattttgttctagatctacgatctaacttttgattactttactaagccctttttatttgggcttataagctagcttatgaactgacaagccttttctgtctaaacgtgcaggtgtttttttttcttttggcttttcgaatgtgcactttcctaacttcacctcgctcgtttgtcatgcaaacgttttctaaactgctaaatggttatgatttttgaaaaaaaatatataggaaagttgtttttaaaaaatcacataaatccatttctcgcataaaaaagctaatacttaattaatcatgagctaatgagtcattctgttttacatgcgtgagagattagtttccatttcattgtgccgaacatagcatttcaatcttaaaccacaaactatgttggagaatcttttttgttttatatttttttagataattttttttgttttatatgagatagaggtatgactctactattaaacttagtattttaaatccacgtacttgtaaaatatacttcctccgcttcacaatgtaagtcattatagcattttctacattcatattgatgttaatgaatctagataaatgctagaatgacttacattgtgaagcggattaaaagacagcttaagtcaccaagaggggggagttggaaatttgttgtcacctgttgaatgttattaaaagacgcgaatattaggagaggacctaatatcaaataattagaaggggtgaggcttcgaactcaggtcatctagcccactaccttgtggagctagccggaagacccctgacctttctcacctgttgaatgttattatttggtagcttggtgcaaaagatactagattgaattctattttttgctatgcagagaattttgctgtgacaatcttttagtatgctcaatctgacaaatacaaatattcgatgctattgcttgattcaataacttttgttctgcattccctcctagagcatgttcacgtgtatctaaagaacatgttaaacatgctgagcaatacataattacacacaagaatttttacagtacttgagaagttgagaggtatgtaccaaaattttcgtacctaagtatcggaggtaccaaagaggtcccaaattgagataccaagaggttccaaattttataatagtaaatgtagaaccttctcgagaaccctaaaaccactctaattacactgtcaattttttctggtgggctaaattacacagtcaaatttggcccagagacccacctcaccaaccaaatcctacggcccagaagcccatacaagttttcaggctctcgg

SEQ ID NO: 30095 - DNA, 802 bp, Oryza sativa
ttcctgcagcccagaggaagttttgcaagtggcacaatatagtatctcatcataccaatgagtgcaaagtgttcaggtagcagacccaatcgcctatcaaacaaggaagaatcaagtttgatgatggaaaaaggccgatgaagattgatgaacatccttttcctgtaaatgtggtgcatgccacgattgacagcagaagattgatcaacaagtaccagaagaggcatgacatcaagttcagaggaattttcagaattgtagtcatcaccaagatgatatatattatcaagatgaccaagatgaagaatattatcaaggtgataagtttaatcatcattgaagttgtgagttcttcaggttttgttggaacgatggaatgaggttgccatcaatcaacaattgccctgggtgtggtggatcgaattcttacaatcagtcttcccagggtaacagtcttaaatcacataggaatcggccagaacccaggagatcagttcattgaagattgggccgattcgtcaagatcatatggaagatcaagttgaaaatgacgaagttgatcaagcttagaaccctcgatggtgtccaactagaatttttacaaggagtcagaaaaggagagttcagagattgagaaatagagagcagatacaggaagttaatgagaaaatcgatcatcggctgaaacgtacaaggaaagagtggcgagttgaatcaaagattgtgatagccaatgaggttgaaaacgataaggaaaggaatagaatttcaacatctgccgagggaaaagcaattgcttcaa

SEQ ID NO: 30096 - DNA, 1501 bp, Oryza sativa
tgtttggattatcacgttgttttatggtgacataattctatactttcttgataattttctaagaataattatttttgaaagttgatataaaattatgatttttctccggacgttaatagcgacaaacatatacaacaaacgatataaatccacctaattatgataccgtttagatctttctctgatatgtagtagtacatagaacaactcatatcttcctcgaataacctatggttcgtacctgtgctaaaaagaaagaaaggacgctaaaaagcagccactgaatcaaaaccaacctgagtggaaacctccggaaaagagccaccttttttacacgcccaacccttgttcggttcttccccccttccaacctgtgatgaagcacgtctccccaatagcccggaaccgcccgttccaccaccaatcgccatcgacgcgcgcccccaccttcgtcgtcccgcgcccaatgtagctgcagctgcagctgctggtgtggacgtagcgggagcggaggcaggagcgggttggctccatcgtcacatcgatgtgagtcgtcagctactgtggcccagcgtccgtccagcgcggcagcgggatgcacagcgtactgctggcctctgtgcttgctgctgctcttgtcactcgctctcgcccgtggccgtggccgtggccgtgctcctgttctctgccgtctcctctaccgcagtactccctcccagattttaatatttttaaccatctattttatttaaaaattttaaaattattatttattttttataatttactttattatctaaagtattttatgtataactttttttatatctgcataaattttttaataagacgagtgatcaaacagtgtaaataaaatattaaaatctcttatattacgggacggagggagtactaattagagcaagtttaatagtatagccaactactagctccaatttatctatagtcaatctaatagctcattcatgcctccatcggttgactttttttttctaataagccaaaacggcttattagggaataaaaataaatttgtaggtaaaacttttatatatgtgttctttgtaacttaaaagccaatgttgaaaaaaaattacgttgaaaatatttcaaaattaagtttgaaaattcaaaatttggcttattttttggtttattggaccattggatggaagcctcatacaatagttacatactacaaaattaatacctggtctcatctgtcatacacactgcgtcttaaattctgtgttatagctgactagaaatctgtagcccgctgcttttctctctcttcatttatcttcttaaaatatgtttacagctggcttatagactgctattgtccttgctcttagaagtaagagtatagtcgatacgcgagattcccccatcggcgacaccgccgcggccgagcccccgacacggcacaaaatttccacgagagcatgcgcgcgccgctgttccacaccggcctgtg

SEQ ID NO: 30097 - DNA, 1501 bp, Oryza sativa
tactccttcttggactcgccgccgccgccgccgccggagctgccactactcccgctgctcccgccgccgccgccgcggcgcttggagcggcgaccaccgcaggcccacgagtccatcggcggcgtggacggcggcggcaccggtggcttcccgtcgagcgccatgggcagagcagagctgaacgagaacgatcagtctctctcggcggagttgactaagagcgatgagattggggtggacaagtaaccaggggagagtggtggtggtgtgcgtgggcgaagtggagagaggcgtgggttcgggtggccatatatataggggggtgcggggcgcggtggagtgactggtgcggggatgcggagtggcggccggcggcggggcgcgcgggaagggtgggtgggacccacagcagcagcacgactccgagtcggagggcgaggcgaagtccaacgtgtcatccaggtctgtgtgaaatgatacaatggttggtggtttgcggggttccgggttgtaggatctgagacggtcgattgggatgtgatggcttgcttccgatggaatacagcctaatacagggatgaacaaatcgagtcattgggatgaagcggtggtcgtatatactgcagtaaagcacaatagcaacggatgttctatctaggttatccattgtggatcaaataaccgattttttttagctatttatcaatcaatgcattacttcacacatttcttttcttcaaaaatcacatgaattttagacacctgaaaggctgaaatcgtatcaaaataagtgccaatacaatactcctcgaccgtatatttcccctaatccccatacaaagctcactcataccgtcacggtgctcctccctactctacctcatcctcatcagcacaaaagttaccaatgatgctggcaaggctcaccggaccatcgtcctttcctccctaaaccaggtaacattgagatgtcccgttcccatcatcttttctatatgtccaacgatgtactccctccgtcccaaaaaaaaaaaaaggcaaactctgggtttccgtgtccaactttaactatccgtcttatatgaatttttttataattcgtatttttattgttgttagatgataaaatatgattaatattttatgcgtgacttgtcttttaaatttttttcatatttttttcaaataagacggacggtcaaacgttcgacacggaaaccagggtttgtctttttttgtgacggagggagtaagccactagagacgccaccaccaacccgccatctgaccactctttcacaaccctagcacccttcactatcctcacaactccagcaccaacgcttatgtctcatctcgcagtccacccattccattgtctcataagatatcctcatcgtcccctctccattatctcctagtcccaaaaccctgattcatagatactctataccaaagtttatgtgtcactagcatcgaaggagcggaagagctcgttatt

SEQ ID NO: 30098 - DNA, 1501 bp, Oryza sativa; identical to SEQ ID NO: 30049

SEQ ID NO: 30099 - DNA, 1501 bp, Oryza sativa
aataggttcggaatccagaaagtttccatactgtttttatccatagttaatgtgtatgatattataggtaccggatctaatacctttgataccaaatatgatatttcgtaggtactatgcttatgttgtacgaaaaataaacggcatcatacattttggaaaggggtagtactaaacaccgtgggcattaaactcgggacgaaacgtgaaccgacgtgtgcaatagcgtgatcgtttacactacttgtttgcacaatgtggcggcaaaggcccaatcattagctcacttagttgcaccccagtatagctgagatagcgagctgattcagtgatgatctcgctctccgcgcgcgagtgagtacacgcgtacgagaatctaaaccacacacacaggcagatcgatcaaggcatatatactactctgcttgctgtgtagctagcagcagctgtgccactcactctcgacgtggatgtattacgcagaaatgtgcagaatcatatgcttaatactttaccaagtcgcattaatttttcaatgggaagcagcattagctgtgccttgattattgctagcttcccccacatgctccttcacaaaacgctttaagtgcgtttgatttggggcgcagatacgcgcggtgtctccctaatcgtctccgtggagaataatccccacgaggtaatgtctacttatgttgctggaatttgataacattatcatcggtagtataatagttggatgtaggtctcgttgctcgatccagttggatcggtcataaatgagatgatttctttctgacttgttaaagatgataatggggatttggactcaacatggatgacagggtgaggtgaattactgcgtgctgattgatgaactcggtttatacattcgtgcagtggagaaatattgtcactagctagtttatactacctcagatgattgatcaacctaccatcttgtaacttctctaatgcagatatactactgaatgtgtttctgtcaattaatagaatccatagtttgagcataacgctaagaactttcgtaaagtgtcagaaccaacgaacaataaacaggcaaattgaggggaagaaacgcacctcactgacatctcaggctgatagggatccgctaatgtcttcgtcctctggtttacttccatttagttgacattacagataaagattgcgtcaggcttatgcctgcagggtgcaaatgatgtgagaaatgagaatacagattagtaccctgaaaagtagggatggcaatgggtcgggtcgggttgggtgcgggtagagcaagtccgtacctgacccgcttttgcccgcccgattgatacccgatagaattggcgggtagaaattcatacccatgcccatacccgttgggtatggtatacccggtggatacccagtgggtttcatatgattgatatctcaatagaaaggtaactaaataaagagcaataaaatcagtaaatcgtaaaattatcaccaa

SEQ ID NO: 30100 - DNA, 1501 bp, Oryza sativa
cggcaggaaggatgccggccgcggcggctccaagaagggcggcaagagcgccacgccgaagagaagcgtggggcggccaccgtcgaagcgaggtgccgccgccgcaacgacgccgccgccgtcgaagagggccaaggtgaaccggtcggagaagacggcggcgacggcgacggcggcgaagcggggtgggaggaggtagaaatttgccaatttgggggcagtgtagtgtaagctagtagaacagatgtgacctgtagcaagtagcaaaggtggatagttcaaggtatgagtaaattacgtagttttgcgtctgcagcatttggaggctaatgtattgcattccgtagtcgactaactgatcgtctgtctttgtagcaacaccattgatcacttgcaaattgctgtttgaatttgtcgttccccatcaccatgtgtttgaagcaacaccattgatcacttacaaattgatggtttgaattgatcgttacccatcaccagggtctcactctcacatcgtttggtttattcccttctcaatctcaaaattttgggttttttttttgaaagaaaaacaaatcggcttcaacagttccgtatgcccaaaattgaaatccacaaccacattcatatttctcgctctctacgagtttagtcatggttgctccctcccactccatcaatctcaaggtgctaaattttagaaatttttttaaagatcggctccaacagttaccctatgaagaaatttaaaattgaaatccataaccccatgcttctcagctctccacaagttaggcgtgcccgctctccgaaggtgttactgttcgcgggaggggatcggggacaactgcgcccacgcagggatgggagtaggctaacggttttgttggtgtgaaagtcgacctactttttttatttattactggaagataatttttagttatcttataaaggagaatatattcacaccttgagaatgcaattcgttatccttctttaaatgagagaaggaaaaacacaaaatggtgcattgaatgaatgcagttaaaaaaaatgcaacgttgaaatcaagatgagaggaaaagagaaggaaaaaaaaataaatggtgcattcaaagaacacaattcagaaaaaaaaatgcaacgctgaaaaggaaaagaaagttctatgcacaatgcagaaaagaaaatgcaatgctgaaaaggaaaagaaagaaaaaaaatgcaatgctgaaaaggaaaagaaagttaaatgcggtgagcgtggatcgaacacgcgaccttcagatcttcagtctgacgctctcccaactgagctatccccgcattcatgtgccctaagcattaaatatggtctctatagttgtttacctatcacaacctgatcactggaaagcaagatacagtcttcgttttcacgttgcattcaggtggagtttacaaatcctgcactagagagacaagaagattggagatggtggcaaagggtttaacagttttg

SEQ ID NO: 30101 - DNA, 513 bp, Oryza sativa
aaaaaatttgtatcccgaatattcgtgagaaaaaaaatcgaatgaccaatatattttcaaatttaatgcaaagattaagttgatgagaaacgacgagcaatttattttatatcctaacactaacacacgtgaggcaaacaatttattttgtactcagttactttcccaaaactttggcaatagccaactcttgccattgccaaaaaaaattggctaagactacaaacgacaccaaaccaacaggctgttggagatgtttggacttgacctgaaccgtccacatcttatgggcctctatatttgggccttacattttcccaaccaaaataacaatacgaatcttgatgggaagtttagacggctgagatttcgcggtaaccgccattcaaacccgccaccgagttccccgccccaaactccgccccgctctctccgaaccatcaaacaatctcgcaccactttctctctctctctctctctctctctctcgtcgcgtgtcgtgtcgtccggaaa

SEQ ID NO: 30102 - DNA, 1501 bp, Oryza sativa
aaatataatcaaattatgcgagttaatttagtttccttagaaaagtagagatgaacatatgctggcgatagttaataccactagaatcctcgagatatttcttgcttttatttattaagacagctattcatggagaactggtttttaattaagattaaagctagctttcatggggaagagaggactagctatagggagcaagaattccgagtgccactagagcaagttgaagttggtgagatctactgcattttttaaactcaatcagatcctagtattaatgaggttttagatgcagatatacaccatttgtcatgctcggcttccaggtccttgatcattgtgtttccccaggtatcatatatctgcgtggaacacatcctataaaaatatttcagttctgtggactaaaattgcttcaatgatctctgaattcctaaatgcagaattacagtatcagtcaaatcttcatcctatgaaatttgtttgtcttaattgtacatggaatttatgaactagaaatttctagttggtgaacccaagagtccaagttcaacttgtctaaaccatacggattaatctttctgtttcatatttttactaaaatgcaaaggacacaatcatgccatagaacatgatttccttgcattttcagagaccaattgaaccggtggaatatagagaattcacacaaattcgacgaatttcccctataacatatgcttatccaaatatttgaaatgcgaaaagatttttttttgtttctacaggtatttagctaattccccattatctaaaaaaaattagctaattccctcatgaaatttataggttcttatagattgcgtagctaatagaggaaggaaatgtacttatctacaccattttcaatatttttaacaaataatgttccacaagttttctacgagtacattcttagagctttattcggtttggaggaatttcaaccataaaaatagggaaaatggagaaatagaaatgcttgcacacttcaatccattggaattttttaaaaggttgaagtggatgaaaattttcctataattattcctctacaacttataaaaaaaatttccttcggttttcctatactgacattccttggtgacatttctgaaagcagcagactgagttccctttaattaggcactggattttacaaaacgggccgaatttagtcgagtgaactcgagtacaagcccattttttctaggcccaacagatataactcgcagcccatctcacggcgaggagcgagctaaaccagccggcctttccagaagcttctcctttatataaaccctcgccccgccaaatccccaccgctccaaatttcgaaaacctcctcctcccctcctctcccccaccacgagacctcgcatcgaatccttcctaccctagccaaatcatcgccgccggcatgagcaccgctcccaccggcgatccgccggtccgcgtcgccgtcgctagcggcggtggc

SEQ ID NO: 30103 - DNA, 1501 bp, Oryza sativa
gttgtcgctgtcctggcagttgatcgatcgccggttggtcgagccctgggccgtcggtgcacccagcgtccgccgcgtggcaagtgcctgtgagtactggccagtgtcttgctgctcgagtactgaagcgtgttcagttcccattggtagcctggggaccaagtagcaaggaatcaggagtctcaggactgcaaggtgctagtagcagatggatctggtctggtgccatgtacacggcacacgtgcatacgctttgcaaggattcgcaacgagaattttgcggtggtgccgtggagctatacgtgacaaatgtggggccagcttccttttctgcgccgggcatatgctagcttgagtgtgaaaaatattactactccctcctttccttgttatatgatgttggacgtcaaacaaataaaatcagataaagaatacatcactaaacagattttagaagagaaaattacacgaacaatggtcagggatcaagtcgttctcaagctcgggatgaggtgaatggagagaaagtgtaacttacccatgacagcaacggtaaggagtaaggacaactatcttcttatattaataacgagctcttccgctccttcgatgctagtgacacataaactttggtatagagtatctatgaatcagggttttgggactaggagataatggagaggggacgatgaggatatcttatgagacaatggaatgggtggactgcgagatgagacataagcgttggtgctggagttgtgaggatagtgaagggtgctagggttgtgaaagagtggtcagatggcgggttggtggtggcgtctctagtggcttactccctccgtcacaaaaaaagacaaaccctggtttccgtgtcgaacgtttgaccgtccgtcttatttgaaaaaaatatgaaaaaaatttaaaagacaagtcacgcataaaatattaatcatattttatcatctaacaacaataaaaatacgaattataaaaaaattcatataagacggatagttaaagttggacacggaaacccagagtttgcctttttttttttttgggacggagggagtacatcgttggacatatagaaaagatgatgggaacgggacatctcaatgttacctggtttagggaggaaaggacgatggtccggtgagccttgccagcatcattggtaacttttgtgctgatgaggatgaggtagagtagggaggagcaccgtgacggtatgagtgagctttgtatggggattaggggaaatatacggtcgaggagtattgtattggcacttattttgatacgatttcagcctttcaggtgtctaaaattcatgtgatttttgaagaaaagaaatgtgtgaagtaatgcattgattgataaatagctaaaaaaaatcggttatttgatccacaatggataacctagatagaacatccgttgctattgtgctttactgcagtatatacgaccaccgcttcatcccaatgactcgatt

SEQ ID NO: 30104 - DNA, 1501 bp, Oryza sativa
gtggctcttctcctctctcggaatcgaaggcgagcgcgcgctttaatttcttcatctccctccatcttcttcattggcggcggcggcggcggttttgcggcggcgcgtgcaggccagcaagaacgaagctaaggtacgcgttccaagccctcctcccgtcgtcgacctcctcctcggccgcatgatcccggaggagatctcgattccgacgtgtgcccgcgcgcgttgctatctcctatctgcatctgttttttttttaaaaaaaaaaagaagaagaagaagaagaaaaattgttcttcagtcaaagctatagtactctccctattggagtgtgctcattcgatcagtcatcagtcagagctagatgattggcagatgtaagctacagtttagtttgtcagtaaatagtatagtacagtgcaagctccatcgtcggcgacgatcagatcaggctactgatggcatttgctgcacggctgtgcgaatgagctgcatgcacttggagttgatgttagagtttgttaaaattaagtttccatatgaattaggctaggaatttaggattcctccctattctcccgattctgtttctgtaagtcgtttagagataaggtagtcgagctctagtattttgtacagttgactgactccttggagttgttttgatcttgcgctttgcattgactcagttcaaagctgttttgatcttgcactttgcatggatgagcatatcgatataggggtggatcgaaaccatgtgaagtctgaaactctgaagctcatttcacatgctcctgtagtgttcttctcctttgggagaatctcagttacctgctctttttaaaagctaatcttgtgatacttcgctgcatcaacttcttgtagcctagtggttgcagtgacctgagcagtaccttaaggttttgagttcaaatctccatagaagcgaatttcagattgggttgaatttcagattaagttgtttgcggggttaagttcctaatttaaatggccgcatatatccggttggatgtagatgccgggtaaaaaatacccttctctaaaaaataaaaaaaaaatcaacttcttagtttatttatcctctagcccttagtttttcttccttgtggtagactggtagttcgcccttcttcttgtttggtttcgcatgtagtagaatccttggagacaaggaagaagtaaaacttgtttggtttcgcatgtagtagaattattggagacaaggaagaagtaaaacagttgtacaatttgcaatctctgtaccatggacatgacatttggtccaataatggtcctttctcatcattgtagcaaaaaaaaacgttttttattttagaagtttatcttttagacgatcaaatacgcatttctcgacatgaaacatgagaactattattagttgcgatgcacttagcatgtttgatggttttacttttcaggacagggaacagtgactgcttgttgaactaagctacaacaa

SEQ ID NO: 30105 - DNA, 1501 bp, Oryza sativa
cgtcgtcgtcgatcttggcgatgtcgtcgtgttcttcctcctcctcctcctcctcggtcttggcgacgctgtcgtcgtcttcgtcctcgtcgtcgccggcggcgtggtcgtccttgaggtggtgatgcttctgttgttgtggccttcccctcctcttgtacgccgggatcacctcctcgccgccgccgccgctgctgctgccatcgtcggctttcgcagcttcggtggatttcctgcctttcccacccctcggccttcccatccaggcgaaccaaacaaacaggggatgaggtggtggtgatgtttaagttggtaactgcaaaataatatgataaacaaatcgaagttaggatatattttttctctctctacttatctgtaatatgtgtgctgctagtttcaactagtcacaactcacaaactcaaatagctgactagatttgcatctatgctcgtgtgaaagaatacgaagaactgattcttacagctaaaagctgcaagcctataagcatcacatgtttgaggcttgtggggtgaaagatttgagccagttattattacagtgggaaaagaagtttgtttgatggatacaaaaggagaaccaaccacagaaatactattggaagtttggaacaacctaacacaaaggcaagaaccatgtgaacagactcattcatgtcctgtaatcttctatccactgtctagaacttcaatccaaagtcataactacctcaagagcatgagcatcccgagtactaactaggtaagtagagattggaaatcagaagaacgatcaagaacaagaacaaaaatatgtactgacctgttatgatgtctggcaatccgaaaacttccctcgacaagccttttcctccgggattaataagagggtttcagtttgcagcaaagagatcttcagagactagctagctgagctattctacgattgctatcaggcaagaaccaccaaccaggacatgaacaagagagagagaaagaacagaggggattcagatatcaagaagaaggcggcgagatcgagtcgagagcttgagatcgtgcacaagactacacgagtttgtgcacacagaaaagagaggaaccaagagacagcaggaagaagaactggctacaccatttctgcagatagagagagagagagagagagactgtaaagagataggagaagtagaaaagatggagatgggagtttgcttgcttgcttggtttggctgccggtggtaacaacgtgcagcaggaatgtacggccctcaggtacagcaatagcacagtgaaagcatttctgatgctcgcttactttctttctttcttttttttttgggagtggaatctctgtttcaggttttttcctgttacaaccaggatgaaattcgtagagctccagtgtctggccctattaaactattgatgatttactgcgagatgtaataagagtacaagtgtgtgtacaatggcgagttctaacttatacagacacaga

SEQ ID NO: 30106 - DNA, 568 bp, Oryza sativa
atagttccatagaaaaacaatcgcagggaatgtccttacctaatgaaatataaacctactactacatttgtttactcatgcccaatctctagaaattattacgttctctgaatttttaaatatccccaaaagcatcaataaactttatttcacgtttttaaatagtgtatttagtagtttaaaattaaataatgatccaattaaggtttttaaagaccaaattttgcaaacatagatataacacagaaatatatatggcaatcgttatgtgttattcaaacctaaatttatggactaataaaattaaatttattctaattcagatcaagaaaaaattaatttgctgacccttaaaggcataaatattaaaacaattattatacgtcaccaaaattaaattaaccctagaggattaaataaactcatgtaaaaagatttaaggcccgtttgaagctgatggaagatgaagattaagtacacacacaaaacgagataagtcattagcacatgattaattgaattttaattattaaaaacttaataaatggatttatttgttttctatagc

SEQ ID NO: 30107 - DNA, 271 bp, Oryza sativa
ctgtaagttgcactttcaaaaataaggctactcatgcctggtttagttcctaatttttttttcccaaaaacatcacatcgagtctttgaacacatgtataaagcattaaatatagataaaaataaaaactaattgcatagtttgcataaaaatcgtgagacgaatcttttgagcctaattagtccatgattagccataagtgctacagtaacccacaatgggctaatgactgcttaactaggctcaaaagatttgtatcgtggtttccagg

SEQ ID NO: 30108 - DNA, 213 bp, Oryza sativa
ttttttatcattttcaaaaggacataaatgcccttggcttcgatagcatgtaagaatgtaaccccaaccagacccaatcatgtcgcacttgtcgttcaccccacatctgaaatctgcatccaacctaaccctaggtggctggtggtgacggtggtggcttcagcttcaaccgtgactagaggcggcggcttctgctttggctgtggcgggcga

SEQ ID NO: 30109 - DNA, 769 bp, Oryza sativa
aaagaaatgtgtggtttgattcattgaaataaggtacacagtgaagtttcgatatgttctcaaatagagcttctgttttttttcgtttttgctctgtacttccctatggattcaatgttttggagctaatttgggtctgtactgacttgcacaactattgccaaatgcatttgctcgtacacctagatctgatttgcgctaggtgaagcttcatattttctataagcaagtgtgtacactattcggctacattttcacagaacccatattttttgcaggaactatcgcagcagctacttcgtcgccctcaaggtgttcgacaagcactccgcccctaagtctgagagtggcgcctactatcatgcacactaggagttgtccgtgctctatcgcctcgcacacccacaagcacagttgcagtgaggagaaagaaatgtgttatttgattcattgaaataaggtacacagtgaagtatcaatatagcttctgtttttttcgtttttgctctgtacttccctatggattcaatgtttggagctaatttgggtctgtactgacttgcacaactattttttgagtccgatggtgaggtgagcatggctgtgccattgcagccccatgagattgtttctgacgctgaatcaaccgtaaagaacatttctactccaactcaaatgtgcatcacaccgcagaaatcatggagtgcaccattctgtgtaagtacaagaacatcaattgcatttgcttactatggagatatcattctaa

SEQ ID NO: 30110 - DNA, 309 bp, Oryza sativa
tatgggacggagggagtagcaaaatttatacatgcatatatgatgtattggatatatgaaaagtatgtttcaaaaaataatctgaaaagtatatgttactgaatttatcgttagaatacatatatactaaaatagatacaagttttgtgaagggtcgaaaagatactttgccagtcgaaggatccaacggtctacaaaatccagagcaaaaattggattgtccgcatttagatgacatggcacgttattgttttgagaaagattagttttttcactactttagattgctaatattcttttattgacagg

SEQ ID NO: 30111 - DNA, 1103 bp, Oryza sativa
tacaaatagtaatagattcgtaactgaatttggagcttgtttgatctgttgccttgaaatattttaacttactagaaaaaaaaatgcccgtgcgttgtaacgggtgaacgctattttaatcttattatacggtttagttaagatgaaatatactttggaaattcgcatggatgtatattctgtttttagaaaatcatgagctgcagttaagaatccgatcgtcttaagttagcatgcaagtttttataagagatttattatacgactcttatatttccaaaagcgaacggacttaaaaattaactcaaatacggatatgtatttccaaaagcaaacgaaattgaaaaccaactcatacacggatgacgtaccaaattaccggtaaaaaacatcttcaatttttataatagtagacgatgattttggaaactattactctaaacactgtcaatgtatttaaatagtattttgtggcggaagcagctctatgataaaaaaaaatagaacagagatggtcaataccacaaaacacccaatacaagtcagcacttaggggtgaaaacggtcacagaaattcccgatcgaccgaccgagcgccgttttcgtataagggtaccgtttctgacggtacctttttggctatttttaaattttgttttttctaatttctttctgcatcgtattaatgtctacactgagtagtttagatgataaatatggtcaattactagccgatcgagcatcgtttctgaagagatgctaccaattctgatcgtttccgaccattttcacaccttttgaaactataggtgccggaagtgctaaaatcggcacttatagatcttttcccacctccacggactaaaaacacaaaaaactggtggctttaagtgattataggtgccggttatgtaaaaagaacgaggtgtcggtttttttaaaaatcgacaccttttaaaaactgagccgtgagtcgagccgccgagcagcagataagggaggatagcgtgcggcgatgagataagtctctctctcggtctcatcgctcctctctctcttgcgtctctctctctctctcatcgtgcctctctctctcgcgaagc

SEQ ID NO: 30112 - DNA, 732 bp, Oryza sativa
tcctgcagcccgtacgaacgagataattaaacgattattaaacttagcatacatatatgattatatatataggttaaaacgtgaaatacaatatatgtaacttggcccgtttagactaatacattttcctagtaatgttgcagagaagacgtcatcgttgtccctcaagccgaagtggtagctagccatcgaaggaattcgcgcaggcaagtgatgtaaagaagtgattgttagagatttaatataagattattagagttttaatataagattattagattattagagttttaatataagattataagattattatagtttgaatataagattattagagatttaatataagattgttagacttagcatatatgattattacaattttaatataagattagtagagatttaatataagattgttagacttagcatatatgattattacaattttaatataagattattagacttagcatatatgattattacaattttaatataagattattagagatttaatataagattgttagacttagcgtatatgattattacaattttaatataagattattagagtattaatataagattgttagacttagcatatttgattactacaattttaatataagattattagatatttaatataagattagtagagttttaatattacgcttagcaaatatgacctatagacttaacaaatatttttgtatgcacaga

SEQ ID NO: 30113 - DNA, 1501 bp, Oryza sativa
aagaaactcgtttcaaccaagtctgttaatatttgttcaacatggacgcactttttttttttgctatttttgagtaatctgttgcaatgcgtgggtatttagatagtagtgattaaaaatatatatacttattaatttattttctcataggaagagcaaagggatatcgggaaaagccagaccaacggttttcatgtggtttagtttggtaaggtcacaaacataacaccaccaatcttcgccttacctaaccaaaggttggtaatgccgaaatttggtaattgttttttcaatgaagtgaacaagcccttaatttttcctattccagttttttctcaacgaatttatttccatatgggtcaacatgtttatttgggtggagcaatttacttatgtacatgatggaaccgaactttgcgtgcgatgggaagggtcatggactagtgatgcttccccgtatgaattatcattcctattttgcttgaatagctttatgctattaacttactacatatgtatataccatagtgattacaaatactatatggttatttctgattttttccaaactaggaagggcagcatgatcctgtaaagggcggtcaaagttttcacatggtttagttttttatccttgattttctcaattgacggtttccatgtgggtcaactggttcttttggtggaacggtttttttaagcaagagaacaaaactttggcaggatgagaagggttgagggacagatggaactcccattctaaaataatagagataacacaaagaatacttctttcaaggtatgttctatttactcatctcaacatttatcatatttatttccggacaaccacctaatataacaaacctcaataacaattaatacacccgtggaaaaaaaagagcaacaacaacttttactttttgataacttcacaccaggaaaacaagatttcccaatcttgcaactgtacaacaccatgagaaataaatttccacaaaaaggtccatgattcccaaacaagcacaggaacccataaatcctactccttacaacaatccggtcgcaatttgtcttatatcccaagagcctaatcgcaaaaccgccactgcccctggacatcccttgccgcagtggccgttaccaccgcctccctcctccccctcctctctccgagtccgagagcacacgcagagaaagagagagagagagacgcgtcccctcgccgcccgcctcctccaccgcccacacgaggggcacgcgcctcgccgccgcctcccctcgccgtcactaccttccatttccgccgcctcctctccacgcgccacctcaccctccccctcccccacgcgggggtataagtacgctcccctctccctacccccaaaaaccaccaaaccctagcccccccaactccgaggcggcgcggcgcggcgcggcgagagggtgggtggttttagggttttgatccggaagggagttccggggggcggcggcggga

SEQ ID NO: 30114 - DNA, 213 bp, Oryza sativa
tttatgtcacattgcctagtagaaatgaggtgtggtgtttgagagaaatggtaaaatcgccataaatgcatttacacatttctttaaaacttgtatacacttcacttgttttatttggatataaggttgaacaggcttattttacgagcacatatatatctacttaaatctcatcggatccacacaaactcggattacttatctttaaaaagc

SEQ ID NO: 30115 - DNA, 1501 bp, Oryza sativa
agcagttctggtggaaataatataatggggccccatgattccccagctcgctgtgtcgaatactcctacagtcctacatgcaggtaggtactcgttattgcgttttcgtgtggctagaaagtgttgtttgactttgtaaaattcattttttttagaagtcgctagttggaattcatgatatagtttctagatggggtaggtcttctaaaccctgccaataaaaaatgtctatcttctgaaatttgtcaattcgacctcataatgtgctagctgagttcaggttttactggtaaggaggataatcctatctagtatcttagaaggaacttccttcttggtttaagacaaacttttatcacagtgctacaacagattaaattgtttagttgtggtttttatccattttaggccgaacatttatccttctgtagttactgtttatatttctgtatagtcgatctgatcatggaatatatttcacgttgtgttatgcgatcatttgaaagtaaagtattcgctctgggtccttcggaacgacgagttgctatgattaatttgaatatgttctctgactaagtatgcacttaagctgcaaaaggaaaactttcatgaatagctatttactgaagatgagacattactagcattgccacgtgatcatatttttaatctacatagtctgcatgctcataggtggttgccattgattatctgagaatgcaaggaacatcgtttatgttgtcaaatacaatttcatcccactcaatgcaaagaaattcccttgatctctctccaactgtttcgattactttgttttctttaatggcctcaaatatcccacatttgcagatacggcacatttgcaactggtggatgtgacagttttatggcctttgggatggcgctagcaaaaggtaaattgtcttccgtgatatatttgttgaagaactatgtatgataacttcagcgtacattattattttttcttcttttaattgaagtgccccagccctcaaatacccatgtaacatcacttcttgtctttcagcaaggatggccatctgcttcgctgtcgcatccaggtgcacgttcgataagccgtaagggagacataccttaagaccagaatttggctgggacaagtattccttttcagtagggatggcaattttacccacgggttcgggtatccatacccgatccgatggtatgggtatggggttaattttttgcccgtaggtacgcccggccgtaacccgaaaatctaatgggtagtagccgggttttatatggtaacccatacccgacccgaaattaatgtagaggttgattttggtctatctctcatacctattttcctttgatctattaaaatcttgaactttgatgaaattatgctagcttgtttataatttgtattgctctttttaaccattggtgataattttacgatttactgattttattgctctttatttagttacctttctattgagatatc

SEQ ID NO: 30116 - DNA, 1501 bp, Oryza sativa
taaaattataggcctcttatattttgggatggatggagtactagacatgagaaaatcattgcctatactccctattatttaatttcatgccttctatagaacacaaaatttttcattccatgtggattttgtagcattttcatataaactaaatgtgatttctacatgaacctggaaaaaaaaagaatgttctgatgctggccacaatattagttcatgtccttgagaattgtaaaattaattaagttctaaaaatccaaaattggtatgctttcaaacaagcaccactaaaatttcactgtcaaaatccaatcatcgacacaagcacaaactaaaactctccctctggtcataagtattatatgtttagaacaaaatttggttaaagttctgaaatcatgacgatcgattacatattagaataagtgggatatcgtgctagtaattttcacagtaaatctatgtatattatttttttttgaataagtatttgaaaaattgcaaagttttaaaagattaaccataaatttcaacaaattatgaccggatggagtatctttcaagtcacacttgtgtccctactacaccaaccatatgctactagtaaatgtttgcaatcactctttactcctatatatgtcccacttgaaacacagagaaattcacataaattatgcaagtagtatttcacagtgagccagcaggaatactcctggagtcctcccattctttttataaacaaagtgaggatactatttaaaacagggaccttgcgggttgtgccaaaagtcaactcctggaaacgggttccttacagaaatataatactacctccgtaccatattataaatcaccgtgattttttgctattcaaaatttgttaagtttaattaaatttttagtataatttagcaacatgtaaaacacgaaattagcttcattaaatctaacattagatatattttgataatatatttattttatgttaaaaatgctaaacttaaaaaatataattacgaaaaaaatttcaaaacaactactccttccgtcctaaaataaatctaagaccagataagacatttcttagtcctcgatagtattagaaaatgtcttatctgattataggttattgtattttgttatatttcgagacggtgggagagggagtaataacaaggatggaacagagggagggagcagtacactcccaattgcaaaaatctggtcaaatctgagccgtacgcccagttgatatgataagtggtgcactacatatccaccgtccccttcctccactaacgaatcttactcgatacagttcgtcccacttctccacacaaacaaagcaaaccgagcgtcacgtctcgggcgggcaagccaccactagtcagtagccgggccccacccttctcccagatctcccgttccctccgatctcctcggcggcggcggcggcgagcggcggatggccagccggcgggagggccccctgatgcgcggc

SEQ ID NO: 30117 - DNA, 1501 bp, Oryza sativa
aaagggacatttaacttcttgccgcttttaagatgtagcaattaattatttgtcactcactgtctatgatatgtgagccctcatgtgtctatgacatgtggatccagtggtaaataatttagcaccaagtggcaaatagttaattattcttccaaaagcacagaaacaaaagcagtcgacaagttcagatataacaacagccagtcagcaatggacgtacaatgcctgtcacactgtgtagatcgagctctaccatctctctgactctctactctctaaactctacaggccgccgtcgcagcagggaggcagcggggcaccacacaggcacctgttgcgagcgtagcaatccgcaccgtgcgccgccatgaacctccccgccggaatctcgccgcagagctcgttgtcgctgacgttgaggtgctccagcctgacgtccatcagcgacttggccaccttcccggtgatccggttgtggctgaggtcgaggtacctgaggtggtgcgggaacctcaccccggtcatgtcgaacgccagctcgttccacgacaggtcgatcttggccgccggcgccgcgatcccgaacaggtgcggcgacgggtcgccggtgaggcggttgtgcgagaggtcgacggtgtccacgtcgccgtagcagcgcggtatctcgccggtgagctggttgtgggagaggatcaagaacctgaagctgccgtgcaccagccccggcgggatggcgccggtgaggaagttgccgctgaggtcgaggtaccggaggttggggtggtcgccggcgagggacggcgggatcggcccggcgagcctgctgtcggcgatgacgagggtacggaggttggtggcgccggcgaggtaggacgccggcaccgggccggagatggaggtgccggtgatgtcgaggtcctcgagcagcgagaggttggcgaaggagggcgggatgggccccgacatgccccggacggacgcgatctggaggacggcgagccccgtcagctcgccgagcgccggcggcacgggcgcggcgacgccggcgagggagaagagcgccagcccggtgacgcggccgggctcgccggagcagaacacggcgggctcccacgcgcagcagttggtcgacggccgccacgacgacagcctgacggggtcgcccagctgcgccttcaccctcagcagcgcggcgcggtcgtcgccgttgcactccaccgccgacgagacggcggtgcaggcggacaggacgacgacgacgaggcagagcagtggaatccacgacgaggctactactgttgcattggccattttcttgggtttttagggttttttttggcagcaatgcaagctactgtgatgatctgcactgaacttgaccacctgcatatatctatagaaatcgccatgaaattcgtgtgctagcttctgcatcagattctcgtttattcacttcatgtaaaggacgttcttgtgttctgcattcaacatgcatgtgtta

SEQ ID NO: 30118 - DNA, 1501 bp, Oryza sativa
atgttatatgtcttcttcatggttgcattctgctcttgtatgttttgttgcgctaatagtttccttttcattggtgatgtatcatttaggttaacttgaagtagtagtgagcattgagcaaactatgtgttttttttctgaatttacatgattttaaagattcaaacattctgaaatctgtagattgctgcacgtttgccttattgattttggaagtaactggtaactgaaaatgtatgtgctggactgctagtagaacatgaactagaaggaataccccttgatgaacatggcaatcaagaagttaagaaggtttcttgatcttctatgactctggtagcttgtaaagacaaaacactgaccatgtcaatgtcaatgcaacttctataaatttatgccattcgatcttaaaatgttagcctgaggtttagttcttatcttctatcttagtcttggtgacagatgcatgtttggtcttacaatgatttactttaattatattgattgcctatagttaattttttattacattgttggcagaagataaatacatctaagatgtgctgttttaactttattgactgattatattccatatttcattgttttgtgattttccaagttgatatctagttgactagtactaattgtactttccgtttgtttcatgagtgtactctctatttcggttttgtgattattgaaactaaattctgtttcttggatataatttagattttatgttggttttattattttatctgggtgacattccgattctgaaaattttacatggctatgcaggtccttcatttgtcttgggggttaactccatgctttattttatttcagtatgtttgtcccacataaaaaatgttaccaagtacctgtaacctagtgataacatcgtatgtgttcatgattgtttcatgttagctgcaaaaatcatttgagtatatgcaaatgaaaacctttttcacatttcgtaacctaccttttcctaaaccaaaccaaaatttgccacccattgggcaatattaaccttgtctgctgagtgttgtggtttaattttaaccttgtctgctgagtgttgtggttatttgatagtacctttgctgccgaaattttgttgtgagatatttagtaagataaacggtggttgtttttcttgttctttcactgtgttacgtataaagtaatagagcatgctgctttgaagaaatcagtctcattattgattaatttgtacaggagacaggtatcatttcttatttagcatgtccatgtccaatttggtatcatgaacagagcttgtgtcaacaagaaagttgaatgtactatataacaataatatgacttgtctttgttctgtgtttttttttaatctgtttgcaagtttttcttgagtgaactgtctggttaatgttcccttcaaatcccttatatccctgtgttttggcattgtacaggtgagccagtcatccaagctctgtcaagatgt

SEQ ID NO: 30119 - DNA, 1501 bp, Oryza sativa
gggacaaagcgtagatgctaagttatttttgggacagagagtactgtctattttgttgtgacttgttttataattaaatgtattttacatatgacttatattcttattatatattttctttgaataaaatgaatgactaagtgctcattcgaaatgcaagtttgaaaaaacataagaatatcattaacacaaaactatgctatgaatacatatacagaacatgaaaacacaagaatcttcgaatagagattcatcaagcaggatcacaaagctactcaagcgaacaaaggaaatattatttcatcaataaaccttcgaatattttaaattgtataatactatgatatagaattatacatgctagggtgcaaaaatataataatacaacgaactaaaaaaaaagaagtttccaatggagaaagtttgaataataccagaaacgcttagtatcggacgtctgacgtatcgtgaaaaatcggatggacaaactactatccccatatccacttcatatatccattacatgacataatgatctttaaaatatttttttctcctaaactacttatccaatcgatgatatgatcacactattatattttttataattaaatctttacaacaagatatcacatcattacattccgatgaaagaaaagtatatgtttcaatccgttaaaatttaatgtttcagacacgatagcaatatgtttcaacacatgttttcattatgtttcataaaaaaattttaaatgttttgataactgaattttttatttcaccatatataacctaatgtttcataaatgaccgagaaaaagtatgggatgtttacgccactactctctcatgccattcgattggctttctccccacaccatacatgtatgcatgtatttagtgatcttaaaaatactttttcttccaaactatttatgcgatgagtgatttgatcataccgttgaatttgttataattaaatctttacaataagatatcacatgactatattttgatgaaagaaaaacatatgtttcaaacaataagaacttaatgtttcatacgtgatagcaatatgtttcaccatgtattctaattgtgtttcacaaaatttttatatgtttcagaggttgatttttttgtttcaccatgtataacgtaatgttgcaccaacggtcaactgaaacatttgaccgtcctattttttttatatcatcgggcgtccgatttgtagctctctccgaataatactcacaagaagtataactactttggctttaatgggctacaaagcctgaacatgtcaaagcccaaaacttctaccccgaatctttcagaaccggcccagcccacgagcttaacccaaaaagcccacaacagcaggaaccttctagtattctcccgtccagcgcatctggaccgtccatacgacaaccgacggctggatttccctggaaggcctttatatgcgcttccagacgctactcgaagcaggaaaccc

SEQ ID NO: 30120 - DNA, 1501 bp, Oryza sativa
gctggaagggtgggaagctagggcacggaagctgtttcctctccaattctgttccccttttttttgtttttactaatttctttttgtcattttcgtgctcttctttttggcatttttttagttctttttcgcgctatttccttgccctagcttaggtttactaatttgctaaaataaacctaagctgttctttttgtttccttgcccgttttgcttttggttctctggtttattttaggcatttttcgctgttgtgcttacaaggataatagcggaacagcgtttattttggttctatagtagcctctgttttttattgtgacttgtctgcattttcattagccacatttggttctctttggagaaacaggaacgtgtttttcgttcaacaagaatgtgtggccttaaatcagtggccttttatatggtgttgtgttgttatcgtcaacggtaagcacataaactagtatgtagttttttttaaaaaaaaaactagtaatccaattgtgttaaatcattagagcgtattttgtgtttgatagaatgggtgccaaagtcacattcaggttactgtagaatgtcgccgatgttttgtagagcaacttggaccaacgtcattccaattgcaacagtgcgagcctatctctttgaattggaaaaggagagaggcgattggtgccacgagcaacttaggtttattggaccatttcacacaaaagcaagtgcactattcaatactcattggcgtgtccatatgtgcaagaaaagaagacgagataacgtgtgtttagtacgcccttcccttcaagcgagccacttcatatatctttagcagctaagcaaagagaattaatcaattactaattaataatcgatcaaattagcaaagttggctacgaaatagcaaaaggatcggcatctgacgaggaatttcgatgggtgagatacctctgcgcccgaatcgttcaccggatattctctacaagcttcagttccatcagttttgtggggacgttttggcagttcggtgcgtgctggctgaaccgcccgtgtaggctccagcagagccacaggcacacggggccactctgcccgagcgccgtaccgcgacgcgcgcggcaggtgcgccgtgcgcgagccccacgcccccacctccgcgcgtggtggcgcacaccgactgcgacgacgagcaccaagtccaaacatgcgttacgcgtgtgccggtggtgcgggtagctgggctcccggtgttttgttttgtttattttttcatttcacggccgctgcgccgtcctgctctggtcgcgacgcgcgcctgcgcgcgagggcggtccgctcacacaacggctcgtacgcggctgtgtggcgcacgggcgcgtggtggagtggaacggtgggaaggtgcgcgacgtttcgcggggccgagccgctagtgacgtggacagagggagtaatacgtggctacgggcgaccttgcctttggtatggtatggtatgccaa

SEQ ID NO: 30121 - DNA, 1501 bp, Oryza sativa
gaagtggaaatagtgggagaaacgctacatcgctggtcgaggaccaggcagtagtcgtaacttgaccacttgaagtggaaatagtgggagaaacgctacatcgctagtcgaggaccaggcagtagtcgtaactcgaccacttaaaatggaagtagtgggagaaacgctacatcgctggtcgagaaccaggcagtagtcgtaactcgaccacttaaagtggaaatagtgggagaatcgttacaccgctggtcgaggaccagggagtagtcgtaactcgaccacttgaagtgaaaatagtgggagaaacgctacatcgctggtcgaggaccaggcagtagtcataacttgaccacttgaagtggaagtagtgggagagacgctacatcgttggtcgaggaccaggcagtagtcgtaactcgaccactgaaagtagaagtagtgggagaaacgctacatcgctggtcgaggaccaggcagtagtcgtaactcgaccacttaaagtggggcgagagagatcactacgttttactggttcaagaaccaggagtaggaatctcttaatcacctaaaggggcgctaaagttggtttattacatgtgcatatcatgtggccagcatgacgtacatacccaacttatagcatattcggatgtccgctcgcaatcatgtcgggtgatcaagccgacgacgttcacgaggaattatccgttaacaaccttttctcgagtagtccagcgatggccggtgctatgagataggtcgtcggtcttcgttggtaggttgggtgcgataactccgcatttgtcgagaatgttctcggtaatggagtgtactcgaccatcacctactcgagtgctcaactgttcctgaaaaatattttctagaaggcaagatatatagcagataatatcgaatatgtattcgaaaaactgcatgggtcttctagtattatcaggatataacgagcagatgtaaatatcaggcattatgtaaaccataaacaagcatgatttatacagaagaagacagagcgagcccccagcgttagatcgtagtcgatttaacatcggggacacccgcgcaacagatattattgtataaagaacatgctctaggtaaacataataaattatagatctgacaatgttgtatgatcagaataggtacgataaattgtagataaaatattgcgtacctttgtagatacatgctggatgtatctacgaaattagtagatcaatttgaaaaaccaatctaccaattaccttattgcgtactcgttcgacatcatatgatctgacatcttttggtacgccgcgtatcttgaggcttggatgatctcgatagaccaagttgtcgatgacgatgatggttccgatctggttaggttggatctccccacagccgaagtcgtcgagtagcttgttgtcggagagtccatctcttaaacccatctcgtcgaaatcctaaagcaccaaaatccccctacctggcgcgccac

SEQ ID NO: 30122 - DNA, 1501 bp, Oryza sativa
ctaaaagacctaatacgctaggaaggcagtgttggcgacaggggatgggcaagataccaaagggcggcctcttgcgccatgcctattaccacatcggaccagggcagagaacagttattgaacacacgattgttccgttccttccaaatggaacgcgcaccaagggtcacgaccgtgtcgaatccataacgatgctcctgcggaacgttgagttggcaagagcagtgccactcgtggaaggaaacatcgtcagagaggaagcaatgtaggagctcaaggctcgataggacggtccaccacaactggagggactcctcctttagtttgttattagcacgtatatgaaagttttatttacaaattacttttcatttgtaaatacgtcgtttggtttattccatatttccacatgcctgtcgtccacagctagctcagctgcgtcgccgacgcagacgccgagtgcgcatgcccggcccgcgcgatggttgcggttgggagatggcgaccgtttcgtcaggttctcgctgctgctgccgccggaatcgctgaagatttgttctttgtgctagccagaatccgttggtctgactagcctggagctcaataattcacttgtaacgggtgacagactgacagctagtgtgttggtcagatcagtgtgatctgagtaccatttggtatgtaataacgggcagatggcccgttaattagcgagatcgatcgatcgatcgatcttcaggcgataattatcatctttaggcgttgcctttacatacattccatcctgtgggcatcaatcatggctacatatggattgatggagtgcattcgacgacatggtttagtggtgacagaagtaccactcttttaaagtcacattctttggtagggtttgatcctgcttctttggcatcgattccttgcttaaaacggttcagcttacaatttataaagctgtactttgttggatcacggtttgggacttggagcatgtaggaggacataaaaccagtgacatgctctgacacgccgatcgagattaaaatgccaaagttgacaattgcacatgtttctttatgatgtggcttgacacttttaggtggttagttatttggttcattgaccctattttgacttccttagccatgtggttccgaacttgtggaaaccattccattggtcactttgtgccaaaacataactaattaaggctgtatgtgagtctgtgacattagttaatcataaaccaaacatggtcctataataacgaatttcaacaaagaaccccaccttttagcaagctttgttgcatcaggttttcgaggttggaaggaagttcagaggtggttagaaaacggtgattattgggaaaattgactctcagcatggaaaactgggagtcaaccacattagggccgtttccactcgttgcttacacgatcaccgcgaatcaacgctatgttttcccaatttttgtgcattgatcggtcacgccgatgtt

SEQ ID NO: 30123 - DNA, 1501 bp, Oryza sativa
tgttactgcattggaagtacatttatataagatcttgttgattgttttcttgcaagagagattgtttataaaattattgtaattttaattgtattttgagtcaatcaaacttttctcaccaaacacattatctaattgatcctgatttttttagtttctgattttagggtgaattagaattagaatcaccaagaatcagaatctactcaactagcttgatgtccgttggagatgtctatccattaataattgtctaaaattgaaattagcttgttgggatgcagtgcagctaaatcatagtggttggaacaattaggtggttctgataaaaattgttaaagatttaacggtatggaatcattatatattctaacactatgttttgttatatgctcacaattagcatattgcaaattcataaggctatattaattcctataacatatggtgatggtatgatgaaaatatttaggcatctgaactttttattcgccatggttacttatctattatgtttgttgatagaggattaacaactgtccaaaatgattcaaactcattttaatgagcacaaagcgcttaaagatatagttttcttcactttgggaatgataccaacagtcgattatcctgactatacggtgtatcactggagaaatgtgaggtagacaatacattgataatttgatatgtgttgtattaataaagtatttaaatttgggtcctttactcatgatgatagtttgacacatctgaaatatgagcgaattgtgtatttctaattgttccttgggtggagtagccgaatatagctctgctattttggatgcaaatttttaagttgttggcatcaactttaaagcatcagatggctccacaatagctctatcgttggaaaaaaattaaatatcaaattgaatatgtattcgaaaaactgcatgggtcttctagtattatcaggatataacgagcagatgtaaatatcaggcattatgtaaaccataaacaagcatgatttatacagaagaagacagagcgagcccccagcgttagatcgtagtcgatttaacatcggggacacccgcgcaacagatattattgtataaagaacatgttctaggtaaacataataaattatagatctgacaatgttgtatgatctgaataggtatgataaattatagataaaatattgcgtacctttgtagatacatgctggatgtatctacgaaattagtagatcaatttgaaaaaccaatctaccaattaccttattgcgtactcgttcgacatcatatgatctgacatcttttggtacgccgcgtatcttgaggcttggatgatctcgatagaccaagttgtcgatgacgatgatggttccgatctggttaggttggatctccccacagccgaagtcgtcgagtagctggttgtcggagagtccatctcttaaacccatctcgtcgaaatcctaaagcaccaaaatccccctacctggcgc

SEQ ID NO: 30124 - DNA, 1501 bp, Oryza sativa
gccagctgatgagttttttgtgggaaaacatgcgctttccattgagaatctagaactacccttgtattcagagtctccagcaatgccatcatcaaccttaagatgatcatcaaggtattctcttggtgctacaggagactcagaatccgatgatgatgggctagtgctgctcatatcataaagaacattacttgacatcactggcagttcagagcagctagtacttaaattgacagaagatgttcttttagcccttgttaattcaacaaccttgagtatgaaacattgaaacaagacatgttacaactttaccagaacacacaaagaaaaatcacaagatgtaagtagcaatggaccacataccatctgctttaaagctgacatgtccttcttcagtttagatatcaccatgttttttcttttaagaatttcttgcagctctgctattctctgcatatagacagatggataacataagtatatataattcacatggttggcataccaccacgacaatttgtaccttggcatcagcagtgctagatgtatgtgcagttgcagccagttcctttatgattgcatccttctcttcgcattctttctgaaggttgtacaattcctgttctgccgccagggaacttagctggatgcaattgaccagagtgtcaccagtcagcaacatttaaagcacgagaaatgttcagattttatcaaagcactccgctccataatgaaggtaatactgaaatgttgatcaataattcgtacattgaaaaaaaaactgtacatgaacaattaacaatgatgacgttgcgcataaataagatgctttcaccacagaatggagtaggatttacctgattgtccccatttacatgattatccaccgatgacacaacactccagcaaaagtctgagaggtctgacattcggcgctcttcatggtccatatgactcacgctggacctatcaacaacatcagattttgcatcgtccattccacagatatcctgcactcgtccaccatatgaaaaggaagtgagatgaaaatacctcatggaacaagctctctgtaaagacataatacctttgtcttgtgaggagtagcagcaatctctggctttgcacacgcacagcatctagctccgtcataatctcctaccttcttgctacccaccaactcagattttccctgctccgaggaaatgaaggtgttgcacttgacatactgctgttgcagggagttcatctcgtcaaacagatcatcaagcttctgctgcatgctttgaagcacctcatcctgcataccataaacatttcttcatacgattacttaaggctgcaagaacagcatgtaaaagccgagatatcgtgcatatagcacattaccgcaaacattagaatatgcaacattcaagtggaacctaatcacctacgaggtactataataaaagtcatatacgcatagcacttggccgaaatgacaagaacacacaggctt

SEQ ID NO: 30125 - DNA, 201 bp, Oryza sativa
aacccccccccccccccccgggttcaaaactcctgggtaaactgtcaggctgcttttgtgctagctacgtggtaattatacaaggcgccccgagagagctgatcattgacacgcaatgcacagtcgctgcgaattcgtgatgggcacatatatacgtaccactgcccctaggtccccctgccggcacatgccccgtgcagg

SEQ ID NO: 30126 - DNA, 1501 bp, Oryza sativa
ttaatgtttgtaaaattctttatggtatactgacatggagagatttcagagtacattttaagttttgaggaaatggatcatcagcaacaactgcatctacccaaaaaaataccaataacaacaacaactgcatcttatacgcttcattctttttagaaatggtagttaaagccaggttgcattcctgacgaaaggtccaaccttttaatagtttatctttcaaaagataaaaaaaagcttatcagtattccgtccgcgtcgcgcgtgatagctagctgagctaagcagaatgtctgtctcgtgtctgagctaaccataaaaaaagaaaagaaaatgttcagtccgagctccaaccagaatgttgtcacgagcttagcctgacacggcagcgtgtgtcaccggcggcgatcgcggtggccgccgccgccggagaggagagcgacggccgggaatttaatgcgccgtcgccgcctcggttggacagcaaatccgccaccgcggggcaagcaagcaagcaagaaagcctgcagggcatcgcaacagagatgtccattaatggccgggttgttgcagatagaggtagtgttggcattgagatttttgacctacctccaactaccagccataaacaggtgaaaaatagtgacaatggctcgaaatttgtgcagatatagaggtgtgtttagttcacggtcaaaattaaaagtttggttgaaattaaaacgatgtgatggaaaagttagaagtttgtatgtgtagaaaaatttcggagggaaatttgtgcaaatataaaactctatttcaagtgtatttcactactcagcactgcagtagaagaaagttttcgagaaaacattttttttaaagcataatgcaaatactaggtggatcggtaccgctttgatttggtagaatcgtagtagtattgtaaggtactagcatatggatcgagattctgataatctttgtcccaagaagccgatgaataaacagaaaaaaacgtaaccttaatcaccaacttgtcggctgtttctttaacattggtcggtagcatgtaatacacctttacaagatttttggcaaaggaggcccgaatttgaggtggtactcctaccaatcaagcaaagtatacacaaagcagcagcgaatctacataatgcagctaaaagcaaaaagaaaagaaaagaaaagaaagccaaaaaaaagctcaaaagaaaagagggccttgcttgcagcaagcactggcaaatctcttcaaatgtgcagttccctccacctcctcaatctctctctcaatctgtcactctcctctgcaacaaccactctctctctctcaagaatctactgttcatttccccctccattgcttctcctcacccgtgctcgcttgcctcgctctgcgttccaagaatccttggggcaagcgaaggcgaagcagcctttgactcgcctgacatggccatggcggccgccgcagccgaggcgttcggcacggcggcgg

SEQ ID NO: 30127 - DNA, 1501 bp, Oryza sativa
aatgtacaaataacgaatagtcctaatgaatgaacgcaaatatgtagatcatttaggaataacttaaaaaaatatatatgcagattaatttggaatggagggagtatattttgagaaataaaagcaaaagcaaaaaaaaaacaagtttatagcatggttagatgattaagcatataatgtcatctccaagggcagccacactgaaaaaatgcttctagatcacctcgttttatcctctccgactatgttcacgagtcatacggtcggatcatacaagattggagactcttataattcatttgttggtagaaggtgaatttgaaggttttgtacgtaaccctttacaatttctaaaattagtaattctggatcatttacgtgtaacatcatttaaagtggtatatagaattagctttcccaactcactttcctcgttttccgtacacatgcttaccaaattgctaaatagcatgattttgcataaaaaaatatacaaaagtttctttaaaaatcatattgatttatttttttaaaaaaataattaattcttactaatggatagctccgttttacatgtttggaggagagttcccaactccaacttactccctccgtcctaaaataagtgcagttttacactattcatctccaacgtttgatcgtttgtcttatttgaattttttttatgattactatttttattgctattagataataaaacatgaataatactttatgtgtgactatttttttaaaaaaatttcataaatttttcaaataagacgaacggtcaaatgttgaaaacagatttccatgaccgcacttattttgagacggaggtagtcctagacaacacagggctgtgcacagagtggaccggagcaaatgggatctgcgagcctttctttctttccttccctacccctgctcccttcctcctcagcgctagcctccctcgtgtttcctttccctttccccttttattttttctaaaaaaagggaaacacggaagagaagcgaatcttttccacctccactgggcaaaaaaaattaaaaaaataaataaaattccccattcccccgaacagattgattcgcttcgattcgagggaggaggggagcacagcgatttcttctctctctttcgccgtcgcattcgcctcgcgccgcgccgcgcacaatcccatccgctgctgcccaagtacgcgcccgccctgctgattcctccgatttctgttcgttgtttcggtgttcctggatgagtcggggtggatggatggggttttggttttttggtggcgttaatcctgtattggtcttcgccttttgcagggcttgtttcgcggattcggattggtgctgactcgctcccgattggcaccgggaggtatgaattctcgctaggatttcggtgggcggattgctgacgaggagagggttgggggggagtggagttggatgtgatcgggttgtgggaaatccctagtttgtggtgttgtga

SEQ ID NO: 30128 - DNA, 678 bp, Oryza sativa
agcaaggacaagagccatcgttccatgtctcgtgggacgtacacgaggaacattgtatatagagaggttctcacgtcatagaggtactgatttctgagctagcaccactgtagtatgttggtttgaacagcaatcctctgagctagcatgcaagtagctagcttttgtcgtaccagcactatatttatgtgctgatgtttgtttttacctaatttcagatgtaagatatgtattagcacttagctttctacgcacttatgatttcctgtaacataatcacataatttgtattattctagaaatatcagttgaattcatagcactatggaaatgtttgtgtcatgcgatggtttcatttgtgaagtggttcacaatttatgtctaaccggttgagcagcccatgatatggccagtgagaaaaacaaccgggaaccatctcgaattacccctccccacctgacctactcaaactagcatgaccagtccacccgttctattcaaagccaccttggaaacaccacaagagggatggtatgacattgaagacacgcaccaaccataggacgattcgaaatgaaccctgcagatccagaatcccagaaaatccagactcgccccttcccaagcaatgttaatgggaacccagctgatgggatacaggaaccactgacaaaatag

SEQ ID NO: 30129 - DNA, 317 bp, Oryza sativa
acatttaactgctccctctattctattctaatttgatcatcctctaagcaaagtgcacaaaataaaaaaaaatgtaatatccatcattttgaaattaatccacattaatcaatgtgctccgtcacttcgtgtccaacaaaaatttattcacactttaaacattgtgagtttaactaatagaaattaatcttaattggttgcatgtatgcatgcagaacattccacaatgaacatttactctctacacaaataaataaaggaaaaagtacgaattagcacctgaactatcgcgatcgaccgaattacccccttaaccc

SEQ ID NO: 30130 - DNA, 495 bp, Oryza sativa
cattgctataggtaacaacagctcaacagcgactcttatcatctataatatgaaaacatggttgcatgacgacgaaaaaatggaaagaatagtaataaaaagaatatttttttttgagtttatggtagacacagtctctaaataatcttatattgcctaagagatcatacttatctcttccattgaacatgcaatccaatatctctaatgctaacttaggaagtatttgtatgtatcatctgaagcaagggaatgtcttccagcaaatgtggacctcatatagccatgtgccatataaacatcaaggtgacataggaaatgagatctaaaccatagtaacaagcttcaactctaaaacattacccaattgcacgcatttgacaaactttgcaaactgatcattttgaaaaaaaaaatgatagatcacatgtaactctctccctacctctctctcaatctctctctcactcacactctctatctctccctttcagg

SEQ ID NO: 30131 - DNA, 1501 bp, Oryza sativa
gggattgaggtgagagaggaaacaagctaggaaagaatagaccagaactagagacaggaccttaaaggaactaactcttcttgttgatgtgttgtttgtttcacttattctgcaagttgattaagcaaacaacctagcatggttacatcacaccccactgatgaaaaccacgcgctacacacacaagcaaggaaacacacgactaacgactctaccctagagggtggcttaggttctgcgacaggttctccaagatcttcactcctgctttacagctggcttcactgcttccttcgcttcgctagcggatcctgcagtcttccggagcttcggcaaacaattggcgacatcttcttcttcgcaaaactaaccatctagtactagtggaaattcgaagaaggaagaagggagtaaaccttttgcaaatagcattaggggaaggagaaaaaaggaactttcgcaaatagttttatttataaaatatgtccttaggttttatccacttggcttatcctacagtcgagatggctctgataccagcttgtcgcgaccgagaaaattgcattttcccgaacgctagtgtattaatccccgtcccaggaaaagccggggtacaccatacaaacatgatataaaagacacatctttattatatcgataatatttacattattacaaaggcacttaaggcctgacaataaaaaataaacagcagcggactagcgggcctacggctccatcttcacaggcgctcaactggggtataagccaagactccacctaagacttcttctccaaagcttctcttactgaaggggggagaaagatagagcaagaatgagtacaaccacagtactcagcaagccacaccggcggatgcacgattaatgcaagggggtacaaggggtaatgatataggggttaagttttgcagaaaacagcatttaaaagtcacttagttgcccaaagccattttaaaaagacgatcctaaagctacacagtattattaatcaaggtcgtgaacccgcacgaacctgccttaacccaaggcctacgatgatttagaccgaactggcaacccgaccctgggtcccagctcgtccctagccatcccaggccaaccattccacattttagttgttgagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggcaggcaggattgagccccctagcagcaggacaccggccctgtgccatgacatctcgactaccgggccgcagctcgtgtagccttcatttgtcctaga

SEQ ID NO: 30132 - DNA, 1501 bp, Oryza sativa
ggggaaagtgggtgtcctcagaaaaccataacgattcaatggcgggaagctatccttgggatcacaatggatggtggacagaaccgttgttgtttgaatacaaacactggtactaaaatttgatcagtcaatgctaggtctgaggcttgtgaaaagaattacaaaattggctttacgcaaaagagccatagccatcctttgaaatacccctttcatatgcattgttgctgtggtggcttgctgagtacggttggtactcacccttgcaattataaaataatcagaagcgggagatgaagcttcagaggatccctatgcctactaccaggagggagatgaagacgatggcgctcagtaggtcttagtacggtcgttgcctgtggcaatggcatgccactgcctaaattccgctgccttatctatttctgcttttggatgtattccgaaccgctcggtccgatgatttaagacaatgcctaagggcttatggtgtaataattagtactagactctcgtgtatgtgcatttggtatttcagctatgaactcgtgtgtaccagactacttgatccagggaaatggtactgtttacacgaatgatttctgttataaaaacgggggtctacaactgggagaaggcggcaataaggtttttgggaagcgcttagcgcgactgctccctgttcgtccgcgacagctcgtcttcctgttcactcacgtgctgcgcgccttcgtcgacgcccgcaaccgcgagtgattcctgtcgagcaaccggttgttccgcaacctcggtacatgttcaacatgttgtgtatatttgatccgttcatgttttactgcttaatttacatatgtagatccaatgatgcgtttatgctagtttatattgcaatgtcatgatttatttatggaataaattaaatcattatgtgcttataatttcaacagtaggcaaaatgagttgcaaacagcacatcaacaataaccacaccaagtcacttcatatatattaatctaagtttgcgttcattccaagcacagacggaagaaaaatccctcgttctttgtacacgcgctactcgaacagctaaacaatatgttttttcaaaaaatttctatagaaaaattaagttatttttttcaatcatatcaatcaattttgcaagtttaaaataattaatactcagttacttatgcgctaacggctcaccattctcaaatttctcctttcccctcgtctcggttacttaagcagacttgctaataaagctatgatcaaatgccacaaattaaggtaaggcctgacacataaaactgtccatgaacattgctaatcaagtcattttcaggatacaggctgcacaagaagaatgccaactagctttctccagaagggctgagctgataataaatggaatcccttcgtttggactagccatgtctaacttggatgagatggcactggtggagaagtggtttttactcccggttcgtaacccccc

SEQ ID NO: 30133 - DNA, 1501 bp, Oryza sativa
ctagacacttgtacattgatctaatggcggaatactaattttttgcatcaacccgcccctggtgatctaaccctccgtgccatgctttgatgactcttccagctcatccttaccaatggatggatacatcctaacagatggattttgcctgcatgccagaaagagccttctggaaggctcgggaaacggatagtccgctgtaagttaagcatagtaggggattatctatgtcgtgttgtgtaacaacatagttaataaagtagtgtgctataattcaaatgtttgtgtcatatgataaaccttgttataagacaaaagaaatataaaactattgcattttcccctttcctactttaatttgtctttgttatatgttatatttgtttccagtaaggactatttggataagccaaaatgctgataatcttgctgtgtaattgtggcgcaagagttttatttgtaatcctctattactatacaatcgcagcctactaattagcattaaatattttctatcttgcaccacagtcttccacgtaagcatcaaataaaaaatgtcggattcacttctacctcaaaaacacgctttcaattttttaacagctttctcagtactggcccaattctaagaccttgccaacagcccagctaaactcctgcaaaaagcccaactcacccacacccacatcatcgttaaaaacaaaaaaacaccagagagagatgcactattcctctgtttgtcgcaatgcataccaggaatgtataaccatatatgtatagatcatattgtatcattgtattccttgtattctcctccatttgaggatcttgtaccttagctatactataacaatacatggtcatcccacaacattgggtgtgtggtgttcctctaattccttctacattgtatcagattccaggatatttccctctctttctgcaccttcctggttgccgcgcctacactgtcgcctccgtagcctccgttggtagaatgccgacattccagcactcctccgtaaaattctcgaaggaactccgatatttcagggcactccttcctgaacttcccctcactctctactaagttaacaaattaaatatgaaactgtcacgtcctgataaattcatcccgaattaaaaatcattccctaaaaggaataatagaattaattaaaattcgaaaagaaattgacaaacactaaaatacgtaccagaaaaattcgaatgtggcccggagaatttttgttaaattctccttggtctaaaaggagccctcaaattttacttgaattttcagagcaccggaaataattattaagcaacaaaaacaattatcaaagtttattaaaaagaaaacctaaaaataaatcctcttcctcctttgggccaagcccagcccaaagtcctctcttcccccccccctctctttctccccctcctccctttgggccccaaagcctccctccattcctctcagcccggccgaaagtctgtt

SEQ ID NO: 30134 - DNA, 1501 bp, Oryza sativa
ggaataggattgaggaaatgagggagagagaggggagaggggacagagatagagagggtagatagtgtgacaggtaggccccacctattttactttttgaaaaaaatgcttactggactgtcacataggaacaaaaccactttgggttgagttagggggtaaatcattctattaatagttgagagtaaaagatgtcatgttttcaggtttatggaggtaatttgtactttttcctatttcaaaaaaattttacattatatttcaggtgtcaaatatcacttgacgactatacaatgctaatttaaatctacatatgtaaaataaatgaaaataacataatttagttgtgtatttttaagtagatctaatttaattttaattcgtttgagattgagattctcaattttttttgaatcttcagaattatttcattagtatatgataagttagcaacatgaatgttacatagatgtaaaacaaatatgaaaaatattttaagccaatgatcttgcttatggtatattttcttgtagttgaggaattccaacacatcaggcataatttgatgggcttatgtcatataccctattaatgtgactataaagtatacttcaataaattagttattgtaaataagtttgggaaaatagattcattctccaggttaattagtaaaagtgtctcatgtcattatgaatcataagcgttgaaaataaacaaactcaaaattacatatatttgtcaaaatataactaataatatggtgctttggagattatcgtggtagtatttaaaagaccctttatataggttaaaaaaatcacatatagtacaaatagatatgaaacaactcaagtattccattatcgtgacacatgttctcataaattcaaggttgtacggtttcaagtaatatgtccaaactagatattaacgaaaacatgattaaaatagagtcaagatctattttaaaaatatcatctacatctacatgtaaacattcctaacaaaaatttaagcaacattaaataagtgcccgcgcatatgcgcgggctaccttcctagttaactatagaagtcaattaccattttaaccttccacctcttgtacctggtccacccttttactaccttgctcctggtaccttcaatcttagtgcgttggattataggtgatcatggatcctaattaattccaagcatagaagaaactctttcggtggaaagtttttttttctttttttcatttgtgaatttggtaatatttgatcaaattttgttaaaaatcaaataatctcggaccgaaatttcagtcacattggtacccttcaatatcttaactaattaaaagatttggatttttccggtcgtctcctcgaacgttcgccttttcatccgtccgtcgcaatcccctcccccccacccccacaatcccaatcggaatcgagccctccgttcccacatgcgccacacatcgatattacacaaattcaatcgaata

SEQ ID NO: 30135 - DNA, 1501 bp, Oryza sativa
ctcgtcgtctcgcggcgtcgcctccgtcgtcggattcgcagcggcgcgttccacgtcgtccccgtctccgtgcagctgttgccggctgccctcgtcgcttcctcgccggccccggtcgtcgtcgtcgtcgtcctctcgtcgttcccggtcgtcgtggcgttcgtccctccgtcgagccgttctcgtccgtcgtccgcgttcgtcaagcgagccgctgcagccccgtcgtcgtcttcgtcctcggctccgcgtcgtcaagcattgcgccggccgcgtctcaccttcgtccaaggatcgccgctgaagtcgtcccctcgccatttgtctccgtcgttcccggccgcctccgccgcgcccgttcgtcgttgtcgttcccacgcctcgtcgcgtggtggtaaggatctctcctctcgctgccccgtcctcgtcctttcggtgtcgcccgtgcccgttgtgcggttgtcagccccggtatccatgtatcggtatcggtagtcgttcgcttgtccgtgtagtgtccgtgttagtgtgcccacttggtagccgcgttgtttcctcgtgtgcaacccgtgtggtgtctagtggagtccgtttgtcggccactcgcctcggttgacacacggggtccgcttccgtcgacccgtggaccgtctctgtgtacctggtctaccgcggtcctttaggttgacatgtggggttcgcatgtcaacagcgcagccttcctgtcttttccaggctagcgcttacacatgttttatagtcgcaaagcctaattataataatccgcaaatctccatataacagcattaaacttcggatgatcatatcttggtcatacgagctccgaatcgacccgttcaagtctcttaatgtttgttataacctaaagaactgtgtgctttctttttatgtgttgttattgcttctttataggcttgtagctttgcttgtgtgcttcgcgtagcttctgtcgttccggaggttcccgaagcgtggttcgtggtcgtcgccgaaggttcggaaggccgttctctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctagaataaacaaaaccccaactagtggacactctattcatggttccactagtatgaatttaggtagatgcttcgctgtttaattaggcaacattaggtggttttataactttagacttggggaattctcatatcacttggatactatggaatggttggcttattgtggaattggacatacccctctcttcctctttcaaagcccctaaaacctgtttttcggtggggtttgggtgcatgctagttgtgggaagttgcaccccggccactataaggattaa

SEQ ID NO: 30136 - DNA, 532 bp, Oryza sativa
ctttaaattatttgaaaattatatatctaatttgtgatccagtcacatgaggccaacatataataaataatgttatgataatatttaaagtaaaaaagacgaattacaccctaaactattatggtcggccgaattaccaccataaactcgaaagctagacatctttcaacttcaactattaataccggacaaattactcgctgactcaactcgaagtggttttggtcaaacgtggtagtcctgtcagcattttcttcaaaaacaaattggtgggacccacctatcatatatctccttcacccctcactcctctctctttcttcttcctccacgtctgtgaatcggcaaggctaggggcggtgagcagtggggcgaaggagcttgagtggcgagcggcggaggcggctcctcctcagcctttgccggcgagcacctccttgatggccacgtgacttctccttagcctctaccggcgcgtgaagaggacaatagtggtgggcggtggagctcaagcggcggaggcggctcctcc

SEQ ID NO: 30137 - DNA, 261 bp, Oryza sativa
gtccgctgctgtttatgttgattgtcagccctaagtgccttgtcataatgtaaatattatcgatataataaagatgtgtcttttatatcatgtttgtatggtgtaccccggcttttcctgggacggggattaatacactagcgttcgggaaaatgcgattttctcggtcgcgacagaaactacaatttagttgtactctctggagctcaaaagttgtgtgttgaagtgtgttaggtctcctactttcatagctgccaatga

SEQ ID NO: 30138 - DNA, 646 bp, Oryza sativa
aactcggaattggaccgttcaagtctctaatttttccttaagaagtcaagaacccatttttgtgctttgtttctgctgttatgtggagtttgttagagtaaaagccttttcttttccgttggtcgtgtagacgctgcagcttcggaagatccgctcttcgtagaagtcgaagccgtcggttgggaaagcgagcaaggcaagtcacatcatctttgaacatattgaatcccagtttgtaaagttatgttgatttaaattattgcattatcgctttatttaaattcccgcgttatcactgttttatttagccatgcctatttacctttgttatgaccttattattgttattgttattatttccttgttcaccctagattaaataaaacccctactagtggacactctactcgtggtatccctagtttaaatttaggtagatgcttcgcaatttaattaggtaacattaggtggttttataactttagacttgggaaattctcatatcacctggacactgtgaaattgttggtttattgtggaattggcttcacaccgccccctctattcaaaatccccaaaaatggttttaggctgggctcggggtgcatggttttgatggtagcacctcggccatataaggaccggt

SEQ ID NO: 30139 - DNA, 1501 bp, Oryza sativa
gcgaaacgtcgcgcaccttcccaccgttccactccaccacgcgcccgtgcgccacacagccgcgtacgagccgttgtgtgagcggaccgccctcgcgcgcaggcgcgcgtcgcgaccagagcaggacggcgcagcggccgtgaaatgaaaaaataaacaaaacaaaacaccgggagcccagctacccgcaccaccggcacacgcgtaacgcatgtttggacttggtgctcgtcgtcgcagtcggtgtgcgccaccacgcgcggaggtgggggcgtggggctcgcgcacggcgcacctgccgcgcgcgtcgcggtacggcgctcgggcagagtggccccgtgtgcctgtggctctgctggagcctacacgggcggttcagccagcacgcaccgaactgccaaaacgtccccacaaaactgatggaactgaagcttgtagagaatatccggtgaacgattcgggcgcagaggtatctcacccatcgaaattcctcgtcagatgccgatccttttgctatttcgtagccaactttgctaatttgatcgattattaattagtaattgattaattctctttgcttagctgctaaagatatatgaagtggctcgcttgaagggaagggcgtactaaacacacgttatctcgtcttcttttcttgcacatatggacacgccaatgagtattgaatagtgcacttgcttttgtgtgaaatggtccaataaacctaagttgctcgtggcaccaatcgcctctctccttttccaattcaaagagataggctcgcactgttgcaattggaatgacgttggtccaagttgctctacaaaacatcggcgacattctacagtaacctgaatgtgactttggcacccattctatcaaacacaaaatacgctctaatgatttaacacaattggattactagttttttttttaaaaaaaactacatactagtttatgtgcttaccgttgacgataacaacacaacaccatataaaaggccactgatttaaggccacacattcttgttgaacgaaaaacacgttcctgtttctccaaagagaaccaaatgtggctaatgaaaatgcagacaagtcacaataaaaaacagaggctactatagaaccaaaataaacgctgttccgctattatccttgtaagcacaacagcgaaaaatgcctaaaataaaccagagaaccaaaagcaaaacgggcaaggaaacaaaaagaacagcttaggtttattttagcaaattagtaaacctaagctagggcaaggaaatagcgcgaaaaagaactaaaaaaatgccaaaaagaagagcacgaaaatgacaaaaagaaattagtaaaaacaaaaaaaaggggaacagaattggagaggaaacagcttccgtgccctagcttcccacccttccagcgagagaacagcgccgcatccatcctccaccgcctctcgtttatatttctgcgaggaaacgaagcgaagcgaagcgaaggcaaaa

SEQ ID NO: 30140 - DNA, 1501 bp, Oryza sativa
atataatgctcgggtagattaaattaaaaacttatgacaacaaaacatttatacccgcaaaatagtttgaatcgaaattgggtttgccttagttcgcgaataataaagttaaaataaaggaatcgactttcgcattcgactttcatttggatttatttggattttgtttgaattctaatcgaattcaaattgttctttcgcacataattatagagaccgagggagccgcggatccgggtgaaggccaagacccgcaagaccttgagcaaggcaagtcatcactattccttgaacatgttgatcccaattgcgaagttgttttgtttacaaataaaattgcatgcaattatgaatatcctacttgtaattatgccatgccttgattattgtttaccccttattccttcgtaaccatgtttacgtatgagtctctagtcaattatgacaattgcttagaaatgctattctagaatcatgcatactcatatttatcaaatgctatatgcttgggcaattacctttgggaaggtaattgagatgcggcatgtggagacatgagcgccacattgccatgatattgatgacatgatttgtgaaaggaaaaaaaagttaaacaactgttttcgactggggcggctggaggatttgggtggtgtccggaaaaggctagtgccgtccctggtcaattaaggaacgagccatgaagttaagcatgaaacgaccccccgtacaaccgcacttctcgtatgggtatagacctagcggagtggatagctgagcggaggcagtatccatgcgtagtggtcttcttttagctgtgtgatgtggcagcagtctgctggcagatgcccggttcggatggccaggtgaatggcggatgcctattccggatggtcagaggctggcttggcaatactacatgaggatacccataagagaacaatcatgatggactgggttcaacgacaagaagcaacgtaggagtgtgtgtttttcccttcccgggagcgccagaactcctctcactgctagaaacgtatgacgcctagagtgcatgaggatgtaaagttcatggagcgggtactgccaatgcgaggttatcgaaaagctttgccgtgacgcgtctcatgtgttgggatgaggctcatgtgttgggcagtcgcggagtgcgggtaaagtgtacatccactacagtgtgagtaaaccaaatctattcgaatagccgtgctcgcggttaatgagcactgggacatgtattacacttggctagactctaaattctttaacttgagtgggatggaatattgcatgataatttttatgctgatggagccacttcctgagaggcgggaatgtggacgtcctcagaaaatcataacgactctatggcgggaagctatccttgggatcacaatggatggtggacagaaccgtcattgtttaatatgaacaatggtattaaaacttgattagtctttgctaggtcttaggcttgtgaaaa

SEQ ID NO: 30141 - DNA, 1501 bp, Oryza sativa
ttatgataatttaaatttaaatggtatataaaataatgattcaaatataaaagtaaagtgatacgactttactagagaagaaaagtagggagacagtttgaatcatagattaatcatctaagacctaaaagcaattgaggtgatatagcttaatgaaagaagaaaatgtggagataatttgaccatatattaatcatttaagcaaaaaaaaattgatgtggtatggcttgatgagagaagagagaaatattattaactaattgaggatgaactatataggcacataagatatttttaaaaataatgaagatatatattgaaatattatgtgaattatgtgagatgatgatttaacatgcttgcattttaaagctctaaaatttaataaatcatttaagcacaaaaaaaaacaattgatgtgatatggcttaatgagagaagataaaaatatcattaactaattgaggatgaactatataggtatataagatattattaaaaataatgaagatatatattaacatattatttaaattatgtgagatgatgatttaacatgcttgtattttaaagctctaaaatttaataaattataaaattatagataatatagcatgtttgcatgatatttaaatgtaataactgttagtcgacgatgatgtagcatctttgcatgttaagctttaagagttagtgggttataactttatagtaagagagaataaggtgttgcaacataaatacagagtattgaagagagtagattttaaactcttaaagggatgttccttgttgtttgcatgtgatatatcactttacaaacatgcaagctaaaaatcaacttctaaaagttgcaaaaaaaactacagctagttaacgtatattgacaattaaatttgtttttttaaattgcgatatgtagaagttaaatttaacttgtatgtttgtggattgatatatcatatattaatctatctcgtcgattttttattttatttctttataaccatttgagtagctgcaaacaacgagtgaatatccccttaaaattttatttagaatagttcccttagcattgaatcttatacgaatcatttgatgatagtaagatctattgtcttcgatgtggagttgtgttcgaactttgaactcgaattatgattttcttatgctcggaatcccatattgcacgtatgtatgaatttcgtgcgaaattgcatgttcaaatcggcgctagtccgtatgaacatgacgtgaacataatctcgacataatccttttctctaacaacacatccgcgccataggccgataggcgatagttgaattacgatcacccgttgatctcccatcggacggccctcaacgcgtgaagcaacagttctctcgcctccggttctccattgtccattcacccggcccatctgcaacccgtcgagtccaacccgccgccggtccgccgccatcccgccgtctctctccccaccaccgcgccgccatgt

SEQ ID NO: 30142 - DNA, 1501 bp, Oryza sativa
aactcaggatgaaccctagttttccacactgaatccatctgtttctagaccggtcttcctctcctccgcctatatatatataaccctggtttgaactcatgccctagccgcctccccgagcgctttatctctatgttcgcccaaggccaccgctctagccgagccgcaccgccgcaaccgtcgtcgcctgaggtggctgtcgccactgtcgggttcgcaagacgaaggagaagctcggcctcacctctgcttcacttggacatcatcggagcgctgtcgtcgacatcaacccgaggtcgtcgccttttgaagctcgccgccggccactcccgtcgcctctcgttgtcgtaattgcgtcggtaaggtccatcgtgttcccctcttcttgcctatgcccttggtttccaccgccacacctttgttcgccgtcatgccatggccaccgccgtgcaccactaccaggcaccgccaccgcctctgcaagacactgacatatgtggtccgatccacatgctgacgcagctagtcaacggggttgcagatgccacgtcggacgaaaccacctcccaaatcgtctgaagagttgatttgcaacgattttgtgagttggaggacgggttatagccggttttgcggttgagggatacgattcaactagggtatgagttgagggaggcaaagtagacttatttccttcctatactttattgggtgaaaactgtgtgcaaaacaatacggttagttttactatagcccacttgaagctacatgggtttgggccttgaggcccgttccaaaatgggctggatttctcaaagcccaacaaggcaacagctggtctccacaactcagccgtttcgtttcgacaagatgtctccagtatttcacatttcgaaaaccactttcgtcaaaatcacccgctcaaaccaaaaaaaaaaaaaatccccaattcgaaacgcgattcgtcagccgtcgccatggtcgccgccgccgtcggcgaggcgacccctccgccgggcgggccaccctcccgcgtgtccgtgtcctcttcttcgtccaccccgcggcgccggtgcgccgccctcacgagccgcttccgcgagccggcgagcccgcggcggcacgcgtgggtgtcgctgcagggccgcctcgtcggcgccgaggaggcgacgtccgccgcctcggccgcgccggggctccctccggatgaggcggtggcgtgggagctcttcagcccgctccaccgcgtgctcctggtcgccaccgtcgcggctgcctcctcccgctcccacgaggcccgccgcgtcgagcaactccagcgatcgattcatattagggtttggttttactgatctcatatatttcgccttatcccagatttattagtcacatagctaatacttaatagattgaagtgttgaacccctttgttgattttagtgatctcatatatactgaagcctgtgtgttcttgtcatttcggccaagtgctatgcgtata

SEQ ID NO: 30143 - DNA, 1501 bp, Oryza sativa
gcgggcagcacaatttgtgtgcacattgaccaccctaaattcatgagcatacttgctaaatatttgatcgatctttaaataaccatatttaaacccttgcttttggatagttcaaatatcagtaaaatattatgtcgctacaactaaatcaatagttcatgtatccacattattataaacatgcaaggctaaattaatctacataggcacaaacaaaccaaacaaatccatctataaatggtgcatactttgtatcatctttatcctataatgtaagggatcatactattttaggaggaattaaggggaggaaaaaaaactatgacaactctcattaaataaaggatacatagagatagggaaggcggttgagataaaattggataaaaaataaagatggttgaagtaagattaggaacaaaataaatgaggggtggttcgatgggacagttagtactttacaacctttatattttgggatatgatttgaatccttggaattatgagacggagaaagtagaggtaaatagaggtatatctatagttagataaaatagtctcttagccatatttttaatagaaaatatcttcaattaatatgccctaaaatctataaagacatatatagcataataaaattttaccttaattaaagtttagaaaatccaaaaataagatgtgctaaatattttaaaaagtaaatacacataatacaaatgatatataatttcatggtaaccaactccattcttatgacacaatattcttttataaattcatattttcaagtaattttagtttagactttatttgctttaagggtaattagaagggaatcaaaactagcattcaaagcaatccaaaatgaattgttggcaaaaaaagaacagatttagaattgagtaaaaaatatttcagtaaaaagtcactcacatataaacatttgtattatcacaaacacattaaataggtgtccgcgcatatgtgcgggctaactttctagttgatataattttttaaacaacttttatgtatttttttaaaaaatatatcgtttaacagtttagaaagcgtacacgtggaaaacaaaagagagaataagttactttagaaaagtgtagataagtcatcctcacgccacgtgcaacaaacaaggagaaaccaatcagacttccagaaaaagtcacaaactcttgtccccattgtaccagtcctgatgcaaacctgagacaatgtgtgaattctgaatacaaacaacacccaaacctagaaaaatcttgagaaagaatggacagggacttcgaacgcttcgtggacgtgtgactcgttggttcgacacgtacacacatacctcccctatgaaacatgaaacatcagcgctagctccgaataatcaagtgcacaagtctcacacacacacactacgatcgagcaaggtggaaagaaaaaatggcgccttcacgacgtcgccgccgctgcaccgccgctcctccgaccaccg

SEQ ID NO: 30144 - DNA, 1501 bp, Oryza sativa
attgatattctatatttcattttgatttgtgtattaactgtaattcagtattctgttaccagatacactgtagatatctgtttattctctagatctttatttctttttgttagttgtttctttattactgaaagacttttggacgttaaattacatctgagaacacatcggctgcaacttttcagtttgtccgctttttagggatcaaatacagtcagcttctttgatactatatatccatagtatttcttttaagatgcacatcgtgtaaaacgtcagttaacttcatgtccccttttctttaaccgggtgcagcagctctttttttttcttttaaaaacttggttgatacgctgaccaatccattgtttcggcatttcagagcaggaagagacgaaattggtagcttcatcctggctcctgctgtttctgtaaacaaaaaatatcgatgcaagttgctacatactttatttatgtctatgatgaaaccgaccaattcaagctgttcatcttcgtcattggtatctgctccgatgtataatatgccatttggatctgcacagtcagcgtctctctgctcttgaatctatcgctcttttttaattagtggcttaatttatcaaacggaatccagcagttcatacgtgcacatttttcctatattacttgtttaccaggtacacaaaaaattcttcatacgagttgccagatggttagatatatatactcctggattctgtccatcaggagctcctgattctttttcttccagtagtacaacttatgtgcctatgtatttgcaatttgtcgcacaatttgatacctggattgcttgccgctggcgggctctgcatatgccattgcttccaagcttcatcatcgtttatacatatagccattgggttgggaagtccacaggggcaatctgatgaagttgactccatttgggagctctccaatcgcatctaaccaacaaagtcttagcttggaaatttggaacatatgtgatcaataggaaatagtagtcaaatttacaaaggaatcagctctgaatcgattatggattatctggtttttgagataatattcaagggtgtacaaatgaataaattagctaccccaattacgtagaactaattagacatcatatggtacttcgaattatctagatttatagtaccggattaagtgttcaatctagtattaggcttctatattttagaacgtagagtactttaaaattgaaattttgtttcgttaagaaaaaaaaggtattataagaaacttagtttttgcagaactcgcaacgtttaagaagcttgcaagcatacacgtaatagtttgcaagcattactcttaaatcggtaagaggaaaagaacaggagtcaaaatcaactcgtgaccataaaaaaacggagtaatcaaaacacgccctgcactgtacgaacaacctgaacaagtgaacaggaattcaccgaatcgcattcaattcggaggtgga

SEQ ID NO: 30145 - DNA, 1501 bp, Oryza sativa
tattattttatcttccgctgttgttctctgatagttgttggcatggctggccctaatataagcatttaagatatggttgtatttgtatgtgaaaaaccaaggctttaacctcctttgtgaggccccaactgggtttatgccatggttcaatcttctgcaacctatcgtgagcgctcagtacccgccgttgcctggagcatcgtcttcttcatctctgttgtgagcagtttgttgtgcaggacctgatggcttttttcaaactttattttgtccttcactgcataagtgtatcctccagtgtaatttgcccatctttaggggcttttatgtaaaactggttgttcacccagttcttccttggtaaatctgaggcttctgcctctttgttatcaaaaaaaaagcattcgtgatgtgttgtgattcaactatgtatgtgtgtaccaacttctgatccagagattggtactgataaacacagaagatctccgatttccaaaatcggggtcgacaagacaaacattgtatccccttgagctatcatgtacaatatttcttacaattggtttgaagatatccttgcaatatatccactccagagcattgtatcctagataacatttcttttatttatgctactacatctcatatcattgcatcatcattgcaattgagcaaggtcagtctcatagtcaaaaaaaaaggttataaaatgtaagaagtgtaaaggtgaaaataacaaatcgttacagttttatttttcttaaattgttgattctgtaagggggatctttcagattgttaattatgtcatgttcatcaaggaggggatctttcatattgctactcatcgtgaggggggggtctttcagattgttgattccattcatcaagagggagtggggatgggatctttcagattgttgattatgttctgtttatcaaaaaggggatatttcatattgctgctcatcgagaggggggtctttcatattgtttattctattgatcgagagagaggggaatgggatctttcatattgttgattccattatgttcatcatgtggattgcttcctaacttttttgtggaaaacgaatgggtccattgatcattttctggataagctctttcaggttgttgattctgctcttcataaggaccgcttcttctaatgaggtcaaagccttggatacaaatgccggctcaacttgcacatccttgattacttcttcactcaggttgtcgtaaccataaggtgcatctttcactcggattgtcgtaaccatcaggtgcatcgtcactcaggctgtcgtaaccattcgctgcatcctcactcaggctgtcgtaaccatcaggtgcatcctcactcgggctgtcataatcatcaggtgcatcctcactcaggctgtcataatcatcaggtgcttcttcagacacccccccaatcattgtcagaatccaatggttgttcatccgatagatccaattctctgagaatgga

SEQ ID NO: 30146 - DNA, 1501 bp, Oryza sativa
tcagccccccgccgccgccgccgccgacgccatcgatcccgcccagcaggacccccttcccgctgcctccctcgccgatcagcccgccgctgccggggaagaacaccccctgcaccatgtatagatccgtacacattttcatccataatacataatccgaattggttgtgtttgatttgatttgggtgcagtttgaattttgctcgaatttgaaattatgaaattcgcctacctgggctctcgcggtgtgcagttcctgttcgagctgagcaagcctgatcctgctggactccagctgctggatgtaagcctgtcgtttcagtcaaaatttcagtaaagtaattaatccacagtggctgaattgaagaagagtggtagtaattaactagcaaaattaatttggtttaatttgatcaaatttgggtgattgcttttgttctgaatatattgaatatatatagcctgtcattttcttctttttctttctgtgtttaattactgtttaattttgcttcactcaccttcttccttagcctgcttttccttgctgcctccctgttctgggctagcctcctcagcgtctgcatatatttacattaatcacaaaatgatacgcaaaaaagtaagcatgatcagaccaaatcatttttagtattgtccttaactcaactgatatgcacaaaaagagaacaacaactaatctctaattatttcttgagaatatcactagtatagtacctttgggtcgcgttcaccagtagatacacccctcctgtgatccttctgcaataataaaaaaaaacataaacaatatgcacattaatgtaagctaaaacataaaaacaatcaaggacagtgttctgaatagattaatcagggtgttttctttagctagcagggttagatattagttggttaattaagtggttaagtgatgatgctgaccttggctgtcaccggcttcacatccctgttgatccctgcaggctcagcagcgaaaggttggtgctgcaggtggtggtgatcctgtctcctgctccctgtcgccaactcctccatggctgctgctgcttgctgctgatggtggtggtgatgatcaggtgacctcgccatcttggttcccacagctgctggggacagcactaaactaatctctccctgccaaatcaatcaatcaatcatcacatccacaaacattaaaccaatctttgatttcatatatactacacacgagtgctacattgaaaagacaaatgacataaccaatgtgagattcagatgaaagtaagtaaaattaattaaataccttgggtgatggctccacatgcatgggctgggaagggaagatgttgagggtctctgcatcatccatgagcacaacacaaatcaagagatcgatcgagcaaaagcagaagaccagctaaccctggagactcacacaccacaactcacaaactgatcgaattgctactgaaaactctactgaagaagagagctaggc

SEQ ID NO: 30147 - DNA, 1501 bp, Oryza sativa
tacaacactttgagaggaaatcaagatatttttttcattagctccatcaacaccaagggaaaatgaccctttgacaatgtaatgtaaactagtatgtcagaagcaagaaacggatcagtgaagaaaaaaacgaaaagcagataaaatatgaaaagaaatgaaaataatagacgaggatttaatttatctcccagtaccatactgacatgtggtcctagaaaaggttttatttccttctttgtaaacataactacaaacgtcagtccaaaaaagaaaatcatcagaaatcaatagcagccaagtcggcattgtgtggataacaaacttaggtgcctcaaataccatttcatttagttatggatacctgaacaaagaatacaccgtgtctatttccaaactggtccaagtgcaatacatcaacctcaaaagaagtcatgtgaatggaggctttcatatcagcagtgaacgaaacaagggcagcagcataacagttcatctaagagtaagaacctagcaacaattctgttagaataggtgtcgaatatactagttctatttggttacagttggacttgtagttgtaataggtgttagggggtggagttagagtcgaactctgtaacccggcatctctcttaaatagagaggggcgcaccacaatgtaaccatggcgactacaatgtagcgtagacacgcagggagatgatggcggcgtgaccatggactcgtagcggctaggagctatattggttggggaggagcgcccataatcagagcctcggggatgtaggcttcggctgaacctcgttaacaaatatcgtgtgttcctgtgtcgtcatctggcgtgtcttgggcgatcaatgactgaagtgatcaggaaggttagtcgtcgttccgctatatcgactaacttttatgacgaattctaacaagaatgacctacacaaaacaatccctgccaagcatggttgcaaagaatactaaagttcctgacggattgtttattcatggttctaattggtgaaacaatagacaatacacaaagctactgattcacaaaaaaactaagaaatactgaaacatcagcactaagtaaaaaactccagatagacaccggataacccacgcatactctacacagtgcccacttgtcagctggggtcaacgctatcctccaatccctatcacagatcccgcaactacctaactggagacacccagcaatccacgtgcatctacctagatgataccagagctcaattcacgaaacacggctaaaaccctaggaacagctcaaatttaaccgcgagtaaggggatgaagcaaacacgtagcaagccaaaaaaaaaaaaaacttacgatgtgaatatcgcggaatccggagagcgcgagcgtcttgagcagctcgcatcctatgcctccggcgccgaccatcagcaccttcgccgcctgcaccccaaataactaccccccgaatcagtccccccaaaactccaccaac

SEQ ID NO: 30148 - DNA, 1501 bp, Oryza sativa
gatcggatatcggcttccccttggacttgtccagctcagcctgctgcagcgcaagggcgagcctgtcctgcctctccttgatcctcctcagcttgatcctgtctttccacatccgccgggccagatcctcggcctcaatctcctcgtcgctgacatcattctccgtcagattctggatgccctccacctcgaagtccgacgaatcccccaactccgtcgcaatgatagccagatgatccatcacaacaccacaaactagggatttcccacaacccgatcacatccaactccactcccccccaaccctctcctcgtcagcaatccgcccaccgaaatcctagcgagaattcatacctcccggtgccaatcgggagcgagtcagcaccaatccgaatccgcgaaacaagccctgcaaaaggcgaagaccaatacaggattaacgccaccaaaaaaccaaaaccccatccatccaccccgactcatccaggaacaccgaaacaacgaacagaaatcggaggaatcagcagggcgggcgcgtacttgggcagcagcggatgggattgtgcgcggcgcggcgcgaggcgaatgcgacggcgaaagagagagaagaaatcgctgtgctcccctcctccctcgaatcgaagcgaatcaatctgttcgggggaatggggaattttatttatttttttaattttttttgcccagtggaggtggaaaagattcgcttctcttccgtgtttccctttttttagaaaaaataaaaggggaaagggaaaggaaacacgagggaggctagcgctgaggaggaagggagcaggggtagggaaggaaagaaagaaaggctcgcagatcccatttgctccggtccactctgtgcacagccctgtgttgtctaggactacctccgtctcaaaataagtgcggtcatggaaatctgttttcaacatttgaccgttcgtcttatttgaaaaatttatgaaatttttttaaaaaaatagtcacacataaagtattattcatgttttattatctaatagcaataaaaatagtaatcataaaaaaaattcaaataagacaaacgatcaaacgttggagatgaatagtgtaaaactgcacttattttaggacggagggagtaagttggagttgggaactctcctccaaacatgtaaaacggagctatccattagtaagaattaattatttttttaaaaaaataaatcaatatgatttttaaagaaacttttgtatatttttttatgcaaaatcatgctatttagcaatttggtaagcatgtgtacggaaaacgaggaaagtgagttgggaaagctaattctatataccactttaaatgatgttacacgtaaatgatccagaattactaattttagaaattgtaaagggttacgtacaaaaccttcaaattcaccttctaccaacaaatgaattataagagtctccaatcttgtatgatccgaccgtatgactcgtgaacatagtc

SEQ ID NO: 30149 - DNA, 430 bp, Oryza sativa
  unsure (1)..(430): unsure at all n locations
atataggcatagtacctgccataatatcaatttgggtagcagaaggattaggaccggggacttataagtccaatggacttaaattatgtgtcaacacagattggccaccttctggatttctgagcgtatatttataacctctgtttggggcggcttataattattggaaagtggaaaagaaaaagaatgcgtaaatgttttaccggaagtgttttanannatgannatggggggggggggggaggtagattaacgtacattcagcatctgctggggtagatatggacaactactaatcatccactgaatcgctgaatcaattacgcagcagcaatcagttatcagtgcgtacgtagttagctacagtacaccatctctagatatacctgaggggtgaaaacggtcggaaatggtaatgtctctttgacaa

SEQ ID NO: 30150 - DNA, 1501 bp, Oryza sativa
agtttagagaccggtgatggactttactctatctattattacctctggttcttttgaactttgtagttgcgtcagttgggtgtaagtagatgcagcattattacatatatgggattatttggatcaggtgcagtcacaatagtgaccgtaacttgcagtagtagtacgcatcattggatataaattgaacggctcaggtcgcacatggtactgttcatattatcgtatcagcaaatactgttcatgtgggtactgtagcttttgatctgaaccggtgatcacaaaaatggatggtcgaagttgtgtgcagttgttaaatcacctaatcccaattcatatacgtggtatggctcccattcctttgatttgaaaatgtagtcatttatggctttccaaatcttcgaaagcatgatagagattttttatagcgcattttcagttttcatagtagcaagcaaataagccaaaatatcttgcattgtctgcattggtgtgagagcatctatttgaaggtgaaaatcagatacaaaccaagttagccttgaaaattgacaatgaaagaaaaggtgaaaatcatctacctgctgaccacatcttgaacaagttgaggcaatattagggaaattgtttttccaaacttctttaagaagattgattgttaaagtaggaacagagggttgatgaggatgaagatgagagtgaacttctttgtaagcacttttttgttgcactcacctgattgggtatgtttccagcaaagttggtcctccaaaacttgtggaataatttgtacctgtaagattgattcagtagctttctgatcaaacatttgtgaaattttttcagtgtcccatctcttatatatcttgataaaaaaatcagcaatatttataaaggcaataggtatggaagagtatcgaggacaaggtgaacatgaagacatgggtgcacagtgaagatggcatggacacggtcgggccttcacgctcgtgccaaaatttggtaaggctattttgttttcaatcacaggacgagtaatttcaccgtccttaagaaagtaggttaaaataactaaattttaaattaaaatttttttggtaccttgagatatttagtatctagagatatcaaatttgtcattaaaaatatatatctccagataccttctcaagaatgataaaattattcttataggactgacacacattactacacacgcaatacgttcacatactcacgaatgcatctcctaacaaacggcacattcctaatattgataaaattatttttaaaagtctacttaattacgcatgtgtaatatccgttggcacccaaacttgaatatcggttggtccctaaaattaatcttaaaccctagcattccacgaatattttaaggagaaaaacaaaagaccataatgcatttaattaatataaaagttgtatttgttgaatttgtagatgtggggtattgaagtaatgaaatttctcgttttgcgaa

SEQ ID NO: 30151 - DNA, 1501 bp, Oryza sativa
ctttctgctcctcgggctaatctttgtgagccatcgtgttcttcaaaaccaaccctttcggatggctatgaaatcagtcctggctttatagccatggttcgagagaaaaccttctctagtagtatcagtgaaaacccatacctccatcttcgggactttgagctagtgtgttcttgcatatccatcgtaggcatgacacatgaaactcttaagtggaaattgtttcatttttctcatagagatgaagcgaagcaatggtacactatgtctgtcaagaaattccacggtgaatgggagtagcttaagtgcaatttctgccttactttctttccattaacctgtgtaatcaatcttcgattagacatcctttctttccgacaacgagaaggaatccctcggtgcagcctgagtaaggttctcactgttaactcagtttggcccagacttgtctttacatgaccatgtgttgttacaacatttttggtacaggttagataaggagtctgttgaaaatctcgatatttccgctggaggatcgtttgcacataagacaactgtcgaaggaagagaactcttagatcttatcttcgagaatgattcttttggccaaagcgaagccgtcccggaggtcgagattatccatgaggaacctctgcacgtggagtcggaacccgactcaactatcgaatcctcatcccagtcgcaggagccggaggaagaagaaattcatcctccggaaattccattccaattcgaggaggatcttttcaaagattatgagaacacctcgaattattcctgcgagaagagaccaccgaccaaggtcaattctaatgaacctctcgataaagctatgcttaaagagacggtgaagaagttgaccaccatcgtgagtaatgaatgtttaagggaaggagagctctcatctgaatcgattcagatacgatgccactcctcaaccattacgtgtctcattggaggtaatttggtccgtgttctgtataatccctctgttggtgccaatattatgtcagcaacctttgcatttgattgcttaggggacaaaccgttggaaccaaccgtcaaaaccttccgaatttccacaaactctactaccgaaggtttagggattatctctggagtgcccacacggcacaacagcgttgaggtcatcttagattttcatgtgttcgatatatctgatttcgacatactcataggccatcccatagagaaactcttagatatgcccgaatccggtgtcctcaacctgaacataggaagaatcgccacctctgtccttgtgttgcaatcaatcaattcattgacggagcctcttcctattcctgaaccaattgagaaggtgatggccatttctccattcgaggccccagagtctatttcaatgaatccatcgaagaattcaatgaaggggaggatgaatctggagaaacgattgaactgccaaaaatggatcagccgtcacgtgccccaattgagc

SEQ ID NO: 30152 - DNA, 707 bp, Oryza sativa
gtcatcgacaacaagtgcgccgcgggaggtattggctatcgatggcgttggcacgtcagcgcaagccaacgctgaagcggcgaatcaatcgactactccagcccagcacatcagggctgttcaagctatactgagggaaactccttacgatcccgttctgaacgacgacctcaagtgttggatagaacgattacgggaatcgatgaccaacctcagcaacgcgtttgaagaagccgctaccgcagcacaccaagatcagccacgaatcggcgacgccaatggtgaagatccggagcagagggaattacctcgacaggctacccctccacctcgtggcactggcgatcttcgagatcaaatcaacggtcgccgaaaagcacgacgcacacgggacgacgcaaatcgctctcggcgtcatgtctcttcacggcgccatgatcgaggaaaccgcccaaacgaggaccgagattacaacgatcgcgaacaacgggggccagacaatactggtcatggccgtcgccgcaacgacgacgacgatggagatcggcgccgagacaacagcgagagacaacgagaggattcccgagatccaggtcatcatcctcgtaaccgtacgctggaaccaagcgacccatcgtcatcgtcatcatccgcatcctcttcatcgtcagacagacatccacgaaggtcacgcgaccgccgacaac

SEQ ID NO: 30153 - DNA, 1501 bp, Oryza sativa
ggagctccttgaagatgaaggctttggtgtctagctcgtgcctgccgtcaagcgcctgtggtcgtcgccctagtcttccgctgtttcccgtttgtctttgtgtgtgctgggccttcgctgcccatgtaataagttaactatttacgcttccgcttgttaaactctgatttgtatcaacttttggtgtaccttgcctcctgggacaaggattaatgcacgcacgtaaggaatgcccgttgggttatttctggtcgtggcaagttggtatcagagccccccttgaccctaggacgagccgtagaccccaagccttagcaatattttcacaaataaaaatcctttgttatttgtgaaaatcctctagtctctctctgtcttgctgcttcatttatcaccaaaatctgacctttgaaaatgttgcttttctttttgtttttgtttgtagatggccggcagcgtcacccgtcgtggtttggacatgactggcttcgtcttggagctgcgaggcatgtgcgtggtcctggggtatccacatggagtggactaccaggccaggccgcttccggatcaggagggtgatgatgcggagccccccgctgcttgggaggtcactgcagtgatcctctctggctctcccgagcggacttcgctggcagtcaccgcgggtggagattccttccccgccgcttgccagaacgccgccctcctcgccatcggcactcttcaccagcgctacccggacgagttgcagcactcgccctaccgctaccaccctcgtcgcggaggagcccgcgactacgccaccttccgggatgctagctcggaggatgacgctaccatcgtgcacctggcgcgcatggtggaggcgtacgacgcggctcgtatcgacttccaccagatggtacgccgcggcatggtcgagaacaacctgaagatcctggagctgcgtcaggagaacctgcagctcaagaaggacctggacgcagtggagacgcagctgcaccagctcaagatcgcccagggagagatctgccgccccaagcgtcgccgtgtctgccgcagccagaagatcaccgcccgcaagagcacctccaggcccgagcttgttcgtcagtccctggcgtggacttgtttcgtcgagacccctcgtgccgagcctgcgcccgtggttccccaggagggggaagcctccggcgttggaagcacggaggatgcgctgttgctcaccttccgccctggcccgtcgcagcagtagacgagcagttagtaggcttgcgcgtgtgttcttcctcgtttgtcttcttgttgagtcgtgtggggcatggttatgccggtgtgtggcataactatgtcggagcctgccttattttattcgcctaagcaacttgaactttaatgaaccaattcaatagcagtaataaattcaagaattatagtagtcgtgggtggttcgtttaattgttagctctttccctgtttgctggttctgtgtggggttttc

SEQ ID NO: 30154 - DNA, 273 bp, Oryza sativa
tgcttagctcctggtttggagttagatctgttcagccgggtatggttgttcagaatggttgggcctgtgcagcatgggtgtgctgttcagtgttggttaaaatttctgattaattactccactgttttacttctcttaaatgttttgctaaatgctgcttttgcaaatgagccgatattatgccatcctttggtatccttgtgcacttgcatatttgctgtgtggcttgctgagtatgtcatatgctcaccttgcaataatcaatcaacctca

SEQ ID NO: 30155 - DNA, 338 bp, Oryza sativa
aaagagaagagaaaagctactagagccatacccgaactcttccgaaggcttccggacacctgatttcaacactatttctattccaccagctagatactactaaactaaacttgagagaaatgagagagctattgcttgaggtctgtgagtgaagtgagaaggcgaggggtttatatagcctcccaatgatggttgtgatggttggaatggtcggaatgatgtgcactagggttcccgaccttccgaaaggttctgataaacaacgatttgggcggagtcgcgacacaaatagatctggcttcttgaatgcgcacgctcttgagccccgcaattgcagc

SEQ ID NO: 30156 - DNA, 1501 bp, Oryza sativa
cactacttatgatgatgaccggaggatttgctggggcaacttctttctccaccacgcggatctttggcgccaattgataacgagggacaaacaaagttctcttccttgcggtgagacgaatcctggccttctgcggcggtgcttctcccttcaatgcggctaattccttctccaagcgatccaccttgtcttctagcttgcaaatcttaccacgattccggtcttcacgatcttgagccgctaacacagtctccgcacgactttcatccatagcccacagcatctcaaccaaatgccttgtggtagcatcattctcaattccttcagtctcaaggtaactgccacggtcacttccctgtggttggcgaggatggtagcgatactcagtatcggccaactgatcactgtagcggtcacggagctctcctatggcgatccttgccacttcctgacatgcatggatataatttcttcctccagcttcgaacatcactgatggaatatcttcactattactgtttaaggtgactttgacacggcacctctcttcatgacgatcatgacgaatctgggcataaaaaggggcagttccaaatccaatgacaaaggacatagtacgcaactcctggacaaacccttcaacaccaaacaggtactcaggcttgtagcgcggcatctaaagacaagtgaaaggagagagttaagacatctatccaattaatagcacaagtttttggattaatttgaataaagtttagaaatcaaagtaaaaggtaagtaaataaagtaaaccaaacttgcaagataatttgaaatagttgaaaacaaagttacaaattttgtactttttaacaacaggtttcaaaagaaagttataaaatcaacttgttaaatttattttattgcagcaggattaaataaaacaatattgtaaaacttttgctgaaaaatgagccattagtacagtaatggatgtacagtactaataatactggaataaattttcgaatgagaaccattaaaagagatttaagaagtgcatgtgccattagtttggtttaattaaaagagaaagggaggagaacagttctacttttccaatatttttcagagggcttctatgggtaaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaatataatgtcattacagaggtagatagttcctctcaatcaataaagttctagcagcggaaattaaataaacggcgcagacggctccactccacaggcagcttgaccaaggctacacctaatcctccacaccatcagcctcattgtagaactcttcctctgatgaatgattgcaaggtgagtatatgacatactcagcaag

SEQ ID NO: 30157 - DNA, 866 bp, Oryza sativa
aggcacgtaaattcaactactatggtagccagtggtgactagcttgtcctcatcggcttggtactaacaaaagataggagttgatgaggatgagggactctctgactagatcacattcgatgtactcctacagttgatgcaaattttggatttttccctatcaatcttctgacttgctaagttgtgattaatgtgaatgctctattgctatctactttctagaatgaaaggagtgcctttcgttcaattcaaagtcacggagacagaaaattcgaaggtcaacaaatcagtcgagtgccaccatcatgtagcagaacacccgttcgatcaggacctcccgtcgtctctcccatttgggtcattggcattcatttcaacccctgctcaagttggtccttcaaactaatctgattaatccttcctcacacccaatgttaaagcatcccatcacatgattccacgtctcctcttcttgtcttacacttccaagatggcactctcaacttccctcctacgtaggcctccgcccactccctcagtcttaaaagtatgccacagtttcgtccctacaatcttctcaccaagggcacattgtaatgcatttgacatgatctgccccgtctaccatgtttcatgtatcaggtatgtgctacatgcaagcacataaataataagtatacttatttgcaataagctacatagcctcattttatacaaaatgagctaatatgattagtatagatgaaattgtctaagttttttttttctattcactggtggctttttcttcactttggcacttgaaccacaatatcaactatttcctgtgggactgtgaggctgtgactacgttatatccaccaaaa

SEQ ID NO: 30158 - DNA, 1501 bp, Oryza sativa
tgggcccatgaacagtgtatttttgtcttttctagatttaattcaaaacccaatctttagaagcccatatctcctaaaccgtagatccgattccagtgaaacttggacctaaattcatctaaattcaaaatctacattttggtaccaaatttgctattttaatattttatttaaatttccttaatttattcaaataccatttggataaatatttgatcttataattgaatttacaatttaaacttatatttgcttttcgaatatttccgtttattttcaaaataccttttagccactaaaaagccgccggttggaactttacgcctttcatggggacgttcgtgcggtctatcgaccccgacgttggaccgttggttgtaaagcctggcaaaacccaaacccaagatcgaaatgctgctcctggcaccccacgccttgatgcgtacagcggtcggagcttcactattccctcgacctccacagcacgccgcacagttagctcttgggctctgtgtgatcctagccgctccgccgccactcacggttgtcggagtaacacttccgccccactaaacccacacaaacctcctatccctctagccgttatactgtctgttgacatcggctagagaagatgctaagtctagtcgccatgctgcccaactctagcaacgactagcaaacacctaaaccctaactgatatttatcctacctcaatcagcttgctatctagactccacgccagctacaatatcatcccaaccatttaccctccaactactcataacctatacatgaaatacgagccgatatgctatcctatttcagcatcgactcgagaacaagtaaatcctagccattcttctaccaaagcccaacttcgaccattactagccacatactcacttaaccagttatatcccttactctccaagcaactaaaacccacagatgaaatataagcgacaaatgttgcttaatctcctatccactttagtctccaatcttttagaacctacacatattagcccagtaatccttataccttataaaggagataggttataccctaaaccctagcccttttagtcgtttatcgttttcttgttattttatggattttattgaatttggctcttcctcttcttcagtagagtttattttattttggatggcaacttgtggtatttcaaggatcagataatcaggttgcctaccttggatttattcgcgttggagcaaggcaagttattattcctcccctttgagcataaatgccctatattctatatctcttatattctatgcattagtcatacatgattttgaatacataacctgaacatagcaaaccagatatgctagctttgcttagccctgcctagttagtttgcataaaaatataatgaacttagattgggacagtacgtacgaattggttgatttccgggtggctagtactgtctcagtcgatatagttattaccaactacttatgtca

SEQ ID NO: 30159 - DNA, 1501 bp, Oryza sativa
gacagcccgagtgaggatgcacctgatggttacgacagcctgagtgaggatgcagcgaatggttacgacagcctgagtgacgatgcacctgatggttacgacaatccgagtgaaagatgcaccttatggttacgacaacctgagtgaagaagtaatcaaggatgtgcaagttgagccggcatttgtatccaaggctttgacctcattagaagaagcggtccttatgaagagcagaatcaacaacctgaaagagcttatccagaaaatgatcaatggacccattcgttttccacaaaaaagttaggaagcaatccacatgatgaacataatggaatcaacaatatgaaagatcccattcccctctctctcgatcaatagaataaacaatatgaaagacccccctctcgatgagcagcaatatgaaatatcccctttttgataaacagaacataatcaacaatctgaaagatcccatccccactccctcttgatgaatggaatcaacaatctgaaagacccccccctcacgatgagtagcaatatgaaagatcccctccttgatgaacatgacataattaacaatctgaaagatcccccttacagaatcaacaatttaagaaaaataaaactgtaacgatttgttattttcacctttacacttcttacattttataacctttttttttgactatgagactgaccttgctcaattgcaatgatgatgcaatgatatgagatgtagtagcataaataaaagaaatgttatctaggatacaatgctctggagtggatatattgcaaggatatcttcaaaccaattgtaagaaatattgtacatgatagctcaaggggatacaatgtttgtcttgtcgaccccgattttggaaatcggagatcttctgtgtttatcagtaccaatctctggatcagaagttggtacacacatacatagttgaatcacaacacatcacgaatgctttttttttgataacaaagaggcagaagcctcagatttaccaaggaagaactgggtgaacaaccagttttacataaaagcccctaaagatgggcaaattacactggaggatacacttatgcagtgaaggacaaaataaagtttgaaaaaagccatcaggtcctgcacaacaaactgctcacaacagagatgaagaagacgatgctccaggcaacggcgggtactgagcgctcacgataggttgcagaagattgaaccatggcataaacccagttggggcctcacaaaggaggttaaagccttggtttttcacatacaaatacaaccatatcttaaatgcttatattagggccagccatgccaacaactatcagagaacaacagcggaagataaaataatacaagtgcccaattaccatgccacaagcagtcgactgggaacaagacctagaacggaattacactacgatcatcttgttaggtatgcaagcgcactgacaagggtttctcttcaagcactatgct

SEQ ID NO: 30160 - DNA, 1501 bp, Oryza sativa
cgggattcaaagctatcaccacctgccgcctacctctgacaaatccgtggaatacacaataaacaaaggtaatctgtaacctagacaccacgtctaagttattaattactactctaatacttgtacatgaacttccttctttatcaagagtcctagtactagagcacttagtatgaatactaaacaatgaacccgcaaagatgaaaacctatcttacttagactaaataattaaataacataagaaaggaacacgaatgcttactttatagaagaagttctccgaacctggagcagagtgtaccgacagctccggtactcctctagaattcctcctaagaagctacactcgtcgaggtagaaatcggatgagcgccaaacttccgggcactcctccagagcttccccttactctctaccttattctaatgtacaaaagatacaatagagcctcttgtaattcagctcaaagttgtgtctattggaatgtgagtgagctcctccttatataggctccaaatgacagttaggggcatgggaattgtctaaaacaacctgcaaccgcctctgggaagaaatccgagccgtctaggtgaaagcagatggcgggaagcgctaggattggttcggccgaacccaaaaactctcctcccggcctctccttgggctgggaggttgcttattgggcccccaacaacctgggctatgttttggcccaattctaaatggtttttattgacttattgggcatctaatccgtgtaaatatgtcctgaatacgcggagatgcattttgtcatatgacggatgtgttttctcctcaaattacttgcatacacatatttcaccaacactagtggaaatgattagtaataatacctaccactaagttggataccatgttttatttcattatatacaggtattgacggtcagatattatgatttaaggaccgtcaacaatattcaccaacactcgtggaaattgttagtaataaatcctatcaataggtttaatatttcattgatttgcttttttacaggaattgatagttatatttggtatttaaggaccgtcaacaatttcaaaacatgagtaggtattacctctcatcgagagggcctaaggctgtattcgataccaggagttcctaactcccccctctcgttttccacgtgcacgcttttcaaactaccaaacaatgtgtttttttacaaaaagtttatatacgaaagttgcttaaaaaatcatattgatccatttttgaaaaaaagctaattcttaattaatcacgcgctaatggaccgctccattttccgtgtgagggtgatgggttcccaacaccaaccaacgtgcacagcctaaacctgtctaaacctttgtcctgatatccatccaaatttagatctcatacgctaccccttttactactgttgatataggacactgacagttggcgcgccatgtaggggttgcatcaagttttacaatgacaatcgtga

SEQ ID NO: 30161 - DNA, 1501 bp, Oryza sativa
taatatattatcataatatgttaaaggatgttgggtgggaaatgaagctccactaaatacatgggttattttaagaagcgatctatctatgaacattttatgtagagtagatgagagactccacgcaacctagaaataacacgataacgacgaagtattatcattgcacagtaatatttttgaaatgtcatgtaccatgaataaacactttttctatataagatagatctaacggttagaaataatgcttctaccggtttaaaaggcataggagtattttaaaaatgtagcttaaaaattatggttgtctttatatccaacattatgaagtgagcgtagttcaactggttagttttcttgcggtcaaacttgcccacccatattattaatcagaacgtttaaaatatattatatttttttaaaaaatgtatggatcaatgaacaatagctataattcgtagaatatatatgactaaaagtattgaatttctttaataattaatatagttaatttggatattcaattttaaattttacagaaaataatctaatagtgagcacaaataaaaattatttatatgatttagataatataattgtttaaaatttgttattataaaatattttttccatgtaactaaaagaaggaaataggagagaagaaatatgtgggggaggtgatatttttttccatataactaaaagaggaaaataggagagaaaagacaagtgcatactggataggcggggaaggtatacgggccccttttttttatcattgtatttggataaatcataaaatgttttttccatctaactaaaagaggaagatagaagagaaataaaatatatgggggaggcacatacgcacgtacacaagcatatgtactggacgggaggggtaggatatgagggccactttttttatccctttctatttagataaataaatctaatggtataaaataatgggcccaccgtatattagtgaaaatcgatggctagatgattaaatgccacgtggcgatgtacgagcgattgtgggagttctatgtggcggcttaatagtgtttataggatgtttaatggacttttagtatataatagatatgatgtagttattttattaatatgtttgactattcatcatttctcaaaagtcctgtgcaaatagaaaaatatattatgtttgcttcgtgtagaacttttgatactcgttttactttaaatgaataaatattagaaatttaaaaataaactaactgtattatctattaaataacggagatagtgttgcaactagcgagtgccgtcgacaaaaagcacccaaatattctcttttccttttcccaaaaaaaaatatgaagaacttgggtcgttcgggctgtagctgtcacacggtgagtcgctgatatgaggcctcgcgtaccaatatatggccagattaattggctgtcgagccttatcttcaatttctctcgatcggttcgatcccatgacc

SEQ ID NO: 30162 - DNA, 908 bp, Oryza sativa
ccccccccgacgcgcacatacccccgggccccaccatgtgttctgccccacctgtcatgtatctcaaaaaaaaatatttcacccagtgtactcacaatgtttcactatatatagatataatattacagtgaattgaaacattcttttgcaacaaatcacccacatattatgaaaaacctctattaaggaaattcatttcattttttgttccctaaaaaatatttcacctagtgtactcataatgtttcactgtttcatctagtgtactcacaatgtttcactatgtatatatctaatgttgcagtgaattgcaacattcctttgcaacaaatcacccacatattttggaaaccctctattaagggaattcgtttcatttttttttgcataaaaaatgtttcacttagtgtacttataacgttttactatgtatggatcaaatattacagtgaattgaaacattctttcgctatttactgaaccattatttttatataaggtgaaacaacgcccaatttaaactatttaaacattttcgatctacttaatgaaacaattccaatatacttggtggaacatcgttgcaacatttaaaataattcaataataagctaatttttttgtcagaatatatccatgtgtggtattgttttaaagatttaattgcaacgatgatttagataaataatttaagagaaaaatagtttaaagtagttttgcacgcatgtatcatactgacgtcagcatgacgtcggcgtccgatttttctccctcccatcggcgcccgattctgagttgcttcctctaaaaatctactccgtatgtgcttaatcaaacaagacaatcaccaacttctcttgtttttttggtagtttgctcactttctcggacaatggaataaattaaga

SEQ ID NO: 30163 - DNA, 1232 bp, Oryza sativa
gcaggcacgggctagcgcggcagaggctgacggcggcggcgaccaggcggtcggccaccacggcacgcgcgcgcgggttacaacgggaggcgcggcggtttgagcggcgcagctcgggcacgcgcgctggttcgcggggccgagcggctgcgcggtagggcagcggggccgggcggcgcagacggcgcaggcgcggcacgggcggcgaccatgcggctctcgcgcacgcgcgggcagagcgagggaggggcgctcggcgcggctctcgcgcacgcacgcgcggcgcgcgggtagaccagaggggggagggacagagagagagacagcgccgggtagggagggggagatgggccgagagagattcggcccatcgaacccgggggaggcaaaatagacttttgcggaggaattgatttgggaaggatttggattcgggattgaactcgacgatagatcggggatttcagatctgagatggcacggacactagacaacaagcaaagaacagatttcgcaaatagagtttttaagagatagttttcccgctaggcgccacgacggaacgggcgctacagtttgctagtacattaacttgtttaatgtattgactcttgctgttgatataaccttttgtttgcaggtttagtcttagtccttgagtgatgcgagttccgattgtttcttctaggatgagaacttaatggggtaaacccctagtcggtgtgcttgtgattgggtagtcaagcttccactgttctctaataagtctatttggccggtcggcctatgtaattattaagttgttgtaagtcttaagtttctttcatcttagttgtgtttgctatgtataatcatgcttaagatgaaagtgtggatctagtgcacatcctgggaactagattcacatgagtatgagttaggaatatttgagaggttgtagatctttagccatttttgtcaagtctcttgaatgtgtaacacatctggtcgccgccttcgagtggtttgacgggcacatctcaggctgaagttgactggcaggctaagggcccagcaatgtctccaatattcctctctcgaggcatcggatgtttcattatgcttgtttgatgacttgaattattcacttcatctctcaaatataatggaaggtctggagagcctacgacactattgtcagggttacgggtaaggtataccctctacccttcgatatacgtcacgtatcgata

SEQ ID NO: 30164 - DNA, 1501 bp, Oryza sativa
ctcgccggcgcctgcggaccccatgccgacgcctgcggcctcctccgcgttggcgcctgcaacctcctctccgcgccccgcgtcaccgccgacacctccttggaccaccgcgccgccaccgggcattgcggcgccaccgctgtggatcaccttctcgcagcagtcgccgaccaagagaggtgcgctgtcaccgggagagccgcctggatcgggtctagtgttagggattttcaccatttcatctcccttttcccttttaccgtgaaatactgggtatgtatatttgtgagtgagggaaatttggtctttgtaaaaaaacataacggttgtaatggtgtggaatcaacgggatgttgacggtgatggcatttttggaagaaatatgcttgtacaatggtatttttgggaagttgcacttgtcgatggcatttctaggataagggtgtttgttgatggcatttcatggattttctcattaattaaataacataagaaaggatcccgaatgcttacttaatagaagaagtttctccgaacccggagtagagtgtaccgacagctccggtactcctctagaattcctcctagaaagctacactcgtcgaggtagaagtcggagagagcaccaaacttccgggcactcatccagagcttcccctcactctacctattttctaatatacaaaagatacaatagagcctcttgatttagctcaaagttgtgtgttttgaagtgaagtgagcttctccttttatagtctccatatgacggttacaactatgggaattgtccaaaacaccctccaacgatcattgggaaaaaatcaggagtgtacacatggaggtgaacgggttcggccgaacccaaaaatccacctcccggtctctcttttggctaggaggttgcttaatgggcacccaacatcatgtactatgatttggcccaattctaagtggttttgattgacatgtgggtcctccaatccatgtaaatgtatcatgattgtccggaggtgtattttgttgcatgacagacgtgttttctccttaatatgcatgcatacttatatttcaccaacactagtggaaatgattagtaataatacctaccactaagttggataccatatattttatttcgttatatgcaagtattgatggtcagatattatgatttaaggaccgtcaacaagttagatggctttgcctctgcttttcaaaaccagctaagttttaacaaaatgctagaaactcaactagctcagatggctactcttgtccctgctaatgaatctaggaggattccagggcaacctgagccctctctagagaactttaatgataaccacaaggggaggaaaatccactcgcgaccagccacatcctaacactgcaggaacaagaaagaacaataaggaggcttcaccatctaacacaaatggagaagaagagacaattcagcgggagaaggctgcgccgcaggagtactgcgacaccaacc

SEQ ID NO: 30165 - DNA, 1501 bp, Oryza sativa
cgccgtcgccgccgcccagcacgcggcgcacctcctcccgcagccgccgccgcaggtcgtcccggccgggcttgccgacctccatgaccaggaacggcaggaacaccgagaagccgccgaacgcgttgaagccgagcacgaagaggatgttgttgatggcctcctccttgctgatgccgtgctccttctcagcgatggacacggcggcggcgccgtgcttctccacgaagcggtagaggaggtcgtacccgggcttgacgacgaacgacggcagcgggaaggagtggagcaggagctcctccagcggctgcgggatgacgcccaccttctgcgtcggcaccagctgcaacgccagccacacgtcgaggatgtacacgccgaagcggtcgacgaggccgtccgccgccgggtcggcgccgacgagcgccttgcagaggaagcggaagatgcacttctggagcgggatgaggtagctggcggaggcggcggcggggtcaggggccctgttgaggtcttcctcgacggcggcgagcatgtcgtcgacggcggcgcggagctcggcggcccagttgcgggcggcgcggcggaggaggtcgatggagaaggccttggtgcgggcgtggtcggggtcctgggtgtcgaggtagacgccgacgcgggtgccgcgggtgaaggcgaggctggggacgtaggggccgatgaggacgtcgcgcttgtcgacgagggccgggtcgaagagcgcggtgaaggcggcggcatcaacgacggcgacgacgcgcgggtcgacgccgaggaagaaggggaaggtgggcgggatgttggcgcggaacacggtgctcttgtggtcggcggcgcggcggcggaagaagtcgtcggggccctggaaccagaagtagtcgaggcggtcgcggagcgggccgagcagcggcgggccgtagctccccggtattggccgcgtcgccgccgccgcactggccggctgcgggaacgacggcaccatggcgcggcgcgcggcgacgatcggacttatcagctacgtgtggtagcttgcgttatgacactgactctagtgtgctaggcgtgtatgacaaaattagctggagcgttcacaagtacacggaggaggaggctgccacagtgtggcaacacgtttgtataaccaaatcagattacgtgggccatcatcgcgtctacgattggttgctgccgttttgagacacaatgtttgttagggttccttgtatccttaacgtgtctttcttaatccatactccctccatttccatttcaaaatgtttgacaccgttgattttttaagtacatatttgaccattcgtcttattcaaaaaatttaagtaattatttattctttttatatcatttgatttattgttaaatatactttgatgtatacatatagttttacatatttcacaaatttttttaataagacgaacgatcatgtgttaaaaagtcaacggtgtcaaacattttgaaatag

SEQ ID NO: 30166 - DNA, 259 bp, Oryza sativa
ccggcgccctcgatgcaccagacgcggccgcggaccacgatgtgggcggcggagggggggcgttcggatgcggtcgaggcgacgccacgcgtacatcgctaggtcgaaccactcggcatcgcgctcgatccatcgctgggcagaacggacaacgacgacaccgagacaccgtcgccacggtcccggttccttctcgccatcgagcttgccgcctacgccaacggccgtggccacgtccccgtcgcctccttgactcgtt

SEQ ID NO: 30167 - DNA, 181 bp, Oryza sativa
gtattgactgttgagcccggcccgtatgaatcccttgtttctacactgccgtgttgggctgggttctaaaaggcccagaaccacaagtcacttaatggcccaattaaatatgggcccatcacgctctttagcgtgggtggtgtcgagcctcttcctcctcctcctaaaccctcgactcttc

SEQ ID NO: 30168 - DNA, 1501 bp, Oryza sativa
ctagctagcttatgattttgtgcagtgtgccgatgtgcagaattagtacttacgaggtacgtgcgactgctatttttgtttgttgatataagaaattgggattgtatttttctgatttgggcaagaactatgcttcagtagtctaattttgagcatgtaaccaagatcaaaaattattgttgccttcaatagaatggaaacagcataatggaaatttctagaaggttccatatggatcggggattggacaagatgatcgtcatattctctccactacatattgtcatgcatcaaggatcaatggaaggacaattcttcattttgagacacttacctaacattcgcaaagatagacacttatgataagcacacaagcacccaaaaatggaagacacatttttttgtttggtgttgaggaccattttgttctctcctatacaacctcaaccattgtcccaatggtagacataagcagcgagggcgtcatgataagcttacagttactactctagatgagatcgtatttgatctaacaagcaaaggatgccacattttgcaaactctactactggtagactttttgatggaggtgtaacaattttcatcaagttcactacacaatttggatatgattgagcgctctcttctcaatgatcatagcatatgtactcctagtttggttttgttgcgcatcaagtacaacggaaggcaattctttaattttgaaactcttacgtaatattcacaaacataggttcttacttatgatatacacacaaacacccgggaagtggaagacacttattttttggtgctgagcaccattatttggtctctcctactcaacctcaattattgtccaaatagtaaatgtaagaagtgagggtgtcatgataccttctagctactttcccagttggcaagggatgaagatttgttaggattgctgagtggtgcatcatgtggatgaaggttcctgagttaatcccaaattaaacggtgctaaagataagcagttgcttactataaacacataagcacttacctaatacaaacacaaacacatgccaggtggaacacacatttatttttgtgatgcagagcatcattttgcagtaccatacatgtacactttcagatcaacatacatacacagtaggattacagtttgcagtcctacacacttccaaacattcatacacaacaattatctagagcataatacagagtgaaaagtatctgaatttatgccaattattgtggaattcccaaggttttggacggaattgaagttgatattctctctagttcttgaggagataatgacagatcgagctgctagattagactgaattggagaagtcttatgtgttatactataatttccccattctatatatatagagaggtaattacgctataacacccaaattctatcttaaaattattgttttcaacttttcatttgaacataaaatagaaaattaggagaaagagtatg

SEQ ID NO: 30169 - DNA, 1501 bp, Oryza sativa
atttggagccagtggttggctatactattaaacttcctctcaaccatttggagccggtggttagctatactattaaaacttgggagaatttgaaccatgccacacaaaattttgtaaaatttgtgatatgccaccctgacccacatgtcattgactcatgtgggtcctacatgtcattgagatacgggtggcatatctcaaattttgcaaatataggttggcatggttccaacaaacccaatccgtggtagatgatgtccggcaagcgagcttcctggccatctttattcccgagttttacatattttgattttggaaaaaaaaagggaaagagatgattgagtggatcaaaagccctaaaccaattttaaattttaataaataaagaaagatcagaggtgattgagtggataaaaaccctcaaccaatttaaaaagatcaagaatgatccaattttaaaacatctttgccgaatttgatgggaatgatggcatcggcatcggcatcttatggacagtatgtgcgagctgagccggcttctctcgtggactggccgtaaagagactgaaaatcgtggactgggccgtaaagagactgaaaaggaagaaaagattgggctttagtccaaaccgggactgaaaatgaagaatttattagctttcagtaaaaaaaatatttttcaatttatttctcacctcccaacaactatatattctatttctgaaaaaatatctttacttattacaacgactgacatttttcatagcattagagaaaaaaaaccatgcatgattatgtgttgcaaatgctccttactcccgtagcacggatgaatgatttacgggattcagttttatctaatttttctcattttatctgatttttgtatcgagttcttgtttatcgtaagaggatttagtatgaataatttcacattataataggtgtgaaataaattctctaaatcaccctgagattaactgaacaaaatcacccctggtgtgaaattaccctcaattattttttgtgtgagagattaaccgagcaaaatcaccccaatccttttgtgtgagagattaaccgaactaaaatcacccctcgtgtgatagattaaccgaacaatgcaaaatagaaaaatatccccaaccatatatactccctctatttcaaaatgtttgacaccgttgactttttaacacatgatcgttcgtcttattaaaaaaatttgtgaaatatgtaaaactatatgtatacatcaaagtatatttaacaataaatcaaatgatataaaaagaataaataattacttaaattttttgaataagacgaatggtcaaatatgtacttaaaaaatcaacggtgtcaaacattttgaaatggaaatggagggagtatggattaagaaagacacgttaaggatacaaggaaccctaacaaacattgtgtctcaaaacggcagcaaccaatcgtagacgcgatgatggcccacgtaatctgattt

SEQ ID NO: 30170 - DNA, 1501 bp, Oryza sativa
tttagtcccgattggtgttactaaccgggattaaagatcctagagccctgacacggcctgacatgaaatcaaccgggactaaaaatgaattttagtccgggttggagttaccaaccgggactaaagatgatttttagtcccggttggtaacaacaactgggactaaagatcttcctcttattaatcgggactaaaaatgagtcccggtttttaatggaaccgggactattatggatttgggtcgaccgaccaaagatggtttctctaccagtgttaactttagaccgaatcccattttcatctttaacccaaaaccagatataactggtcactatcaaaatcagtgtaaacatgatttctcggtggttttggctaacgtggcgcctacttggttggtttgactaggtcttcgtgacacgtgcattggtgtggcgcttaggtggtaattcgatcctagaaaaataataaaaacagtgggcccacatgtgagcagcacacaaaataataataaatgtggggcccacgtaggccccacatgtcatcctctctcattcctcctctctcccctctcctttcttcctcatcctacctgtcgcgtgcgtcgtgtggggatgtgtagagacggccgacgtcccacctgccgccacatgccatgaggagcagaggctgcggagggagctcgtccccggtgagggtgccggtgatctcccatcctcttcttcctcctctctctccccatcttccctctcttcatctctctgctctctcctctctgttctccttgacagaatagtgtggaaccatcatagttgaagtaaattatttttatagggaattgaaagttttgtcatgccaatggttatattaaggaaatagcaaatgtactacttgcaaagatctttatacatcaaagtgattgtatagaatttataaatatttttgttgggtttttattttcgagtcttttggcaatgggccatgaatttgtatatgacaatatttccaaattttacaagtgcttataatattctctagtgtatatatgttgtgcaaatgtgcactgcacatgctcaggagggtgagcataatattgttgtagaataatgtgtaagcacgacgcctctttggcttacacttcctggtagtgatgagagattaggcggaggtcttggcagacgaaaacaatcctggccctaaggtagtaggtgacatggtgtgatttatacttatgatacaaataatttttcccgtagcaacgcacgggcattcaactagtatatattattccgattactgacattcatcatactttattatttattaatgcagtatagttggtatacatgtatacaggatgaaaaccggtaaacaagtgtgagtatatcgaaaggaccacaacattcatcttccatcagattagtttttaagagacattttattttttaattacgatatctttagtcactactatctgccttccaaacatttttatttgccaata

SEQ ID NO: 30171 - DNA, 1501 bp, Oryza sativa
aaaagaaattgacaaacactaaaatacatacaagaaaaattcgtgttgcccggagaatttccgttaaatcctccttggtctaaaaggtgccctcaaattttacttgtattttcagagcacggaaaatagttattaagaaaaaaaacaattattagagtttattaaaaagaaaaactaaaaataaaccctccttcctcctttgggcccagtccggcccaaagtccccctcctctccctcggcccgcggcccaagtctctcttccctccctctcttcttcctctcctctctctctcccgggcctccctccctctttccctctcggcccagccgcccggcccaagcatggcagccgcgcctatccgcgtccaaactaaaaaatattttcaatttttttctggaaaatgctacgcatacgaattttttgtacgatattggtaccatcaaacgtaacaacgccgacggcagggaacctaactcaagcgcacggcgcatgcgcacacggcagtcaagagcgtcatgggccctaaagcccaattagcctctttgcatctaactttacatcttcctttgttaaaccctaaacctgactttccctattccatgttatcagcgcatctgcaattctgcatttaatccagagagcatacggcatacgaagacataggtatgccatcttatttgcctgaattcctttagcttcgcaatcatcttttttggtacactagtctccctctctttcttttttggtcctgggtaatgtccatggccatgaaatgcttcttttttattatagaatgaatctgaatttttgctttgcaaaacatgccattgtttcaatttacatgtttcagtaatggagaccaatttatctaccaatgaagtagaagatgatattgccatatcagacaaagatgattttattattgaggaggtccaaaatgaatcagatgaccaagaaattgagaagtttgtttcaaatgagcaatcaacagaggaagctatgttacaagaaccaaagaagggaattctatttgatagtgcaaggtgcaaggaacatatatgtatgagtaatttgcttaacctgccacatgataaatgagtgctgagtacaattactatataacatattattaggaagaatattgcttaagatatgattagaaagaagattgctttggttggatgtgcaaccagaccaacgagaaagcaggccaggtcgtcaggaggagcctgggctttggatatgggctttgcagtgaaggagggatctgtttcgtcactacaaatgttaggagagacgtttcatcgtacaaacatcgtataaaaaataatcgtatgtatagcggaactctttttttctccgcgatactatccgactcggaaccactttcgctcactttgttcgggcgtataaacaacgtattcgattcagaccggtgtaattcgattcagaccgggacacctcgtcttacttcccatcgtaatcggactcgtattcct

SEQ ID NO: 30172 - DNA, 1456 bp, Oryza sativa
ttttatggaatttctagaatttattttaaaagtcttgaaaagaaaatctaagtttaattaataaattccaatataaaaagtggccagataaaatttcattaaatactttgcttaattctataattcctagatttttctgggatttatttgagctaaggaagtatttttaataaatggaattgcatttaagaaataatttaaattgaaaaagttttaaaaagtcttcttttggctttgggccgaaagtcggcccaaaacctctcttctctctcctcggcccagccggcccagtcagccgcgcgcgcgcgccctcgctgtcgctgacaggtgggtcccacctgtcaggcccgtcgtcttcctcgggccgaaaccctagtttcgcgccgccgagctgccgccgccgtcggtgacgtcattgctggcgtcatcagggccgttcgccgtgaaccaccgtggacccgatcgatctcggccgtccgatttggatcggatcaatctcggccgtccgttcgtgtgaaccgccgcccatgcgccggtccaccaaaccctagcccgctgacgcaataaatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaaaaatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacactgattaccttattccttgataccttgggttatattaatttgactagttgagctttatttatattggttcaactagatattagatataattgcttagccctgcttagaaacattagtacacttatgggataactaatgactcactattatttcatgatggcttattgatagttcacgatggtcaatcgtgattagttaattaattaatgtgccaactaaaacctggtaatggtgggttgtgagcacatggttttgatggtcgtgctcatggcaattaaggaccggttcacgagtttcggttgtgaaacatttatcgtgccaaccacaagccagcatgggcaacagctttatcttttgtatagcatggttcattgcggggcaccagactgagaagtggcggagataagcccacgggggtcgctggggagtccatgccttgtttata

SEQ ID NO: 30173 - DNA, 239 bp, Oryza sativa
tatggaggttgacagcaggccgcacctcccccctcctgccaaaaggagcaagagggcgaaatcttctccacccaagcttgacacacgcagaaaagctgctggaatggggagaggaaaaataaaggtgccattagtcccaaagaagcttgatcttggcaaggcgccagtagctcctccaaagcctccagccgaattcacattgggcatgccattggtcggagacgatgccttattcaaga

SEQ ID NO: 30174 - DNA, 269 bp, Oryza sativa
cagcaaacgataaggattatacagaggcatataacttaaccatttgtagcaaggaattggaaacttataggatcaagcagaatgccattgattaaataatgtaaactactgtacgttcatgaagttctcttaactgttttgcaataggctcatgatcattaaatcaagtgcaattcaggctgaaattcaagaaatccctgcaaactaaaacttttgaaacggtgaagtgaacgaaatctaaaaagcattatactcatctaaattacagc

SEQ ID NO: 30175 - DNA, 1501 bp, Oryza sativa
aaaaatgtttgtccgttcgtcttattcaaaaaatttaagtaattgttaattctttttctatcatttgatttattgttaaatatacttttatgtatacgtatagttttacacattttacaaatttttttaaataagacgaacggttaaatatatttaaaaaaagttaacggcgtcaaacatttagggaaggagggagtatatgccaaacatatccctgtatggctatattgattggcaacaaatacagtactattgatcccgtgttgtgccaaccacaacagcgacaagtatcctgtcaatttgtggtgctaacaacttgccattgataagtccagattaactagaatagacgcaccaaggcacatacatgtaaatgctagctcctggataggcaaaattgatccaaagaccagctaaactgccaaatcgttgggaaagtttacataaatgtgtctcccttgcaggtaaacaaaaacatatagtgagctgaagaaggctagttcttcgtgcaagagatcagctgtgcaatcctcataaaagggatcggctgatcatagctgatgaagaaaatgaatttgttgatttcatgaataacagtggcactaaaaggcattctgaatataaatgaaaaatacagtgttagaaagacaccaaaaacaaacaaacaaagacttgcaaggaaaacagtacaagacaaacagtcaccatagttctacttctttcacatgtgaaacatggctaggaaaggaaaatgaaaacctagacatgtaggaattgagtatacgagaattgccatggtttgtaatttgtactctgtagtttgtaccataggcattgcatttattcatttactatggcaagagaagaacagagaaccaagagcagttcaagaatagatagcagtctgttagaggagcgagttcaatgcagaagagaagttataatcaattggtatggaaacaatggatgtatcaaatggcatcggaaaatgtcgttgctgcactcacatatctagctacaaaaaggacagatggcttgaaggaggagctagctacgtacatcatgatggtattattccaaatacaatctgaaacaggtttgtagcctgagtttaaatgataaaaaaaggagtaactgaatataattttaaatggttggtttgccaagtcagtaagctatacaagcacagcaatgtacaaggttatgaatatattaccaacaataatctgtctcaatgcagaaaacatgtcgaaataacaaagcacgaatgaacagagcaacgtctgtcatacaaaaaactaaaatttcttgtgtggtcttagcagagccacttatagccaacccaagtacagcgaaacgtagtcatggcagcttaatttctcaatgaaattcataacaagcacatgttcattgattattaattaaacatgttttcttttgctaaggcaggtaaatgtacctgcccatgtttgcctctatattggaattaatttgtttgttt

SEQ ID NO: 30176 - DNA, 1501 bp, Oryza sativa
tcctggcttgacaaaagattaagcctgctatttgaattagggaagcatatgcagataattaataagttattttctcacacatgcagataataactttttttttctcataggtggcataatactacttaccagcttattcagaaaataagcagagaaacatatagtgtgaatgatcgcattgagcaaagctcgagtgaacatatctgcccagtaggatttaggaactgtaaagggcacggatcctatgtacaataaaatttaacctttttaccgcaagaaatatgccaagacatatgtcgttcatagctaccaaaggtcaattttggtaccacggaaaaacaaaaggctagttctgcatcattaattaaccaatcgtatcgatcacacaaggaaaacaggggaataaaatagtagaacccacaagtcagaaaaagcccgacgtcgacgggaaacagcaaggggtcccaagaagagaagcggctggttgcccaacaccgatttttgaatgggtagcttgtgctcctgccagatgacgacattagtgtgcaaatcaatcatgattaaaataaaaatgattatattcaaaattcactaagaacaacccagaaatgatatcgccaaattcagaaatattcagaggaacgctcgctctggcatttttcattcagccttttaatgatgatagaagaaacatggtttatagtgctgtttcacaatgaatatctgctcaatcaagaggaagcatttctcattagttttagtacacatcatgtttggagaggcgatatacgtttttagatgctgaacttcaactgaaataatgcatcgaggggttagaactgcattgagtatattatttttattttttacctatgctgcaatctaaacaggcaccccattctaaataatctgaaaactcgacaatctaaacaggtttcccattatgaaaattataaaaacttgaaattgcttgtaccttcaattcagggaaggaggttttgcgagcgcaaaacacctgttcatagtgatatgggaatcagaaatgctagtcaccggtataccgtttggagtcagccccggacgggacaatttcccacggatcaaacacacaccctcacggatcagatacacacactcgagaaacattgagggcctatttggattgctaccatgccaaatttttagtagtgccaaatcttagataaattttggtcctaccaattttttggtaggataagattatatttggtttggtaccaatataaagccaacatgtgacttctagtgaagattgttctagattgatggcaaatctagcatgggcattaccaataaattggtctcaatccaaacaagcacatgtactatttaaactaccaaaatattggtaaggctaagttttggtagcaatccaaaacggccctgagtcactcccaaacagacacctacagctcccaaatcgtcacgagcatggctgcggcggcggagccggcggcggtgg

SEQ ID NO: 30177 - DNA, 1501 bp, Oryza sativa
agatttaattcaaaacccaatctttagaagcccatatctcctaaaccgtagatccgattccagtgaaacttggacctaaattcatctaaattcaaaatctacattttggtaccaaatttgctattttaatattttatttaaatttccttaatttattcaaataccatttggataaatatttgatcttataattgaatttacaatttaaacttatatttgcttttcgaatatttccgtttattttcaaaataccttttagccactaaaaagccgccggttggaactttacgcctttcatggggacgttcgtgcggtctatcgaccccgacgttggaccgttggttgtaaagcctggcaaaacccaaacccaagatcgaaatgctgctcctggcaccccacgccttgatgcgtacagcggtcggagcttcactattccctcgacctccacagcacgccgcacagttagctcttgggctctgtgtgatcctagccgctccgccgccactcacggttgtcggagtaacacttccgccccactaaacccacacaaacctcctatccctctagccgttatactgtctgttgacatcggctagagaagatgctaagtctagtcgccatgctgcccaactctagcaacgactagcaaacacctaaaccctaactgatatttatcctacctcaatcagcttgctatctagactccacgccagctacaatatcatcccaaccatttaccctccaactactcataacctatacatgaaatacgagccgatatgctatcctatttcagcatcgactcgagaacaagtaaatcctagccattcttctaccaaagcccaacttcgaccattactagccacatactcacttaaccagttatatcccttactctccaagcaactaaaacccacagatgaaatataagcgacaaatgttgcttaatctcctatccactttagtctccaatcttttagaacctacacatattagcccagtaatccttataccttataaaggagataggttataccctaaaccctagcccttttagtcgtttatcgttttcttgttattttatggattttattgaatttggctcttcctcttcttcagtagagtttattttattttggatggcaacttgtggtatttcaaggatcagataatcaggttgcctaccttggatattattcgacgttggagtcaagggcaagttaattaattgcctgcccctttgtaggcataaaatgctcctagtattgctatatactgcttactattgctatggcattgagtcaatagcatgatgtttgagatacagtaagcctgatacatatgcaagatccagtatatgggctagctttgcttagccctgcctagttagtttgcataaaaatataatgaacttagattgggacagtacgtacgaattggttgatttccgggtggctagtactgtctcagtcgatatagttattaccaactacttatgtca

SEQ ID NO: 30178 - DNA, 1501 bp, Oryza sativa
ggttatgtatgattttactaggattatgcagggtctgcttgtctcttgttttttttcatattttatttgtcagatgtattgtaaagagtactaaaataagtatagtatagtacagtttttgtactgtttagtgaaggataattaaattgtttttatgatttttaacctgactgttcagaggaaaatatttttttgctgttatatggtacaattgagtttttctactttatgatttgtatgatctcaatgactagacttttgcaaatccatatttaattacattagtacatatactgctatcagttacatttttttatctctgtaattacagtttttgttttctgtaattgcaatagaaattgactgtaatttattttatttagtattaatttttttcttatgaaataataccattgtagtgcaagttaatatgacagaaactgtagttgtgtagttgttttctatattgatctttataaataattgacattaacaaataatatcagtctcattttttttcttttgttaatgttaggatgatctccttaaggaccgttctatgacaaatatctcggctgtaaagaagtgttttgatggagcttcactagcaagacatgttcacacatgtgacctggtttattttcttactttttttctctaaattttgcattatataacttaaattctttttcatgtatttttttgttttcattcagctctttttcccaattgtcaagagtcgtcactggttcgtatttgtcattgatttgaaatctgaaagatttgtttttctggattcattgtatgatgaggagagcttctatcatgctgaattaagacctaaactggtatacttagttttatatacatttatgaatttgtaaatatttcataacagcttttttattcatctacaaaatttaacttctattaatattttttttgtagatttcaaattttagtcttgcctggaacctttatgttcaagatcactctattgatttcaacagattctcagtgatttatcctcctgtgccaaaacagaataataggtttgattatatgtctttatttttgcttaccaattttcttttcaaatctttttttttggtttgatattgtttctcctcattttaattagctattgtttatattgtatatgtttgaaactgcatgttactgtttttttcaaacagtttaatattttatttgtcagttgtatagtgaagagtactgaaataagtatagtaaagtacagtttgtgctgttgagtgaaggataattataccgtttttgtgctttttaacctgactgttcagatgaaaatattgtgcagtaatatggtatgattgagatgttctactttatgttttgtatgatatgaatgactagactttgcaaatctatatttaattacattagtatatagactactatcagttacagttttttatctctgtaattacagtttttgatttgtgtaattgccaacagcactaag

SEQ ID NO: 30179 - DNA, 1501 bp, Oryza sativa; identical to SEQ ID NO: 4871

SEQ ID NO: 30180 - DNA, 1501 bp, Oryza sativa
ttacttatgttatccagatgatcaaaagttgactccagtggccaaaggatttgtggtatgaaaacactagtgcacgtccactatatatgtctctgagggcaattagtatcttgtttttgcttcctgacaggatcatatcagcaactgttcattcagcatttagaattcgatattgatacaattacagcagtgcatagtcaatgtgcaaatctttgttttcttccagcagatgatcctcgtggtcctcatcagtagagtgatctggatgcagctgccttgagcagaatagagaagaagaacaacactgctttacatctgaagactgtaatgagcaatgttcagtctcaggtatttatgagccctggagccttatcattcatccatctttccttccatcacttgctgggctagcattgacgaagtcatgtggtaataactgattcatcaacaaaagtacttgtggccgtgctgtttgacccttgcacagttgcaaggtcacatatagatgcactacaccgatgtgccagccaaaaaagctgctgcactccaaattgcattctgaattaattttttctgatggatcgtccggtccagattgtcaagaaattggatgtatatggctggaaggaatagattctccacagtttgtcaagcagtagaactgaccggatcaaatcagagccgaaagctccaagctttcccgttttcaagccaggaagtatgaggagaatcagtcaatccaccccctgtaaattatctgtctctcttcaaaatccaataggaatcctgcatctcaacttgtgcatgcagatctcacttgtgtatctcatctcatctcatcttatcgatgttgatctcaacttgtgcattcagatttcacttgtgcatctcatctcatctcatcttatcgatgttgatctcaaattgtgtatgcagatttcacttggtagatgctgcaggaaggatcaacagcttatgaaaagccattcacagaagatatgatcatgatagacgggggtggcggcgcggcgcggtggccggggaagcatggtcgccggcttgatcgccggcgatcgctagcttggacttgaacttggaggaggaagtaaccgagccgtcatattattatttattattattcagaggggtctttgtgcaaaaaggaaagaaaaacaaaagatgctggctgcgatagcgacccgagtgaggggtttttgtgaaaaaacatatactaaggaggggatagataaatcgcagccgttggatttagcatcaagattcggtctcactctcgtcttcctcggtgtctccgccccgccgtctccgatctcccgccctcccgcctccgccgccgccggcgactgctcccgctccccgtcgttgcttccgttccggtaagctgcctgggactgtatctagttgaggttgctagtccgaatccctgacgcgcgttgctcgctcttctgggccgcagcagatcggtctccttccatggcggcgg

SEQ ID NO: 30181 - DNA, 847 bp, Oryza sativa
ctccaatgtctgtgcgcagttgagaatatgaattcgttcatttgcatcgaagtcgggggctactgtcatggttatggataccacatacctaatagtagttggctatattttggcaggacccaccacataccatgtcctatacgcagtcaacctccggatatggagggagttccggataagcatcgctaactagagttctacatggaaacgataatgactactcagatagtatccatattggtttccctcgttctacttgcacaaggggacacctatgggataaatacaagaccccctaggaggagaggggagaaccaccacggaagacacccatgacaatcaacacacgcccaccagaagccacaacatacaagcctacatacgccaagacacaccgccggatatcgacttcagggataggcatggctattcccctacggtgtctccggataccgtcaggagatacgaaagcgctatctctgatctcgccgggcacggattcgaggaggaagactaccctgttgtcgactacgagtcagaccttcagatcaacatgtggacaacagttagatatgctgcccacatattgtactggtgtgattatggtgaataaaagcaactccggctccggccaacaggatgtagagttattacctgacagctcaggggcctgaacctgtataaaaatccccgtctccgtctcttttacctcagtctcgcgtatatcctagcaccgacgatccccatactgtccaaataccgtagtcgaaacatcaaacgtcgacagtggcgcgccaggtagggggattttggtacttcaggatttcgacgagatgggtttaagaga

SEQ ID NO: 30182 - DNA, 1501 bp, Oryza sativa
agcacgtgattaattaagtattagctattattttttgaaaaatgaatcaatatgatttttaagcaacttttgtgtagaaactttttgcaaaaaaacatcgtttagcagtttgaaaagcatgtgcgcggaaaacgagaaagataagttgggaaacttgggataagaacgcagcctaaggtggtgtttagatccagggactaaattttagtccctgtcacatcgaatgtttggacattaattagaactattaaacatagactaataataaaactaattggataaatgagagctaattcgcaaaacaaatcttttaagcatgattaatctataattagcacatgtttattgtagcatcacataggctaatcatggattaattaggctcaatatattcgtctcacgaattagtccagggctatagaatgggttttgtcattagtcaacgtttaatacttctaattagtgtcaaacatccgatgtgatagggactaaaatttagtcgctggatccaaacaggcctaaggctgtgttcgcgggaggatgttcccaaccagccattagcacacggaaaacggaacggtccattagcgcgtgattaattaagtattagctatttttttcaaaaatagattaatatgatttttttaagcaactttcgtatagaaactttttaaaaaaacacaccgtttagcagtttgaaaagcgtgcgcacggaaaacgagggagatgagttgggaaacttcgggcaagagcacaccctaagagcaggtacaacagcaggctataggccagctataaacatattttaaagagataaaggaagagagagaagagcagcgggttacagatttgtagccagctgcagcacagactccaagacgtaatgtatgtatgataggtgggaccatgtattaataatatagtaagcaactattatatgaattgactattacattggctatagatgatttggagctagtagtgggttatactattaaacttgctctaaggttgtgttctttccttcaagttcccaacccttctcctcgtttttcgcgcgcacgtttctcaaactgcttaacggtgatttttttgcaaaaagtttctatacgaaagttgcttaaaaaaatcaaattaatccattttttttaaaaaaaatagctaatatttaattaatcatgcaataatgcgtgctccgttttacatgccggaggaggggttcagcttaagtatagttacggaaaacgagtatcgaccactagctgctttcgtttacattctgaaagagagtgaagactggttacgccccacgtggatgattccattccagtcgcgctcgcgccagacggtcgatgcgcgcaaagtcagggtcagctcttcaatttgagtaccaactatagataattaaatactccttatatctgaagtattattgtatcctcaaatctgaaggttcctttgctacactacagatatcgatcgaagaaaactagtccatagg

SEQ ID NO: 30183 - DNA, 1501 bp, Oryza sativa
gccgccgcgggagacagccatgccgcgtcgccagcggagatgtactggaagatcgcgctcccgacctcgccgatgcccggcgccatccgcgacctcatcaacccggcgagctcagcggggtcagcttcgaaggaggacacggtgggcaacgtgttcttcctcgagaaggacctcttcccgggctccaagctgacgctccacttcacccgcgccaccgccggcgccgcgctgctcccccgcggccgcgccgactccgtcccgttggccaccgaaaagctcccggagatcctctcccagctctccgtccccgccggctccccggccgccgacgccatgagtgcgaggccgcgccgctcgccggcgaggcgaagcaatgcgcgacgtcgctcgagtccatggtggagttcgccgcgtccagcctcggcacccgcgacgtgcacgccgtgtccacggaggtcgacagggcagggccggcgccgaggcaggcgtacagggtggaggccgtgaggcccgtgccggtgtccggcggcgacatggtggcgtgccacggcatggcctacgcgtacgccgtgttcgggtgccacacgaccacggcggcggcgtacacggtggcgctctccggcgccgacgggactagggcggaggcgctcgcggcgtgccacgccgacgcggcgccgggggtggcggaggcgtacaagaggctcggcgtggcgcccgggagcgtgccggtgtgccacttcttgccacaggacgacatgctctgggtgcgtaactgagcgcgcgcgcgtgaaaggggataaaaattgtgtgatctcaagatagctccttcctatattttggagctatatgcgtatcatgtcttatcatatgtgtatgcgacgacccgaaatgccactactatacttgtggcagcatgttaataagtctgcatgtacgattcatcgatccatacatcttgtatgacaatgttacacggttgtatacaccactacgtaaaatattttcttagctactcccaacatatgcaggcaaatgaggggaagatggatgtgtgccgttggatgcagtggttggctgggatgaagtgaattgcaagaccgtgactttccatccaaagtcagaggatccgtttccggccatgagaaggctcgccggtaatacgataggctcccgagagtatacgggctgcccgcgaaaaagtcatcttcacaaataggttcttaagcactccacctgagttttttttcgcaagcgggtctcctgagtgtcctgtatgtgcttaggatgaaaatggagcggatatggatggataatgcttatacaatatttctttccgtattttctgtcggataggaaaacgaatacgaaagctcggatatgaaaacaaatatgaattatctcgaatatgaataaagatcgaatatgatcggacacgaatagggaaataaatatttctcagaacatgaaaaacacttcaatttctaatagaaacaaatactat

SEQ ID NO: 30184 - DNA, 1501 bp, Oryza sativa
cttttgtacattagaataaggtagagagtgaggggaagctctggaggagtgcccggaagtttggcgctcatccgacttctacctcgacgagtgtagcttcttaggaggaattctggaggagtaccagagttgtcggtacactctgctccaggttcggagaacttcttctaaaaagtaagcatttgtattcctttcttatgttatttaattatttagtctaagtaagatagatttccatctttgcaggttcattgtttagtattcatactaagtgctctagtactaggactctagataaagaaagaagttcctgtacaagtattagagtagtaattaataacttagacgtggtgtctaggttagagattacctttgtttgttgtgtatcccacggatttgtcagaggtaggcggcaggtggtgacagccctgaatcctgtctcagtaatcctccatgttcggatacatcatagagctatagccggaaccacgctggtagaccagcaggggtcgatgcccgaagcaacatataggaaattacctttgcttagcttagataattaaaacacatagaaagtcctctctagcctacctagcctaccttgtccttggattgtcttatccttaggtggattacacacgttccttgagttcgatatccttttggggtcacccgaaggtgaagtgatacagcggtattccgtgcgcttgcggatttatctgtggtcgtaagaaataccaagaaatatttgtatgcatgtaattatggatgaaaaccaccctccacgcgaagagaaacacacctctggccaatctatgggctaactaatcatatgaaactaacataattgaagcgaatttagtatgcaccgtcatgaggacccacaggatagtgactgaggcgaaaatgatgaagaaaggcggtgaatgtggttcctctgaaccaaggttcagtcaaacctggagtgtgactaatcaccgccagcttccacgtgtcacttcctcaggcctccacaatggcgattatgcttgattcccaagctacataaggagaagtttccactctcaaaacaccaaaaagttgagtacaactcacttttatatttagcctactctacagtagagttagaatataggaagatagtgagggaaagctccgaaaaaagtgcccaaaatatcggagttccctccgagtttcggaggagtgcatgtcgacattctctccatggggtgtactggaggattgctagagatgtcggcactctctcctatcttgtacctcgacaaatacttcttttatataagtaagtattcatgattttctttagtatttacttcagttatttaagtaagatatattctaatcattgtggattcatcgcttagtatttatattaagtactctagtactaagactctagataaagaaggaagtttttggccgagttgtaatcaatattgtagaggtgctatctaggttagaggttaccatcatttgttgt

SEQ ID NO: 30185 - DNA, 1501 bp, Oryza sativa; identical to SEQ ID NO: 30150

SEQ ID NO: 30186 - DNA, 818 bp, Oryza sativa
tattcaatcttgaccagatttaaatatttagaattaatgcttgtttagtatatttgctttagattgatattttgtataaggttgtatcggagctatagccaatacattatcttttcttacctaaacggtcttatcggctatgatacaaatacttgtagtttgcaatttattcaatcttggatacaagcagtttataaaatctcggtttagttcaatctatcccaattgcttgaaaatcttgaattatagattacatattgttagtttctgttgctgatggaacatgtgtaaggatctttcatatttatcttttcattccatactttatagccgattcagctcagttgcatcggctcggctaggtcatgacgatacgtcattggcttattggccaattgactatcgtttactagttcaaacatattgttattcttgttggttgcaggattgaaccaactgacatgttctgaatccgaagcgatatttggacctacactggagctaagcagaacttctaggccgctatgttttcgcataaacagactaacacactaccgtgcacaatctagtcacatcctgttttcttcaaaaacaggtagtctcttctcttcctaaatatattctgcgtaccattcaaaggttgacgctaatattataaaataagttcgttgaaggactaaaatgccaaaaactacatcctacagggaggtttggatccatgatcctactctattccctccgtcctaaaaaactcaacttctagagtttaaattttgttccacacaaaaccaacttctatcatcctacttaccctcagc

SEQ ID NO: 30187 - DNA, 697 bp, Oryza sativa
ggtggcatggctgttgaacaggctagtcctcttcgtatatatacatgtagcagcggttacagccaccctaaaattctcagttcaaatctttatatgagcgaatttcaaattgggttgttgtctgagaggctaaggttgtgttcgtttcaggaggatgggaactaattcctcccgcacggaaaacagaacgatccattagcgcgtcattaattaagtattagctatttttttcaaaaatgttttaatatgattttttaaagcaactttcgtatagaaactttttacaaaaattgtactgtttagcagttccaaaagcatgcgcgcggaaaacgagagggggagttgggaaccccgagatttattcaagagtactcttggcagcacggataaatattagatgtttatttttaaatctagcggtagtttacagatttcactacataagtgatttgcgctactaaaatcttgaactcttctatcaaaagtccatattcacacccaactttttgaaatatgtagctacagaatccataagataaattagcagccaggatctggaaaactcagtttttcagattcttaactagctaccaaatagcaattctatgctcttccaaataggtctgaacctccttatccgttgggttacattttagctagacatgtttggttccatctccctcctggctcttccagt

SEQ ID NO: 30188 - DNA, 1501 bp, Oryza sativa
agtggccaaacttgtcatatatcaagcagaaattaaaccccaattccactaattaatcggacaccactcagcagctaaatcaaaccaaacaaaagctagaaagaaaatggtgccaatttgccgaaccagaagctaacacgcgttaacgtacggtttggtatgaccacactaaagtacagtgctgaggagagccaacacccactcatcacttaatctcgcatcttctagtagaatttgctagaaaaatttggcttttttaggttaaatatcaatttgatttcctgtttttgaaaagaaaaacatatacctttatcgaatttattccgatacccttttcgcatacttgatatatgcggttgtaaaatcctttatgcgtgggaccaatgtaggggcagatccagcatgtgacatagagggtacaattataccctaaattattttgtaaacaccctttattaatttgtataatatatgtttgaggagtaaatgatttcgaattaacagacattgtattgataacctacagctagtatatacttaagagaaaatctcggtcaactgatagaaaacaagacatatttgcattactcatagtcactataaatcgataggtattatccatgtaggtgcgggtcatatatttaaataaatacaattctatatttaaattttgtctcaaaataaggacaatccaactatactacttattattgtgacattaatcacatttaattcaaatttctgttcgtcttacagtcagctaccatctcactccgtaccatttgtcatttaatagggggtattttggataattttccttctattttattttctcatctcacttctaaacttacatttacaatgagatggagcgagtaaatgttaaatctcatccaaccaatcgtttatattatgtaaggcacattgatcttatacacgaaggtacatgaaggtaagatcctgttttggatgtagggactaatttttaacccctgtcggattattgaaactaattagaagtattaaacgtagactaatgataaaactcattctataactctgtactaatgcacgatacgaatctattgagcctaattaatctatgattagtttatgtgatactacagtaaacatgtgctaattatagattaattagacttaaaaaaattatctagcaaattaactctcatttatgcaattagttttattattagtttacgtttaatacttctaattagtataaacattctatatgaaatttagtccctagatacatacaccaccaaaagtatggcagatgtttggcatgttgggcagcaaatcaccaccgacggaaaacggaacaaattttgcttgaaaagaaaaatcagtcgtttgcaggtgcagctcagcctatactccacttgagtgcggttgctattaataaacgcgtctcgtccgcctctctctctctctctccgctgctctgcctgactgcctccatcccccaccgcgattgaga

SEQ ID NO: 30189 - DNA, 1501 bp, Oryza sativa
ctgtttgttgaggactcaaatgctttactgcattttgtgatatgtgccaagtacataaaccatgccatgcaccagtgaatacttcagacacagcctttcccattgcaatgtcttggtctgtaaaaatggtttgaggttgcttttgattatgggctgataaaaatgtattgaacatccacttgaatgattcaaatgtctcatcatacatcaaagctgcaccaaaaaccactgtctctctaaaatggttgaagccaacaaacataccaaaaggtctactttctttatttgtcccgaatgtagtgtcgaaggtgatgacatcaccaaagtgagcataatcagcaatcatcctagcatctgcccaaaatatattagctatttgttcttcgcaatccaattgcactgcatagtgaaatgagggattttccacaattttatcttggaagtactttagtaaacttcctgcctcaccataaagtaagtccctttggcgcctagaacgcaaataattcttatgatcacgctgtgtgtaaccaagattagctgacccaccaacatgccgaccaagaaactcatgtgctgctttaggtgtaataccagaatcatacgccacctcaatttcgactgcttggtgtttagaaatgttcctttgtgatggcatcaaacggcttgtttgtggagtttgaagaagatggctgtgttctacagctaagtcatgaaccttgtatgtcattgtttccctgagtaaagtgatgcccatgcgaacttggcaaccagttcgagtatgagttcgattacgttttgctacagcatatttcttttcttctgctctagaaccctgatttgaacaaacaaacctactggatgttactaactgatcaagatcacttttgttagtgtaattctttcgaacatcaaagccaatacgaccaccatatttgacccaaaaatcccaagcttcttcataggaattaaatgtcataccaatttgaggcatccaacagggaggtttagtagatctgttacattacagtatagaggaataaaaagtttgatgcatgaacaaaacaggaagaaagaagacaaaaatcagaagacaaaggatcctatcgcgatctgtacctctccaggttttgctccatggccttctcaacggtcatggctgaacagagaagagaaaaagaagcgtgtgatgtgcagcagtagggggtaaagtatgcttcccatggtagaattggcgccaattctcacctccctctcagacttttccctccaaaacacatctgctggagtcagagagtaggtgaaaagttgggggaaattgagcaaccaatctagaccatcccttgtgtgctggatggttggatgatgggtactgctaaagttgcagtcacagtagtgactgcatctgatccgaatccgtgccgtttactactattgactagaagtttgctcttctgaaattctcacaaggcagcaagatgtaaaatgacaaggaactgac

SEQ ID NO: 30190 - DNA, 1501 bp, Oryza sativa
gagttgcggtgcgagagattggtgcgtactggtgcgagaaccagtgagcgagcagaattatctctcgaacaccgatggaaggtgcggtgcgagagattgatgcgtactggtgcgggaaccagtgagcaagcggaattatctctcgaacaccgatggaaggtgcggtgcgagagattgctgcgtactggtgcgagaaccagtgagcgagcggaattatctctcgaacaccgatggaaggtgctagagttggtttattgcaagtgtatctcatgtggccagcatgactcacgtgcctaacttacagcatatccggatgtccgttcgcaatcatgtcgggtgatcaagccgacgatgttcgcgaggaattatccattaacaaccttttctcgagtagtccagccatggccggtgctatgagataggtcgtcggtctttgttggtaggttgggtgcgataactccgcatttgtcgagaatgttctcgataatggagtgtactcgaccataacctagtcgagtgctcagttgttcctgaaaaatattttctagaagacaagatatatagcagataatatcgagtatgtattcgaaaaactgcatggatcttctagtattatcaggatataacgagcagattaaatattaggcattatgtaaaccgtaaacaagcatgatttatacagaggaaaacagagcgtgctccagcgttagaccgcagttggcctaacatcggggacgctcgcgcgatatatactgtataaagaacatgctctaggtaaacataataaattatagatctgacaatgccgtataatctgaaaataggtacggtaaattatatataaaatattgcgtacctttgtagatatatgccggatatatctacgaaattagtagattaattaggaaattaatcttactaattaccttagaatttgtactgcggctttttggctgtttagttgatctatttgcttttggcttacgtcaccagaatgagcagctcgattgccaactaggaattgaattctagtgcaatcacaggaactcctcaactccgattagactacaagccaatgaacagatcaatgcctcacgccagccgagtttggctactcgggcagccaatgccttacgccagtcgatgtcccacgcgtcgagggattggtgttggatcagtcttagatgccgctgacaccatggccctctgccgtggtgacgtgtcgaagcttggtcgatctcaccggatcgaatagatggtgacgatgattccaatctcgttgggagacgtactctggccgggttgaatcttcctggtcggaagtcgtcaagtagcttgttgttggagaatccatctcttaaacccatctcgtcgaaatcctgaagtaccaaaatccccctacctggcgcgccactgtcgacgtttgatgtttcgactacggtatttggacagtatggggatcgtcggtgctaggatatacgcgagactgaggtaaaagaga

SEQ ID NO: 30191 - DNA, 1501 bp, Oryza sativa
caaaaaatttgaataaaacgaatggtcaaacgttgttcgaaaagtcaacggcgtcatacattaaaatatggagggagtaatacttagcaagaactcaagtaggtaacaaatttctaatcgctagaaaggggaagtgttggaggagcgattctccagcagcgaggaagtgcagatctttccttgagtgaaaactcgtccagggggttagttgtgcacgacgtggaaaagatctccaagatagggtccagctccccacaagacaaatgaacacaagcagttatacaggttcaggccacctaaaggtgtaatacccctactcctgttttttttgtcactatctggatctggaaattataaactagacctttttcaaactaaggaacaagcatccctttttatatagcacgtccccgaggggctcacagtgccatttttctgctcttccttcgtgttgtcactcagctgtcttgtcgctgtcagttggttcccttctaatcttcccgagaaaccaaccaaaagtatatgattaagttgccccgggctccctgggcattgatctggcccaggtgggtttccatcctgcccaccacgcggcatatggtgggcctggcgatcctcaacctatccaagatagtgccacggctatttttcttctcagttggataagtcgggtgtcactgggcaggcgcgacacatatccagacgcctgttgctcctaatgactcagcgttagcgtctttttgacctcaggctggttggggttttcccccataaacatgtttcatttatggtagtgaacgcttgcccacagctggcagtgggacacgttcgccactcaacccagccttctggtcgtgtcccgcgcgcccctgaaacaatagttcagctatcttcgttcaagcttctcgaatatatctttgatgaaaagtagggtttatacttttacatatttaaaaacaaaacttgaataatacaaataatcaaaagtctgcctaaaattccatggcgccaaacattgaaaaccggagagagcgtagtagtgaacaacatatcaatatgcatatgtatatcatgtttaactatagaacattttaccgctgacaagttttgggatggcgatcgagattaccggccggcagcgcgcaacttacaacctaatatttcactgctgaagaaggaaaatttgtccaagatgctataaatttccgtgatgcatacattacgtctgtttctgtgtgtgaaaatacaagtagtgacagttttgtgtcgcagtcgcaaccgcaatcacattgtgttatcttgtctccggccagctcccaatcatatacctgtcgcgatgcatgtatgctactactaaattcgctgaactgacgaagatgaaactgacacatgcaccactccctctctttctctaagatctttttacctcactcgatcaggtacgacagctaagctagccatctatcgttcatggctggtggtggtgtgggagcatcggcgg

SEQ ID NO: 30192 - DNA, 1501 bp, Oryza sativa
gagggcttctatgggtaaccatttggcataatctagggtcaaggaggctctgataccaacttgtcatgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaaaaataagaaacagcgcaggcgactcctctccacaggcagtttgaccagggctacgcctaatcatccacaccatcagcatcactgtagaactcctcctctgataaataattgcaaggtgagtatatgacatactcagcaagccacgcagcaaatatgcaagtgcacaggataacaaaggatggcatagtagggtttcatttgcataaacagcatttaacaaacatttcagaatttaataaaacagttaggtaataattaaacaatattaatccaacgctatacaacataccctgttgcataggcccaaccattctgaacaaccatcccggctgcacagttctatctccacaccaggaatataccattccaaaccaggagctaatcaaattattaccagttatagcatcttctattatgatgagaagtgtgaaactaatcacgaaagacattgttagacccgcccagaaccgcgggcacggctattcaaatagttttactctggccagagatgtaccactgaacccacaagacacagccccacaacatgtcaccatgcgcctcgataccaccacggtacctcagaaaggagctgtgacagtacccctcgcacaacacaatccaccacagtgcaccgttcctggatcataatcacccccttataaacaaggcatggactcccaagcgacccccgtgggcttatctccgccacttctcagtctggtgctctgcaatgaaccatgctatacaaaaggtaaagccgttgcccacgctggcttgtggttggcacggttaatgtttcacaaccgaaactcgtgaaccggtccttaattgtttgggatctgtgtgacttgccttgctggccttggaactcttcaaatttttctcctgcgaaaacgaactctccggaaacgtcggaatctaaacagaaaagagaaaaaacaccaaaacaacacataaacaagcatgaacagtacatgtggatatttttaacatgtagatctcaattttagaaaaatttagagacttgaaccaactaaatccgagctaagatgaattagttatgaatttttaaagtttaaatcggattacaacatttatatgggttttaattgaattatgacgcaataatgaattatttttgaaaaggaaaagggaattattgcgtcagcggctagggttcacggtgaaccgggtgcacagcggcggctcacggaaacgaacggccgagatcgatcctatccacaacg

SEQ ID NO: 30193 - DNA, 578 bp, Oryza sativa
tatatcatgctattgtaaatgatctactattatctctcctgctcactttcttatccatattttctagccagcagctcagtacataaacaatataaaatgctatattaactatctatgatatactaatagtccattaaactccttacaaacactctcaatctgtcatatagtgttctacaaacactcctaagacgtcatgtggcgctcaaataaactagaatatcctagaaattatgataaaaaattaaaactattgattttcctttaaataggtgaacccaataattgtaactactacatctcacagaaataaatccggtacccccatctcaacccctaccatatgtgtgcacgcatgcacgtacgtacctactccttccaccatcctactcacctctaggatccaactctcatcttctattttctagctaacacataattaatgtataaaaaataataatagctaaatacatgtacttttctcagtttatttgatttggtgggttatttataattaaatacataatctgagatccatattacccatatttactatatagaagttagataatgcggct

SEQ ID NO: 30194 - DNA, 376 bp, Oryza sativa
ccgatctgcatccacccgccgagcagagaccagcgccgccgccgtcgccgtccgttcctcctgtatcgcgtcctggtgagcatccgcccctcgttacgcacatttttttattcgaatttttttttcaagaatgaatttctgtgcgttaaccctagatagtacgtagcttccgttgtagatctggatctggaaagcttttctcttgatttgttcgtaatgtgatactaatagcagtttctttgcttgtttgtttgtttccctaaagaaatttcttttttctgggatgtccgacgttggagacgcccctgtgcagcgccgctcttgttcgaatccggccggtggtctgtaggattgggcggctgcggcggcggcgaga

SEQ ID NO: 30195 - DNA, 1371 bp, Oryza sativa
tatatcatgctattgtaaatgatctactattatctctcctgctcactttcttatccatattttctagccagcagctcagtacataaacaatataaaatgctatattaactatctatgatatactaatagtccattaaactccttacaaacactctcaatctgtcatatagtgttctacaaacactcctaagacgtcatgtggcgctcaaataaactagaatatcctagaaattatgataaaaaattaaaactattgattttcctttaaataggtgaacccaataattgtaactactacatctcacagaaataaatccggtacccccatctcaacccctaccatatgtgtgcacgcatgcacgtacgtacctactccttccaccatcctactcacctctaggatccaactctcatcttctattttctagctaacacataattaatgtataaaaaataataatagctaaatacatgtacttttctcagtttatttgatttggtgggttatttataattaaatacataatctgagatccatattacccatatttactatatagaagttagataatgcggctgctctaactacaaatatttgagcaaaatagcagtttgaaaacaatcaacgaattcaaatatgagtctaaagtccaagttcaatcaccaccaagaagcctggaaccataatgcatactttgggcctgaatccgaggaaggcggagctacaatgaggtggacactgatgacagcagcagcatcgacttcctcaagttcctgagccaaataacgcgctagataattatgtgcagggcaaggactaacaggaggggcagagagagatgttccatgtcttcgacaaggactagaaaacaacttcatctttgccaccgagcctcgccacgttatgtccaatgcatcaagaaaggctcactgatgagaaggtcgacaatgatccgcgaggctgatggtgacaggcggatcactacaaggagtttgtacttaaattcagaaaaaaataaaagaagcaatttgattaaaacacatacaaaaattataaaatcattaaaactataaaaagaaacaagattccatgtagaatataaaatatcaagagtccatataaaagtataagttataaatatatggaatttggaataataaaagaagtattaaaagaagagtccaaatacaacacgatacatgattaagtacaatttaaaatccctaaagaagacaatgtagaataaaacaataatttgattttaatacaaattctagataagaataagtcaatcactaaattcaaaatacaataaatatttttattagaatttttctatatttattgattcaaatgcataacaaattgca

SEQ ID NO: 30196 - DNA, 1501 bp, Oryza sativa
aattaaggaccggttcacgagtttcggttgtgaaacattaaccgtgccaaccacaagccagcgtgggcaacggctttaccttttgtatagcatggttcattgcagagcaccagactgagaagtggcggagataagcccacgggggtcgcttgggagtccatgccttgtttataagggggtgattatgatccaggaacggtgcactgtggtggattgtgttgtgcgaggggtactgtcacagctcctttctgaggtaccgtggtggtatcgaggcgcatggtgacatgttgtggggctgtgtcttgtgggttcagtggtacatctctggccagagtaaaactatttgaatagccgtgcccgcggttctgggcgggtctaacaatgtctttcgtgattagtttcacacttctcatcataatagaagatgctataactggtaataatttgattagctcctggtttggaatggtatattcctggtgtggagatagaactgtgcagccgggatggttgttcagaatggttgggcctatgcaacagggtatgttgtatagcgttggattaatattgtttaattattacctaactgttttattaaattctgaaatgtttgttaaatgctgtttatgcaaatgaaaccctactatgccatcctttgttatcctgtgcacttgcatatttgctgcgtggcttgctgagtatgtcatatactcaccttgcaattatttatcagaggaggagttctacagtgatgctgatggtgtggatgattaggcgtagccctggtcaaactgcctgtggagaggagtcgcctgcgctgtttcttatttttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcatgacaagttggtatcagagcctccttgaccctagattatgccaaatggttacccatagaagccctctaaaaatattggaaaagtagaactgttctgctccctttctcttttaattaaaccaaactaatagcacatgcacttcataatctcttttagtggttctcattgaaaatttattccagtgttattagtactgtacatctgttactgtactaatggctcatttaccagcaaaagttttacaacattgttttatttaatcttgctgcaatgaaataaatttagcatgttgattttataactttcttttatttctttcggaacctgttgttcaaaagtgcaaaatttgtgatcttgtttccaactgtttcaacttatcttgcaagcctggtttactttatttacttaccttttacttaatccaaaaacttgtgctattaattgaataaatgtcataactccctcctttcacttatctttaga

SEQ ID NO: 30197 - DNA, 1501 bp, Oryza sativa
gtgtttaatgcaggcttcaaagaaagggctgttgtttttgcaattgatttttatttgaactcttttctggaaacaactaagtgagtgcttctcaaacgacacagatgagacagtgcgtctcgtccggtcggagtatgtgcaatgtatcagtctttaaaattgatcaagattggcacccggccaacaattttcaaacggccacccgggccaacatctttcaaacggccacccgggcctagctgatcccatcagctgcagattttccaaacaacgatccccttttcacaacagcaatttcacaaggcagtagtcaaacaaaactacgctaggaatcacctcacatccgcccatgaccgtgggcacggctgttcgaacagtttgttaacctctgtagagggggtacactttacccgcacgacattactaacccggatcacccagcccgtggggatcagccacatcgggagacctccaagctttcatgacaagacatttccaaggccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaaaacggtccttaagtgcaagagcgggaaaccgtacacccggtatgttccccggtccgcggttttggaaattcatttagttcgcaagcaccgacccaggtgtcgggttttccaagttttttgtaagacccaagttttacccaagatgtttttcagattttaagtttgaaggcggccgtcgatactcgtgcagagtgcacgatttccgaggcgcaactgggtggttacaagggaacatgggataacaattaacaaaggaaggatcaaatgcaacaaactaggtaggttcgccaatctgccttgcagacgggacaaacagattaagtgcgatcctatcaatgcataatatttttcaagcaacataattaaattcaaatataggctcaagatgttcaaaggtggcttgccttgctcgagatctggagcttgatcctcgaactcctcgcactgcgggtcttcgggctccgaaagtacacgcagaacgggacaactcaacaaacggcaaaaataaagccctattaatgacctctaagtgtgccattagatagatctcgagatttgaggaattttggaagttgaacggagtcaaacggatttacggttggggagatattgaatttctacgattattggatttttggtctaaaggaaaaggatttaattaaatcctttttgaaaaagaaaagaaaataaaataaaagagggagggaaattagacttccctcgggcggctagggcgcggcccgagagaaagggcggttcggccgagcttaa

SEQ ID NO: 30198 - DNA, 218 bp, Oryza sativa
ataataataataataataataataataataatgatgatgccatgccgtcatctacatgtgatgatgatgatgtgccatgccgtcatctacatgtcatgccacgtaagtaagaccacggtcaaatgagactttcattgggatgatacaataaaccaagtttagggtcttcgatacacactttgcaagttcatggatctagataaaatttgcttacaagt

SEQ ID NO: 30199 - DNA, 336 bp, Oryza sativa
gtattaatagtatagcaagcaactattgtatgaattgactattacattggctatacttggctatactattaaacttgctctcgcaccatctttcttccagcaatacagaaaaactgatgtcagagggctaatagtaaatagatttttcatagagtattactactactgctagtaggagaggagcgaagcagcagctccagatctgtgggtgtctttgggtgagtgggcaaataaacaaacaaaagtggcaagccaagtagccaatccgaacgcatccccgtctttctttctttctttctttctttctttgtgcccaactctgacacgactcacagt

SEQ ID NO: 30200 - DNA, 221 bp, Oryza sativa
aaaaaaccatttacgcccttgctcatttgatcatacttctcaatggtttttgtttcaatataatcaatatcgacaagtgtttgatagtgataatctcataactattacatgagtaaaaagttctaattccaacaaaaattttcaccttcatcactcgtcgcacgcacgcctgctggtggatcccgctaccttcaaccgttctgccgcccgtcgcccgtagt

SEQ ID NO: 30201 - DNA, 181 bp, Oryza sativa
tattacctgacctgaattgatggtctgcacagatcctacatttgcacatcgtgctccatgtggctggccgcaggacaaggtggagtccgccagtgatggaggttgtttgctatttttcatttgctcgtcgtctctatgacatgaacaataatgtttttgctttttttttgcgcttgctaga

SEQ ID NO: 30202 - DNA, 1501 bp, Oryza sativa
ctttttcggaacgtcgccgccactcgtcgtggtagtggcaacagcagcgtcagacccctccttggcgaccttctctttcagcgacgccgccacctgatggtccacgagcgacccgatgatatcagtcagagggagagccaacgtttcatgaagtcataatgtgatcccggaagaaagatgcaaaaggacagctaagtacacttatattgatggcagcgtcgcgctcggctacccctttctcgcaaaggaggacggggacgttgctcgccgttgtcgggccgctgattatcagttggcggacgcggcgctccacggttgcgctattcaagcctgtagattgagaacagaatccgataagacgggaaaaacatgaacataagggagtcaatttaactaaaaaggaaataccctgaggagaaacccgggtcgcgtcctctggcccagaataatcaaaggcaggatgggctcgagcctgaagcggctggatccgcctaccaatgaagtcggcagcaacttcataccccgacaacccccgttctcggaggtcgtcaatgatatcgatgaaagattggagggacggggtcaaggcgggtttggtggtccaagatgaaatcttgtctggctgttccttaggtacaacgaagacaggatccgaatcctctatctgaagatagaaccacctcccccgctatttgctgcgagatgtgaggcactgaaaggggatgtatcgcgacttcaggccatcctgaagtcggaaaccaacacacccggacacctttttggattccatccagcgtaactcatagtaaaagcggaagaggtcaagaaacggctccaccccaatgtaggcctcacaaagatgcgtaaaaatactcaggaaggcgatggaattggggttcaaatggagcaaggaaagaccatagaaattcaagaccaaaaggagaaattcagaaggcggaggaagaaaaccacagagaataaagtcctcaaccgcaaccatgcgacccaggacaggctggggttcagtacctcctacttccctctccgcggtcccgcgaccgggaagggcgccatcctcttgcagtttcttcagtgacgcactggtggaggtagacttgtcgagatccatggccaccgaagatcgccggagaaaggaccgagacgagttggctagggttttttgcgggagcgaagaagacgagggacgcttggaagctggagagttttttcaacaggcagacctcaaatgggatccccaaaactcccttaaatagacgcacctccgccggtgcgaattccaaggaaaggagagagaagtcgggggctacttgtaacatacccaaaatttcaggacttaaaatttcttgtcaaaatagttagaggttaacttctccaatttttagagtcaaaaatttccgttttaatttaggtgatgaccaacttaaatcattgcatgattaaaatttgagaacaaaataaaaccttttcattcccaacatta

SEQ ID NO: 30203 - DNA, 1501 bp, Oryza sativa
gccgggggctggctcggaagtcggaggcgcgcttcgtcggcgaggggggtgtagaaccagtcgctcttccagtcgtcccacttcttgcgcaggacgcagggaatgtagcggctcagcaccggcccccgcggctggaagtagcagccaccgaccaccgacggcggcgacactggctgtacggtgaagaaccaccggaacagccgaagagatgggcgcaccccgataaacatctcgcacaggtgtgcgaagatggccaacgtcattaccgcgttgggggtgaggtgcgccatctggagatcataatgctccagaacatccatgaagaaagaagagaatggcgggactagccctgccattgcaaaagagaggaagaagacggaccgccccgggtaacgtggcgccgggcgtccctcgcccagcgcgaccatctcccggccggtggcagattccggcatgaagcggcgcggtagcccagcctgcctctcgctcacgatgcgggaaggcggcagcacgctaccatcgagcggtgcggagccccgtgccatgacgccggcagaggaggaacttgagaacgagcgagtgcggcgagggtagggcacaggaaacgaagagttagagcgcaagcggcgaaggcaaggggaataatggcgagaggaaggaaacgaatctcttcctcggcgtctttatacccttgccaacgctctgcccggctcctcgcttcccgcgcccactatctcgccccctcgtttcttgcgcccacgcctctgctaatcccactcgcccgtttgcggcgcacgaggccgtggcagtcgagatgggacatatcgtgcgcgcgttaacttcgctcgccgaccgaagcgccatcatcacgtctccaggcgaaacgaactgactcgtcccgattcgcgcgctgctcgagtgatgtggcagtctcgaagaggccgctcattattatcgatcagttttccctgccaatgcgtgcgacttgcgaccgctgagttcctacccgcctgtagagaccggccccacctgtcaccagatctaaagaatggcgtcacgcccgagcgcttccctcgaggggggcgatcgccctggcgtgacgccgggggctactgtcgatgacatggggccgagggtatcatgactagaggttagggtagccgcagtcacccacgtggcccgggtcgggcccgagggtgacgagacctccccgccttttgtctccccgaggggtcgggccgctcccgtttcggccccgagggcaggggcgccccgaccccctgtggttttgacgccacgtgtatggtttaggtgagcacagcagggctcacctaaccgcatttattgcggtttggacgagcgcgccacgccgcatttaatgcagcgcagcgctcatccggtccgtgaccggtcgcagtgtgtgaccggtcacagaccggtcagatcgcgggttaggtggcaacaggcggcctgacacacgcctcgccccgtcccgtcggat

SEQ ID NO: 30204 - DNA, 819 bp, Oryza sativa
ctagtaataattacaaggaaaaattggaaccatgccattataattttgcaaaatttaagatataccatcctgaaccacatgtcattgactcatatgagttctacatgtcattgagataccgatgacatatcttaaactttgcaaaattataatagcatgatttcaatttaccctaattacaaacaagcttatgcaagcatgcaacatatctataattcattgaattctacatatcaacatccaatcatttttcttcacattattttttcacaatatttttaacatatatatatatatatatatatatatatatccatcatttctatattacttaacatatattcatctatacaattaaagtgtagaatatcatatttcatctacaatctcatactaaatgtatttctctctaaacatactttgacaaaccaattttatttgttgttaataactaatataatttatacttttatacttttagctcgatcattaaaaaaatttagaagttacttggcaatttccgtagaaagcgtgggaaatcacctaatgtgtcccttcggtagacgtgcggacgcgttgtgtgcagtggaagaagggatagaaggacgactgcgctacaaaattccaatgcatagaaaccttgagggttcatagcatgggtttgaacaacgtgtaaattgaattcctgccttttcttactccagtgttttcaaattcctacattcgaaagaaatcatgctttaacagagtactcccttcaacacagagctccctgcccattgcctcaaatcgtgtaaaaaaaataacttaaccttcaga

SEQ ID NO: 30205 - DNA, 1501 bp, Oryza sativa
aacgcgaaaaacctggagatgaactttacccaatcagcgatggcgatggtcgtcgtttccacggccggcggcaaggtttggggcgatggagaggcagagaacctcctccctcggtttcttcggctctgagtggtgaatggagaatggcaacgcgtctgggaggagtagagagtgagaaaagggaaaccgagatcgacgacacgttgcggccacgcgtcggctcgctcaatctctccctctctcggctggagcagtggaggaagtgatggacagagtcaaggcaagcttaagaggctgtcaggtgggtccaggtcgtggcaaactaggctagggtgagagggttgggtaagattctgggtaaacttgatttttagatcatttttcggaattattttctcctctaactttgtagcttcataacttaatgtgtggaccaaattatctagtgttgaatttactggaggtaaatgattacacctagattccattttctttggttgcactcaaaaataatgggtagattaatcacagaaattaaacaaagatgggctgttagaaagctagattgaatttttaggaggcctaaacagaggaggaaaattctagaaaaattatatttaggcatgataaataatctagtatttgaataaattattttccatcttcacttatgagcagttaaatgtacttttggatgaagtatgactttagccgattaaaatttaatttgattccttttagttttctgctttgactgattaatttgtggtattaaacttagttattaacttgtaccaatattatagtgaattgcttgtgctaaacattatctatctaatttttttccatgattttaacttgcacataatattttagagaattaggattactttactttgtatatgtgttcccacttcataattgcacctaatattgttacagggattacattaaacttcttttgggctgagaagatgatatttgagtttaatattaagtccacatgttatcacccaagattaacttttgtttagtaattttaacccttttagtttatgctcatgagacatattatgaaaagcaagaccaaaatccaaatgcacaagagactcgagcctaggcatgcattatgcacatgtatgctcatatacttggtgacatttctagtctaatgttgggaatgaaaaggttttattttgttctcaaattttaatcatgcaatgatttaagttggtcatcacctaaattaaaacggaaatttttgactctaaaaattggagaagttaacctctaactattttgacaagaaattttaagtcctgaaattttgggtatgttacaagtagcccccgacttctctctcctttccttggaattcgcaccggcggaggtgcgtctatttaagggagttttggggatcccatttgaggtctgcctgttgaaaaaactctccagcttccaagcgtccctcgtcttcttcgctcccgcaaaaaaccctagc

SEQ ID NO: 30206 - DNA, 1501 bp, Oryza sativa
cggaggcagtttgcctcacaatccagcggagagacattcacagggtataaccttcgcatactgttaattcaatttttgatacttctgttagtcgtaattctattgcgttcgttgtatggtcatgatgcttattatatcttaagcatgcttctggttatgttagattttatcactagatcaccccactttgttcatgccatgattattgtcttaatattttagattaaaatatgtcaatatatgactatatttccaacaactgacaccgatggctttggtaagacctagcatctggcactcctccatctccctccatactcgctccatgtccatcaccgcaaggtcctccttagcgaacacagccgatggtgggccttctggaactccaaggctcaccggaaagtgaaccaggtacaagtcgatgtactccacttgcaaattcctacatacatgaaccattgctcaaaccaactacgaaaatgcctgcctttatcaattgtcaaacatatatatgaacatactccctccttccctaaatgtttaacgctgttgacttttttaaacatgtttgaccgttcgtcttattcaaaaacttttgtgaaatgtgtaaaactatatgtatatataaaagtatatttaacaataaatcaaatgataggaaaataattgtgacatccccgcccagagcttaataggattaatagaatactacaacttctttttcggaagccgatctcagaagaactctaaggttaagcgtgcttggcctggagcaatttcgggatgagtgaccgaccgggaaattcttagcgggtgcacgagtgaggacaaagtgtgcagaaaagatttgtgttggtctgcgagggctttctatgacctataaaagctgccagatataagcgggacgttacaataattaataattacttgaattatttgaataagacgaacgatctaatattttttaaaaaaagttaagggcgctaaatatttggggatggagggagtatatagcgagctctaactattggtgcatgctaaccggagtgtcctacggagtgccggcaccacacgaccggggtgtgcatcgctgatccataatttggatgtgatgtagagttcatctcgcgatgaaaccaaagccaacgcgcaccgcttctgtcgtggcctcaccaagggcagcctctgtgccgtaattggccgccgtgtcgaagtgacggtagccgactttaatggtgcataggacggcctcggtcacggcgaccggatcggctatatgcctagcgggaacgttgccgtgcccatgcctacccacggcatcggcttgccggagcttagcgccacctccggcatccgttttccctctgcaccgtccgcagccatggggggatcgaaggggcaattgtgggagatacaggattgatgaagtatatattgtgtgtccatactactaactatatatatatatatatatatatatatatatatatatatatatata

SEQ ID NO: 30207 - DNA, 1501 bp, Oryza sativa
cttagcaagccacgcagcaaatatgcaagtgcataggataacaaaggatggcatagtagggtttcatttgcataaacagcatttaacaaacatttcagaatttaataaaacagttaggtaataattaaacaatattaatccaacgctatacaacataccctgttgcataggcccaaccattctgaacaaccattccggctgcacagttctatctccacaccaggaatataccattccaaaccaggagctaatcaaattattaccagttatagcatcttttattatgctgagaagtgtgaaactaatcacgaaagacattgttagacccgcccataaccgcgggcacggctattcgaatagttttactttggccagagatgtaccactgtacccacaagacacagccctacaacatgtcacgatacgcctcgataccaccacggtacctcagaaaggagctgtgacagtacccctagcacaacacaatccaccacagtgcaccgttcctggatcataatcacccccttataaacaaggcatggactccccagcgacccccgtgggcttatctccgccacttctcagtctggtgctccgcaatgaaccatgctatacaaaaggtaaagccgttgcccacgctagcttgtggttggcacagttaatgtttcacaaccaaaactcgtgaaccggtccttaattatcatgagcacgaccatcaaaaccatgtgctcacaacccaccattagcaagttttagttggcagtttaattaattaaccaatcacgattgaccatcgtgagctatcattaagccatcattaaataatagtgaattataagttatctcaatagtgtgctaatgtttctaagcatgactaagcaatcatatctaatatctagctgaaccaatatataaagctcaactagtcaagttataatatcccaaggtatcaaggaataaagtaatcaagaacaaaagggctataacaaacaataggttaactccacccaatgacattcgaaaataaatgcaatagttgaatagaaacaatagctttaaacgggatcaacatgctcaaagggttgtttgggatctgtgtgacttgccttgctggccttggaactcttcaaattcttctcctgcgaaaacgaactctccggaaacgtcagaatctaaacagaaaagagcaaaaacaccaaaacagcacataaacaagcatgaacagtacatgtggatatttttaacatgtagatctcaattttagaaaaatttagagacttgaaccaactaaatccgagctaagatgaattagttatgaatttttaaagtttaaatcggattacaacatttatatgggttttaattgaattatgacgcaataaggaattatttttgaaaaggaaaagggaattattgcgtcagcggctagggttcacggtgaaccgggtgcacagcggcggctcacggaaacgaacggccgagatcgatcctatccacaacg

SEQ ID NO: 30208 - DNA, 1501 bp, Oryza sativa
ttttgcttctgatgttctcccttctccggttccacattacaattatacttcttaatttccattttcccaactcatcaacatgtggtcattctatgttatctgaaattttgtgataaaaaaaattctataatatattttgttctgtgataactaataatacaaggagttctattgtttcacacattaactaattgggttatatcaattgtacaaaactacaggtattatggtccaaattacacaaaaccatatatattttagcgcgtagcatagaaccatagatattatggttcgaaaatttcacagaactacaccattaaccatttttacatactcctatatcaaaatagaaatcgtgggtgtaacatctatatgatagataacactcataaatttgagatatgattgtagatcttaaaagtgtggtaaatcaaagtcaaaatgattagtaatgtggttttgcaaaactttataaccataatacctagaaatgtgccacgtgccaaactttacgcaattttgcaaaacttggaccatcatatagggttttataaaatttattttttaaagttgtttgacacatagaccatccctaatatttcccttctactttttatttttttacttatatactaaattaaaccaataaccaattacatcataatactgaaaattatagtgcaaatatatgaaacttatagtgtaagttttgactctttctcctcaaacaacatagaaatagaaacatccagtccacataaatactatataaatatagcttacccatgtaaatggactactacctctgtcccataatagatgtcactttgacttttggttgcaacgtttgaccattcgttttatttgaaaaattagtgtaaatataaaaaaggataattcatacttaaagtacatttcataataaaacaagccacaaacaaaataaataataattctataatctttcgaataagacgaatgatcaaattttacaaacaaaaactcaagacgacaagtatttggggatggaggtagtaccatataatccatcgtttcattgttcgattcaaacgtaggcgttgtaaggaaacgtgccatgatgactggctgtgtttagatccaggggtgaaaatttttgccgtgtcacattggatatacggatacacagttgaagtattaaatgtaatctaataacaaaacaaattacagtgcctgcctataaaccatgagaagaatttattaagcctaatttaacaaatgtttattgtagcaccgcattgtcaaatcatggagcagttaggcttaaaagattcgtctcacaatttacacacaatctgtgtaattagttttttttctatatttaatacttcatgcatgtggccaaacattcgatgtgatggggtgaaaaaccttgttatatccggcccgttgagaaaagacattgtatgatatggacaatgggaaacaggacgaatttttttcatttttaaatttttttaat

SEQ ID NO: 30209 - DNA, 1501 bp, Oryza sativa
  unsure (1)..(1501): unsure at all n locations
caatataaaatggggccagataaaatttcattaaatactttgcttaactctataattcctagatttttctgggatttatttgagctaaggaagtatttttaatagatggaattgcatttaataaataatttaaattgaaaaagatttttaaaatcctcttttgacattgggccgaaagtcagcctaaaaccttctctctccctctccccggcccaagccggcccagtccgcccgcagccgcccgcccgcgcgtgcgttcgccgctgacaggtggggaccgcctgtcagggtcgtcgtcttcctcccgacgaaaccctagccgcaccgggccgccgccgncattccaaatctaaccgtccctttccgtttccggtgaaattgattgaggggaaaggatccccgtgatccactctaccttttcccttttggaaacatcgtctaaatcgctttggaaattcgcggattcgatctcgaatcggattcgtctctctctcccgaaccctaatatttccatcgcgtcgctggtcgccatgggcattcgccgccgcgccctagtccctatttaagcacccccaggtcctccgctacccgtcgccaccctcgccttcatctctcgtcgctggtagagccctagcaccgtgtagcctcgcgccgccgtcgccgccgccgctccagccgtgtgtcgccgtcgctccagtcgtcgccgtcgctcgggaagaccgccgtcgtggtcgccgtcgcgtcgccatcctcgtcggcccctccatcgttgctgtagaccaccggagcaccgccgtcgtcgtcaacccgaaggttgccgccggcgagcttgcacgcccgagccgccgctggtgatgacgtcatcgccgacgccatcgttgccatccgtcgtagaccggtcgtagaccgttaaatcttggccgtccgttgtggataggatcgatctcggccgttcgtttccgtgagccgccgctgtgcacccggttcaccgtgaaccctagccgctgacgcaataattcccttttccttttcaaaaataattccttattgcgtcataattcaattaaaacccatataaatgttgtaatccgatttaaactttaaaaattcataactaattcatcttagctcggatttagttggttcaagtctctaaatttttctaaaattgagatctacatgttaaaaatatccacatgtactgttcatgcttgtttatgtgctgttttggtgtttttgctcttttctgtttagattctgacgtttccggagagttcgttttcgcaggagaagaatttgaagagttccaaggccagcaaggcaagtcacacagatcccaaacaaccctttgagcatgttgatcccgtttaaagctattgtttctattcaactattgcatttattttcgaatgtcattgggtggagttaacctattgtttgttatagcccttttgttcttgattactttattccttgataccttgggatattataacttgac

SEQ ID NO: 30210 - DNA, 1501 bp, Oryza sativa
acaatctacagtttggcttccattatgcaaactcaaatttttaatatcgccaagcacacctgttgaaatatattattagattgaaccccccccccaaaaaaaaaaacagacgcacagaacaatttgatattataaattgattccacaagacattaccatgtgtggagaaaggcacaggctctgattcaaaactacaatccaatcgagtttgcccaggtttcagcattgtttgccacgaaataggggtgagcataataagaagtgaatgaatatatcatcacctgtgcccgatgtagatgcagacttcttcctcttcctattttcacggttcttttgaactcgtgctgccttctcctcaacgctgagtgccgcgtaccgctctcggtctctttgtcttcttaattcatttgcagttaatttaggaatgccgtccatcgctaggagttacaaccttcaagcatacaacctgggcatatatatactcggggaaccacaaatttgaagatctgcaaggaaataggaagaaaaagaaggattaatttcatatggaggtgttttgcatgtgatgttgccactgggtttagattctcctatagaacagtaggatggctttatatatttttcagtaactacgaacaagaacagtaggatggcttcacagtgagtagtgctaatcatctgtattacaagcaaaatttagagcctccagtgatctgaaaagttcagaagaaagaaaggatacaaatccattgacaggggctgcacaggatcaactgaaaggatgcaaatccattgatatgttaaaatcttcaaactctatggccaatttctgattggcaattgtgaatgatcaagaaaacaaatggtgatccacaaattgacacatcacaaaaacatgtaaaataggagaaattggtattaccttagggttcaggggaatagtgatggttcctttagttcctactcaaatctgacgggaaccaatcggcgcaagatgaacctgtgaagtggattgcggcgacggtggcacggcggaaggggaagaaatcggttccggcgaggacctgtgaacctgtgatgtggattgcggtgccggcggaaggggaagaaatcggttccagcgagggcatcggtggagtatggcggcgtcggcggaaggggacgaccctccggcggcgcgaacggggaatgcgaggaggaatagggtggaggaggaggagcatcggctggagcaccgttggactgaggcggggcgaggagaatcggggcgaggaggagcgcgagtccagcatggtcagcgcaagttcatcgcgcgagaaggaggaagcggacaatccgtggcggatggatggaggatatggatcaggacagacgcagatggacggtaaggattgatcgagatgatttcacctgtaagattggagggggcaactcctcatttttatattagtatagatatcgtctccaccgagccacgagccggactatggctaccgtccac

SEQ ID NO: 30211 - DNA, 1501 bp, Oryza sativa
ctaatctctttgcttcatcggccacagcttcatcggttacaggagtgtttcttaacgcgccattcctgcttcagctttgttttccttagccgatgattgatttcctgctcgacttcccgaaagcgctctcggtttctcattctttgaacccttctgttctaattctttgtaaatatactaggaggacaccactgagttttcctctttttgtcatcctccgggtcatgatcctgatttaccgggcccaacctttgatgaacagaaacccttgcatgcttcagccgattgcctttaatatacgactggcttgaactctctgcaacgttgccgcattcaggacagtcttcaatagatggcagcctcataccttcattccaacagaatctaaagaactcacaactctaatgaggatcgaagccatcatcatctttctcgtagcgcttctcctgttgtctatcgtacttcttttggtacttattgatgatcttagccgaattcacttgaaaaccccttgcacggcccccatcggccgttcggccagctgtatgcaccatattgacaggaaaaggattgccatcaaccttcatcggcctcttggaatcatcaaatttgattttgcctccttcgatagctgtttggatctgctgcttaaagaccttgcaatcattggtagtatgagatccagaattgtgccatttgcaataccttttcttgcccaattcctcagcggatggaatagtatgactagcaggcatttgaatctgcttctctcggagtaacagatcaaaaattttgttagcattggtaatttcaaaatcatacctctcctcttttccagaattcttcacccattggcatggtataacctttgtgctccttacccattcggctgcagctatttcagaatcatcatcctcatcatccgatccacacatgtaagaacagacattattaaccttcctagaattcctcctagcttcagcaaacctctgctcgtgcaaagttaccttttgtgtaagatgcgataagctttcaaagtcctcagatgagaatttctcccggatcggagcaatcataccctgaaaagccaaatcggctaactgggcatcagttaaactcaagctaaagcacttattcctcatctctctgaacctctgaatatattcatgcacgggctcgtcatgtttctgcttgatcactgtcaaatcagacaacttcatctcatgtaccccactatagaaatagctatgaaattgcttctccggatcggcccagctgttaatcgatccaagcagaaaaccaagtaaaagccgatccagccaaagacaatcgaaacaacctaaccctcaaggcatctacagccgatgcttcaccacactgagctaaaaatcggctaatatgctcataagttgatgtactatcttgccctgacaactttgaaaaatctgaaactttgaaccggttagggagagggactctctcaaaccattcaggatatggc

SEQ ID NO: 30212 - DNA, 1117 bp, Oryza sativa
cgccggccgtcgccgacgccggcaaagaaagaatggggcggagatccccggaaaagagcaagaaagggggaatagagactcaccgccgccggcgtgcgcgggagtcaaccgccgtcggtcgccattacgccaacgcaggagagaaaagaaggggtggcaccgcgccgctgtgctcgccgggcgccgccgcacagcgctcgacggctgcgcgcgccggcgaaaggaggtgcgacggcgccagcgcgccgtgccgccgggccgtgcagccgccgtgccgccgtcgcaccatggctagggtttcggccgagagaagagaagagtggctagggtttggccagcggttgggggctcgggttttgctctcccgatctccccgcttggccgtctgatcgaaaccctagcgatcggacagccaacgtcggccggaccgcttttggcccaagagggggcgcgcgctaggcctctttcccggcccaggcccaggttgcggcctagagaggggtgagagcccgcatgtgcatataccagggccgccagagtccaattttggtccctcggggccgaaagaaaaaggaaaagagtctatttttagtccctgtttcagatgcatttacaattatagttattaaatgtgtttatttctaagcaatttgagccaacgtgaaaattgtttagagaatagataaatgtgagaaatgcttctgaacatgtattttgtatattttcatgcaaattacaatagaattttgaattgtttttgcatgatttacctccgtttaagatttgaaccgaagggttaatttttacagagtgaataacagaattttgtcattgtttatatgaattttatatagatcttttgctgcaaatagatgaaattgatgaaaattagtgtttctaaaattaaattttgaaccaacgggataatttcattttaggaacattaattatgtgctatgatgttgtaattttctaaccaacgttgataattgtaatgttatagttatggctctatgtgttatgtctattttctgcccaacggtgatgtagacttaatacataataattttaatattaattttgttctcacaatacatgattatctcaggtggctact

SEQ ID NO: 30213 - DNA, 1501 bp, Oryza sativa
tcataaggtgaaactgtaaccagatttttgtgttagtcatgtatcctctttccaattttgcgagatcttttactgcatttcatctcagcaaatgatgtgaataatatgagccatttgatgatatttctttgcatacattttcatttaactactgttaggcttttaatattattaacagactgttatggttattccaacagtttactatatatcatctatactaatataaaactactattataatctgtaggcttgccccagtctctctcgcggcaatggtctgcgtgtgctacaatctgcatccctccacgcctgagtaatcccctccgttcccatgttgaccgacgcggccgccgctgtctcctccaaagcagcagcggtcctagccgaattggccatccccattgccaaacaccatcactggcgccggcagcctcaatccgcgtcgagtttttgtctccaccagcatagtggtctctacacatgaggttggtcttaggctgcaacttttaactcttattttccatcttttaatcgaactcgatgcgagcacgggcttaatgcattcaagccacagtctcaaagcattctgtatttatgttgatgttggttgattgctcttgatgtgcatgtcaggtacttggaggttttttatttccctcatgacgaggacttgttttctcttatctttcaggcctcgagtgacaaatcagagcagcaatcatgctttgttgtggcttttatctctgccgatctcacggcaatctatcgacatgcacatttgtattttgtagttggataaaaaaaaagtagcaatagttgccatctttttctctaggaaaaactgatttgtttatatgctttctcagtttatgtcagagaaaatggttagttgagcttgtctcctatactgaatgtgcttggggttaactgggctttcagtcagtaagcatggtaacagactcttcattgagttaagtagtccaataattattttttaaagcattttagtcagagtagaaacaattatattttttctctactgactgcatctggtatttttggtaattagctggcatcacgtacttatgtatatagtcatatggacatcaagcatgtttgtgggataatataagatgctctaggcagagtagaaacatttatattttacattcctttgtgtcatattttcccttttttagggaagggggcagatcactgctcaataataaatttattcatagtttatattttgtttaattagatgattgactatgaaatttcatcacctgttgtcgagctggagtccccagtgaagacctctgtatgggaccattatgctttcattaaattccatcaccttggaaaactggttttgggtaatagtaatccctgtaatctgtatattttggtgtgtgcctaattgtatgaattgaaagattgaattaagttatgagcactaaccaaatggacaggcttgctttcagtctcctgacttttg

SEQ ID NO: 30214 - DNA, 1501 bp, Oryza sativa
cacaccgtcaaggagccggagatgcttgctgccaaactggacctcctcatgaaactcttggacgatcacgagaaaaggccaaaaggcaccatcaaggccttggactcacacgtcacgtgtgaggtctgcgacagcatggaccactctgggaatgactgcccagaaacccatgaagaagtccactcgtgatccgccatatcctaaccctgtagaaaccagcagtatcacccaagaagcaccatctggaagcacgactgatgaagaagttcagccagaaaagaccgtgccccaggagtattgtgacacacgactgctgccattccctcagagaagcaggaaaccggcagtagatgagtagttcgctcattttcttgaggtgattcagaagatccacattaacgtgccgttgttggatgccatgcaagtgccaacatacgcacgttatctcaaggatatactcaacaacaaaaggccgctcccaacaactgaagtggtcaagctgacagagcagtgcaacaatgtcatactccacaagctcccggaaaagaagaaggatccggggtgtcccacgatcatctgctcgattaggacacataaattcgaccaagtcctctacgagttaggagcaagtgtaagcgtcatgcccaaagacgtcttcgacaagctcaacttcatggtgttggcaccaacaccgatgcacctgcagttgaccgactcatcggtccgctacctagctgggatagcggaagatgtaccgatcaagattcgggatttctttatcccggtcgacttcgtggtgctcgacatggacactaaaaaggagacgccgctcattttggggagtccattccttagcaccgcggatgccaacattgatgtaggaacaggaagcatccgtttccgtatcaacgggaaggaagaaaaatttgagttttagccgaggaccgaacaatgttccatggtccggatcaaatacgggccaaacccacagaacagccaagaaacaagagaagccagctcagaggaagccatcgcccgcaccaaaaccaaagaaggtgtggaaggtaaagcaaaagacgcccgctccatcacctccggagatgggtggaaactccgcgaactaaactgaagggaggtatggtcttgcacgttggaccgaaaatgacgtgaccttcgccaacaggtaaattggtatgtatccacatatttatttccatcaatttgcatttttgcatcaatgcatatgtgaattccaaaatttgcatttagaattgaattttgagaaaattacttcaaatgaattttccagagcaaaccaaaataaaattttcaacgaaaattcgctgagccatgaccgcactgaccgttggaatccaacggccgaatgtggggttggttgggcccaccaagggtttggcctccagcaaggccaacggttgcgtgcctctttctttgaggcaacggctagtgggtcccacaggtcggttatgaccgttgtggg

SEQ ID NO: 30215 - DNA, 1501 bp, Oryza sativa
gaactcagaaatgacacgaccaactcggccaaaattcacaagtctacaaaatatatcaagaggggaggccgccaaccgaaattgggctggtttggcccagcctatggttcggccgaacccatcatggtgccattggatgcaaggttgcagctggatggtgtggattagcccccaatgacggttggagggtatttccgaccattccaaccgtcacaaccatcattgggaggctatataaacctctcactctctccatttcaacacacacttcaagcaaagttctctcatattctctcaagcttagtttagtattctcaagcttgtggagtaggaatagaatagaaaacagagtctagaagtcttcggaagagttcgggtatggctctagcagctctcctttcttcttttgtaagacttgtactttatttagaatattcttctttatacaattctagtattgtaatactttccaagtatatgagcgccaactttactttatatctgacttatattgattttactgctagcttatttgggagatgcaatggtacgggtatagtgtttgcttatgcaattactctatgttatgacgatgacattagagtagtatctagtagtttaggcgtggtgtctagattattgggtatcattattttgtgttatatgctgcggaagagaggtgggccactgatggtgacagctcagtacgggtattcctccgcgcttgtatatagtcctaagttaatttcctggggagggtattcctccgtatttagccccggttgtatggtcatgacgggctgtcgtaaggaactggacagtcaggggtggcttctcgaagtaccaggagggcatcggaaagagggtattagctagttaatcttatagcaaagatgtatgcataatatgtattctataagtataggaatagattcttttctattttcttcccacttagcttagatagtttaaatatgagaatgagtagtcttatgcttgtctttcattctaccctatgaattgtactaaccattgcttagactatggttattacaagtaatatataaattattagtacgattctctctactataatcttcccacgagattaaacaaatacgatatccttggaatactctcgggtgaaatggtacaatggtatatccgtgtgcttgcggatgaactctgtaaccataatataccaggagtatttctgcgccattgctgggaattatatttctagtaatgtcgttaagaaataccaataaacatttctggcaccgttgccgggaagatttataaaagagattaccactactattactctatatttacctctgtataatcattgtcctttgcaggctaaccttggtttttttcacttttattgtggaaacagggtagtgcatgattggttttaacttgccgaaaaacttcaaggaaaatccagaggctttctttcagagcgtcaagtcgcgagtcgtcgctccgcagaaaactc

SEQ ID NO: 30216 - DNA, 796 bp, Oryza sativa
tgagataggcttttgtgattttccaaagaattaatcttcgagtgggctaaggcccatctattaattccaacaaaggggatagcgctatatcgctaatctatccagcggtatcgctaatcctttaagtgcgcccaggactgtaactgtctcacgctccaaacaagcaagagctactcggtctcgcacccttaatacgcgagaccaccggccaaaacacacaacccagcatcgaggtggtggagcccgtgaaggaattggcctcgcgcggctatccgcgagagcgcctctctgacgcacgtcggggcccacctttggtctcgcacttccccaccatgaaaccgagtgcgatttcgcattctcccagcgcgagaccgaaatgttaattgcaaggctaagttgattatatttcgtgtgaagaccgtggagtacgtatatatattttctttcatgatttttagtagttatgtgtaatatatatatatatgagagaaagtagtaatttaattagtgagactagtcttatccacattaactgcgattgataaaatcattacttaatgaattatagttaaattaatattatggagtacttattatattattatgttggtaatcgcaataacatatcacggcaaataaacttttagtgtaattctcatggagtctgatgaggacacaactagcttggatataaccaagactaccttatatattaatcaaccaaaggtgcatatgttctacattagatttacttgttatatatttgaacaaacgttgctacacaaagagttttgtg

SEQ ID NO: 30217 - DNA, 1501 bp, Oryza sativa
attctttcttgtccaacaatgactagtatctacccatgggtataaatatgtacacccggggtcattctaaattatctcaacgatcaatacaactactcttggcgcatcgccaccgtctttaccgagggtgcatcggctttcgatcttcagctaaggggtaagtcttatgttccgtcagtcttggccatcgtattggctacattggcgtcgttcaaggctacatcagtacattcgacctcttggattgctctggttcagttgatatatttgcctatttatttatcatatatcttagttaatctagttgagcatcttaatttgatcatattggctgagatttgttttagggtttatgctggtatcgactaaatatcttgctagattagattaactaaggtatctaccactcttaaaatcagtcaagggcttgattgtctagatattacgtttcttttcatacttagtgctgcatcagttaagtttgatatactaaatcgtgtttcgaactataatctctagcctgctttttgattgcccataagggtttcatcggggtttcagccaatgagttatatggatgttggatcggtttacaaggattagatacatgttggttttagccgattgcaacaaaggtttcactgtttatctaatcttgttaatttaatgacatcggaccttgttggtatttcttaacgatattactagaaatataattcccagcaatggcgcagaaatactcctggtatatattggttacagagttcatccgcaagcgcacggatataccattgtagcgtttcacccgagagtatttcaaagatatcgtatttgtttaatcctgtgggaagattatagtagagagaaccgtactaataatttatatattacttgtaataaccatagtctaagcatgggttagtataattcatagggtagaatgacacacaagcataagactactcattctcacatttaatctatctaagctaagtgggaagaaaatagaaaagaatctattcctatacttctagtatgcatattatacatacatcttagctataagattaactagctaataccctctttccgatgccctcctggtacttcgagaagccatccctgattgtcgagttcctcactacaacccatcatgaccatacaaccggggcttaatacagaggagtaccctcctcaggaaattaacttaggactgtatacacgcacggaggaataaccgtactgagctgtcactatcagcggtccacctctcttctgcagcatataaccccaaataatgatacccaataatctagacaccacgcctaaactaccagatactactctaatatcatcgtcatgacatagagtaattgcataagcaaacactatacacgtaccattgcatctctcagataagctagcagtataatcaatataactcagatataaagtaaagttggcattgatatacttggaaagtatgtattacaatagcaga

SEQ ID NO: 30218 - DNA, 1501 bp, Oryza sativa
agcggccgccgctcgccgcgcccttcgtcttgacgacgcggagccggtggtagcagtaccagaggtcttggcggcggaggaccgcccaccagcatctaggcgctgccgtgccgtcatgaccaatttggccacgtcgtccagccaacgttgggctggagactccgggtcatggcgacgggcgggtgacgtaggagcgcgcccgcagcttggagcgcgccctggggcgtgctgccgtcgccgtagacgagaaggcgacgctccccatctcgccgcctttttccatctcccgtggatgtcgaagtcgcggatccttcggccctctcgagcgccttctcccgcctaggactttggcgtgaaggggcgggtgaagtacgagctcgacggcgtgggttcggctccccgtcgtcaccgctaacactcggagagaggttgtgcgcctttgcttgttcagccattggactgaacaggaaaaggttggcgcacacgaaagaatacgagagcttagaaaaacacacgcagcgccccctacctggcgcgccagatgacggagcgtggggctcctcaccgggagaccgcgcaggcccccctttgccggttcggccggggaccctgggtgagattctaagctcttggtctgtggaaggttcgcgaaaatggaagaagcacacaagacacgggcgatgtatacaggttcgggccgctgagaagcgtaataccctactcctgtgttctggtggatctgtgtatgaaaaactacaaagagctggagggtcagagagcttttactctagaaaccctctcctctggttctcaatccagccttgatcgttctggatccgaatcccctttctaagtgggcaaggtcctccttttatatctcaaggggataccacatgcaccatctcttcttttttgtgtggggacttattctctcttcccccaaacttggcttgacttctcttcataaatggacggagatttgtatggttgccgtccgaatgaccttctgatgggacggcccatacctacctccacttccgccggaagcaggcgcgacgtgggaacatggctgtctgccgtcgacatgaccagtgtcagaccggtcacaaatcggtcattcttgtccaccacgtgtcagtttagcaatctgcatgttcgcccttcttcatacaatgtcttgcttgtaatggttaggatgaagcctggcatatatctgaccgggactaacgtgccatctccgggaggtaacacgctagctccagctggggacgagcgcctagaagccctcgtcctgacgggatggggcgaggcgtgcgtcagatcgcctgtcgccacctaacccacgatctgaccggtttgtgactggtcacagaccggataaacgagcgcgctgcactgcgttacatgcggcgtgacgcgctcgtccaaaccgcaataaatgtggttaggtgagccccgctatgctcacctaccccatatacgcggcgcaaaacccacaagg

SEQ ID NO: 30219 - DNA, 1501 bp, Oryza sativa
atctcgtgggaagattatagtagagagaatcgtactaataatttatatattacttgtaataaccatagtctaagcaatggttagtacaattcatagggtagaatgaaagacaagcataagactactcattctcatatttaaactatctaagctaagtgggaagaaaatagaaaagaatctattcctatacttatagaatacatattatgcatacatctttgctataagattaactagctaataccctctttccgatgccctcctggtacttcgagaagccacccctgactgtccagttccttacgacagcccgtcatgaccatacaaccggggctaaatacggaggaataccctccccaggaaattaacttaggactatatacaagcgcggaggaatacccgtactgagctgtcaccatcagtggcccacctctcttccgcagcatataacacaaaataatgatacccaataatctagacaccacgcctaaactactagatactactctaatgtcatcgtcataacatagagtaattgcataagcaaacactatacccgtaccattgcatctcccaaataagctagcagtaaaatcaatataagtcagatataaagtaaagttggcgctcatatacttggaaagtattacaatactagaattgtataaagaagaatattctaaataaagtacaagtcttacaaaagaagaaaggagagctgctagagccatacccgaactcttccgaagacttctagactctgttttctattctattcctactccacaagcttgagaatactaaactaagcttgagagaatatgagagaactttgcttgaagtgtgtgttgaaatggagagagtgagaggtttatatagcctcccaatgatggttgtgacggttggaatggtcggaaataccctccaaccgtcattgggggctaatccacaccatccagctgcaaccttgcatccaatggcaccatgatgggttcggccgaaccataggctgggccaaaccagcccaatttcggttggcggcctcccctcttgatatattttgtagacttgtgaattttggccgagttggtcgtgtcatttctgagttcttggcccatctttccacaagtttgattctcgacatcgcccgattcattaatcgcttgttttgatgttgattctcctctattttatgttcattctctacaagaggttagtaatcctagtactagtggaacatttattgttctaacacaaatatgcattgaaagcataactagttctcctctattttggtagtattgacggtcaaaactgattgctaacgaccgtcaacagacctccagccgatgtatgctttaacctttggatccgtgcttattctatcgtatcattattagccgattggtttctattagattatattgttgttatattacattatcatcagccgattgactttatttacatcaagtgtcagattctgcatcaaacatatagc

SEQ ID NO: 30220 - DNA, 1501 bp, Oryza sativa
gtgtaggttggaaatcgacccttaagttgtatagacggtaactcactcataaatccacttaaaatcacatgtactgtgtagctcgtaggaaatagcaactattcaaataaatgattcaatattaagatattgtgcacacacctatactgtacatcccattatagctatacggtatagtattaatttgcttgttgcatatattaaattagagggactatatgacaaacatgaatattagataaatactagttataaatcttgatctcatataattatagttcaattgtaaattaggattattcattgtaaaattatgtgatgggataatctgtaaccataatatgattaacctaaacaactctaacatacaaagcatggataattattaaccttttctaatttattgtgacaagtaaaatattttcataattaaagcaaagcctccatcaataaaataataatacaaatggttccctgcgattaattgcttgatcccaaatccatccgacgacaacagaacctctagtatatgaccattttatttagatcgatgcatgtgtagccataatccttccatagcctttagctagactaaaccacatattagccagatatgtatctcatttatactacgttggctagctcctaaatagaccaccatgacaacagaaagattaagaaactttagcccttagcatgttggaatccatcagcaagcgcgaataaaatgagcaaccctaggttcgacctcatcaaatatattttgtttgtgcatatttgaatgttgcttgaatattggtttttctcgcgtattatagaaattgtgtatcggtcagttgtaaggcaacatctacaacttccaggaggtgaaggttgaacaataattatatcaagaataaggactatcatgcgcaggcaagtcatcactattctttgaacatgttgatcccaattgcgaaattattttatttacaaataaaattgcatgcaatgatgaacatcctacttgtgattatgccatgccttgattattgtttaccccttattccttcgtaaccatgtttacgtatgagtccctagtcaattatgacaattgcttagaagtgctattctagaatcatgcatacccatatttatcaaatgctatatgcttgggcaattacctttgggaaggtaattgagatgcggcatgtggagacatgagcgccacactgccatgatgttgatgacatgatttgtgaaaggagaaataaaactaaacaaccgttttcgactggggcggacggaggatttgggtggtatctggaaaaggctagtactgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggtaggtgcgctactgtgggacagccgttgaggtag

SEQ ID NO: 30221 - DNA, 1501 bp, Oryza sativa
cttagatttgctaaggtgtggctaataatttgatcgtattaacttaagcaagtgtggcaatatttattgataaataatggtaaagtatggctaggaagcaaatacaccggggcccctttgaattgtaggaataaaaaaacgaaggaataggaaaaacatacgattctaatagggatgtaagtgtaaaacagaggattacaaaatacaggaaaaacacaggaatgatcgtttgattggactgcaggaaaaacatagaaattggatgagagagattgtcggtgacatgaggccgggagtatcatgactagaggcttgaggcagacacaatcgcccacgtggcctggcaccctcggggggcgtcgggcccgagggtgatgtgttcgccctcctctttgtctccccgagggggtcggactgctcccgcctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtctgtgaccagtcacaaaccggtcagatcgtgggttaggtggcgacaggcgatctgacgcacgcctcgccccatcccgtcaggacgagggcttctaggcgctcgtccccagctggagctagcgtgttacctcccggagatggcacgttagtcccggtcagatatatgccaggcttcatcctaaccattacaagcaagacattgtatgaagaagggcgaacatgcagattgctaaactgacacgtggtggacaagaatgaccgatttgtgaccggtctgacactggtcatgtcgacggcagacagccatgttcccacgtcgcgcctgcttccggcggaagtggaggtaggtatgggccgtcccatcagaaggtcattcggacggcaaccatacaaatctccgtccatttatgaagagaagtcaagccaagtttgggggaagagagaataagtccccacacaaaaaagaagagatggtgcatgtggtatccccttgagatataaaaggaggaccttgcccacttagaaaggggattcggatccagaacgatcaaggctggattgagaaccagaggagagggtttctagagtaaaagctctctgaccctccagctctttgtagtttttcatacacagatccaccagaacacaggagtagggtattacgcttctcagcggcccgaacctgtatacatcgcccgtgtcttgtgtgcttcttccattttcgcgaaccttccacagaccaagagcttagaatctcacccagggtccccggccgaaccggcaaaggggggcctgcgcggtctcccggtgaggagccccacgctccgtcatctggcgcgccaggtagggggcgctgcgtgtgtttttctaagctctcgtattctttcgtgtgcgccaaccttttcctgttcagtccaa

SEQ ID NO: 30222 - DNA, 1501 bp, Oryza sativa
cttcatagccttcgtcgaagtcgtcgaggttgcggtagtcgtagcggtagccgaagtcgtcgtactctacgatctccgttggtcgtgagtcgacaccgggggagctgaggtagccgtccaactgtttcgtcgaaaccgtgccgagaggctggagtatgacaccgacttccctagagctagactggatcggggccagggcggatcccgcctagacctacggggagatgacgctcttgtggtgaaaacgacagccaaatcgttgaggagtttcatcaggattggcggataggctctattgtcttcatcgggtcgtgttggagtagattggatctcgtccgagtggtttggggccaactcggttgagatgatcttggggtagatctcggccaagtttggggtacgaacggggcggaaacctggtctcttcccgactggttcgaatccgagtcaagaagagaaatcttgccgaagtcgttggtgaagaagttgaggctgccgaaccggaacgcctgcccgggagggaagacgaagtcgtcgatgccggagacgaaacccatcgcactaatcggcgaagaacttgacgctacccctatctggcgcgccaattgtcgaaacaagattttggcaatactaaaagggggtggctatcaagctggaaaagtggatgggttgagaaacaaagaattttatactggttcaggccttcttaacaagaagtaataccctactcctgtccggggattgatttgccgagtgtattattgatcgtatgatctgggagcagatcgtgccctaagaggcacctggacccctccttatataggggaaggggtccgtattataaaatacagtccatatccctaacggaataggtagttacagataagattcaatcttaaccgactaagatcccgggtatttccttaacatacaagtttggaatttaacccaagtccctttaaagatattctatctatacatggcaccccatacccagtcggattataaatgccgtgttggtatggggtatccataatctccacaaaattggaataatgtgacggaaaagttgaaagtttgtgtgtaggaaagttttgatgtgatggaaaagttgaaagtttggaactaaactcggcctataatatataggacgattcattttgcttgaagattggtgatctaccggtatatttcctccgtactaaaataaacaatccagtatgaagtatgatatatcagaatcctattggtacgaaatccggacagtagatcgttataattgcccaaccaaaaaaaaaaagatcgttataattgccagtacacgaaggaattattactattgggccgattgggtcaataagcccatgagagcccactgggccggtgctgctgacgtcacgccgagctacttacctccgcgagcggccacaacttcgctcccctcccccctcttcgcctgagtcgagtcgcctcccccaccgcgggccaaccatgctgccgc

SEQ ID NO: 30223 - DNA, 1501 bp, Oryza sativa
agctggagggtcagagagcttttactctagaaaccctctcctctggttctcaatccagccttgatcgttctggatccgaatcccctttctaagtgggcaaggtcctccttttatatctcaaggggataccacatgcaccatctcttcttttttgtgtggggacttattctctcttcccccaaacttggcttgacttctcttcataaatggacggagatttgtatggctgccgtccgaatgaccttctgatgggacggcccatacctacctccacttccgccggaagcaggcgcgacgtgggaacatggctgtctgccgtcgacatgaccagtgtcagaccggtcacaaatcggtcattcttgtccaccacgtgtcagtttagcaatctgcatattcgcccttcttcatacaatgtcttgcttgtaatggttaggatgaagcctggcatatatctgaccgggaccaacgtgccatctccaggaggtaacacgccggctccggctagggacgagtgcttggaggctctcatcctgacgggatggggcgaggcgtgtgttagaccgcctgtcgccacctaacccacgatccgatcggtctgtgactggtcacagaccggataaacgagcgcgctgcactgcgttacatgcggcgtgacgcgctcgtctaaaccgcaataaatgcggttaggtgagccccgttgtgctcacccaacccatacacgcggcgccaaacccacaaggggtcggggcgcctcagccctcggggccgaagcgggagtggtccgacccctcggggagacgaagagggggggcggccacgtcaccctcgggcccgactcccccgagggggtcaggcctcgtgggtgattgctcctgcccaagcccctagtcatgatactcccggtcccatgtcaccgacagtagcccccggcgttatgccagggcgatcgccctcctcgagagaagcggtcgggcgtgacgccacttcccaaagcctggtgacaggtgggaccggtctccacagttgggcagaaacccaacggtcgcaaatcacgcactccggcaacggtaactcgactgtcaataatgagcggcctcttcaaggctgccacattactcgagtagcacatgaatcgggatgagccggttcgttttgcctggagatatggtgatggcgcttcggtcggcgagcgtaattaacgcacgcacgatatgttccatctcgactgcctcagccgcatatccacctcatgcgccgcaagcgggcgtatgggattagtggaagcgtgggcgcgagaaacgagggagcgaaatagtgggcgcgagaagcgaggagccgggcacagcgttggcaagggtataaagataccgaggaagagatttgcttccttcctttcgccattattccccttgtcttcgccgcttgcgccctaactccttctttcctgtgccctaccttcgccacacgcgctcgctctcaaacatttcttcttccggcgtca

SEQ ID NO: 30224 - DNA, 1501 bp, Oryza sativa
tattccattaattagttacgggtataaacaagtacaaaaataaagcatttgatacatatacagaatataccctatagataaataactaccctaatgtttagcatttaggatacatttaagaaattctcatgtatcgctagaaatgttgcttttgcactcattttgttggtacattagtagatgtagcaaaaattgttgccttagctcatcaatatcctacaaatgcatttatttataaaataaataaaaataatataaagtaattttcaagacacgcataaagagatgtatcatacaacccgacaaggtactaagaaatttgaatagttagctaccttgcattagacaaataaatttattggttagaagagtcatacataaaagaaattaaaatggaatatccattttaatatgaatacaaacaaatactaaaataaactatttatcaaacacaaggcaaaaaataaaagagatgtgtgatattatccttgaaaaaacatgcctgacatgaatcgtaatccagagtttcgcacaggaaaagtccatctgatctctacacatagcttttttttccaatatgtaacaaaaggatagggcatatagacagttcatactacccatccaacaaatttaaatttaaaccatcatcgagattgtttaatgccatataagaagatgaacgattgcaaacatcctcgattttaccatccttatcatacgtgacataatgtatgttaggaagatgaaattggagctgcaaaatagctgaataaatatcgaactgtgggaaaccaagaatcctatacatagcctctggcaatgatacgtatctggcatcattgtaatgtcctatctcatttatttccctagacggatcaacaaagcaaaattactatattttagtggttttagatttacccaaacaaatagttaagccaagacactatcaaaacctagtattcatattagcatactgagtatcacgcaaaacaagtttcagacaatgtggatctcatcaagcagtgtgccatttcggagaattcttgggttacacaaattcaatccccattacttattaaaattgtaatttttgtacatcgagaaaaaaaagaaaaataaatatatgaaaaattggactctcgtgtgtccgcaagatttgagtgaataaacactggatgtccatagcagcaactttcaaagcacaggctttttgctagttcattcaaatgtactcaagtgtccatagcagccctaatgattcatttcacttaatttaaaatgtaaaaggtcaatcatagttaccagaagataccgtgcatagaaaactcaactaaaccaaaaaccatcgccaattaatgtagtccatttattatccatgctaatccagttcttccataattatgcctacagataccacaagtaactgttttcatctggatgacagaaaagatagattgcttttagcaataaaactataatatttttttaacacaacaaattg

SEQ ID NO: 30225 - DNA, 1501 bp, Oryza sativa
gaggcgctgacgaaggagtggcggccgaatggcgagcaacagccgccgctcgccgcgccctccgccttgacgacacggagccggtggtagcagcgccagaggtcttggtggcggaggaccgcccaccagcacctaggcgctgccgtgccgtcatgaccaagttggccacgtcgtccagccaacgttgggctggagactccgggtcagggacgacaggcgggtgacgcaggagcgcgcccgcagcttggagcgcgccctggggcgtgctgccgtcgccgtagacgaggaggcgacgctccccatctcggcgcccttctccatcacccgtggatgtcgaagtcgcggatccttcgatcctctcgagcacctcctccctcctaggactttggtgtggagggggcggtggagtacgagctcgacggcgtgggtttggctccccgtcgtcaccgctaacactcggagagaggttgtgcacctttgcttgttcagccattgggctgaacaggaaaagcttggcgcacacgaaagagtgcgagagcttagaaaaacactcgcagagccccctacctggcgcgccagatgacggagcttggggctcctcaccgggagaccgcgcaggcctccctttgccggttcggccgggggccctgggtgaggttctaagctcttggtctgtggaaagttcgcgagagtggaaacacacaagacacgggcgatgtatacaggttcgggccgctgagaagcgtaataccctactcctgtgttttggtggatctgtgtatgaagaagctacaaagtgcgagccagcccccgatcgttctgggatcgtttcctttttttcttctctctaagtgggcaaggtcctccttttatatctcaaggggataccacatgcaccatctctccctctctttcttttgtgtggggactcatcctctcttccctccaacttgacttctcttcattaatggacagagatttgtatggctgccgtcccaatgaccttctgatgggacgacccatacctacctccacttccgccggaagcaggcgcgacgtgggaacatggctatctgctgacgacatgaccattgtcagaccggtcacaaatcggtcattcttgtccaccacgtgtcagtttaacaatctgcatgttcgcccttcttcatacaatatcttgcctgtaatggttaggatgaagcctgacatacatctgactggaaccaacgtgccatctccaggagctaacacgcctgctccggctagggacgagtgcttggaggctctcgtcctgacgggatggggcgaggcgtgcgccagaccgcctgtcgccacctaacccacgatctgatcggtctgtgactggtcactgaccggataaacgagcgcgctgcactgcgttacatgcggcgtgacgcgctcgtccaaaccgcaataaatgtggttaggtgagccccgctatgctaacctaccccatatacgcggcgcaaaacccataagg

SEQ ID NO: 30226 - DNA, 1501 bp, Oryza sativa
ggataagttttttcagaggtctatttgcgaaataagttttttaaaaggacaaaaatgtgaaaaatccagatgtttattactactccgtattacggatatctgagatcttaattttatagggtgtttgccagttatagtaggtactttattgttcaaatctatcgatcacaatcaaaggtacttaagaattgacagaggtacttaaatgaaggaagggtaaaaacttttgcatgcatgctaacataagcaataaattaaatacagaacagaaaaatatctttgcaatatgaatatataggtacttgtcggtgacatgggaccgggagtatcatgacttagagacttgaggcagacacgatcacccacgtggcctaaccccctcggggggggggggggggtcgggcccgagggtgatacggccgcccttctctttgtctccccgaggggtcggaccgctcccgtctcggccccgagggccgaggcgccccgaccccttatgggttttgcgccgcgtatatggggtaggttagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctggcgcacgcctcgccccatcccgtcaggacgagagcctccaagcactcgtccctagccggagcaggcgtgttagctcctggagatggcacgttggttccagtcagatgtatgtcaggcttcatcctaaccattacaggcaagatattgtatgaagaagggcgaacatgcagattgttaaactgacacgtggtggacaagaatgaccgatttgtgaccggtctgacaatggtcatgtcgtcagcagatagccatgttcccacgtcgcgcctgcttccggcggaagtggaggtaggtatgggtcgtcccatcagaaggtcattgggacggcagccatacaaatctctgtccattaatgaagagaagtcaagttggagggaagagaggatgagtccccacacaaaagaaagagagggagagatggtgcatgtggtatccccttgagatataaaaggaggaccttgcccacttagagagaagaaaaaaaggaaacgatcccagaacgatcgggggctggctcgcactttgtagcttcttcatacacagatccaccaaaacacaggagtagggtattacgcttctcagcggcccgaacctgtatacatcgcccgtgtcttgtgtgtttccactctcgcgaactttccacagaccaagagcttagaacctcacccagggcccccggccgaaccggcaaagggaggcctgcgcggtctcccggtgaggagccccaagctccgtcatctggcgcgccaggtagggggctctgcgagtgtttttctaagctctcgcactctttcgtgtgcgccaagcttttcctgttcagcccaa

SEQ ID NO: 30227 - DNA, 1501 bp, Oryza sativa
cttttttatttaatatgtgatgattaggtaatgcttagactagcatataaaagattggcttgattagggttctaaaattgaagttttctttgaaacgactaatgttattatttgctcttgccatagaagtggtttttcaggactcttgataatataactattggtttgggatgataaagcttcagtttaggacgatgagtgctgccctgtaggttaaaatcccattttaactaagttatgtattatttgactagcttgcactttcaccctcttcctttaaacatactgatagtatctgctcataaaattattgtgcttgctatgatttaggtattaaaatcacataccttttataatctatgtaaaagatgtacaaccagaaaccaataggttaacttgacagaattgacctttacaatcctacaataccgtccattccaactttctttgctaaataaatatgctgctgtgtgcattatttggttcacatacctgattattagaaaattactgaaaacagtttggattgtttacctgtttgtttttttagtatggataaatcattactttgcttttggttggtacctttttgtgccccccccccccctgctatttgagatgtttaattaatttcctcatattgggctaaatttgtacctgctggtggtccttcagttaattcattcacagattacttgacatcggcaattgcttctttgattcttacaatctgaatatataccaaaaaacaactatgttaacttgcttttttcacattcagaaaaagaacattactaggaaacaaggatgcttaattgttctaatattgttgagtagttcaatgccataagattattgactgccagtattgataaaaaaaattgtatttttgcatcacttctcaggcagctatgtacacgggggaagcaattcatcatagcaaaacatattgcacttccatttgcacatcaacaaaagggcccctgtgtgaattcggtgaaggcatccaaaccatattagtagaatttagccatgtgtaatatagttttatagtcctatactcctatgtgctcatctagcagaactgtttcaatgctaccactataaaactactatgtactgtctatcctgccatcaaacatgtggcacattttgctatttaggactgtccacaatctgcatatatgttgtgattagcttttagcctctataacaactttcaatataaatgctcacgtcacaaaacttcattttttgcactacactaaacctaaatctcacaccatgtcgttagcctatacttgaccttcacagaccttgcaaatagcatttgtttcagttacctaccagaaccaacagatgtaatcaatgattttcctctcctggcaccactggtgcaacgcgcgaagcgcgcgttcacctctagttgtctttatagtactaccatattggcattagcaccatatgctacacaaaagtatacttgtggctaacttgtagc

SEQ ID NO: 30228 - DNA, 1501 bp, Oryza sativa
aagcagtattaataaggagaagatcattagcttgaccatgcaatggaaatagttatacctgcttccccatctgtggggatatcacagcatacacgtttgcgtcctcaactgttttgtgcaacagttgcctatttccacctgttgtgcccataacaaatggcaatccaagtttacagtaaagctcagcattagctgcacatcaaaaacaccataaatgtcagattagcagcaataatagtgagcaaataatatgaaaataaggaacataaagcatatcagagagtttaatttaattaactaactaataaataaaagttaaaaggctgacataagatgaagagcagtagcggctatcctgccaaacctacttccgatagaatatcaactaaggaagattggattctgtagttaaatattcctgtttctttttgtacagttgcaaacagaacaacagacaaccatacatacataagctaacgggatcattataatcgaacatacaacttaatgattacaacttgctcttctatccattcatcaaaatatacgataattttcaactaggttcagttgtatgcactatgtagaagaagctcgagctgaacatgagatagggatttgtctgatataaacaaccggcagtttttgctgatgcaattacggaatgcttacttttggtagagtttagcatataaggagatcaagcaacagaaaatatttatatgctcaccattaacagcatcaggaacagtgtagtcaacaactatcatatctgggtaatccttagcaatcgaagggagaatactttctccttcagatgggtcacgaatataaatttccctatcacaaatttcaacctttccatcaggaacctcaatagcactgaatgatacaggaactaactgaagaccagcagatacagctgcttcagcaacagccttccccattttcccagtacaactattcacctaaacaggtaaatattggtataataagtgaaatctgagataataaaataatggatctacaggaatgtaaatcatagaagcagttaagcggtgctttaatgaaaattttggaagtaattactaatcttagtaacttcaaactcaagcatcacagtatgatgtggagatgttgcaaggagaaaaattcagtacgtctggatcttaaatttacagaacactcaaacaaagtaaaaaaaaaaaaaaaaaaacaggtcagctcaacacgatatatgattgttgacgtgaaaactaatgaaaaggtaaaacagcagctaccagctttttaatatcgtgtgctaatcatagtaactgaaactaaacaagcaatcgaacctgtcggacttccatttcatggtgctacgcacccatttctatatatgaaattgctttataggatattgtctggaaactgaagtactgaatacaacatattaagtgactcaggcagctaaaaggcaagtttgattgagtttttttcaatgctcttttcaaaa

SEQ ID NO: 30229 - DNA, 1501 bp, Oryza sativa
atgaaaagttgggtaataaattgatttgtttggaaaattggtcgccttcttctttctttttcccttcgtgatgtatatatgtgcaacttatatgttcctgaaaaactggcaataaattgatttgtgtggaggtgccatacaatctcaaagttaaatcttttagtatgcatgccagatccatcgccgcatgcatgacacaacggggcaaaaacactgcatcctcacaaagaatgcaaagggcacacctgtccttctaccactaaattaacaccattaaggggacttgacagagtaggggcaaactgaagcttcggtttgaaaaaacaggagcaaaattacaaaccttgtaaaatcataattgcaactcgaaatagggacaagaacacaattacccctaataataataggaggtaataaagtgtagaaaaacacattaagaaattacatatattgctggtttaatatgaattttcaaacatatgaatgcacttttaaaaaatataatcagcttaggagagaaagaaaaaattggtgaggataagcagcatctacccagttcaacaaatggttttactcattcatcgtgtgacatatccaacaatacaaaatcatttgttgagttgtatccgacgtcacatagcccgccgcgctccctccctctcttcgatctcattcccctgaaatcacgcaaaatcacgcctaactccacaaatgacgccgctgtcgccaccactcagattcggtgcaccaccttgcccgtgagcccatccacacatcggcgccccctcaaccctagcgtcattgttccccttgggctagcggaggcagtggctggttatagctttataggactgttgatgtgaaaaacacacactggcctgagagatttgctttactctagtgcaggtccaaagaattgcttctgatttctaagcgtgccagttggtttgcaaccaacaagaaataaaagagaaacaagaaaacaaagttaaatccgtaaacgatagccgatgacatatcgttcaatattaagccgatgttatttgcattagataggcaatgaagagtaaagcagggtaaagttaaatctactcgatcgggtgtagatattaatgatatataatctatttctaaaaatatgtttaaaccaagtgattgggatagatcggacagtttgccgagacagtataaatcacttatgtttaaaagtactttgagatagagattatatatattcatagcatagccgattaagtaaatctaagatgtatcggctaatactccgataccactctatcttaagatgttaaaacaaacgaaatacactaaatatcaagcttaatatattttaatgcaataagatcttaatataaagggcagatttagcatatcgagtaatcatataaggaacaagatgactaaaccaggtaagatcggctgaaaccccaattctatctctatcgataatcatagaacaagctaaatattatgattctagata

SEQ ID NO: 30230 - DNA, 270 bp, Oryza sativa
cttcccctagcaggacaagtggctacccaggaacttagtgaataattaccccatcaggaaatggggattgattaatccacccacccatttacctgttaacgagaaaacaatagcaccaagtgcataaacgggtgtgggtatggttttgtaggacctacacctgtaaccaacccaataaataacccttatttcatatacagtaaaatgttacttggcacaccggcattttgtcttgctttttgtggatctggggctctaggttacccatca

SEQ ID NO: 30231 - DNA, 458 bp, Oryza sativa
tccagaagaatggcatcaagcccatgaccaacacagttaaacggcgggctgcagcacagatcaatggggtgtagcccaaggctaagcttaagaagaagcagcgtgagatcacacgccggaccaagctcacgaacgcccatctgcctgagctgttccagaacctcaacacttgattgctctacgcttattcgacgtcaagtggagatatttatttctgtcctcactctacctactgcaatgctttatatacctgctacccttattgtgtatgttataaatgtaattccggcctccgggagcataatctgagacggtcagctttgtaaaacataaatcaattcaagagcttgagatggcataccttcgcctgtcaatgcgttcttcaaattttcgtactgtaatgcccaaacgcaatgtgtttcttgttttcttttcttacgtttcaatgggatcctagg

SEQ ID NO: 30232 - DNA, 1501 bp, Oryza sativa
gtcccagcgaagtagttggcatggcaacagcaattagaaccactagcacagtcaccaagaggagagagtgagcagaggctagctcttggctttgttcatccctatttttcttagggcatgtttagttcgcgaaaagaaaatttttaggtatcatatcagatgtttgaccggatgttgaaagaggttttcggacacgaatgaaaaaactaatttcaaaactcacctggaaaccacgagacgaatcttttgagcctaattaatccgtcattagcatatgtgggttactgtagcacttatagctaatcatggactaattaagctcaaaagattcgtctcgcgatttccgttctaactgtgcaattagtttttttaatctatatttaatacttcatacatgtgttaaagattcgatgtaatatttttgggaaaaaattttgggaaataaaccagtccttaatttcacctttgtatcttggatagccttatcttgctctctcttatattaacccttcaagaagctttctggatagatataggcccggtttagatccaaccccaaaattttatactctgtcacatcgaacgtttgaatatctgcatgaagtattaaatataggctaaaaaattaattgcacagattgcgactaatttgtgaaacgaatcttttaagcctaattgcttcatgatttgacaatgtggcgctacactaatcattttctaatgattgattaattaggcttaataaattcatctcgcggtttactgacagattctgtaattagttttttattagtgcccgatataatatccgatgtaacacgctaaaactttacgcccctgaatctaaacacccccatagtgtcaaaagataaaaaaggaaaaacttctactatatttggtcagggtctcaggtataggaacttccggtaagcactcaccaccatgtagaccttataagagagcaaatttaatagtacagcccactactagctccaattcatctatagccaatctaatagccaattcatacaatagttgcttactatactattaatatatggtcccacctgccatacacatattgagtcttggagtccgcgctgtagctggctacagatctgtagcccgctgcttttatctctcatcgtttatcttactaaaatatatttacagctggctaatagcctgttattgtacctgctctaagcactcagtgccatgtagaccttataaggttacactttgaccactgactgacttatcacttgatggcatcactaaaatttactgcttgtctaaaaagaagtcaaattctaacgatgaatctgaatttgcttgtctagattaatcatcaggattggacattttttagacagataaagtactttcacagcgcgtagtcctgtggtttttaaaattcttgattatttatgccaaatcaaactgtggtacatcgatttcgaaataaaagtgtcaaattttgtgctttaacgttactaga

SEQ ID NO: 30233 - DNA, 289 bp, Oryza sativa
cgttttggacagcgacacggtctccaaaacacaactttggcttcttgtttctgtaaaaatatttattaaaaagtgatatatgtatacttttatgaaagtatttttcaagacaaatctattcatataatttttatattttcaaactcaacaaattgagacttattcatgatttatattttcaaggtttgacttaaacattgtcctaaacgacttcttttagaatacggagggagtacttgggtgtagttctttctcaatcccacattcacacgggtaaaagtgcacatga

SEQ ID NO: 30234 - DNA, 187 bp, Oryza sativa
ccaccccaccccaccccaccccaccacaccacgccgccactcaccaccgaccgaaatcccccgattgccgccgaatttccaccggatttgtccgaatcggggcggctccgcgcgcgcgtgggggtagagggcgcccgcctccggctcagcgcgcgaggcgcggggaggctctccgcgtccgtacagc

SEQ ID NO: 30235 - DNA, 1501 bp, Oryza sativa
accggccggggtacacaaacgacaatgttgacattcaggtccacgtcttacaaacatcataaaagtcttacataaatgcagcggaaaaacggaagacaacaggagctaagccttgactagaactgcagcgggaacaccactccacaggcatcctcgacggcacggacgaagcctactcctcagagaaaccttcatctgacccatactcgtgctctggggttgggaaaaatagagcaagactgagtactacccactgtactcagcaagtcacaccggaataggggtatgatgtagggaattatcaaaggagagctagagtggttcatttgcataaagcgagcattaataaacagaagttgacagatttaaacagttgtaacaattaattactattaatcatccgctgtccaacgctatcccacgttgtgacaggcccaaccatccacctaaactatccaaattcaaaagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacgctacaagcccagccgttgcccacgctggcttgtggtaagtacgctaagttcttccagggcatcccgcgaaccggtccttaactgccatgggtgcgaccagcaaaaccatgcacccacagcccaccatgtgatttattttaattaaccaacaccaaagcggtggcactaatccaacaataccattagaaccaacagtctaaacattaataggattttccccattgtgcactagttgaactaagcatggctaagcaatccctagtccaatctctagtcatgttataacccccaagctgacaaagggacatggtacaacaatagcatggctatgacaattggtaaacaccccatagtaacattataaaaccatgcaatatttgaagaaaaacaatagagcatttgcaatataggttcaacatgttcaagtgacaagcatgacttgccttgctctgctgctggaggaacctcggcgactatttcgaagtacaccggagcgtcggaggaaccggaatctagcgacatacaaagcaaacattgcaacggcgcgggtcggcgtcgaccgaagcggcggcgcgacgcggctggagtcggcggcggcggcggagagaggtggttcgcgtggctacggcgctacggaggtggaggggggaaatggagcggtggc

SEQ ID NO: 30236 - DNA, 1501 bp, Oryza sativa
aacattgtccaaaacgttaattaatatagaaccagagggggtatagtattaaattattaaccgcaaaatactaaaatccagaagtgatcaacaatcatcatgaaagattagcaatggcaaatagagaattgcccccaaacaacgatcaatccaccggaaagaagaaccctatcttccagaaacgcacttggctgataaaacaagcaagcaaaaacagggtagatctgatgctgcttctggacttatcaaatctcagagcgcaccactgaattcagaaatcacaacactgattcattgttagcaccaaaacaaaaaagggtaaattatataatggcagaacagtaattgaaatgggagtagtaacacaatcagtactgaagtagataattaatattccctccattgtaaaatattttatgcaactactattaacgtatagattaagaaaaaaatataatcatttccttgtttggatcaacccaataagttgcttataagcatacacgtattgtattatgaaacattataaaaaaaatagttgtgccctacactataaaatgaagggagtagtagcagcgacacaggatattccttaatgcatgataaaaagatacaatacaaatttaattgtggtttgttacataaatacaaataccttgttataggttagcttcctctaagcataatattatactgtccttagctcttcaattgtagttatggatcttgatcctatagagagaaaaaaaaatgcatatcaaagacatgaattagtacatatggtagttaagaaaatttcggaagaagaatttaaaataccactaacgagaggtaagggtgtaagtaactaacctacaaaatacacttatataccaaaatgaattactcaatttttttagagtaattctacggtccttgaggaaataccatgaggtaccaaaacttagtgtaaaatttggtacctcataatacctaaatatcaagaggtaccaaatttacaatagaaaaaaatagtacctcatgatatctcctcaagtcccgtaaaattgctctttgagaataataagagataccgaaaaactcagtgatctctggtcgttgatcaaggtcctaaaggggctggtcttgatatgctcgggccggctgctcctggccttctgcctccttgcttaatgttgtgacggcaccggcgagccaaggagttgagctgataaggcatcgccgcctaccagcaagtcggggttgccgggtaggggcggcaggcgccttgtggattggcaggttgttggaagcgcggcggcaaccggccgggcctaggccgctgggcgggaggcgcctggagcaagcgtcgagcagggagacagttgtgttaggaggcatcggcatcggcggcactatgccccttgtcttgttctcacatccggtgagaccgtagtactagtagggaggaaccagggtttagtctttattgggctcgggccgaacgttggtatgtcgaaag

SEQ ID NO: 30237 - DNA, 745 bp, Oryza sativa
actataaaggagaaaaaactttgaggaaaaaccaggccaacctttgattagtcgaatgcaagcaaatattcctcagaccatgatgcaggttacgtggatcataggagaagttaatcgatagccgataaactagtaaaagatgctagaatgcagcaactaagttctccagtttataactgtcaaaaaaaatcctagcaattgttgttacgctagagctttgaaagaccattttagtgcaaccaactgtacggtaaataatgtagtagttctatgtttctgaaacggaaataaagtttttgagttatcaaaaatactcctaagggcctgtttggcacagttctaaccaaacagtttcaactccactaaaactgggagtggagctgggtggaactctctcacaaaatgaactatagttgtggagctgggtttaggcagctccacaactctactccagacccaactcctgaagctaaatttaggagttggagctgtaccaaacatgctctaaatggttagaatatgacgaacaaaagtatatcactatagtacaatacattgattatactatataatttttatttgtaattcttttatagaaaatgagagatcaaagtttgaaaataaaaaataccactgtcaactatttttaaaaatggaggaagatttttttttttgggggggggggggggtaggggtgaaaacgaataagataatatccaatccaaatctgtccgaaacgaggata

SEQ ID NO: 30238 - DNA, 1501 bp, Oryza sativa
cacgtgggcccgccaccatccgtccacccggtgcgccgcgcccaaaccacgcgcccccgaaaccctagcgcccgcccccgcgtgcgccctccccaccgtgaacccaaccaccgccatgtgggtcccgcgtggtggaccgcgtccacccgcgtcggcctctctctccccgcgccccctctcttgggccgcccctcccgcgctcgcgccggcccattaggtccggccaagccgcataaacccctcgggccgcgcctaagccgcccgaggaagtctatatggcatccctcctttcttttttcaagggatttaataaaccctttttcccctattccataaatcaattccttattcccaaaattccataaatcatttccttggtcccgcacgtcagtgacggtcaataatattcttgagaatattatttctataaatttcataaatcaatttcctcttgttccacaaatatcttcctttgcccagaaattccaattaaacttccaaaattcatatctctcaatccgtagctctgattgactccgttcaacttccagtatttccataaaattgagatctatttaatgtcactactaattagtctaaataggatctttcttttggtcttttgtttaggttttcaattgtttgcgtatagttgcggttaccggattttcgtcgatcgcgggttttctcgaagattcgtgaagcttcgtgaagaccttgagcaaggcaagtcaccctttgaccaattgctcctataattggaaaatcattattattttgtttgcaacttgcattattagaatcacacactcaacttgcttggtctcggtatgcgtgccaaaccgacggacctacccagtagtcgcacactcgcactaattcctgtaggttgtactaccctgatttccttgtcactccacctttgtggaacctcggtatccgtgctctctgagcgcgtataccaaatatcccacatacaccattgtttgtcgaaaacttgggaaatgggtttgagaagccttgaaaacccgacatgtggcgtcagtgtgtttgaaaataaaatggattgtgaaaactcgcgatgcgggggttgtgcctgtgtggcactgtcccgtattcgcatataaggactgattcctgtgggaaattcatccgagcatataacaagtgcgaccacacgggtgcaatgggacgcccctggctgagtaattagctaatcggggggagccatgatgccaagagacatgtggattcaacggggtggtgtcgggaagaaccctcgggcttcctggcacagtatggtctgggacctaatctggtgttggtctgggacccctctcgttggcatatggtgaacctgtgttggctttcgaaatgccttgtcatgaaagccttaaggtctcccgacgtggctgatctcacgggctgggtgatccgggttagtaatgtcgtgtgggtaaagtataccccctctgcagagattaactaactgttcaaacag

SEQ ID NO: 30239 - DNA, 1501 bp, Oryza sativa
ccaaccttcgctgggttcagctttgagaaaatgccaagacgagatcaagttttgggctgtgcgtttcaacgctgaagacagggtcataatcccggtctggaaacatgtaatttcttcctccctacaatcacttgatctgttgtaacctctacgctttgtcttcccaaactgttggttttgggacttgtctaaaaaaacacgtgctaatgacgggcacctactgcgttccttgaatccttcgctccaaactgagccagattttcagcgcatgtcaaaacagaaagctgattagcacacaactaattaagtattaactattttaaacttgaaaaaaatatatttatttgattttcttaacaacttctgtatagaaaacttttgaaataaatacaccatttaataagttaaaaaaatacgctaacgaaaaatgagcaagttaaagtttagaattgaattaaagaatcaggctttaaatttatttcatcaccaagtcaaactcaaaaatattacctccgttctaaaatgtattggattaacatcaccaacaactatgaacctgaactagatttgacgtaacctagcactacgaagctgaacatgttgtttagattcgcagatgatgtcaaatctaatcctacatagctacttcctccgtccaaaatattgtgacctaagatcgggccgtcatacagcgatcaatctgtccgtctgccataccactggcgagtctgtccatccgccccattgccggtgtcgctactcagtgctgccattaccatgctggtgtccgagtccgtgccattggggatcgaagagcagaggaagagggtgcaggcacgggcatttaccaggaggagaggaaaaggataaggagcacacaagcgcgcgcgtgtgccatcggggtatagcgcacgctgcaggagaaacctgtctggagaccgcggccattgcctggacgacgaggagcagcgtcagtgctgcctctcgttcatctccggcctcacctaataatgatggagaaggtggccagcggcgcggacatagcaatcgcttgagggtgtgaaatagtggccatggagattgtgttccatcgctacaaccacagaaaatccccttcacatgacgaaagagaacacatcaagagacacatcagcccactgctagactgctaattaaccagtccgctccaagcgtgacaaacaccaagataaaccatagtgccatactatgacgcacgcaacgacgtacgtcaaagcagctttcaatagtacaacctccgcctcattataagtacaatcataggttttcacgtcaaattttaatcgtttgtcttatttgaaaaatctttataattagtatttttattgttatgagatgataaaatataaatagtattttactcgtgacttatgtttttaaatttttttaaaaaaaattttcaaataagacggacggttaaagttaggcgcgaaaaaccataactgcacttataatggaacgg

SEQ ID NO: 30240 - DNA, 1501 bp, Oryza sativa
cttaccgaccaagcactgaacaagatgcactacctgcacgctgcactgacggagacgctcaggctgtacccttcagttccactggtgatcactgatcagtcaatcaattgaccaatgaacagtatgatcaggaagttataatgagagtatatatcaaacttaccgttgcttgtttgtcttgatgatttaggagaacaagcagtgcttttcggacgacgtgttgcccaacggttttagcgtcagcaagggggacggggtattctacatgccctacgcgatggggaggatggagttcttgtggggtaaagacgctgaagctttccgacctgaacgttggctcgacgagcacggcgtgtttcagcaggaaagcccattcaagtttacagctttccaggtgaaattttactgaactcaccatcatcgtgatcgaattttctgaacttggtgatgagacagtcctgaattctgactacctgagtgaatcttgtgtaggccggcccaagaatctgcatcgggaaggatttcgcgtacaggcagatgaagatcttcgcggccgtgctgatccgttccttcgtgttcaaacttcgcgacaagaaggacaacgtcagttacaggacagcgattacgcttgccatcgatcaggatctccatctgactgctacggcaagatgagtgtacagtgtacactatacactatacagtgacagtggcacgtagggcagctgactctactcacgctagtgacagctccttgtgaaaacataataataatatctctcgaaaataatatagctgcaaacttaattgtgtctgattgcaaatattccgtctagcttgctggaataaattactatttcccgtgcatctaaaatttatttaaaattatacccatcctaacactactagaaaaatagtttttccaggcggcaaaaacagttttgtaagcaaaggcctgcgatgcccgcctacgaaaatcaggcggcatctccattattgtaggtgttagattccacctgcccgtgaaaatcatcaatgcgcacaaaaataaaaacagccgtcaccacccctacccgccggcgccaccattggcctcctcggccccctcccaaaacagccgtcaccacccctacccgccggcgccgccaccggcctcctcggccccctccccctccggcagacggctctccacctccgtccaaggggagtgccacttccgtaggccagctctcctcttccatccagacatgggaggggaagggcctgcgttgtctgcgccgccgctgccatccgctcctccgctgtcacaccccaatctggcaccgccgtacaacggcacctgacaggagcgtgtcgtgggaaaaagggcacgaaccgcttcctacgaaactgcgatctcagtaccagtcccaggacatagcgctggtacccacggtgacaaatatgaatcattgcaatccttaaaagaaatagaggacttatttaccttaacttaggttgcagc

SEQ ID NO: 30241 - DNA, 1501 bp, Oryza sativa
cgatctggaatctgatccttccccttttcagtttatcaatctcttttgctgatgtgtgttgcttgctttcagctagacatgtactccatctggaattcttgaagatccgaatagtagcggatggaaaaatatctgctgcttttgtgaggccaccatgttcgatgttctcattagttctgttgcaaaacaaggactgcatcaatttttttttcgaacagttagaccgttgccgatgttttatattaagatggtgtcccattttaaaaagtaaacgggaccaaaccttaccgtgtgcagtttgattgctgaaaaaaacaaggactgcatcaaattcattgctgaaaaaacaacagtttgatgtggtcatttgttttttttttttagaagtggtcatttgttttcatcgtgcctcctggtttcacttgcaatattcaggatctggttacatcagccattcacagttatgcagatcagttcatgaccacagagacggatcaatgtgagttgattcttcccgaagactttgatctttttcttgtggtctctgaatatttgtgtggtctcaggggacttggaggtcccagcaaattgactgctctggtaccttcagaaacagtaatttgattgtctcaactgacacgtttgcaagccattcctgtttcggtagtgacatctcccatcttctgaacaatgaagatccaccatggcattgcttgctgcagacgaactaggataattttcatttgaaagtagggtggttgaaacaacggttgccttcttttgaagtcggataaaaattcatgtcttcacaaaagtacagtcatgaggtgagtgaatggcatgaacatgtgcagttttgaagattacagtacagcataatacagcacaatgaccagtaattttagatgggaactgctcgtaattacggtacatgaacttcagatctaagtactgagtaagcgtgacagcaagcgcaagacaggtttgcagagggcatgtgcaaaggcaaacaaaaagcagatgatacatttggtactacatgtacatactttaatgctgactactactgtttagcctgacctttcgtcaagacgcaacaattgttaacaggctggaaatggatgtgcaataggtttgtcctcctactaccaaacaaaagcagttcttctgtaagcaaagcagagcaaactgtactccctgaagcatctaaccacctgtttctttgaatactccctccgtccaaaaaaaaaaaaaggcaaaccctaaatttacgtgtctaactttgactgtccgtcttatatgaaatttttttataattcgtatttttattggtattagatgataaaacatgattaatattttgtgcgtggcttgtttttttaattttttttataattgttaaacattgggtacggaaaccagatttgtcttttttttagacggagagagtatgaatgagcattgactcatctattaatgataatctctgatgtatagtttc

SEQ ID NO: 30242 - DNA, 1342 bp, Oryza sativa
gaaaactgtgctaagacatcttactccctccgtctctaaatataagggaatttgtttgttcgtgtagtaggatgtatcacatccaatcaaaatcttttatactccctccaacctaaaatataggccgtgtttatattcaaacttttttcttcaaacttattacttttctgtcacatcaaatgttcggacatatgcatggagcattaaatatggacgaaaaaaatcaattgcacagtttgcatgtaaatcgcgagacgaatcttttgagcctaattacgtcatgatttgataatatggtgctacagtaaatatttgctaatgacggattaattagacttaatagattcatctcacagtttacaggtggaatttgtaatttgtttagttattagtatatgtttaatacttcaaatgtgtgtccgtatacttaaaaaaattttgtcacacgaactaaacacagccatcataacttttgggtggatgggacatattctagtatagtactattatatgtctcattcaccctaaaattgttatattttaggacggagggagtatattataggagagagggaggaccagctgaaagaaaaacaatcaagatacagaagtcattctcagccattaaaagaaagaacgacaacttgttggaagcataataaataaacctgagtaaggtaatgcggtgctcgtccaatgctccagcctactccctccgtcccataaaaaaataacctagtaccgaatatgatacatcctagtatttcgattatggacatacatacgtctagattcatagtagtagaatatgtctggttctagattcgttttttatgggacggatggagtatcgacgaatgacaatcccatcattaattatatcctgcctatttggaacctacccggctataactaaagagatgcattatacagaatgacaaagatatcccatcactaattcgcgcaaaatacagaagggcgcatcactcagcgcggcaatccacaactaaagccaatctaactaaatatggaaaaactaagaaatgttattgataaacactcaaatataagaaatatcatcaacaagtgagagttacctaaaatactatcatacatgtgattttatcctagaaatatcattgttgttaagtttccattaatcggatccatatgccattataacttctttgattttgaaaaatatcataattatttgtttatttgaagatatgttattacaatttgaccgaaattagtaatatgccactagtaccatttcaatgtaattataaaaaagatttggactaaattacccctcctcctctctccttttttgttcagg

SEQ ID NO: 30243 - DNA, 1501 bp, Oryza sativa
ccaaaagatttaaattttaggaaagaatcaagacacgtagggagtactatcttaatagcacaagaacaccgcctttctcagcgagagaaatgggtacccgtgcgtctctgacatgcatcatgcatgagcaaaagtgtccgatacatataaaatggcgggaggagctagagtacgttcgagcctaccaaccagacacgacggccgtgctggtgcggtgcaggcacgtactacagtactaccatccatccgttcgtcacgttggattcttggatacttgtgccacgggctaaacatactcctcctccatacacaccgtcaccgagcaacctgtcctggatagcctaatgcagtacaacccacttagcttaatcatcaaacaaacatcgccacaggaactatggttaactggagagtggtagtttaatcctcgggaaccgggctgattaaaaagagagagaaagattaatcttctcgagagccgtggttgcaaagtttgcaagctcgtgggcagcaaatgtgtctgcatcctacaagacgatgtgctcgtgtacgtacgtttgctcgccgaggaggagagagatgcgagctagctagcgtggggttgggttgggttgtggtggagtggctacccaaaaaaagagcagtggatcgagtaggatgatggactgatgtccagtagcgccgcgtttgcctttggacgcgagcgagtgaccggccgaatctggtttggggatggatgtccgggttttgtctcatctccttcattcctcggtctcttccccgccatggcaagttcaaaatgcggctttgctccggggcaaattcaaacgcatgacgggtattacgtgcaatttgtgatgaattgcggtttcgcatgatggatggtgattggtgatccatacgccccctgtgcaccggcgggcggcggtggctctcgtcaaagcgtcctgagttgttgacgcggcttcacacgtccgtcgtcaaaaccccggggccccaaaccggtcaaccgaccattgaccaccaccacctcggcacctcctccatatacaatggccgaatggcgccgtcccgccttgtctcactccactacacacctccaccgccgctagctttcaaaaaaaaatggacgccaatccgcctcaccggctcaccaccactccagccactgacaggtgagcccccactcgaaaatatctccgtccgatccacccagcgcagtcgcagcggcacacgggcacgtacgcacgcacgcccgccggaatagggaggaaccccgatcccgaccggtccagctatcgccagtccacatgagagtacgtacgccacaggagccatccgggccccggtacgcgcgctacgcatctttcgaacccaaacccccccgcgacgacgccacgccactgccctccagctcactgccagtgctcccccatcactccactctccccccacgtctcgcctcgccgcaacagagaagcttttcagcttactccctgtg

SEQ ID NO: 30244 - DNA, 1501 bp, Oryza sativa
actccttccgtttcagttttatatgataagtctttcaacaatttcctagccaaactaagtttataaaaaaaattatcaacatataaaatatcaaattagtttcattgaatatattttgataatatgtttgttttatattgaaattattatgtatttttctataaatttgattaaattttaaaaaaagttgattagataaaaagtcaaacgatttaaaatataaattgaatagagtacattatgagttgcggtctttcaaaaagaaaaagagagagaaaaaataaataatttcctgctaagcaaatactgtccgtcacgaaatctccaatcgcgtcatcagctataccaacgcaacgcgcgttctcctcccccacccccctctccccagtgacgatgacacgtgggccccacacgacgttaggaacgaggcggtccgctcgcggaactataaaccggtcagcgtccgcacggcaccaaccttccttccttgtgcagttgtgcgggttggccggcccgcccgtggatcgtcttccaaccgggcgcgagtcggagtcgcgaccgcgaccgcgacctcacccaccgtttctcgatcgtttctctccctcctcctcccgcgatccggtcttcttcctcctccccgtcgtgctcgccgcccacgactcctcctcctcctccaccaccacccctccacgacgcggcgggcggcgagcgcgcgcctcgtctcaccctcacgcctcccacgccttggaacccaattggagatagaagaggggagcgcgaggtcaaaccaggggaatcggaatcggaatcggaatccgcgacgagacgaccctacccccgcgctccggcgaccgaccggcggcgatggagggcggaaaccacggtgggggagggtacccctacccgccgccgcagcagtatccttacccgtacgggcagtacccataccagtatcctccaccgcagcagcagccgccgccgccctccgcctacctctcgccgtcccgttcgttccacggttacccctccgcgccgccgccgcagccgcagccgcagccgtacgcgcaccattccgccccgctccagccttacccgccgccgccgcagcaccatgcctacccgccgccgcagccgcatccgccctcgccgtacgtctacgacccttaccacgcgcccgccgcggcgtacccttcctacccgagccccaaccccagcccgtccatctccccgagctccagcttccaccaccaccctgaaccgccatcgccatcgccctccgcgccgtcgtacccctccattgcggatgggctcgccaacatgcacgtctccgaccgccacgactacccgccgccgccgtcgccggcggccgtgcccgcggcgtcgtccccctccgtgctcccgccttccgcgtcgttccccggcggcgggagcagccacggcggtggcgggatgcagatggtgccgtacggccctcctgccggagggtcgcagcacggtggga

SEQ ID NO: 30245 - DNA, 1501 bp, Oryza sativa
caattaatcaatgcgatacatcatacaacactcaaatcacaaggggaaagccggatgaaatataagaaaatgggtagttaagctggaatattaaaggttcaggacctgtgaaagtgaaaaaaaaatagccttacctttaaattaatccattgagatgtatcttaatgtttatcagtaaccttccctatcaaacttttctattacaataagaagaaaaagaacacccatgatcttctttgttttgtcccttttctgatagaatatgaatgcacacaacttgctccaatcaaacgagatgggcagttcttgatctgtgagagaagttgctacctttggaggttgcttctttatccaagcatcctaagaatctgtacacaataccatacgaaacagtcgtaacaaggttgacaaaagaaatgcacaatcgtttgctcttcagtttatcactgcaaccaaaatgtaaattttaaacttaattttataggtgatttcgatggtttttcatcgtagtttattttctgttgttggtttttaagtcactaaaacatatttataaaaatacatttttttttcactgataagcgttacggtttataatcaggacgaaatgacagaaacacttattagggttaatgcaagattacagggttaccgaatcagtaaaatggttaaaacgaacagaaaagacaccggaggttatgtcagggctacccaaaaactgtgaagagccacactagctgttgacactcaacggcactcacaaatttctgatctcatatcaagtggttggaaaccccacatgctgaaatgcttgatcataatattttttttagcaaatgcgacaagacgacagcagctgatggcgtacgcatcagatcgagatgtttctgtccgtctcaaccgaaagatagcttgttcactgaagctcactaccaccatggacaagcacgaagcatatccatgtaggatgaaagccactgggtaaaagaaaaccattagagcaaatctccgaatctgtggctctgttaaaaaaaactctctgaatctgtgttctccagtttcttccaagaaccgttagtaaaaatgggtccagcagatagccctgattgaatctctgctgatgctgtcaatttgtcaaacacgaggtagagtaaaggctttagcgacatctatctagttagttatctaactatataagcaaagtgaagcataattaagcgagaggaaagcacactccagaacccaaaacagctgcagtgccatcagtttcagtttcagtttgagtgagctcgagggagcttagggtggctgccatgctggtggtggagctgggcgtgtggctcatcccgctcaccctcttcttcgtcccgtgccggcggatcgtgctcctcctcaagcagctccaggggttccaccggagcatgacgcggccgcggcggcgcgcctccgccgacatgctcagccgattctccgggctcaacgacaacatggtcttcgtgct

SEQ ID NO: 30246 - DNA, 1501 bp, Oryza sativa
gaacaaaatctagatatcacaactcaacttcactttgtcaagagttagaaagtgaaggatggagatggggaatcacttgcctcccaggatcaaactggagtttctttaccaagtcaacaagaatactagtccaaacaccagtcagctcgcaggtgacaataaaaagttttttttttgaacgacaaacaataaaaagttcaggttggtgtcgagcagtggagagagaaatcaagcatagcacatcactgcagactttttctttacagcgttacagtaaaacaacacaaacaaccttctggactactgtgatgtctaaacgcagaagaaaaatggacaatggagaacgatggccggccgtgtagcacatgttagcctccttttacctgcatccacagttccacacggttagtgtcgacctaaaaatccactgcttgaacttgtgtagttctcttgcgcgtttttggaaaagatatgcagatccaattcacatttttttatgtaaactgtcaagtgtccaagcaaaggaactgagcccgaggtagctccacgggccacctaaaaaatcactgcaaatcagaacggaatttaaataaccttatgttaagccttacacatgaaaaagcataggactatttgtatgtagcgctcaatcgctctttcaaatagtcgccactctttataggtgagaacctgaaaatgaatcaaatttcaagcagtatgagaagcaagcataataaaaggaactagacttgtgctaaagcctaaaggaggaagagaacctcggtgggcatgactcgctgcaacagctttccaaacactgaaccactaaatcagggtttgggtcaagaaaaaaagccgcctgacaaattgaagaacatgtgtaagagagtgcaccaaaaaggtcctaacattaagcacgcaatttaagtcgctgaaacgttacgtctatattatcagtgatagtttgcacatgaataggtccacctgactatacaacatgtattcagcaggtgacaaaaccccttgattccccaggaaaaaaaaaagaactctcaattatgaaattctgaattcagcagtcataatactcacagaatatcgctctttaccaactgcaacaacacggtgcactgtagacctacaagtcagcaaaagagggagaacattcaaaattcatatacaaggtttttctttcttagagatataaaatagaaaaggaagtgtataatgtaataaaacagaactccaaaagaattatagaatttcaaaaacacactgaaatggtctaacctgttcatgagacaatcctaaaccaacttcttgttaagaaaacattgtgtcatacaacaaatttagccatgtcgaattgcaaaaaatagaaagttcttggtgcaactactcacaattgtaactggtttgtttgagctttttaacaaccatggtacatgaggcttcctcacaaccacagaatatgtcatcaaaaataaaaggaaaagggtac

SEQ ID NO: 30247 - DNA, 1265 bp, Oryza sativa
ccgccgtgctcgcctctccaccccctcgcctcctccgccgccgcttcgcctcgccgccgccacctcgcctcccttgccgctgcgctcgcctctccaccccctcgcctcctcctctgccgccgccgccgcctcgcctcgcctcgccgcgctcctgcctctgccgccgccgtctaaaggagaagagagagagagagtgagagatagaagagagagagagaaaccgataggtagggccaacctattttttaataaatatattgctgactggactgccttgtagaccaaaactaccgcggattggataaggagggtaattcgtccggtttacatagtttggggtaaagaatgtctggttttgtagttcaggggggtaattcagactttttccattctaaaagcataatggttttcaacataatatgaccagcttattgcttgagtactatctttactcttttagtattaatatttgatataattcaaaataagctgtataatctagttgaaacgaattccaacatacggctagctagccttatccgatcgccttgacgaagaagatgatcgatgcatgcatgcgcgccggccggcacaagaacagctcgcttttcttgattaaaaacaagctaagctaagagcaggtacaatagcaactattagccagttataaacatattttaattagataaaatatgagagagaagagcagcgggctacagatatgtagtcaactacagcacggattttaagacgcagtatgcgcatgacaggtgggaccatatattaataatatagtaagttgaattggctattagactgactataaatgaatttgagttagtagtgggctgtaatattaaatttgctctaaggcaggtgggtgatggcctcttggtgctagaaacagctgtaacctgttgtttgtgctaagctttgggggtaagcatcattgtttaatttctgacttcctgtaggtgatgattaattagtgcaggtcaaacccttatctgcaagactgcaagctaactagcataggtaggtagctagcgctgtttcttctccttcatggtattgcgcctgtgcgcctgtgtttaagttccatatcaaaacgggaagtttaaaaaaattagaacgatatgataaaaaaattgaaagtttgtgtgtagaaaagttcgatgtgacaaaaaagttaaagttaaaagtttaaagaagaaaaattagaatctaaacagggcctgcatatggatatatcttgtatactgtga

SEQ ID NO: 30248 - DNA, 1501 bp, Oryza sativa
ctattccgttgagatggacggaaacatcttgatcttatatgtagcccatctgctgttgctgatttctcgcgtgtgttaatactagctttacttatgagcaatcatgtcagcatctggtgaaatttgtaaccgccttcgagtgtcaacatatatttttgctcttcactgttttcaggaagactggacataacctccactgtattttctgttgccaaaacattggtatagagttttttgtataaagattcttatgatgctttcacgattaaggaagacacaaataaagtaactttgctctcagatcaagaactgcccatctgtgtttgattgaagcaagttgtatggtttcacattctgtagtaagggacaagagcaagaaattcatgtgttttttctattgtaattgaaaattttgacgggggaagcgctgatatgcatacttcctgtgtgttctaaagcctgtgccttctacatgttgcagctccatttttgccatagtttagtaagcagcagctctgatgagtgataagtggacaattgatcagctctaatgaggctggaacctgaaatgaaatgactgacaaccagtatccagaattggtcctggtctgttctataattggcttttcatgggcctctcctgtacggtcgtattttctctctgctgggctgtaatcttgtgcgagattggccatgcctttgtaagaaatgggccttagtgggccatgtttactgtagctgggccctgtttgtttgtccagtgatggcccacctgtcagtccagtccgtggatacagacgccggaagcggatggacgtgactcccgctcgggcgcccggtggaaggagattaaaatcgggcgtcagcacccgatttactacgtgtaaactcatttttctcttaaattactcatccaaataatgatccgattgcaccattaaattcattgcaattaaatattaaaaaaacaagactatattccgacgaaaaaaatagcttattattaaattatttttaaatattgcacgatgtttcactaggtatataaaaacaagatcgaaagtgtttcactcgtttaaatcgggtgttatttcaccttatataaaaataaatatttcagcaaatagcgaaagaatgtttcagttcactgcaacattagatctatacataatgaaacattatgagtacactaggtgaatattttcggtggaacagaaaataaaccaaattattttaatagagagtttttaaaatatatgggtgatttgttgcaatgaagttgtgtgggtgtgtggaagtggcaggtgggtccgtgaggagagggagacacgtgggtgggccgcagggcgagcgtccgatcctggcgcacccgcgccggtcgaccgagaactagcattctcggaagcggacagcagcagaagcaacaagcagcaaccacttcccggcgggagaggcagctggaagccggagatggtcgccgccgccggagatcgcctggatc

SEQ ID NO: 30249 - DNA, 1501 bp, Oryza sativa
atccgcttccactcgggaagcctagtctatgatgcccgcagacatcccgaatcacacagattcgtttctgaccactcaggtcatccatctgccacataggctgattctggttacgattcccaatccacaacaacttttcacaaagtacaggcaaacaaatctacgcaacgggaaccacctcacacccgcccatgaccgtgggtacggctgttcgaacagttagttaacctctgcagaggggtacactttacccacaagatacgaacttactccagacactggccggtgtcagaggctcgcgacaaagcctttcccaagccgacccagggttacctcatgccacatagaaggatcaaatcctcacataaatataggccattttagttttcacaaatcaaactccaaccacctcgatcggtaattcagcaagcttctcttccttgcttaccaggaacccggtttggctccaaccgaccccgccctggcgttcccaactattggcatgcgaggtttccctgaaccgactagttacttagccagggtgtcccattccaccttgtggttgcactttgattatgctcgatgcgtttcccacaggaatcggtccttatatgcgaatacgggacagtgccacataggcacaacccccgcatcgcgagttttcacaattcattttatttttaaacacaccgacaccacatgtcgggttttcaaggctttacaaacccatttcccaagttttcgataaacaacggtgtatgtgggatatttggtatacgcgctcagagagcacggataccgtggtaccacaaaggtggagcgataaggagtcagggtagtacagcctacaggaattagtgcgactactaggtaggtctgtcggtttggcatgcaaaccgaggccaagcaagttaaacgtgagtgattctaataatgcaagttgcaaacaaaataataatgactttccaattataggagaaattgatcaaagggtgacttgccttgctcaaggtcttcacgaagcttcacgaatctccgagaaaaccacgattgacgaaaatccggtaaccgcaactatacgcaaacaatcgaaaacctacacaagacccaaaagaaagatcctatttagcctaattaatagtgccattaaatagatctcaattttacggaattactggaagtggaacggagtcaatcggatgagcggttgggaatatatggattttcaaagtttattggatttactaatcaaaggaaaaaggatttaataatttattaaaccctttttggaaagaaattggagggatgtgatttagactccctcgggcggcttgggcgtggcccgagaggagaggcgcggctcggccaaactaatgggccggccggcccagagaggcggcccaaggggcgcggggagagtgagggagagagagggccggtgggccgagtccaccttgcggggtcccgagtggggcccgcttgtcggtggcgcggctcatcg

SEQ ID NO: 30250 - DNA, 855 bp, Oryza sativa
tgcccgttctgttgaaaccatgcttggaattcgttgactttgatagtactcatacccttgcaatggtgcaatattcatcatctttctctaaatgaccatcaagatccatagctcatcttatttcctgaagtctttgatgcaactatccaactcaggccgttcttcatttcttggggctgcaattagaggttaaaaaaagactaatggtttttattaaatactaatgtatagtttgattcgggatgatgattggcagtagagtagggggaatttgaattggaagtgattgatatgataagtagtactacaaagtgataaatagtactctcttcttccctaaatataagagattttgattggatgtgacacatcttagtataagaaagttgtccacattcattgtactaggatatgtcacataaccaaaatatcttgtatttagagacggacaaaatatcttgtatttagagacggagggagtgtagtgtaaacattcttctttagatgcactatattatactcagtgcagtaaaaaaattgtatacttgatgtagaattgtggatacaagcatatataaggataaatatacccgagctggcaactgacgagttggcccaggagccacagtagtagtagtacaatacattgcatatgtgactattcctacgtgggcccacttgcaagagaccagtctggctttggcacgcacgggtgattagcttagtgcttaatcaccatgtactttgtgctaatcaaaagggattaaaactagcttcgattaagcacgcgcgtgaggcggggagcaccacgtccacgcggacaccgcgtagagcggcgtgcccttccaccccagc

SEQ ID NO: 30251 - DNA, 470 bp, Oryza sativa
agactgggcctcatttatagggctagctttcttgggccccaagcccccaagtgcatcttccccgtgaggaagattaatgggctcaaatgtagaaagacattttaccttcggaaaaaaatccactttaacttccttaactgttcatcaaatctaattcgtgacccttaactaaaatatcgggtaagaccgaactattgaaaccagtgtaatttgaattctctagcaattttgaagggtggttttgttgtcgtgggggtgttgatctggtcttcatgccacgtgacgcttatatagcattaaaattttaaaaaaatatatgtgagacctactgacatgtggggcccacatatcatcctttattcctccccctctctctctctctcccttctctcacttttctcttccccaccggatcggcggcggcggcgtgcaggcaatcccctccagctccgcgccatctccatgtcgtc

SEQ ID NO: 30252 - DNA, 390 bp, Oryza sativa
gctgttgttttcgtaattgattttatttgaactcttttctaaaaacatctaggtgagtgcttctcaaacgacacggttgagacagtgcgtcccgtccggtcagagtatgtgcaatgtatcaatctttagatcttagaacaaggttggcacccggccaacagtttttcaaacggccacccgggccaacaacttttcaagtggccacccgggcctagctgatcccgtcagctgctgattttccaaacatcgaaccctttttcacaacagtaatttcacaagcagttgtcaaacaaaactacgctaggaatcacctcacatccgcccatgaccgtgggcacggctgttcgaacagtttgttaacctctgcagagggggtacactttacccaca

SEQ ID NO: 30253 - DNA, 729 bp, Oryza sativa
caaaatagatatcggtttgtttaggatagcttcagacagttacatcttctccagaatcaaaagtttctcctaaacaaatcggtttttcgttcagagaagatatagttacagagtccatggaactgattttttttgtatattctcacaatttaaattcccacacgccacttctcaaaatctaaatatccacgaacagacccagcctcgccgcgatccgtgaccgcgagcagcaacaagtggccaccagcccaccactgcccccactgtggcaataccggcgccgtgtttgctcctagcgtacgtgcgtacgcagcgtaccaacgtaacgcactaacgcgcccgtggttgctgcgtgctcgcaagagcaagatgcaaaccgttcagtccaaaagctggtctccttctaaactctaacaagataaagatttttttttcttcggtactcgttagcacgcttctcaaactgttaaaaagtagtgtgcttcgtacgaaaattttctatatataagttgctataaaaaacaaataaatccatttttcaaacttttaataattacgattcaattaattatgtgctaatgacttgtctcgtttttcgtgcgcgattaatccttgtagggtgatgctaatgactaagccgagaagatgatgctgaccatgtccgtcgtcatggatggtggttgagcgaaactttcggcgaggggagaggaggaggagccagcctcatga

SEQ ID NO: 30254 - DNA, 1501 bp, Oryza sativa
ctcagcaagccaggggaaataagtgtttaatgcaggcttcaagggaaggctgttgttttcgtaattgattttatttgaactcttttctaaaaacatctaggtgagtgcttctcaaacgacacggttgagacagtgcgtcccgtccggtcagagtatgtgcaatgtatcaatctttagatcttagaacaaggttggcacccggccaacagtttttcaaacggccacccgggccaacaacttttcaagtggccacccgggcctagctgatcccgtcagctgctgattttccaaacatcgatccccttttcacaacagcaatttcacaaggcagtagtcaaacaaaactacgctaggaatcacctcacatccgcccatgaccgtgggcacggctgttcaaacagtttattaacctctgcagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacacgttaggtcccagaccatactgtgccaggaagcccaggggtcctccccgacaccaccctagcgaatccacatgtctctcggcatcaaggctcccctgataagctagttactcagccaggggtgtcccattccatccatgtggtcgtacttgacttatgatcggatgaaattccaaggaaacggtccttaagtgcaagagcgggaaaccgtacccccggtacgttccccggtccgcggttttagaaattcatttagttcgcaagcaccgacccaggtgtcgggttttccaagtcttttgtaaaacccaagttttacccaagttgtttctcagattttaagtttgaaggcgaccgtcgatactcgcacagagtgcacgaatatcgaggcgcaactgggtggttacaaggggacatggtataacaattaacaaaggaaggatcaaatgcaacaaattaggcaggtccgccaatctgccttgcagacggaacaacagattaagtgtgatcctatcaatgcataatattttgcaagcaatataattaaatttcaagtataggctcaagatgttcaaaggtggcttgccttgctcgagatccagagcttgatcctcgaaatcctcgcactgcgggtcttcgggctccgaaactacacgcgaaacgggacaactcaacaaacggcgaaaataaagccctattaatgacctctaagcgtgccattagatagatctcgagatttggggaattttggaagttgaacggagtcaaacggatttacggtggggaagatattgaatttctaagattattggatttttggtctaaaggaaaaggatttaattaaatcctttttggaaaagaaaagaaaagaaaaagggagagggagggaatatagacttccctcgggcggttagggcgcggcccgagaga

SEQ ID NO: 30255 - DNA, 1501 bp, Oryza sativa; identical to SEQ ID NO: 25142

SEQ ID NO: 30256 - DNA, 1501 bp, Oryza sativa
ggaggatgaggaaggagcctgacgaccatgaggagactcttgccggactccaccaggtagcgaacagcgaagcatccgccgtaatctcgcccgcctcgcgagaatcggcgaacctccatgggcggtatcaccagattaccgtcgtcgtcttcgtggaagtccggtaccgaaaaaacatggaggttttcttctcttgtgaggaagtggaaggctttcttgtggtgtacgacatcctccagagcatggccggtgaagaactcagcaggatcatgagtcgcctcctccacacctcgatgcctcaggatcccgaatgcatggattcgtggattgttcatcatgcaggaatggctgatggcggcggcgacgcagcgttcgtcgcccggtggcgaagagagggtcgcggccaccatgtccgtgcccgtgtcggggaagtggaatcgcgtgccgttgcggaggctgagtagcgcgtagtccaggatttggccgaaggcgacgaagacccagccaccgtcgtaggcgccgaagtagcgcgcggcgagtgcgtcggccgggagcgggtggccgaaggcgtgggtggcgcagcctgcgagagcgcacgcgaagcaatgcccgtcgtcggcgcgcgggacgagtatcgacgggagcggcctcgtccccggcggcggctgcggctgcggcgcgacggcgacgcgccagtcgtggcagactcgggccatgcggcgccggtcgacgaggcacgggaggcgcttgtggacgaggcgggggacgtcgccgacgaggtcgcgccacagcgcgtccatctgagaggcggaggcgcggcttgccgatggcgaggaggcgatgcgctgtgtgtgcgcgcggcgggaatggtttggaatggttcctctgcttctcgaaacggaaggagatggtggaatggtttggaagaagtgggtgggccactgtgagatcggactcggcctcatttgtagggccagctttcttggggcccaaaagtagcttcctctggaggcagattaatgggctgtactgtagaaagtctactttttcatgaccacattctgcatctagctatccccatgcaactgatcacaaaacaactagtatgtcaggagaacaaagacaaggcatcagcatgttgactggttagctgacaccgatgcaccgtgttatgtcagtatgattgaattagttatgaaactaatttgtgtcatacactgaggattctaattggatcccgataagagaagcgactgaaaccagtctcaagaagcaatccatcgatcttcactgcaaattccgtttgatgcaactgatcaaagaactcttctatgatgaggaaaacgcattactaacaacacaatatgatggtgcactaatgcaatccaagtcatgaacaccagccattctgcattgggtacacacatggatctcagatgaaacattattcctgtgtggcgtggataacattttctcttaactcgtggcccaagccaattgg

SEQ ID NO: 30257 - DNA, 188 bp, Oryza sativa
tgaacggagtcaaacggatttacggttgggaagatattgaatttctaagattattggatttttggtctaaaggaaaaaggatttaattaaacccttttggaaagaaaaggaagagggaggggaagtagacttccctcgggcggctagggcgcggcccgagagaaaaggggcggctcggccgagctaaa

SEQ ID NO: 30258 - DNA, 1501 bp, Oryza sativa
catgtctagtgttttgtgtagcacttttttaacgaaccggcacttttgagtagcattgaaaggaaacatattgaatgatgttgaaataagaaactatgcgaagtaaaatatagaaaagactcctaactaaatacaaagtaattatattgagaggagaaagtaattttctttatttggaagtaatcactataaatattttgtaaagagtaatttagcgtcatatagaaaataactctttaggtattcaaagtaattacacacttggaagaaaataatctttttataaaaagaatagaagtaactttttatggtgttagatgtaagtacacttctagagggaagtaaaactgataagatagaagtactttttatgggattagaaaaaactttgaagaaatagaagtagcttttaacattactagagtaactatattgctagaaaaaaaagcaagtctggagaaatagaagttactcttcacggtattagaagtaactcagtgctagaggaaagtaactctaaaaacaaaataaaagcaaatatttaccccacgttactagaaataactatattgctgtaagaaagtaacttttcatggtatctaaagtaactacactgctataagagctaagaacaagaatacaattttaaaataatttaaatatattaaatattggacttgttttatcacatattttgagcggagtacaataggtcaaacggatgttaaaaataatatatctctatctctactattataaaaattgaagatgtttttaccggtattttggtaagtcatccgtatttgaatcggttattaagttcgttctattttggaaatacatatccatgtttgagtcggattttaagtctgtttgctttagaaaatacaaaagaagtcatataaaaaatttctttaaaaaaacttgtatggtcacttgagagtaaagttggactcctaattataactcatgattttctaaaaaaatattcaagcgaattcacacagtgaatttcatcccatgtaaatcgtataacaataataggattaaaataacattcacctgttgcaatgttgcaacgcacatgcattttttctagtaatttaaaagatataagtggagaagaacagcaaattaatagttatgaacttaatatgtagcatccgcttaaatggatcctgagaattgaagcaactgaaaccaatctcaagaagcaattcatcgatcttcactgcaaatcggttttgatgcaatgcaatgcattcttttaacagaaaaaacgctaagtaatgttgagtaaacacatcgcagaaaatgcattactaactacaacacgacgatgatccactaagcatgtgtttggtttcgggactagatgggatgggatgaaaccattcatccctaattttggggttgggatgattccactcacatgtttggtttgtaggatgggacaatcccaatttttttgtttggttgaagggatgagggagaaatggga

SEQ ID NO: 30259 - DNA, 1501 bp, Oryza sativa; identical to SEQ ID NO: 25127

SEQ ID NO: 30260 - DNA, 444 bp, Oryza sativa
cgggagtactcagcaagccatgggaaataagtgtttaatgcaggcttcaaggaaagactgttgtttttgcaattgattttatttgaactcttttctgaaaacaactaagtgagtgcttctcaaacgacacggatgagacagtgcgtctcgtccggtcggagtatgtgtaatgtatcagtctttagaattgttcaagattggcacccggccaacaactttcaaacggccacccgggccaacaactttcaaacggccacccgggcctagctgatcccatcagctgcagatttttccaaacatcgatccccttttcacaacagcaatttcacaaggcagtagtcaaacaaaactacgctaggaatcacctcacatccgcccatgaccgtgggcacggctgttcaaacagtttattaacctctgcagagggggtacactttacccaca

SEQ ID NO: 30261 - DNA, 1501 bp, Oryza sativa
gaaatcatagaaaaaaaatcgagcggagagttcaaagcgaggtgagatcgagaagattaccggaagagagactgttttttttttctccttttttttcgttgctatatttttctctggatgccggatgatatgaagccgcttggcttggagaggaggaaggtcgatataaatagagcgagtgcgattctcttctggtatttttgcagattagcccacaagattagctcgatggcaaatacgcccttccgagaaaaaaaaagcccttaattaccatgtttaactgctgctccgtacgaaattgactagagaatgagaaaacagctttgaactctgtgccttaattttacttttgaaattagaaatgtggtacgagttgtataaagagttcgtggaaatattattatgcgatgcgcaaagacgacttgatctcttgctatgcatgatcgacatatttagttaattaatgcttataattactaaattcaatgtttgacgcaattataaaaccagcttatctggcctcatgctttagatcggagatgatgtatttaccggttcataaaatataaggtgcattaggtttttacacgttattttaatgttgagttttgaatctctcattgacaactatgaaattaacatagcaagaattactttcaatgcaatattagcttaaatttttagaaaatacttctaaatattgacttatcctgttatccttaaattcgtgtctcgtacgcattgcctccttggcggcagcaccgctacagacctacagttaccgagtcccctgtgtcagttgaacccgacgaaattcctaaatacgctacgtaaaatgaaataatggataagcacatgattaattaagattatatttgacatagcttcgaatcgaaaatactttagagctggatatttttaactccatgaatctatggatctgaatttacgattacattgataatacatgtatgaatctattttttattttaaataaaatatgagaatttatatcactacagtttaatatacaaacttcaaatccatcgtgaaatgtcaaatagtatctaagtattagctttaaaaatttaaaaatgaattaatactttttaagataatttttctatagatttcttggtaatcgtgtacgaacgaactaagcaaatttggtttaccgtgcgtccgtgccatgcaatgaagcatcatccgtccaaggcgtgcaaatcacaggccaggattagggtccattcggccattcccccaaaccaaattaggcctactccatcctgatgaaattggtcgcctcaattccgccttacaacattttggcccacagatatttttccctcacgcgaggcgctcaacggagagaacttgtggcccaagacaaatggcccaatataaaaggcctaatctcatcgcttggtggcccaagccacccacctctgctatcttccaaaccaaactttcctccttccgcttccaaatcaatccccacagc

SEQ ID NO: 30262 - DNA, 1501 bp, Oryza sativa
ggacgagccggaggacgtcggcgttgaggtcgcaccatagcgcgtccattggagaggccgaaggcggaggcggaggtgcggcttgccggtggcgaggaggcgaaggtgcgctgctgcgctgtggggattgatttggaagcggaaggaggaaagtttggtttggaagatagcagaggtgggtggcttgggccaccaagcgatgagattaggccttttatattgggccatttgtcttgggccacaagttctctccgttgagcgcctcgcgtgagggaaaaatatctgtgggccaaaatgttgtaaggcggaattgaggcgaccaatttcatcaggatggagtaggcctaatttggtttgggggaatggccgaatggaccctaatcctggcctgtgatttgcacgccttggacggatgatgcttcattgcatggcacggacgcacggtaaaccaaatttgcttagttcgttcgtacacgattaccaagaaatctatagaaaaattatcttaaaaagtattaattcatttttaaatttttaaagctaatacttagatactatttgacatttcacgatggatttgaagtttgtatattaaactgtagtgatataaattctcatattttatttaaaataaaaaatagattcatacatgtattatcaatgtaatcgtaaattcagatccatagattcatggagttaaaaatatccagctctaaagtattttcgattcgaagctatgtcaaatataatcttaattaatcatgtgcttatccattatttcattttacgtagcgtatttaggaatttcgtcgggttcaactgacacaggggactcggtaactgtaggtctgtagcggtgctgccgccaaggaggcaatgcgtacgagacacgaatttaaggataacaggataagtcaatatttagaagtattttctaaaaatttaagctaatattgcattgaaagtaattcttgctatgttaatttcatagttgtcaatgagagattcaaaactcaacattaaaataacgtgtaaaaacctaatgcaccttatattttatgaaccggtaaatacatcatctccgatctaaagcatgaggccagataagctggttttataattgcgtcaaacattgaatttagtaattataagcattaattaactaaatatgtcgatcatgcatagcaagagatcaagtcgtctttgcgcatcgcataataatatttccacgaactctttatacaactcgtaccacatttctaatttcaaaagtaaaattaaggcacagagttcaaagctgttttctcattctctagtcaatttcgtacggagcagcagttaaacatggtaattaagggctttttttttctcggaagggcgtatttgccatcgagctaatcttgtgggctaatctgcaaaaataccagaagagaatcgcactcgctctatttatatcgaccttcctcctctccaagccaagcggcttcatatcatccggcat

SEQ ID NO: 30263 - DNA, 325 bp, Oryza sativa
ctttacatttctttgcggtcttaagccgctgctcgctgtatggtcgatgcgactagcgctcccatgtagcaacggccttaagccggagctccttagtcgattgatgcgaatagcgctcccggtagacaccggccttcagctggttagtagcagagtagacaggctagaagatagtgaaattgcttctacatggtcatgtttggtttgtagttgtaggtcatggaagaaaatatgtagccctctatctgcttatgaactaattcatttggaaaacactatgggatcgatccttttggaaaaaattatgtgttatacttcgcccaaa

SEQ ID NO: 30264 - DNA, 165 bp, Oryza sativa
atttcctgggactggtatcggttaacaggttaatttggagcgtcacgggctagttccgctcgggactagttcggggcgtgacaagcagccagtcgacgctctcgtgagtctccccgaccctctgatccagatcctatgctccttacctctcctccccttctcaga

SEQ ID NO: 30265 - DNA, 959 bp, Oryza sativa
aaaccaccgtatcctgttttccttggtaataaacacggtaaaacgcagcacagtagagtaattctacggtccttgaggatgtactaaaaatttagtgtaaaatttggtacctcatgatacctcataatacctaggtatcaagagataccaaatttacagtataaaaaatagtacctcatggtacctcctcaagaaccgtaaaattgctctatccaaaagagtaattctacggtccttgaggaggtaccaaacatttagtgtaaaatttggtacctcctttccctatagggattgaggctcctgttctatcactctgaatttatgggcaaaacctcaacaatatgacgaacagatctgcattccatccttaccacctttgtacgtattatgtaggagtatgtgtgtcaagaggtgaacggtgtaccataatgttttaccagcattccatccttaccacctttgtattatgtaggagtatgtgtcaagaggtgaacaatctaccgtaatgttttaccagaatggtaaaagcataagcatgaatgaatgctcacgcttctcgtatggaacaaaattcagctgactgctttgttattttcaatcataccacgagtctcttactgcctgccaggtgaaccactcgctggtctttctaaccaactaactgggctctgtaataatctttgctcagtggtgtgtcggtgcctgtttggatatatattgattatactgttaatttggtatcttttggtaactaggtagaacaaaaccatttttaatggattctacacatttttcttgatttactgagacttgagtgggattaaacggagctcggatgaattagttatgaattttagaagattcactgtgtttattactataacaaaaatccttaaataatttatggcgcaatattaaccagggctgacgtcagcacgggggggagtgcggcgccgaca

SEQ ID NO: 30266 - DNA, 779 bp, Oryza sativa
aaatgagcaacaatgagtcaagcgcagacacaggaaatcccctgcaaaggtaaaattataggcgaagaatacaattacctatgaaggtcctgtatttaataacaatttatttcaaccgcaacaattatgaactgattttcagatccaagtttaacagttcaagcgtatgtatttaataacaattaatttccgaataggcacaatacatcagaatcagtcaaaaaaagtagttatctccctgttttgacatccaattttcacagctcgaacttcactgctgaagtaaactcaacggaactcgcacgcttatcaagactgaacaggaaaaggaaacttgaccttagaagaagcggatctacattgaacaacagttcgacctgttcaaatccagcaaatcacattgaaaggtaaacatacagaaaatcaacaaaattgttagaaaggaaatttttccttatttaagaataaacactgactgtgatatgaataaaatcaggtctagaaaagaaaaatatcagatcccatcaaccaacatggaaacgaataggtatgttaaccacattataaaaatgatatcgtcattcagtttatttttaaatcactttttttttatgaaaaaaaatatttgtcttccagtctcaagatgaatgatcgagtaagtaaggaaggaaacattacaaggaataaggttgctgtaccaccaaggaagaagaaaaaatcaagcgtgaaagaatggaattttggcaagcctacatgcacatgtcaacactgtggtgcac

SEQ ID NO: 30267 - DNA, 325 bp, Oryza sativa
atacaaaagtaatcctcaaaagttgtgttcactgttcgagctcgtttctaaggataggcgggaaaacacttctttccggcctatccccgatcttgttcgtgacctaaggtcacaacagtggcgccgtccgtggggacggaaagtctccattgaattgggctcaaacagtaaatgcgacgttctcaacgacagaagactgtgccagtacgctatacaggagcttttgcaagcgcgacagctgcactcgagagagagtgggaaaaggcagtggaagaaagtgacttggtaagagcaacggaaacacttgacaagcagtgggcagaga

SEQ ID NO: 30268 - DNA, 1501 bp, Oryza sativa
taacgccggttccaagctttcttccagttcttctctcctcaattagacaattctctcggtcaatagtaattcgacaatccatatgatcaaccaacgagcttacggatactaggttaacaggaaaagagggagcatataaaactgacgacaatgtaattgatggagtacatttgactgttcccactcccctcacatgtcgtaaagttccgtcggcagtttgaattgtttctttaaatgatgactgaaatggagtatatgatgtaaactcactcgacattcctgtaacatgtctagatgctccggagtctaatatccaagttgagttaggtacctgcataggatgtgcgagattaacaaagttgccaagcactgttgttttctccttcactttctgaattcttccccttatttcttcaacttcttcagccaatttctcaagtatttgctcaattccttgaatttcccccatggcagatcaaccaaatcttctaggatactagccaaatcaattaataggagtaacaacactactcctcagtttctcaccaaaaacagaacagcagcagtagcactacttcctcccagcagcactacttttcagtttcccccaaatcagcacaacagcagcagcaagccaagctctcgtactcagtttcttccccaaatcagaacaacagcaacagcaaaccaagcttccgcttcacctccaaatcctcaccttctcaagtagcagcagcaccagcaacagcaccaccaaagtcaccaccactggaacggacaacaatagccaatagcaccaaatccttctctgttgatcctacagccaacagctgcgcgtctctcagccgctgtgctccctacagcttgtgctgcaccaaatccttgcgcagctcaaccagcgagcgtgcgccctgctcctccttcacgctgctcgcgtcgagaacctctgcagcagccgtcgccgcctccgccgtcaacactgccgctccgcctccgctgtccgacgtcgccgctccgcctcagccgtcgacgtcgccgcagaacccctctggtcacagcgccgccgccgactagggttcgcgtcggcgaggtcgccggtgacccagctctgataccatgtagttttgtgatttttcctctagaagcttcacttcatttcctttctcatctactatacatatacattggtggaatgggccctattgggctgaaatacacacgcctacactcaacagttaaagatggaaaatgtaacagaaaaaggttttggagttaccaaggtgccaattgatcattatttcttgtgatacatttcacttgtcccatggcatctagttccagcaggggtgacatttgcaatattatactgatgttctaggtgttcacaatagagctcaaatggcacagcatattccaactcttaaataactttgtgtatgtggtgtgctagtgcagaatgatatccgtaaaaatccactatttagacaacagttccatgaga

SEQ ID NO: 30269 - DNA, 691 bp, Oryza sativa
gatatgggattatgtgtataattgtttactgtcaaaggagacctagggtctcatttcagaggaaccatgttctaacctcgagttaataaccaacctgctgatggaaaagaaaatcaagcgagtaaccaaagagacatttgtttggactaagagtttcagatgtgtctttttcggatcaaaggcaacgatagttagtatagcttttggcgaaacacttcaaggtttcactgaaaggcagcaagccaaaggacctcatcgtccccagaagcatccacaacccacattaaagagtaccacctgttagagataggccgaaagatgattgataaaagagattggcaaagatgttctctagcaggaaagaagtaggccgaaaggtgattgataaaggataaacagaaacatgctctgcatcgctcaaggaatacccctgatagtaattgccccgcaacagtcaccttgtcattgaggtaaaaaaaaatcatcatgagtaagcaagatgacctaggtaaaagtgttttcatgaaggcaaggagtgaaatattcaactcggtatcagatgctacacggagtgaaaagtgcaggcaccagttaccaggcaatgccatgtcttgggagatgatccaatgggaaggaactcatcaaggtcgaaggtgtaaaggaatacgttgaatgctaaatgatgacaaca

SEQ ID NO: 30270 - DNA, 1501 bp, Oryza sativa
ccggtcccatgcgagagagggctcgaggaggccgggaatggtggcgacgtgggcggttttcggcggccatggcggcaacggcagttgccggcctgaggttggggatgacaggtgggcccatgggtcccacctgtcggccaaagaggagagggaggccggctggggacgcaaagtagacttcggggaggagagggccgagcggcgagctgggccgagggagagagagagcccgagaggaggagggggattgggccggggcggcccaaaaacaaagacggggaaaaaaaattatttgttttctttttattttaattgatgcaatgatctttgtgctattaaaactatctcttgagctccgaaaattcactagaaatttcagagagtattttagggcacaaagaatattgcgaaatattcccggccaaagatttttttaaaggaaatttttaatttcctctataatttcacttgattaaattgatttaacttttaatataatttctagaaatgcattattaattgatttttattcccgaacgaaaatcggggcgttacataaaacccctatgaaacccttgttggcagtcaaaaggcaagctagggattatggttataaacacgacttagtagatcaaacttaactgatgctacactaagtatgaaaagaaacacaatatctaggcaatcaagccgttgactggtttttaaggtggtaaatgccttagctaatctaatctaatatagttaaacaatttagccaataccggcagaaaccctaaagcgagagacaaccgatagggctaaattgagatactaagactagattaactaagacatatgataaataggcaggcaaatatatcatccaaaccagagcaatccaagagattgaatgtgctgatgcagccttgaacgacgccgacgtagatgatacaattgtccggggcggtggaacattggacttaccccttcgccggagatcggaaagcgatgcagcgccgcgtcaggtgccaagtcccgccggacgatgaaatagagtagaaaagataaaaggtggtgatgcgctgaattgtattgatcgtggagataaaatacaatggccctggtgtacatatttatacccatggggagatactagtccttgtaatccttgtagaacaagaaagaagctttcctaaagataaaaggaaaacataaagtccttataggatactaaacacactaaactaataaactattcctaattaatagataacttaccataccgcatcctacttgaactcggtcacttctggataagcttcctttaatagattaatttccttaaccgaatatagcaggaatccgactattggtgatgtgataattctcttaggggaataccaaatttcactgttaacatcagcgcaaaagatactaagggcccatttgaatcgtaagaatgaaaaaaactggggaatagaataaacatatgattctaataggaatgtaagtgtaaagc

SEQ ID NO: 30271 - DNA, 1501 bp, Oryza sativa
ctatttctctaattttaaacccatatttaccacataattatttttattactattatttttaaaaaaaaattggttagaaatatagtgactaaatgcataggttagtcttataaagtacatcaataatttaatatttctatatatattgtaataaaatataatgataaaatttatcttttctagatcgtgcatttatctaaaatgataagtttaaacgatattatcaaccgtgagtactagatgcgataagtcgtattagtacaaatctgcataattattatgttgccatattttggagccggaagaaatactgaaatcttcagtttagatatttttcgtcagatcggaaacatcactctcgggccgtgggccatccccatggggtgggacccaaaagcttcatccttatccgttaacgatgagtcatcattgaagatgtgctttcggtctgctcaccgtcggtgcagctaaccacattgacagtgattaacaaacttccaaaggacagtggccactccacacttccacagtagtagccccatcattagtctctttctatgggtaataagagcaggtataatagcaggctattagccaactataaccatattttgatgagataaacgatgagagagaagagtagcgggctacagatttgtagccagctgcagcacgaacttcaagacacactgtgtatatgataggtgggaccatatattaatagtatagcaagcaactattatatgaattggctataaatgaattggagctagtagtggactgtactactagacttgctctaagccaacacactggtatatacagcattctgaaagcagtgttatctatttcccccatctaaattggaaatcaatatatacacctaaatgtataaaaaaattacatcatctatcctaaaacataataatttttaacatttagaatttatcttaaaatataacaatttctccaccaaattttttttccagccaatcataattatcatcatccaccattcaatttgcccatctatctagttacattcacttctagctcaaccacaaccattttacatttaacatttagttctatttactttttaataactatattcaaccgtaaaatattttatatttatattttaggacgaagataatacataatagcatctttatagttatcgtgtgatcataattagtacatgaagagaagattacaaatatggttatacttgaaacgtgaaaggttattttttttaaaaaaaagataaatttagcctccacatccaatccgatgcatacggccaaaatcgtgtggaaggtactgggtgtgattgttgcggtaagacgaccagccggtgcggtgacgcctggtcatatccactcaatgatttaaggaggggcacacacactcagctcaattacttgggaggcagtgagttgttgtaaagttgcaagagagagatcagttgttgagtgcgtggaagcagagatcaggaaga

SEQ ID NO: 30272 - DNA, 330 bp, Oryza sativa
atattcgatgtgatatttttgagaaaagtttttaggaaactaaacaagccttaactacacggacattaaaagaaaatcaggtgtgctaacaacatgacatgtcaatgttagtaagagttattaaaataagattagtacatatagcattttcctaattgtgaagtaactaccaaaataggaaatgcttcacgtaacaattatgttttacataataggagtagatctctatctccattggcatttcttattgtttttacagggttggtggtcgggtgatagtgccatactatcatgcgagttcatctagtttttgacttggcacctccaaga

SEQ ID NO: 30273 - DNA, 154 bp, Oryza sativa
tgatatttggcacgccccttcgtcttcctcgctcatccccaactgctctttgcttccggcgatttagggttttgctctcagggtaaatccaacaaaatagccccttgattctccgctcctccagccattctccgtcttcctcctctgccatgtc

SEQ ID NO: 30274 - DNA, 1501 bp, Oryza sativa
tatatgaagtcgcatgaccaattgaatatcatattgatcgtactaagcacattggctacaccaaggaatcctaacagtgaaataaccatgttgtggccttagcaatatataagttaattccatataggaattaaaaaatgtccatttaaacttgctacggtacatcatgaattcctaacatttagcatagaacaatctagaaatgtgtatttgttacatgacacttcagttaagtggtaatttgctaaaaaaaactatgacctctattttaaattttcttacttaattggaaagagataacttagaatggatacctttaccccatgtcgtgctatgggatcaacccacatattttcatcccgaattacagtgatcaaagcatttcaaggatgcttcatagagtggaattctcccaaaaaagagatgaaaggaaatgtaaattgaacaaaaaattattaattctaaatagaaacattcaaacattttagtaagactaataaaatgagtatatctaaaagaattaaacattcgtaataaaaactaaatcagcattaaataaggtgctcgcgcatgtgcgcgggcgaccttcctagttttctaactaattggcctatcacgtttgagagctcagagtcacatgatgcagcaagcgttgggattttcatcgctgaacatatgccggagcctgacgtcagcgctgtcgtcggagtagtacgacggcgagtagtggcggccgccggcgcagtgacagtggccatgggtgcagtggcaataatgcaagtggtatccgtaacaccgcggcggcggcagccgcgacagatggtagtgcatgtatgccgccgtggccgccggcacaccgatggtggtggtggtggtggtgacctcgccggcgtccgtctcagccttgccgtcttgctcgccgccgaagcagataagctcgccattcttctcagccgcgccgccggccgccatcttgtcctcgccgtcatcctgatcatgatcgtgactgcacttcaccggcgggggcggcgcgacgacctcgacggtgttccgttcaccggcggcggcggcggcgttgagcttgtgatcaatggtggagacgagggcgaggctggagaggctgaggtcgaggagacaccggtcgatctctgagttcaccttgtcgaactgctcggcttgccacccgccggcgacgaggctgtagatgcggctggtggactggcaggaggtgacgagcagcagcgcgcggcggagcgccctctccagcctgcccaccagcctcctcgtggccaccgccgccgtcgacggcgaggaggtgtctacccccttgaggaggtcgccgatgtcggccacgcgctcggcgagcttctcgcagctcttcttgctccggctcgccgccttgaccgcgccgtcgatgtcgttcgccagcttgacgatggtggtcacgccgctcaccaggctaagggtctccattgatcaaaacaaacttaatttctatctt

SEQ ID NO: 30275 - DNA, 185 bp, Oryza sativa
ccacacacgctactctctctttattgccacgcccgcgcacgctgtttctgccgttgcacctcggatgggacacatgcctcgaccccccgccgctacgagttccgaggaggagatcaagaaggaggtggcggccgtggacgtcgtcgtcgccgcaccggacgacgatgtggccgccgatcgggagg

SEQ ID NO: 30276 - DNA, 209 bp, Oryza sativa
tgattatcagcaagtcgtggactgcgggtaaagcgtacatctgctgcagtagaatatctttgaaactattcgaatagccgtactcatggaattgagtaccgggactcatatggtaccctggttagaaatttaaagtctacatttttataaattcttgctataacacttccagattgtttattactgcttttatacctccctagtcagaa

SEQ ID NO: 30277 - DNA, 1501 bp, Oryza sativa
ataaatagatatgattgattaaactataaatgatttagattgatttactgatagtagagactagagagaacttgaaagcgtcgaaagcgcaagcacgaatttttactctagtatctaaatcacattaacctttttactcatttctaaacgtggcataaaatgtcagtagttcacattgcggcgtaaagcccctttcacccttttccccgtgaaaaataaaaaggaactgcatggcgatcttctggggcccaaccatggggaccgccggcgacgcgactgtcggtcataaaaggaggaatatatcccaaggagtaataatgctagagatcatcagttcatcacaatcacataaggataaactactactgtcatggcaggctaacacattatacctggtaatttcaggacataattctagagaagatgggtcgtgattgctgaaatattccagagagattgaaggatcccatcgcaattcacaattcacgggtacggttgaaacacttgaaacgtttctttcttgagctgtagatggacttcaagaacaggttcccggagtgatttgatcgatgctggcaaattaacaaatgtgtgattctttaagagtaagagagatttcaaatagccatttgtaaactttgtttcttctccgagaagaattctttgttagtttttgaaaacttcgcgagaataaatcttgcaagcaaggaagtagacttcttgcaaaaccagcatcattcatcttagcgtaatgaactttacaagatccgaagcttgtaaagtggagatgatgttctcccttttctgtgccatattcacatataatttgacgctgtagagatttgtgctccttttatttcttggaacagatgctcctttcagacatgcaaatctcaaaacaagtacacgtgattcatccgctaaggttttcaattccaggacattgcttttaatggatgttaatgcatttttcttttgtgggggacgtgtttgcagttcattttttaaaactacaaaaataaaaagacgctatctgcagactgatggaaaccatgtgcgccatctgtggtttgcagctgaaaagatgatacggtaccaatctcaccagcctctttggaaacacattggcaaacgcaccctaatgatggatctaactgccatcatgttgctaactgctcatggactgcagctttaacaaatcgcagagtcaaggaactgaaagcacaactgtagttgccatcgttacgaatagctcctttattttacgaaatgtggataatttgttatatatttgtctaaaacatactccctccttaaaaaacttcttgtgacgatgttaacataagcctataactagatacataactagaagttaatttttacgcaccgagaaagtattattattgttgaaaatatagtcatatatcgtcatattttaatccaaaatattaagacaataatcatgacatgaacaatgtggggtgatctagtgataaaataa

SEQ ID NO: 30278 - DNA, 1101 bp, Oryza sativa
atgtgctaaaaagtcaacggcgtcaaacatttcgaaacggagggagtatatgatcgattgatcgatcgatgcagctgtggatgagcaaaacgagtacgtactagtcgtcggggtcgtcggcaacgactgcgtcccgctcgcctcgccgtcaccatctaaatatccaggttcagtgatgggattcagaaattgctaaaaaaacagtctaaggtaaagattaactaatgaggtgttaaatttgtacgaaatttacatagtaatttaattttttaaaaaaacattatttacaaatggaacactccagccggccagagtccagatcttaacactcccttcgtttctaaatatttgacgctgttgattttttaaaatatatttaacaccattcgtcttattaaaaaaactctcaaaaactaaactaaactcttaaactcttaaaaactctcagaaactcttaaaactaccagctgacaactatcagctaatcccagctctatgtgtcctcgagcttcttgtcctagacttcagctgctctgctaacatgatccaacagtcctacctcctcagcgtgtcctaatatcttccgctgcaaaaggtgagaaacaatttgaaaagggagcattagtggtgagtaaaccaatttagatctaaagatcatattattcctagtagtccagaggacccaacatacagcttcccctctcatattcagggatggccggaaaggcacatctgcggggtttctggcatctggaaattgctcaaccgtctatcactctgagacaagaaatgggcacacatcagccacatttgagatttggcacacctcaacttttttgtaaagcaggcaatcatagtgaaagcagcaggccaaccactcccatatactacctccgttttttaatagatgacgctgttgatttttttctcacatgtttgaccattcgtcttaatcaaaaaatttacgcaattataatttattttgttatgagtcgttttatcactcatagtacttttaagtgtgatttatatcttatacatttacataaaatttttgaataagacgaatggttaaacatgtgagaaaaagtcaacagcgtc

SEQ ID NO: 30279 - DNA, 1501 bp, Oryza sativa
aagtgtgattataatataagtgtaggtaatttaaagcgatttgacttttcttttaaagctactgtcttttatgaaggaaaagttaacacttgcagagtttttcttataaaacttttagaaacgctaacgtgatatgctctgagtaaatctagaattttttaactacttatatagttacatcaaagtttcaaacggttaaaaagatttgtttggagtatgtataggtttttaggttttttttttttttgctagggcttgtttttgttaatcccctacaagaaagtgattaagtgattggaaagatgtaggtgtggaactaaccaaataaagcttaaattaaaggtctatctatgtgacaactccaattccaaaccctaatctgtaggtcaccagtcagaattggggggtgtcattggtgtcgaaaaatagggagaactcgctggagtcaggggagaagaagcccaagcacaaatcttggcgcggttccaatgatccaacatctctaaaattttatccccaaatttctgccacgtagcattcccgtttaattaatccattactggtatccctcgcaaagtgatgtgcaattaggcattactgagaacaaagggatgaaaataggttcatagagaggagaggagagggtaaggttggttgggaatggacgatcatgatatgatgcctcatctcatcacctccctccggccggcctctttatgctcttccttagcttagctttcaccggcgatcgacttggatggccggattattaataaagaaatgcgtgtagtgggggcgaataagggtaaggctaaggccgtagtagagacgccgatgggatgagatgagggctggccggcccggggtgacccgcatgtcgttttcggaggataagctcggctagtcgggcgcttgcatcatggggttcggcgagattccggatgcatccgttgcaaattgccatgttgtagtaaacaaaacgccatttttgtgacgccccggtgatgttagcgctttcgtgtgcatcctaactgaaacagctcaggaggtgagctgggaatttggatgccaacgaacgatgaactcatctctgaggctccggctcctccaatcaattgtgtgcagtttacgcctgatgcacggtggatggcggccggatcattttgttgcaggagtgaaaaaaaactgaactgctctgaatatctgaacagctgatagcctgagagaagagccgggagaggtatgaattagtagggcatctatttttcgcagccatgaatactttacaagctcatcaaagtttaattctttttcaaagatgaatgaaaacttaacctttctatgtggattaacacagctcagtatctgatggtaagcaattgcaggctagcatagtagcatcggagacataataatcacaatcagaaggcatgacaactgattaggcaactcgagagtacacaactacacacatatagatcagacaagcacgtgagaaagg

SEQ ID NO: 30280 - DNA, 315 bp, Oryza sativa
aagtacactgaacataaagaaagtgaatccaagttgtttgttcgtggtagctattcccagttatgaaccaagtgatatgttcgaagatagtctacagaggtcagattaaaaacacatctaacaacgaagctttagatttggcaggatcacgatcagaccataacaagtctagcagtaaagtcatttggggagacgtcaaagcatgtcaagtgggataagttggttctgttgagaaacatagttcaaaggcaaagttaccgacccttgcatcgaatagcagaagtaactagcacccggagacctggaaagctaata

SEQ ID NO: 30281 - DNA, 1501 bp, Oryza sativa
actgccgcgccacatgtatatatattttaactatcaacatacatatataatagccactttgccatttctagacaaacttaacagtaatatagcatgtaaatcggtgcaatagagaatagaaagtttatattaacaatgcagagagaatccctcagctgcctgcaggttgaatagctgtagtactggaaagaggcatagtattgtggaaaagtaacgtaatccgtatgctgctaatgcagtacagtatatacttatcttcgaagaaagatgctgcaatcagctttcggccgtggagatcgagaggaaggggagagccattggcagccaggcaccaatcagtaaacccataatagtgcatgatctagtggtctctataattgcgtacttgtaagagtttgcatacttgcatgctagctactcctatcccagtaaccctgtcgagttataaaagaacaaatggaccgggggacaccataaagcaacaggcatcgcgcacggcaacgatgggatgtgcaacagctttcgatttcacgtggcccaaaaggttcccttcttttcctcgagtcattttatagcaaagaacggcaggagattggtcgctagctagcttagcttaccttgcttgctcgagtgaatcgccaaccaataatctctctctcacaaccccagcatgcggcctcacatgcatggcacatacggctgggtggatttcctactggcttggtctttgcatgcaggggttagctaagctaagcaatagatatatgctgctttgcgtggggcacgcacgtagtcggggatgagagaatctagactttgaccggattctgcttggacgagaggatcagagctcgagccgctggaatctagaaacagcacgcaggatgtgcgagattccatttcgtcatttcatgggcatatagtataggagcatgtagaatatactccatccgttttggaatgtttaacaccgttaactttttagcatatgtttgaccattcgttttatttaaaaaatttaagtaattattaattcttttcctatcatttgatttattgttaaatatatttttatgtaagcatataattttatatatttcacaaaaatttttaataagacgaacggttaaacatgggttaaaaaatcaacggtgtcaaacatttctaagtgcccccgtattgcacatgtacagtacactacagttggcagcgagcctgcaggcctcgtgccgtcactcgtgccgggaaactcacatgcgcgggctcgtcaaaagcgggccgggtcggccggctaggcagccagtggcttgtccgaacctgatcgattgcccctgccatttactagtactcctatattgggggtcggcttctcctgtcaggttcttgcaggtgcagctttccattggaaagaagaccagacgcgggctataattcttgactacggccgtatttagtttcaaaataattcttaaacttttaacttttctatcacatcaaaact

SEQ ID NO: 30282 - DNA, 457 bp, Oryza sativa
cattgttgctctatatatatatatatcttttagcagagtgatgaagagaagcccttgttagtacgcttgcgtacttaacaagatgaccggagtgcggttccgttctaggtctcgttccccagtcgactacttgtggcatgtcaaccgggcccttgaattattttgtcttccgctgttgttctctgataattgttggcctacctggccctaatgtaagcacttaactttcttagcctaaattcattcgtgatatgttgtgattcggctatgtatgtgtgtaccaactactgatctagggattggtactgataaacacagaagatttccgattttcaaaattgggggtcgacaatttggttgctttttagcgacaggctaaacacaagagacatgttggacatgaaaaattgtgccccactaaatgctgacttaacctgtgttttgtgttcacttcagt

SEQ ID NO: 30283 - DNA, 1501 bp, Oryza sativa
acatacatatatatacacatatatgacaaatgtttctgttcatgtgtaaatagttgttccggcaatttaacctgtttgaaatcaagtctcgagaatttgattaggatcaacaaatcaagatagaaattaagtttgttttgatcaatggagacccttagcctggtgagcggcgtgaccaccatcgtcaagctggcgaacgacatcgacggcgcggtcaaggcggcgagccggagcaagaagagctgcgagaagctcgccgagcgcgtggccgacatcggcgacctcctcaagggggtagacacctcctcgccgtcgacggcggcggtggccacgaggaggctggtgggcaggctggagagggcgctccgccgcgcgctgctgctcgtcacctcctgccagtccaccagccgcatctacagcctcgtcgccggcgggtggcaagccgagcagttcgacaaggtgaactcagagatcgaccggtgtctcctcgacctcagcctctccagcctcgccctcgtctccaccattgatcacaagctcaacgccgccgccgccgccggtgaacggaacaccgtcgaggtcgtcgcgccgcccccgccggtgaagtgcagtcacgatcatgatcaggatgacggcgaggacaagatggcggccggcggcgcggctgagaagaatggcgagcttatctgcttcggcggcgagcaagacggcaaggctgagacggacgccggcgaggtcaccaccaccaccaccaccatcggtgtgccggcggccacggcggcatacatgcactaccatctgtcgcggctgccgccgccgcggtgttacggataccacttgcattattgccactgcacccatggccactgtcactgcgccggcggccgccactactcgccgtcgtactactccgacgacagcgctgacgtcaggctccggcatatgttcagcgatgaaaatcccaacgcttgctgcatcatgtgactctgagctctcaaacgtgataggccaattagttagaaaactaggaaggtcgcccgcgcacatgcgcgagcaccttatttaatgctgatttagtttttattacgaatgtttaattcttttagatatactcattttattagtcttactaaaatgtttgaatgtttctatttagaattaataattttttgttcaatttacatttcctttcatctcttttttgggagaattccactctatgaagcatccttgaaatgctttgatcactgtaattcgggatgaaaatatgtgggttgatcccatagcacgacatggggtaaaggtatccattctaagttatctctttccaattaagtaagaaaatttaaaatagaggtcatagttttttttagcaaattaccacttaactgaagtgtcatgtaacaaatacacatttctagattgttctatgctaaatgttaggaattcatgatgtaccgtagcaagtttaaatggacattttttaattcctatatggaat

SEQ ID NO: 30284 - DNA, 872 bp, Oryza sativa
atcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttttttttccgcttagatttttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcccttgaccctaggttatgccaaatggttacccatagaagccttctaaaaatattggaaaagtagaactgttctcctccctttctcttttaattaaaccaaactaatggcacatgcacttcataatttttttttaatggttctcattcaaaatttattccagtgttattagtactgtacatctattactgtactaatggctcattttatcagcaaaagttttacaatgttgttttatttaatcttgctgcaataaaataaatttagcatgttgattttataattttctttcatttcttttgaaaccagttattcaaaattacaaaatttgtaacttcgtttccaactgtttcaacttatcctgcaagtttggtttactttatttacttaccttttactttgattttctaactttattcaaattaatccaaaaacttgtgctattaattggataaaggtcttaactccctcctttcacttgtctttaga

SEQ ID NO: 30285 - DNA, 413 bp, Oryza sativa
ccctatgagtgtagtgcaaatagggtcaaatggtacgtttgattttgaaaaacggggtcaaattagcaaagtagaaaaagtaggattagactggtagttagaattcgaaacatggtcaactgagcaattgaccatagtttttaggcaaattttgctacaggatataggaatttcatggttttagcggtaagacaccgcacggagtcacttttggggaaacacactctgaaaatatggttatttgctagaggacaccaaacccattaaattattgttttcgtgctgaccaggcgagaagtgtcccacttttttacatggcttgaccaaattgccccttttttctctttgtcttcctatcttatttccttatctcttcctctctctccctcatctctctcccttgacgcgctgaa

SEQ ID NO: 30286 - DNA, 1501 bp, Oryza sativa
ttggtttgtcctggcttagtgtgtcaatctgttgtgtcttgttggtctgtctcccctcctcctagggggtattgtatttatacccatagatgtccctttgtccaagtagaactagagagaccaatatggatacaattcgaatagtcattatagttttcatatagaactctactcgtccttccttatctggaactcattctatatacgagctatgatttcgtataagacttggtatatgatgggcctcaccgagcttaatcaattactattagatatgtggtatcaataaccctgataaggtgagagaagaggaatagatgaaagatggaggggtcagggggaatgtgaggatgagttggaggccactgataagtgggtccgatttgatgacgcaacaagtcaattgccacatcggatgaaactgcctccgaaaccaccctgggagtcgattgcaatggtttttggagttagaggatgggttatacccgattttgcaatcaagggatgtgattcaaggaaatgagttgaggggagtaaaatagacttattctgtgagtataaaggacagtaactattggatggtccggtaagcccatgcgcatcgctgtcccatgctgctcatcactgtattgaaacggtagttgcgcttgagttgagaatagggcggtttcgatctcgtagtgcgatttagacatgccatcggcttttgatttggacgtctcctaggcattactccgtacgacagagagacgaccaattcttccgagacaggagtgttttggcatttcttacatggaaacgcttttcgatcgcgcttaactcctgctgcagagttagtttcaggaaactgacaggggagatcaggaatgtggccttagtgattgcttaactatacttaatttcatggcacatactgatccaacgttcacatgctcttcaacgctcggttgcaaattgcaattgacagtagcagcaaaccatgaataggtttataataatgatcaaccggttgtcaacggccagtattgtattgtcggtaatcggcatcagccacaaacaccagggttgttagctctaacgaaccactattcatatatcagtctgaaatactgaaatccgatgatgctacgcggcaacggttttatacttttatgatatcataacaatctgccgtcacaccatgcaatgatgcgagaaacgacgctgaccacagaaagatttgttcgtgcctgtgctgcttaactttttggtctaaaatacagtgaccccaaattcccagaacgatgggagacctgctagctgctttgccaactaacgcgcaatacgctattattagtgatgtgctatccatgtttagcacgtcgaacacgttttggagcagatcgatcgatcacgattcacgtcgtcggtgacggtgcgtacgtgcacataatagtggagcacaaaaatggccaacacaaacccaagtccagattgctagctaagtcgtgcctgcgtggtt

SEQ ID NO: 30287 - DNA, 1501 bp, Oryza sativa
aatcactaagctgaatgataacatgcattgtattgaaatgtttcattcagtaacatgccattgtttgcactgaacatggtattttaggaactgaaattattacacattgctagtggtccataatgtcgtttgccgacctgtccttgtctgaaactcttctaacacattctggcacactgacaggatcttaaagctgatcctaaggacgagttccttggtacactaagggcgatcataagatgcttcacttgccctgacagatactttgagaaagtcattcgattggctctaggaggaatgggcacagacgagaactctcttacaaggatcataacaactcgtgccgaggtagacctgaagctgataaaggaggcctaccagaagagaaacagtgtcccattggagcgagctgttgctaaagatacaaccagagactacgaggatatactccttgccctccttggagcagagtgaggtgtatatctgctccatctcgtctgtctgatcctccttgtttgatcggaaaataagatctgcatagaactgtgttctattttgttgtttctgaatgatacaagtgagctagtctgcatagcagtgctcatataataaaatctgtcctgcatactggtttgtcatctgagctgcttcagatactattggagtattggttcattatcaagcgttattgttgcgtggggaattcaggtagttttcaaaaaaaaaaaaccccagttacatcgttcgggaatagggtttttaaaaaaaaagcccagttacatcgttcgggaatagggtgccatgagttagcagaggatggttacagacataggagaccatagaatcgtggaaacttaattgttcttaaggctaaacatgttttgtcggatactcccatgagaatctcatggtatattcaactcaatactatggcacttttgcggcgtagattggatcggctgtcaattttcacgagtgaccaagacttgtcacagtgtagtaacttgctacgcatggctcttacatggttcgtgtgtatcaggacttgacttcaggagattatcagaaggtggcaacctgcagtagtgagtacatgacagttgttacttgtacgctgaaacctcttccacgaacttatcaggctcttgtactcttcctgtttacagtacatgaattaatttctttgagcatgtcagcggcgatcttttaccttccgtttttcgtatgtccgcgcaatgttgtcactcgtgacggtgtatactggtgcttgtatgccattaggccggctcatgtcaacaaccgattaagacagacaatattaacagacaggtcaattccaagaagtagttgaacatctgacagctttttttttctctctgaaagaagaacatccgacagaattgctagactaatttcaaccaatcttgtaagtaacgaagtccaaaaaagccaaccaagaattgagattacatgagtgtattaacgcatatttctgcaaatt

SEQ ID NO: 30288 - DNA, 1501 bp, Oryza sativa
ttgaatcaatttaacaaatttgactctaatttgatagatttttaacaaaatgaagtaaaaaaaatttgacataaatttttacagtttttttacggcatattgtcctattttatggatcccaaatggcacacgatgaagcagaaacacaaatcttagtcaaatccaacagagattaatatccaacgacaaattcacggcctcctaccgcagcagcggccactgacgccgcgcgacagtcgccgctgccgtcgtgcaccggttctgccaccgctccctccgcagactgccgccaccgccacccctctctctgtgcaccagtgccgctgctgtgcccttcctccgctcgtcggcgccgtcgttcccttcctctgttggaattaatgaagggtccttagcccactcagattaattctttaaaaaatcacaaaagaccaccttatgggatggtatgcatggagagtttagtaccatcttacttattctagagaggggtacctccttaaaaggggatggcctcctagccactcgaagcatgtgtggtggagagaagagggggaacacacgcgctcgcctcgccttgcctagcaggacaagacaggtgccgcgcgtgcatgatgtacgcgtcgaatggtccgctaaaattagttcctcaccttcgcagatgcagcctcattttttagttttgttttgctgtgggaaattcggatttgttttgttttggaaatgttccaaaaatccggtgtgcacgatgtacgcgtcgaatggtccgctgaaattgattcctcaccttgcgcagatgcagcctccttttttagttttgttttgctgcgggaaattcggatttgttttgttttggaaacgttccgaaaaatccggtgcgtgaaaacgacatggagtccggataagttacacgcgacttatccatttaggttacgtggagtggagatcatgcgggcgccccgatcaagcgaccattctctctataaaccgagccgccgtcttcacgcaacacacacgaaatcaatctagggtttgcctcgtactctgtactgcgtcgtcgctcgtagactactccatcccgctcgccggcgtgcaccggcgatcaggagagcaggtctctggaacctctgccttcgacgtcctgcaccgggagaaggcggcgataaggtttttggaagcgcttcacgcgactgctctctgttcgtccgtaacggctcgtcttcctattcgctcacgtgctgcgcgccttcgccgacgccagcaactgcgagtaatctctgctgagcaaccgatctttacgcaacctcggtacatgctcagtatgttgcgcatatttcatttgttcatgttttactgcttagtttacatgtatagatttaatgatgcgttaatgctagtatacatctgcaatgtcatgatttatttatggaatatattaaatcattatatgtctataatctcaacaatccaaaaaccttattataggcactgtgattttaca

SEQ ID NO: 30289 - DNA, 1501 bp, Oryza sativa
cattgaggccatcattattgtcattgtgggaactactcctaggtaaagaaatggctgtctagtctaatggtaaaatcattccataatactccatgctcctcatatctcatgggtgtaatgtatgtatgtgttgcgaacagatattatataaagtgtcgtatagtatgtttgggcactaataaaaaactaatttacagaatccgtcagtaaaccgcgagacgaatttgttaagcctaattaatctgtcattagcaaatatttaccgcagcaccacattatcaaattatggagtaattaggtttaaaagattcgtctcgtaaattagtcgcaatctgtgtaattagttattttttttagctcatatttaatattttatgcaggtgttcaaacattcgatgttataggatgtaaaatttttaggtgggatgagaacatgccctcacttgaaacttttgcttgaaccttatgcatattcatggtgaatactccctgctcctcttttgtgccatcatttggccatcctacacagtcaaatcacaatcaacaaagatgtgtgcatgatgcatttctacacagtcaaaagtgcaggtttgggagtttggaatttggattttggcaaattcagtgggcccacaaggacataattttgacgattccaaaatttagggctaatttacaaaacactcccacacaaacgttgccaaaccaaaattttggtattgctaacaagctgtttttataggtcaattttgacataatccaaactaatatttttgatagtgttaaaatttgtccatccctttgcgctaccgaaaattctagtagcgtattaaaccaaaccagccttatacccagagagattcaaatatgcaattcaattttacgaataattaaattaatctctaatttttatattagtaagacattattggctagaattaggaattaatccctccattattaaatgtgcgatgcgagtgtactaatttatattatgcataaatattaacatatttggtactgtgaaaaccacatcaatagagtatttatggctagtaatctggttttcctttatggtgcggtagtgggctccataaaaatatctccgagaagacaacacctagtggaaaaagtaagtgtcagtgttaattaagggcaataattaaattgaggctacgcgtcaagcctaggtctatacgagatatgagaatctatagctgtgtttagttggtgtgccaaaatggacgtatatttgaaatattaaacgtagactaataataaaataaattagattctgccttgtaaactgtgagacaaatttattaaacataattaatccatcattaacaaatgtttattgtagtatcacattgtcaaatcatggtgtaattaggcttaaaagattcgtcttgtaatttacatacaaactgtacaattgatttttttcgtgtacatttaatgctgtatgtatgtgtataaacatttgatatgacggagtttt

SEQ ID NO: 30290 - DNA, 1501 bp, Oryza sativa
ttttctcggactcacagagtctagctgcccagcagcacaacaatccgcttccactcgggaagcctagtctatgatgccggtagacatcccgaatcacacagattcatttcttgaccactcaggtcatccatctgccacataggctgattctggtaacaattcccacaccacaacaacttttcacaaagcacaggcaaacaaatctacgctacaggaaacacctcacatccgcccatgaccgcgggcacggctgttcgaacagttagttaacctctgcagagggggtacactttacccacacgacattactaacccggatcacccagcccgtgagattagccacgtcgggagaccctaaggctttcataacaaggcatttcgaaagccgacacaggtttaccatatgccaacgagaggggtcccagaccaacaccaggttaggtcccagaccataccgtgccaggaagcccgagggttctccctgacaccaccccgttgaatccacatgtctcttggcatcatggctcccccgattagctaattactcagccaggggcgtcccattgcacccgtgtggtcgcacttattatatgctcagatgaatttcccacaggaatcggtccttatatgcgaatacaggacagtaccacataggcacaacccccgcatcgcgagttttttcaaacacaccgacgccacatgtcgggttttcaaggcttctcaaacccatttcccaaattatcgacaaacaacggtgtatgtggaatagttggtataagtgctcagagagcacggataccgaagtaccacaagggtggagcgacaaggaatcagggtaatacgacctacaggaattagtgcgactactgggtaggtccgtcggtttggcacgcaaaccgaggccaagcatgttaagtgtgtgattctaataatgtgagctgcaatcaaaataataatgattttccaattataggagcaattggtcaaagggtgacttgcctcgctcaaggtcttcacagagcttcacgaatcttcgagaaaacccgcgatcgacgaaaatccgataaccgcaactttacgcaaacaaacaaaaacctaaagaaaagaccaagaaaaagaccctatttagactaaataatagtgccattaaatagatctcaattttacggaattactggaagttgaacgaagtcaatcgggtgagcggttgagaagatatggattttctaaggattatttgattttctgtctaaaggaaaaggaattattaattcccttggaaaagaaaaggaaggagggatcggatttagacttcctcgggcgacttaggcgcagcccgagggattcacaaggcttggccggccattgggccgagcgcggccacggggaggcggcccattagggggcgcggggagagagggaggcccaacggggtgggcgcggtccgccgcgcggggtcccgagatgggcccgcatggcagcggtcgggtgtatggtgggg

SEQ ID NO: 30291 - DNA, 466 bp, Oryza sativa
attgaatatttcaataacatattcaagctctttaaattccatctgttccttcaaaacctgagcttgacttgagaagcgaaatacgatggtgccctctcgtatgtctgatcgagtgatcgtattataaaacgcagccacagttatacttttgcacgcgtcagttatccttttgcacgcgtcatgtgattcgaataactctgataaaaggggataaatatgtcatttacgttttccgtatgtaatgtaatcgtcttcagttggtttatctataaacagtggttaatggtagctagcactaacagttatcgctgcgcctcagctgctttaaaatgattcgctagaagcctagaacggtcacacgatttgcgagttctagtgatgttttgcatgcaatttcttgtagaggcatggggagattgcaggtcatttatctcctgattcgccagtaatattgttctcatataat

SEQ ID NO: 30292 - DNA, 272 bp, Oryza sativa
agagtgacttgttaagtcgttgtcttatatcgttgtgttagtttgcttgcttaaagtttgcttgtgtgtggctcgcatgtgatttacatcagtggtgggatgtaattgcatgcgtttgtttgtttttgagtgttaggaagttggagagtttagtggtgtgagagtcttcagtttgtaataatgaaactcagttaagagcaataaaagttaaagtaattctctatcttaagtagtttccccggtttctcttcttgtgccctgtccatgtcaga

SEQ ID NO: 30293 - DNA, 1501 bp, Oryza sativa
gagttccttgaagatgaaggctttggtgtctagctcgtgcctgccgtcaagcgcctgtggtcgtcgccctagtcttccgctgtttctcgtttgtctttgtgtgttgggccttcgctgcccgtgtaataattttatatacgcttccgcttgttaaactctgaattgtatcaacttttggtgtaccttgcctcctgggacaaggaataatgcacgcacgtcaggaacgcctgttgggtgatttccggtcgtgacaagttggtatcagagcctcccttgaccctaggacgagccgtagatcccaagccttggctatattttccaaaaaaataaaaatcctttattatttgtgaaaacccgctattctctctttgtcttgctgcttcatttatcgtcaaaatctgatcttttaaatgttgcttttcttttgtttttgtttgtagatggccggcagcgttacccgtcgtggtttggacatgactggcttcgtcttggagctgcggggcatgtgcgtggtcttggggtatccacatggagtggattaccaggccaggccgctcccggagcaggagggtgaggatgcagagcctcacgctggttgggaggtcactgcagtgatcctctccggctctcccgagcggatttcgctggcagtcacagcgggtggggactccttccccgccgcttgccagaacgccgctctcctcgccatcggcacccttcaccagcgctacccggacgagttgcagcactcgccctaccgctaccaccctcgtcgcggaggagcccgcgactacgccaccttccgagacgccagctcggaggatgacgctaccgtcgtgcacctggcacgcatggtggaggcgtacgacgcggctcgtatcgacttccatcagatggtgcgtcgtggcatggtggagaacaacctgaagatcctggagctgcgtcaggagaacctgcagctcaagaaggacctcgacgcagtggaggcgcagctgcaccagctcaagatcgcccagggagaggacagccgtcccaagcgtcgccgcgtctgccgcagccagaagatcaccgcccgcaagagcacctccaggcccgagcttgtccgtcagtccctggcgtggacctgcttcgtcgagacccctcgtgccgagcctgcgcccgtggttccccaggagggggaagcctccggcgttggtagctcggagggtgcgctgttgctcaccttccgtcctggcccgtcgcagcgttagacgagcagttagtaggcctgcgcgtgtgttctttctcgtttatcttcttgttgagtcgtgtggggcatggttacgccggtgtgtggtgtaactatgtcggagcctgtcttatttttaatttgcctaagcaacttgaactttaatgaaccaatttaatagcagtgataaatttaagaataatagtagtcgtgggtggttagttttaatcgtcagctctctttctctgcttgctggttctgtgtggggttttc

SEQ ID NO: 30294 - DNA, 1501 bp, Oryza sativa
tacttaccacaagccagcgtgggcaacggctgggcttgtagtgtagctttcctttagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctaaagggggttatgcgaagggtcctgtcacggcctctttccggtatgtcgtggtggcatgccggcgcacggaaacgtgtcgtggggctgtgtcttgtgggtacagttgtacacctctgatcagagtaaaactattcgaatagccgcgcccgcggttatgggcggtcaaccagattcaccgtgattagaatcacattagtttagtctaatgaatttggatggtataggtggttggttgggcctgttgcaacgtggtgtagcgttggacagtggatgattaatactgcttaatttttacaactgtttaaatccttcaatctctatttataaatgctcgctttatgcaaatgaaccactttagctcttctttgatgattccctgcatcatacctctattccggtatgacttgctgagtacagtgggtagtactcagtcttgctctacttttcccaaccccagagttcgagttcgggtcagatgaaggtttctctgaggagtaggcttcgtccgtgccgtcgaggatgcctgtggagtggtgttcccgctgcagtttagtcaaggattagctccagtttcttctgttttccgctgcatttatgtaagactttacgatgtttgtaagacgtggatctgtatgtcaacattgtcgtttgtgtaccccggctggtcctggacggggattttaatgcacattctgcttggaattctattcgggaatttctgggcgtgacaagttggtatcagagccgaccttgaccgtaggacaagccaaatggaaaaacctaagagccctctgaatccttttcattgcatatgttctttgcaattggatttgttccgggaaaattgggatctgttcttgtggttcaagggaaaaaatcttggtcgctcgtttaagcggggttttttcaaaacaagtcagtctagggttttagtaaaattattgggatttattcgtcagtcagttggggtttgatgggtgaaatgcattaggtcctagctcaggaatatgagttgcaaggtgtttatgctcttatcgttattattagtatgtatctaatttctcattattttatcgttatgtgggtctgtcttgtttattcgctctcatgcaaaatgatctatgcataaaaatttcgctcttgttcgtttcccttatttgggtcttttattgctttatttaaatttggatttgagcatgcattgatcctactcctttgtcttctctagatggccggtcacccacccaaccaccgcggagaaggcatgatcgatttcgtggcagagttggcacgta

SEQ ID NO: 30295 - DNA, 1501 bp, Oryza sativa
tctaagagtgatctgactgaaagccttctccaggtgccgttgtggtcgcaaaacctcaattggttgcaattcgtgaacgagttagcagtggaacaaatggtgccaaccctccagtttctactgaaggaaagagaataataggtgcggcaaatcctggtccagaagatgctgctgatcttctaaggttggtcatttttatcaatactacaacaagataacttgaaaacttagctgaattcgttatattcctggttaattatttactgctcttaaaactgtgtttcttttcaatctgtagaatgtgcctccaatgtggtataccaaagacctattcacacgcacgaggtatggtgtgtcctgtttgcaacgatagaccagagcaggcaagagagccagaaaagaagaaaggatcgaccgtcaaagacaaggagaagatcaaaaggatgagggggcaatcatcacacgcttcgtggaagagtgaaactgagatggccctgcggcaacaatttgactgattactaactagtgccacctcctatacttggtgtcatgtgttatgtacactgcgaatacttatgtaatcctatcttcatcaaaatcccgtagaactgcctccaagagtcatagtcggttcccgattgtgtttgctgtattttcagttttccaccatgaatatggatttgctcgataagctgagaaatggttccttgcaaaattccgtcgaagccaaagtttgagccaattgtatgatcatttactccctctatcccaatatgtagcaagttttaagcttgtgcacaagtattaagtaaagtagaaaaaagaccatactaccctcaatgattattcctgtactaaaactcagtggtggcggtttgtttgctgccatcaaactcacacgtgcatttcaaacgcattggcgccagaaagctggtaaaacacagtaaaaatccactcacacgcaaatcaaattttaaactggtagacggcaaaagcacatacggcaatataaactagtactccattattttcttctctttcactgataactatgctgaggggtagaattggtagatttattttcttctctttcactgataactatgctgaggggtagaattggtagatttgtggtaagagttgtactaggttgtaacatttgggacaaattttgaatgccaaaacttattatatattgggacagagggtgtatttttcctcttgcaaattgttcctcagacaagactggaagtggcaatcctaatgttgggtcaggactcatgagtgcctgatgctgtaggactgatgcggcatcagaattcttcgacgcaaggaatgaaatgggttggttgggacttgggacttgtatttcgtctccaaggctcgtccatcgtactgtacggacagttttaaattttactatctataagcagggatagtcatgtggtgtaacatggccaacgtgcaatcggtccaaggagatagacgcgaccgtaccaag

SEQ ID NO: 30296 - DNA, 171 bp, Oryza sativa
ttgctaggctcctcgaatctcagggactagattcctgtaaggggggtggatttgtcacgtcctgataaattcatcccaaaataaaaatcattttctaaaaggaataatagaattaattaaaattcgaaaagaaattgacaaacactaaaatacatgccagaaaaattcgaa

SEQ ID NO: 30297 - DNA, 368 bp, Oryza sativa
tgcgttctcgcgccgccgttcgccggcgagcgtgcgccgtccgctccgcggagccgccgccgctgtcggtgacgtcattgctgacgtcatcggggtcgtccgccgtgagccgctgtggacccgatcgatctcggccgtccatcttggatcggttagatctcggccgtccgttcgcgtgaaccgccgcccgtgcgcccggtccaccaaaccctagcccgctgacgcaataaatccccttttccttttcaaaaataattcattattgcgtcataattcaatttaaaccgatttaagtgttttaatccgatttaatctttaaaaattcataactaattcatcttagctccgggaaaggctaatgttgtagc

SEQ ID NO: 30298 - DNA, 1501 bp, Oryza sativa
aacacactttcctaaagataaaaggaaactaacaaactatgcctaattaatagataactgtcatgtcgcatccttcttgaactcgaactcttctagataagcttcctttgattgatccgactccaccaagaacacgacatcgtggcgacttctcccatcggctgattctagaactttgaagccgatactgactctaaaccgatggtaattttgggattaccaaatttcactgttaacaattgtcaaatagtttctttggttttagttcagattatacattttttccctacattaagtgaaattagcggctcgccggttcgtttaaaaaaataccgtataatctgtatcaccgtatatagtccagcatagcattaataagttaatccgcgtacttcgggagtatggcagtacttgcttgcatgctacgacgccgggttcttcagttcagaggaagattagtagcggcagtggtacaaaaactgggctcctcttgcagtagacagtggacggacagaaataaatttggtgccgtgcaacgtacacgacatacacacatacccttgtcctcctgctcctgattggatcggtagaaaggtggcggatgctggattataataaaaaccctgtagattacacccataataaaatggtcaaggaccacgacaccacataaagacacccatccccgtgatcaactacctcaattagcctcccaagatccccctataatttaccataatttattcaaacagctggtacctctcctccgggttaataatacttatcgttttagacaaggacacgatataaaaaaaactttaaccattatttttcattataatatatatagaagtgttaacaaatatatgattttattaaattactttttaaaactaatctatacaggtagtcaccatatttaatagacaaatattttaaaatcaattcataatcaaagattctcaagtttgacatcacctttatctaaaataacaactattaccagcaccgaaggataatactaatttgaacatattcaccctactacaaatcttaataaaatctgaacaatggcctattggagttatagtactataatatatcattttccttagtagggccgagtttggttctaaatttttttttcgaactttcaatttttctatcacattaaaacttttcaacacacacaaacttccaacattttcatcatatcgttttaatttcaaccaaactttcaattttaatgtgaactaaacacaccctaggttactgtattttggcactgaggcggcacacatctacaagggaacgcacgaatctcaaagcagatgctcaggccgaacgcctccatctctaccgttcactgcgccacgttggtgtcctttttgcatgatggatcgctcgctacgagtttttttcttttttaagcggcagcggcaactggaaggtggaaggctctcctctgcttttaagaccagcgctgagacagatcgagcga

SEQ ID NO: 30299 - DNA, 1501 bp, Oryza sativa
tcgtcttgcggggcgtggtgcggatccggactccttctggcgctggaagaccctttagctgagcgttctccttcttcaggcgcgctatctcgtccttcagagcgacgatcctcatgagcttcccatcgttcaaagccttggtcgccttgtgcaagtccgagtgcatcctgtccaatcccctcatcacagcacacatgtgaccaaaggtggtgtcgttctcgccagctgtcggacggaaggagctgacgccatcaccgttggctcgacgggggtggtagcggtacgccgtgtcgtggaagatgtagttgtggcgctcccgtagtctggccatcatcaagtaggctgcctcctgacaggcgtgatctgctgtgcctccagatgcctcgaccgccatgttagcgaggcaagtccccacgtagccatggacctccaagcggacacggtgaggaagctcgccactaagcagcggaatcgtcgtgtactccggcgcattggggtagcccaccaccagtgtcatacgtgccaactctgccacgaaatcgatcatgccttctccgcggtggttgggtgggtgaccggccatctagagaagacaaaggagtaggatcaatgcatgctcaaatccaaatttaaataaagcaataaaagacccaaataagggaaacgaacaagagcgaaatttttatgcatagatcattttgcatgagagcgaataaacaagacagacccacataacgataaaataatgagaaattagatacatactaataataacgataagagcataaacaccttgcaactcatattcctgagctaggacctaatgcatttcacccatcaaaccccaactgactgacgaataaatcccaataattttactaaaaccctagactgacttgttttgaaaaaaccccgcttaaacgagcgaccaagattttttcccttgaaccacaagaacagatcccaattttcccggaacaaatccaattgcaaagaacatatgcaatgaaaaggattcagagggctcttaggtttttccatttggcttgtcctacggtcaaggtcggctctgataccaacttgtcacgcccagaaattcccgaatagaattccaagcagaatgtgcattaaaatccccgtccaggaccagccggggtacacaaacgacaatgttgacatacagatccacgtcttacaaacatcgtaaagtcttacataaatgcagcggaaaacagaagaaactggagctaatccttgactaaactgcagcgggaacaccactccacaggcatcctcgacggcacggacgaagcctactcctcagagaaaccttcatctgacccgaactcgaactctggggttgggaaaagtagagcaagactgagtactacccactgtactcagcaagtcataccggaatagaggtatgatgcagggaatcatcaaagaagagctaaagtggttcatttgcataaagcgagcatttataaatagagattga

SEQ ID NO: 30300 - DNA, 1501 bp, Oryza sativa
tcgaatgtcttggagtttattaatgttctactgtgttgatgaagtttgaaccataatttgaatttcttttgttgaaatttgaggcacatgggcaccaacgaaattagtttcttcgggagaatatgctaagacaaaatggggccacttactgtttaccatcataagacaacagaggttgatggaatggcagggtcaagacgattagtagtacgcctctgttttcctctttcgagaatagtacgtctctgtttttaaatatttgataatgttgacttacatgtttagaatggatagaataaaacttaagtgacgaaaacaacaatagagaagaagatcggtgtagtgtaaaaagagtagagaagcatgaggaaggtagaaggcagcggacatgtcgggaggaaaactggtgtgtgacctgaggtttgctgaagtgtggctaagaagaatggtttataattctttcttaaaaaaaaggagaatggtttatagctatagtcgttgcactaatctcaaagcaatcccaggctcaaaaaaaatgtttggtagtaccaagcatgaacatatgtgcaacctcgtgaaattattttactccagtgcctctcaagaaacgcttataagggacgtgggtcaaaaggttggtacaacatggctcgcttcctccgtgcatgtgtagcatgagtttacttgattgttttaactttggttaagagatgcttgctgtccgtcgctctgaaaattgggtgttaggcgtgagaagagaagagaggaatagagaaaattgagaaaatatgtaaaacgagataagctactagcgcgtaattaatttaatattaattattttaaacttaaaatatagattaatatttttttaaagcatttttttataaatagtttttttcaaaaaatatcatttagcagcttgggaagcgtgcgtgtgaaatacgatgttctttttttctcccttttcaactctcaaacagcatcagcttgtcaactatcaggcaaattctgatcagaagacagataacacaacagctatgcctgatccttttatttttcactactactactaaaaaacaaaaacttggggcggttgactcctgaccaccactaacctgttggatcgctggaaaatgttggaccagatcaaaccacgcaggcacgacttagctagcaatctggacttgggtttgtgttggccatttttgtgctccactattatgtgcacgtacgcaccgtcaccgacgacgtgaatcgtgatcgatcgatctgctccaaaacgtgttcgacgtgctaaacatggatagcacatcactaataatagcgtattgcgcgttagttggcaaagcagctagcaggtctcccatcgttctgggaatttggggtcactgtattttagaccaaaaagttaagcagcacaggcacgaacaaatctttctgtggtcagcgtcgtttctcgcatcattgcatggtgtgacggcagattgttatgatatcataa

SEQ ID NO: 30301 - DNA, 1501 bp, Oryza sativa
gaacaaccatgtgtgcgcttttcatagtgcatttggtggtggcgatagaatacttggattgggggtggcagcacggagattaaattaaatcatgctgtattagggctggttgtaacaatgtgattgggacactagcttgtttaggccgatggttatacttatacgccgttgcttagcgctcctaacttactattgacggatcatacagggttacacgcgtaaccgttcttactaggaattaaagcaatgtgcacgcaaggacgcaacaatcctaacatccttagcagcttcacatcttcaccaaaactattgcctgccctgcccggccgtcaatggatggccaccacagaaagtcggaaaacgttttgctgtttaggctgtctgatgtttgaactttctagcccatcgttcccttcctagggtgtgcttagttcacacaaaaattagaaagtttggttgaaattggaacgatgtgatagaaaaattagaagtttgtgtgtataggaaaattttaatgtgatgaaaaagttagaaatttaaagaaataatttgaaactaaactcggccttaatttagaacaactctaactaatggataccatacacaattctgactagtgcaacagtgactgcacagttaggcacttattgggcacagccacgtagccaattgacctccaaagtttctctcgagatatggctatatttaggtacagtggtgtaaagttttggcgtgtcacatcggatatacggacacacattaaaagtattaaacatagtttaataataatacaattacaaaatccgcatgtaaaccgcgagacgaatttattaagtctaattaattcgtcattagcaaatatttactgtagcaccacattgtcaaatcatgacgtaattatgcttgaaagattcgtctcgcaatttacacgcaatctgtgtaattagttgttttttttatttatatttaatactttatatatgtgaccaaatatttcaaagtaacagggctaaattttagcggggggataaacaggcgcagtagtgccggtagggcgatgaatgcatggccatcgagagaaacattaaatgcgtgcagagaccgttgttttcctgtagttgttttttttggacccctttgaatcacggaaatagaaaaacggaggaataagtgtaaaacagagcattgcaaaacacaggaaaaatataggaatgaccgtttgattggaccacaataaaaacacatgaatttgaggagagataaagactcaaaggatttcttccatgaggttctacctcttgttaaaattcctccaaaacttgtatgggaagaggcattccatagtaatttcatagaattccatagcgttcattcctttgattcaaagggctttgtagaaaaaattcctataaaaataaaatcctctaaaatttctatgaatttcctccgaatcaaagcgggccttatttttttctggacggccagctttcagagttcagaa

SEQ ID NO: 30302 - DNA, 523 bp, Oryza sativa
gccataatactactgcggtagatccaagcctacttgtgaattatcatatagtaataaggctgttcttgctaatgtttacaaggaaccatgtacaggactatgcacacaaatacattaagctgattgagttacattggcaatttatattcaggtaccaacatagatgtcatggtggatgcactagttactctagggtgttacaaatgaatggcagcatctttatatccatttataggtgtatcattttgacatattaatttggtactatatgatcagattcaacacagaaattctcaacgcgactgaatttggtgatcagagtgtaactcaatgtccagaagtttttgaggaaaaacgaagtgaacaagcatcaagtatgtcaattcgcaaaacaattttgttttatttttgtctattagtattgacaagatatagttttttaatcaatcagtcagaagcctgaacctggatcaactagttgttaatgatattggaaaaggagcagtgttgactttttcacaga

SEQ ID NO: 30303 - DNA, 868 bp, Oryza sativa
tattaagcctaattaatccgtcattagtaaatggttactgtagcatcatattgtcaaatcatattgtcaaattatgacgtctcttctaggcttttacaattatttctgataattccaattaaataacaatttatatttttgggatttttagggtgtaacaatattttcagccaaatagtgtccaaaagacagcacgcgctttcaacggtcgtcggaaatgtgcatccaccaactcctccaccagcaccatagccattctccacgacatcatctttctcacgccaagcatgcgggattgagcactgatggaaccacaaggatatgggtaaggaaaaccgcgtcactgcggtggaatggttggagaacacaatagtgtaaacattaatttctaccgtgagaaattaaaagatacagggaaagagttgaaataattctgcaactaataaacgacttgtagattggaaaagcatcacaaagctacaagagattaagaggcacgagttgttttcatgggagcacagaaaaagtcaaaaaccgatggtcgtctggttaaccatctccgtcaaagtatttatatcacattatgactggagaattttaagagaagtttcactaccatagaattgttaatcacatacgcgtgttaatgtcgaacatatatagtcacaaaaaatgggacggaaacgtcgtccccgtcttcagaacgtggggacagttttgtccgtgccatgtaaaaacatctcacaagtgccataccacgttcattgaccacatcgaatcaggattttatgactataatgtgtgtaccttatttattgaacgaggaactttatgactattgtcgatccggtcgccccgcttggccagg

SEQ ID NO: 30304 - DNA, 483 bp, Oryza sativa
atgagaaagatgctacaatagaaagaagaaaaagggaaaattacgaaggagaaaaaccaatctaccgcaaggagaagagatttttgccaagggaaagagaggggattggaggaagaataaataccaaacccagacattatactcttattagaatctcaggtacaccgttttgcaagttgagggactcatcatatttggtattgcagttcgaggatgagattcgaactcggcgatgatctaaactgaacttgttccaatttaaaaagttgtatacactttctgggccttacaaagtagacgggccagagtcacaccagcgtcagcgggcgaggcccaataagccccgtggcaaacaacgccacgtcactgcctgacactgtccaccacactaatgtgaacttattccatttaaatttcgttgtggatcagacatttggtgggccttattcggattccagcccagcaaatgatgggccccgcagt

SEQ ID NO: 30305 - DNA, 1384 bp, Oryza sativa
aggtatgtcaggtgtagcgtggcagtgagctttgtaggccgaagatgctgaatattgtctgtgagttgtgaacttccaagaaatttgatcacactggaacgggatcgcttatctgtgacgggctgaaagcatcatcactatcgggtaaggcccccgtcactgggcaaaggtcactgatgtgaggaaaaatctcaatcgggctaaagcccgtcacggatggatgttatctcactcgggccgaaaacaaagcgcgtggaaaacaaagcccgaaaataaatatctatttttgcaggcgggaaaaaaaatagatccttctgtacataacttcgcatgcatattcacagctaaaaataacagcgcccgtaaaatttgtaattggctttgtgaaaaatcatttttctagtagcatcttacatttcacatttacgataaatccacatcatagacgtagacctattgacgtcttacgtctattgacgtctgcgacttgattgagaatagtcataaagttcctctttcaataaataagtacacacattatagtcagaaaatcctgattcgatgtggtcaatgaacgtggtatggcacttgtgagatgtttttacatggcacggacaaaaatgtccctacgttctgaagacggggacgacgtttccgtccattttttgtgactatatgttcgacatcaacacacacgtaagtgattaattaacaattctatggtagtgaaacttctcttagaaatctccagtcataatgtgatataaatactttgagatggttgaccagacgaccatcgttttatgacttttctgtgctcccatgaaaacaactcgtgcctcttaattaatctcttgtagctttgtgatgcttttccctgtatcttttgatttctcacggtagaaatcaatgtttacattgttgtgttctccaaacattccaccgcagtgacgcggttttccctatccatccttgtggttgttccatcaatcctcgatcatcccacatgcttggcgtgagagaaagagagagagatgatgtcaaggagaatgactatggtgctggtggtggagggatgtggtggatgcacatgcccgacgaccattgaaagcacgtgctgtcttttggaggtcccgttcttaataagtgttggatgaagattaatattttcatggcacgtttttcaaactaataaacggtgtacaaatatgtttcgtgcgaaaactttctatatgaatattgctctagaatatcgtattaacctatttttcaaatttgtactaattaaaactcaatcaatcatacattaataccagctcgttttgcgtaaaaaacttaatcttcatcttaatctttatctttaggataaaagaacactgcctat

SEQ ID NO: 30306 - DNA, 1501 bp, Oryza sativa
cgaagggaggattccgcctcggccaccactctctcgtgggcggccaaggtggtctcgccatggtctagcatgcgcgctcgctcctccagcgcccgggcatgctcctctagcgcccgagcatgctcctccagctcccgggctcgctgcgcctgttcccggccgcgctcatcctgttcgcgctggttacggtcgaggagctcgatcagtcgacggatcgtggcctcgaactcctgcatggagcgggcatgctcgtctaaggccttgcactcggcctcgagcgccgccatccgagcccgcagcgaggcgtcgacctccgatgcccgctgctcttgggcggcagccgcgtcgaggtctccacatgcgtcttcgaccctcttcgccagatcctcggcgtgggcctcgtactgcaaggggatctcgcccagcgcctcttgcaggacgcttgaagcgatgatcgccgcctgccgctcctcctccgtctcccgtatgaccgagtgcagcatctgctcgcgcgactggatctctgccagttgggcttggcgcattttgcgccccacctccaccatgtcgtccatggcgtggcgcccctcgtcaacccgcgcgcagtccgccgcgagctgcgcccactccgcctccagggccgcccgctcgtccgtcagggcttgaacttgggcgttgacccctcccggacggtggaataggcggcggcgagcacctgcaggagtggctccatacccacgggagttggagaagaaaaagtcgcggtccgcccccgggacggcggagtgctgctggacccccgcgagactgggagctgttgtcacgtcctgataaaatcatcccaaaataaaaatcattttctaaaaggaataatagaattaattaaaattcgaaaagaaattgacaaacactaaaatacatgccagaaaaattcgaatgtggtccggagaatttttgttaaattctccttggtctaaaaggagccctcaaattttacttgaattttcagagcaccaaaaatatttattaaacaacaacaacaattatcaaagtttattaaaaagaaaaacctaaaaataaccctctccttccctttgggccaagtctggcccaaggtttctcccctctccctctcggcccgcggccgaagtccctctctcctccctctctttctctccctctccttatcttgggcctcctcttccccttccggcccactgcctcctctccacctcctcctgggctgcctctcccctccctccttcccgcccggcccaagccacgccacccagccacctggcccacgccgagccgctccccgcacgcgctgcgcgcgtgccgtcgtcttcctcctcccgcacggcctgctctctctctccccggaaacctagcgccaaacctccccaaaatccacgtgattcaaaccgggaattccaaaattgattagggggaattaatcccctttccctcctctctctttcccccttaattcccccttgaa

SEQ ID NO: 30307 - DNA, 1501 bp, Oryza sativa
gctgcgccgcctccgttgtcggattcgcagcggcgtgttccacgccgtcctcgtctccgtgcagctgctgctagctgtccctcgttgcctcctcgccggccccggtcgtcgtcgtcgtcctcctcccgtcgttcccggtcatcgtggcgttcgtccttccgtcaagccgttctcgtccgtcgtccgcatccgtcaagtgtgccgctgcagccccgtcgttgtcttcgtcctcgcctccgcgtcgtcaagccttgtgctggccgcgtctcgccttcatccaaggatcaccgccgaagtcgtcccctcgcctttcgtctccgtcgttcccggccgtctccgccgcgcccgttcgtcgttgtcgttccctcgcctcgtcgcgtagtggtaaggatccgtcctctcgctgccccgtccttgtcctttcgttgtcgccccgtacccgttgtgcggttgtcgaccccggtacccgtgtaccggtgtcggtagtcgttcacgtgtgcgggtggtgaccgtgtagtgtccgtgttagtgtgcccgcttggtagccgcgttgtttccacgtgtgcagcccgcgtggtgtttagtggagtccgtttgtcggccactcgcctcggttgacacatggggtccgcttccgtcgacccgtggaccgtctctgtgtactcggtctaccgtggtcctttaggttgacatgtggggtccgcatgtcaacagcgcagccttcctgtcttttccaggctagcgcttccacatgttttatagttgaaaaacctaattataataatccgcaaatctccatataacagcactaaacttcggatgatcatatcttggtcatacgaactctgaatcaacccgttcaagtctcctaatgtttgttataacctaaagaaccgtgtgctttctttttatgtattgttattgcttctttataggcttgtagctttgcttgtgtgcttcgcgtagcttctgtcgttccggaggttctcgaagcgtggtttgcggtcgtcgccaaaggttcggaaggccgttctctttgagcaaggcaagtcacatcatccttgagcatattgaatcccagtttataaaattattttgatttaaattaatgcattaccgctttatttaaattcccgcgttatcgctgttttatttagccatgcctatttacctttgttaagacattattattgctattgttattattatcttgttcaccctagaataaacaaaaccccaactagtgggtactctattcatggttccactagtatgaatttaggtagatgcttcgctgattaataggacaacattaggtggtttttataactttagactttgggaatattcatatctcttggatactatggaatggttggcttatggtggaattggacatacccctctcttcctctttcaaagcccctaaaacctatttttcggtggggtttgggtgcatgccagttgtgggaagtagcaccccggccaatataaggattaa

SEQ ID NO: 30308 - DNA, 472 bp, Oryza sativa
cttgctgttgttcccccttttcagaagtgtagtgcttctgagctgaagacaaagttagaagaccaaggctcagaccccagttgagttttgcctgtggagtggagctgaagccccgctaggatcgcctttttccgctgctgtcgttctctttcggtgtgaggactaagtgcctcttctgtaagtatttacgctttatttacgtttggaactgtttattacttatcgtttatgtaccatggctggtcctggacagggatttaatacacaaaatagtctggaaatttgggctaaatttctaggcgttacaaagtggtattagagccaactcgactgtaggttgagccaaatggtcaaatcctaaggacaagttttctgaaaaccctagttgtgaaatgtctcctctcttcctccggcatttctttgtgaaacggtttctcaaaattctcctccctgcctctccaattcttttagt

SEQ ID NO: 30309 - DNA, 674 bp, Oryza sativa
gtaatgatcttcattatctcgctttgcggtctcatcgcaaatatgctgtcatgagtcttcatgatatccttggcagcctccggggaagaaacaataatgaatggtacctgtccaaacttgagtaacatgacaggcccataccgtcgtgatagatcatgtaaggagcggtgtgggagatcaccgatcaaatggtgtatactacccatgatagggagctgccatgggcacggtggaagccgtccggcttgcttgcgggagctgaacatagctttgtagaaattaatcaggagtaggaaaggaagaatgatgagcaatgagtagtatatgagatttgccatgagcaaggaagggatcggaaatgctgcatatatatgaaatcggtagtgagttccgcacttattaattgggactccaacaagttgcttcaagttgtttatttaattatgtgtgcacattagtgacgtagtgcagagaacagaaaattatgttaagtcgtttctgggttctcattgtctgttatagtttggtggttgtaaaaaatgagaacatcaatggcaagtacttttcatattgacaggtcttaaagaatgttttttgtccagaagacggtggtcgagggaaggtagaggccattgcattggcggagcctgtggacgacagcgaggagggaaaca

SEQ ID NO: 30310 - DNA, 834 bp, Oryza sativa
ggcgaattcgagctcggtaccctactagccaaatcactcggattaatccctaccgtccatccgcgtgcacgggttcgccaccgcatatactaatataaaaaggaggggttgtacccctccaatcctactagccaaatcactcggattaatccctaccgtccatccgcgcgcacgaatttaccaccgcacgattccacacgcaaacttcgctcctcctccacacgcgaagacttcgctcctcctcctccacgcgtggacttcgcttctcctcctgcatgtagcgccgccgcatcctcgccgtcgccggagctcctccccgcgcgtactgccaccgcatcctcgccggagccgctgcccacgccgacatcttctgctgccgccgccagatccggcttcttccctaccgttgcggccggatccgacctcggccccatccgccgccgccgccgaggtcggcccctcccgtccctgccgccggagtacatccatgtttccctcctcgctgtcgtccacaggctccgccaatgcaatggcctctaccttccctcgaccaccgtcttctggacaaaaaacattctttaagacctgtcaatatgaaaagtacttgccattgatgttctcattttttacaaccaccaaactataacagacaatgagaacccagaaacgacttaacataattttctgttctctgcactacgtcactaatgtgcacacataattaaataaacaacttgaagcaacttgttggagtcccaattaataagtgcggaactcactaccgatttcatatatatgcagcatttccgatcccttccttgctcatggcaaatc

SEQ ID NO: 30311 - DNA, 302 bp, Oryza sativa
tgttattgttattatttccttgttcaccctagaataaacaaaaccccaactagtggacactctactcatggtaccactagtatgattttaggtagatgcttcgctgattaattaggcaacattaggtggttttacaactctagactttggaattttctcatcacctggacactatggaatggtttaattattgtggaattggattcacaccgctccctctattcaaaatccccaaaatggttttaggctgggctcggggtgcatggttttgatagtagcatctcggccgtgtaaggaccggt

SEQ ID NO: 30312 - DNA, 307 bp, Oryza sativa
tattttctaggcagttgacttatgcttctcagcttccaaaatatttttggatgcagtcacccgagatgatgaaagtagggctattttcacatgcaaacggtgacacggcacctggcgtactgcatgggttcctcataaaccacctgtatagttttaatagattgtttgagagaagggaaaacaagaagattgatcagaagctacgcaaaatgagctgagacattagctcatgattagttgagtattaattatttcaaatgtaaaaggtggataatatatatgatttttaaaacaacttccatataga

SEQ ID NO: 30313 - DNA, 1501 bp, Oryza sativa
tggacttgttccggttacatgcaacatgaattcatgatcatgggtctattttctatgctcaaagactggactatttattattctccgtaagggttatcaaccgaatacttgcgccagtcgggattcaatttttatatctattttggggtatcccataagggataatcactcagatcagaagctattcatatgagctacacttggtctatattacccggaagatttattactcgggagcatgttacatgcgtcatcctataaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttaggctgattatatattgtggtcatttttcaggcggttggtaaatcctttatgagtttatttactcggattttataccacatatgtcatatatttccaggtgtggtggaaccatgtgtcttctagggacttaagcacatctgttaaagcagtgtgcgcatggcgtatgcccaatactttggaaatttctttattcacaacatactagcttttttatagctgttttgctatgtgaattttcaataatgtagccaactttaggttacactcatcatattttacaaagcagtcggtatatcactcggatcatgttattcagggatttacaccgcatatgctacatattaatatcaagtcgcttgattaactataattatcgaagccactcggttggttggattatttattccttgactatatgcttggtttgttcacttaaccgcatagtcgagggctacacctattaggtgcatctagtcgatgcacctgactttatttttcagccctccacagtcttcagatttggtaaaagtactcgggagaccatggcaaagatgattgaagtactcggctttggagtaatctggttcgagagaagattatcttttcgactgtgaaggtctcaggggctactgtggagattatgggtaccccatacccacacggcatggttatccgactagttataggggataacttatatgtatggaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggca

SEQ ID NO: 30314 - DNA, 184 bp, Oryza sativa
ttcattgcaagtatgaagataagaatgcaattcacaggtgtccgtgacagtgatgccaagaggtctaaaccgaagatttattattttagccagtgtcaatcggccactaatttccccctgacaatttgttttccttcccagtcatagatccatttcaccacacaacaggtttcctctgtttagc

SEQ ID NO: 30315 - DNA, 1501 bp, Oryza sativa
gagctccacccagctccacttctattttcggtggagctgaaactgtttgtctgagcttcagtagaggtggaggtggatttgtgccaaacaggtcatatatatatactagaaaatcggtgcgccggttggcgcacttgttttatagcccgtgtatattgtttatatattattaagatgcattactttcattctattaaacaggataacatcatgcaatgtgtacagttaaatatcaatatcttaaattattaaaatttgaaaatcatattagtagattttttatgaaaactctttttatatagttgtatttttattatctttgatatatgtatagtttgtgaaagttatgataaactttatgtattggagagtgtgtctaaattgacattattttgtttcccaaaaaaaagggcattcattttaagaatgtaggatacattttactgaattttataagaattagttcgattttcttgaaattcatgcaaaagctgaacaattaaataaacatttcattattttttttcaagtgcagtttaacttagcatatcacagtactatatggcaattttttaatttttctcttttcccatccatactatttagggttatttatttatgaaatgttataattgagttatctattagattataaaattggtgatgaattttttaagatgtttcatattttttttagagctgcgatgctcatcatttcttcctaacacgtactaacaattttccaaattttttttcccaaaaacatcacatcaaatctttgtacacatgcgtggagcattaaatattgatttaaaaaaaaaactaattgcacagttaggggataaatcgcgagattaatcttttgagcataattagtccatgattagctataagtgctacagtaaaccacatgtactaatgatggattaattaggatcaaaagattcgtctcgcggtttctaggcgagttatgaaattagtttttttattcttgtccgaaaaccccttccgacattcggtcaaacatccgatatgacacccaaatatttttttttcgcgaaagccctagtactccactgaagcctatacatctagcttaactatcctactgagtaactacggtaggtcagttgctatttttatagggaactatgtttattttattaagtgtcgaaacatgaattcggcaataataaaagggggtagcgcacgagacctaaaagtggatggatgtggagacaaaggattagacaggttcaggccctctcaatgagaggtaataccctactcctgtttggggatttgaatccgccgagtgtgtattgatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgt

SEQ ID NO: 30316 - DNA, 1501 bp, Oryza sativa
accaaatctgaagactgtggagggctgaaaaataaagtcaggtgcatcgactagatgcacctaataggtgtagccctcgactatgcggttaagtgaacaaaccaagcatatagtcaaggaataaataatccaaccaaccgagtggcttcgataattatagttaatcaagcgacttgatattaatatgtagcatatgcggtgtaaatccctgaataacatgatccgagtgatataccgactgctttgtaaaatatgatgagtgtaacctaaagttggctacattattgaaaattcacatagcaaaacagctataaaaaagctagtatgttgtgaataaagaaatttccaaagtattgggcatacgccatgcgcacactgctttaacagatgtgcttaagtccctagaagacacatggttccaccacacctggaaatatatgacatatgtggtataaaatccgagtaaataaactcataaaggatttaccaaccgcctgaaaaatgaccacaatatataatcagcctaagccataatattggtcaataaaaatgcacacttacgtggcaaaaagcaacgatattgtatccaatcaattgcttaaaaacccaaacagcaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttataggatgacgcatgtaacatgctcccgagtaataaatcttccgggtaatatagaccaagtgtagctcatatgaatagcttctgatctgagtgattatcccttatgggataccccaaaatagatataaaaattgaatcccgactggcgcaagtattcggttgataacccttacggagaataataaatagtccagtctttgagcatagaaaatagacccatgatcatgaattcatgttgcatgtaaccggaacaagtccaaattgaaggtatgatacttgtgtttgaactagtaagcctctgagcatatagcttgtccttctttgtagtcacaattgtccatcgatggtagctgacgcagttggcatagagacaagacgaccaatatagagataatattgcccaccagaggtggcaaaaatattggtggtagtgaagatagtgataccaatcaaaagtactgaagtcgcatagccatggaggcgaagaaaccagtcggcggcaaacagatcaactaacaatgaagatgaaggcgcccagcgataaagttgtgtagccatggcagcgaaataatcagtcggtgacagacgaggcagatcaaatgcgatgacgaaatccaccaatca

SEQ ID NO: 30317 - DNA, 247 bp, Oryza sativa
taaaagatgttggaggtggaatttcttggaatacatctttggagttctttcatatgcttgtcttggctagtgatgcggacatcactacctcggatagacacaacaatcctccaacggtcatttaaggacagataacaagagctcgtgcgcgacaattaaatttagaggtgagctcgttcctatgttcttctttgtatgaattcgagaatagattgctacctaatgattatattgtgattaggaacaa

SEQ ID NO: 30318 - DNA, 1501 bp, Oryza sativa
ccctcggattcgttcgaaatctttccccctaaacctcgccggcgcatcaatggcggccggatcttccgcgctcgtttccccctcatccggccgctctctccccctcccaaccctatataaacactccccgtgcctccctccgccgttttcgccactcgccgctctctctctctccgccggaatcgagctcgcgccgtcgctctctctctctgccgtcaccgccgagctccggtccgccgccgtcgtcgccccggaccttctcccgcttcggcgtcgcctccttcggcttcgccgcatccccgccgacctcgtccacctctccgtttcggtcgccgaccaccggaacgccgccgtccccgtcgacccgtgccgcaccgccgcctttctccgctccggtcgccgttcccgtcgtcgccgtcgacccggggtgagccgtggaccgccgtttcgtttcccccttccctcccctctctcggccgccgctccgccgtgcctatggccgccgccggcgaccataggggcgcgggcgcgccgcctcccgtcggctgtgccggcgtggccgccttcgggcgcgtcccacggctgccatgtggggcccggccgtcagccgcccgcgccctcgggtgcggctgacgcatgggacccacggcgccggccggtgtgagccgggtgcacccggtccaccgtggaccgtgaggctgccgcgtgggccccactcccgtggacccggtccgcgcgcccctcccctcggctgacgcaataaatctaattttaaattaaaatttaaatgaagaaattcgcaaatatccatttaaagagcatataaccttcaaatgggcataacttggccatttgaactcggaattggaccgttcaagtctctaatttttccttaagaagtcaagaacccatttttgtgctttgtttctgcttgttatatggagtttattagagtaaaagctttttcttttctgttggtcgtgtagacgctgcagcttcggaagatccgctcttcgtggaagtcgaagccgacgtttgggaaagcgagcaaggcaagtcacatcatctttgaacatattgaatcccagtttataaaattatgttgctttaaattattgcattatcgctttatttaaattctcgcgttatcactgttttatctagccatgcccatttacctttgttatgaccttattattgttattgttattattaccttgttcaccctagattaaacaaaaccccaactagtggacactctactcatagtaccactagtataattttaggtagatgcttcgcaatttaattaggtaacattaggcggttttacaactctagactttgggaatgttcataacacctggacactttggaattgttggtttattgtggaactggcttcacaccgccccctctattcaaaatccccaaaatgattttaggctgggctcagggtgcatggttttgatagtagcacctcggccatataaggaccggt

SEQ ID NO: 30319 - DNA, 1501 bp, Oryza sativa
caaatccatcgccgcggcgcgcggcctccttctcctcctcctccgccgcggcatgccgccacttctccgccaaatctaccacctcacgccatcacttctccgccaaatccaccacctcacgccgcctccactaccgcttccaccagatgggctgcaagaggagggctagggtttcccgcgacggcgacggcggcggcggcggcgaggaggagcccgcgccggccgccgcagagagcaagagcctctacgaggtaaatccccaactccaaaccctaggttcatggcttccaaggtgttgccggtacgggtagtggttggtctgatcgaatgcaaaagttacaagccaggtggcccccggaggcgcggatgcggcgcgtcgccggactcgttgcggaacacgccctccaacatcgccaggctggaggacgccatcgagcactgcgccgcgcgccgcaagtaccttgcccgcaccaagagccccttcgacggtgaggatgtccgctggtacttcttgcaaggggcaccccccccccccccccccgccttctgcatccgctcaccgtgtgttggccctcgggctctcctgcttcagaatgctacatccagtaccaccagtttaaccgaccgcttcagtcacttgtggtagctagaatgtaggtttcatgtgagactgttgctgatttgaatatactaattgatagggtactgtgatttagagaggcgttcacatgcgtgcgctaatgaattcgctgattgaacttgcaactcgaagcaacgcccatttacattagattcatatttgaccgtggcatgtcttcatacttcagaactgctgtgctcaattaaattgatcatcggtttggactttaaaattatgaagtgtgtggtaaacgtattactgatcttatgttttgtgcggttcgctgttgacgtgatgctctctgcttcagttccacagacagagataatgggaaaaaggggactacttccggttcagcatgagagattctcttgcattggaggcgtcgttcttggaggttatcttttttaacaccaatgccgccttaagtgtatactcatttatgtgaaaactggactgttctaacagtgataaaaacaatccacttgaaaagcgatattactagacaatctagttccaagagagttgtgctagtccctctacaatacaaggggataatgtcatctcagtctttttaaaccacttgtcttcgagatcacaatactggtttactggtttgtagagggaggaagctatgcttgcatactggtggagagagtacgctaaatgcagcgaagggccaaaaggttccttagttgcagctgatgctagatattgaatatgtctttgttataagaacatacactattgcaggttgatttaatgagacgtcattgcttccctgtgtactggaatgggaagaacaggcgtgtcttgaggggccactggtttgctcgcaaaggagggcttgattggatcccc

SEQ ID NO: 30320 - DNA, 1501 bp, Oryza sativa
acaagataaaagcaatctgatattgcaaataggaatttaatacaaatgataagttggggttccgaagaaccagcagacggacggtctagccgacacgcgcgctgcaagcaagtagcaatggctaaactttaatctattaaaacccgagaaaccctgaaggggtacctagctacttataggatgtgggagaatgaccaagagggtcctagggtcgtgctccactagcttggggcgcaccccacatgggccccacttgggccggggtcccaaacaaagttacaagcccataggcccattataggtgacgcaacaccttgttcctgtgattctggccacacgagatggaattcggagaagaggctggatccgttggaaagagggctccgagaactttccatcaagtactcaaggccgaaaacggaggtcgtatgcagattcggcggccgtttgaagtcagcagtgtagcaggtggccgaatcggattccagcacttggaggacttgatccttatatctccttgttcatccatgatatgagcaatggttgtatccgtagtagtcatggtcacatcaattacaaactaatataattattttttgattgcaccaaataaatagaaattaaaaattttattctctctctatatattacaagatctagatctagatctggaactaggaggtggatgtgatagcaaaataaaaaaattgagaatttatgttaccacattaaaccaatacaacaagaggcatcaagtttatagctagctaagatatatccgtaatcaaatttattttttcttgcaacatgactgtcgacgtttggtatcgcgactacggtatttggatggtatgggatcgttggtaccaggatatatgcgagattaaagtaaaagagacgaagacagggatttttatacaggttcgggccccttatctgacaggtaatagccctacatcctgtttatatgggattgatatagaaaaccacagcgtacaacaattgggataacctatctagccatcgtcgacttggcggcgtgaacaccaactcgtagtcaacgacagggtagttttccttctcgagtatgaactcgtcgagattagagatggcgctagatccctcttgccgacttccgtaggcaccggatggggtatgtctaggcttatctctaatgttgatatccggcggcgtgtgttggcttgtggctttgtggcgtgtcaccactcctcctaggggggcttgtatttatacccatggatgcccccttgtccaagtaagactagggagataaaaatggacacaattggagtaatccttgtcgtttccatatagaactctatttgtcctttcttatccggaactccttctatatacgaggtttgtttctgtataagacatggtatgtggtgggccctgcggagtttagtccactactattaggtatgtggtatccataaccatgacagtagcccccgacttcaatgcaaatgatgtgacc

SEQ ID NO: 30321 - DNA, 322 bp, Oryza sativa
gattaaactgactaattgctcgatgaaccaaacctgcataagcttgctgttctgttgcttcccatacactgaacggaccgactttgattagcctgaccttgaccagaactgctggtgctcatagaacttcttttctttggattgagttgctaatgctggaaatttcggtaacctgaaaattcaccatgctgaaaattcacaaacgcactcctcggtttcactattgatttcttcccttgcgaaggcgaaatcgaaaccttcacaaactttccgtggcacactacaaccttgggtgctcaccggcgacgccttgtcgtctagg

SEQ ID NO: 30322 - DNA, 1108 bp, Oryza sativa
agatcagtagttggtacacacatacatagccgaatcacaacatatcacgaatgaatttaggctaagaaagttaagtgcttacattagggccaggtaggccaacaattatcagagaacaacagcggaagacaaaataattcaagggcccggttgacatgccacaagtagtcgactggggaacgagacctagaacggaaccgcactccggtcatcttgttaagtacgcaagcgtactaacaagggcttctcttcatcactctgctaaaagatatatatatatatagagcaacaatgagtacaaaagtactcaacaagccaccccacaaaatgcaataatgtacaggataatacaagacatggctatgcttactttgcgtaaagctgagttttcaaataccatttcataaacttaagacctagcataaactgatcaagttttaactccattgttcattaaacagcgacggttctgtccaccatccattgtgttcccaaggatagcttcccgccattggtcgtcatggttttctggggtctacctcttcccgcctctcgagaagttgatcaaccagtacaaaatcatcatgcatcatcccacccaatcaatttaagaatttagactctagccaagtgtaatacatgtcccagtgctcaataaccgcgagcacggctattcgaatagatttggtttactcacactgcagtggatgtacactttacccgtactccgcgacttgcccaacacatgagcctacgtcccaacgaatgagacttgccacggcaaagcctttcaacaacctcacattgacagtacccgctccatgaacttgagtcctcatgcactctagacgtcataagtttctagtagtgataggagttctagcactcccgaggggaaaactcatgcaagcctaacattgtatcctgttgttgaacccaatccatgctttcctcttttgggtatctctttgtagtcttgtagtcctgacaagtcagtctctggccatccgtatcgggtatcagccagcagactgcttgttcgtccacacacctaagtgaaaccactatgcaggggtactgcctccgctctgctatctactccgctagg

SEQ ID NO: 30323 - DNA, 1501 bp, Oryza sativa
gaacaagataaaagcaatctgaattgcaaatagaaatgaatacacgagataagttggggtttcgaatacaagcagacggacggtctagccgacacgtgctctgcaagaaagtagcaatggctaaactttcatctaaacaaaacccgagaaaccctgaaggggtacctaactatttatggaggtaggaggatgacctagggatgcctagggtcatgctccacctggttggggcacaccccacatgatccccacttgggccggggtcccaaacgatgttacaagcccattggcccaatataggtgacacaacaccttgtttctgtaattgcggccaaacgacatgtaatttggtgatgaagctggatccgttggaaagagggctctgagatctttccatcaagtactcacgggccgaaaacggaggtcgtatacagattcggcgaccgtttgaatacaacagtgtagcatgtggccgaatcagattccagcacttggaggacttgatctcgatatcttcttgttcatacatgatgtaaggaatggttgcatccatggtagcatggtcacatcatttgcattgaagtcgggggctactgtcatggttatggataccacatacctaatagtagtggactaaactccgcagggcccaccacataccatgtcttatacagaaacaaacctcgtatatagaaggagttccggataagaaaggacaaatagagttctatatggaaacgacaaggattactccaattgtgtccatttttatctccctagtcttacttggacaagggggcatccatgggtataaatacaagcccccctaggaggagtggtgacacgccacaaagccacaagccaacacacgccgccggatatcaacattagagataagcctagacataccccatccggtgcctacggaagtcggcaagagggatctagcgccatctctaatctcgacgagttcatactcgagaaggaaaactaccctgtcgttgactacgagttggtgttcacgccgccaagtcgacgatggctagataggttatcccaattgttgtacgctgtggttttctatatcaatcccatataaacaggatgtagggctattacctgtcagataaggggcccgaacctgtataaaaatccctgtcttcgtctcttttactttaatctcgcatatatcctggtaccaacgatcccataccatccaaataccgtagtcgcgataccaaacgtcgacagtcatgttgcaagaaaaaataaatttgattacggatatatcttagctagctataaacttgatgcctcttgttgtattggtttaatgtggtaacataaattctcaatttttttattttgctatcacatccacctcctagttccagatctagatctagatcttgtaatatatagagagagaataaaatttttaatttctatttatttggtgcaatcaaaaaataattatattagtttgtaattgatgtgacca

SEQ ID NO: 30324 - DNA, 1501 bp, Oryza sativa
ggcacctattcatgcttgctcgtagcattgagagtcagatcatatcaaaggcgaggatgcatgaccaatgtgatttatctcctatttctgaatccccaatatacttatgtaatgatgatgtgcaaacattggaggagcaatcttttgtctcccctgttactaacgttttgcaggaagatcagcacatccaagaaaaggagaatggtatacttgagaagaaagaggatgaagcacctgcgatgtctaaagaaagttcgcaaggtaaattaaatggtgctgagagaaatgaaggtgagtattctcaaggtgagctacacttgtccacttttcatgctatagtagagcaaccattagtagaatcaattgctgagttgcctttgtcacaagttgatttacttgctgttccttgtcataaagaatagttgtgcgataatgcttcacttatatccatgccacaactagtgaatgaacatgctattcctgttgttaatactaactgcgctgattttaagcatgttaccatggctactacggatacaaccattgctcacatcatggatgaacaaggagatataaggatcaagtcctccaagtgctggaatccgattcggccacctgctacactgctgacttcaaatggccgccgaatctgcatacgacctccgttttcggcccgtgagtacttgatggaaagttctcggaaccctctttccaacggatccagcttcttctccgaattccatctcgtgtggccagaatcacaggaataatgggcctatgggcttgtaactttgtttgggaccccggcccaagtggggcccatgtggggtgcgccccaagctagtggagcatgaccctaggaccctcttgatcattctcccacatcctataagtagctaggtaccccttcagggtttctcgggttttgatagattaaagtttagcaattgctacttgcttgcagcgcgcgtgtcggctagaccgtccgtctgcttgttcttcggaaccccaacttatcatttgtataaaattcctatttgcaatatcagattgcttttatcttgttcttgcttgtttcttcgatttgcttgtaggaatagggttgatctgcaccgacaagatcaataacccacggagaggtgtatcgatcgctaaggcgcaacacaacgtctcgtacggttgtagtcggattgtcaacgtttcttccaaatcgtagttatcataactcaccgaaagatcgggccaacaacagtcttgagtgtcgagaggaacttagggtccatcagtaatatgccgatgatatgattttgttagatttttctaatatactaatttggcatgtctgtgtaaaaaaattgaaataaactttgtttttttattaatttacaaataacctttagttaattagtttttaatagcgataagttttttcaataaaccctacaaatttggttttaattgtgcaaataatttatgttcattttttagagatatggaaagt

SEQ ID NO: 30325 - DNA, 524 bp, Oryza sativa
agagaaatcacctaatatatgttgaaagttcatgtttacacctaaaggaaatgtgtactctcatgttgtctaaggggatcaagtggaacaagagcaggtaataactagtcttatcagaaaggatctctttggaatttgaaatatattagtcattgctacatgtttaaaaatactggaacttcctggtgtattattgctggctgaactatggaatagttagccccaaaaatgaagttcatagtgtacacacaatacacaatgttttcctgagattatcccctagcaacatcacactgcaataaaattccctctggtgtttgcatttctatttttcagtcctgtttgtaactttgtatatcttatgtttcgttccttcctcatccttacctttctactgagcttttcaatttaagagatgccaaagataaaaatcactacttattcttctgtgtgtgtgatgcttgtcttttcaggttgcactatgtaattggcataagcttaactaatccttttatttttgcttc

SEQ ID NO: 30326 - DNA, 316 bp, Oryza sativa
gttttgcgagatgttggcttctgctactacactccgattccttgctttcaaatttcccatgttgttacggagaaaaagatgcgtagaagctatcttcaatatttttttttcttttgtagggatggggtagcaaaatcgattaactaaagagttaggaagactaaaccattatttagaatcaaatttatatgtggatcaatttaccctgtaacaatgggataatgtcatctagttaatttgtttattttgctagcatgagtgatatggtcatatcctgaattagttgtagtccacggggttgggaatttcctgtaga

SEQ ID NO: 30327 - DNA, 497 bp, Oryza sativa
ggcgatgaaaacaccaaggcaaaggtaatccatctcgctttagatggcatcacccgttcttggtatttcaatttaccagctaatagcatttactcatgggagcaattgcgcgacatctttgtccctaactttcgaggcacttatgaggagccgaagatgcagcagcatctactcggcattcgccagaggccgggggaatcaataagagaatacatgcgtcgtttctcgcaagcccgatgccaagttcaagatataaccgaagcgtctgtcatcaacgccgcttcggccgggctgctcggaggtgaactcacaaggaaaatcaccaacaaggagccgcagacactcgagcacctgcttcgcatcatcgacgggtacgcaagaggcgaagaggattccaagcgacggcaagcaatctaagccgagtacgataaagcctccatcaccacagcccaagcccaagtacaagcacaggtcgccgaaccggctcctctcaccgt

SEQ ID NO: 30328 - DNA, 206 bp, Oryza sativa
ccccccgcgcgcgcgtacggcgtacatacatacgtgtgatcccatctgccggtctgccccccgtggaccgagggtgtcgcggtcacccgccgtgcgccccccgcgcgtgcccgcaggcaacgtggtcgcgcgggcacgtggtaatatagtatacacaagtctctggtggtaaacggcatccacctcctctttccctctccggcagc

SEQ ID NO: 30329 - DNA, 353 bp, Oryza sativa
attccacattttagttgttaagcaaattttaagaatttgaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccccgggacaggcaggcaggattgagccccctagcagcaggacaccggccctgtgccatgacatctcgactaccgggccgcagc

SEQ ID NO: 30330 - DNA, 1501 bp, Oryza sativa
aaatgcaaatagacatggtacataccatttaccacataaacatactggagcgaagttactatacactgcaacaactacatgtatctcaatcccatgatacgaccactgatcagcaccttaatcttggaataccgccaatttgagtgtagatgtatgtcaacctagttttcccaaattgatccgtacttatatattgtccatgcttatcttacatgtggaatatttctgtaagaaacaatcaaaatctgccatatatataatccctctaacatgaatgaaaataacagaatgacaataaaaagcactatttagcctagtattaactacagaaagcaacagcctagtgaatacaaacctgaaagtcattaagctccacatcactgtgtgcttccctgtcatggtcacatagactaaatatctgctacaaagccctcacaaaccgtcgctttagagattgtgcctcttataaaacaatggagctattgggttaagcataaccttttcagcatagtagaagacctccggaacctgcaaatatccataaattatattatatagttaatccaagccttgcacaatatctggaattctatctcagggaaggcactggttaaaattatcaagtgcatagtacagtagatgtttgatcaggttacacaaaaaattatcaaggcagatatgggcaatacacgtagtacattgttagagatggacagcactgtgttctcaaactgagcatcaggaaaattagtgatccaaatttattactaaagccctgaaaatcaagtattaattccataagactacagagcatttcatcaagctgtagcaatcaagttgtgtacatcaaaatagcaggcaatgcaattaaccatgcataaatgcaacagtgggatttagcttgcacaacaacatgtatcttccatcacagtatcaacacagagtcaggaatgaaaaaaatgggatttaacttgcacaaccaaatcattatagcttcatgtgccaactctttccccttagccttctatgtaacacatgattggaaatatgtgtaaatagaaaaaaaaaatgtcttataccaaggaattttagtgcaagtattttttttacaaaaatgtggagtaggaagcattcctttccttccaaatcacagaaaaaatatacactctcctgctgaggattttatacatgaaggaatacaaaggaatgttagaaatattaacaaatataatgccgagttgatgccaggagtgtatcgatcttagaactgctttgatatatcgggttcccacccacctagtacgcgacaactgtttagaaattagaagagtatcaaggtttgacatccaccgagaattttgaaaacaaattacaattacagttgatagaaaatattagcctacaggatatcaattattaactattcactcttgagagtagttcaaaaaatatttgcttaatctcctgtcttagcactttgtcgagcacttggccggcagaa

SEQ ID NO: 30331 - DNA, 487 bp, Oryza sativa
ccattgtttaacttgctgcgtcgagagtgtggtactaacactagctagatagagctagaaatcaagctgtatatatgagcgaattatacagtacaaagcactagtaaattaaagaggaaaaacgagcatatatagggccgtattttgctgcattccgattattgtttcagttcgctagctaccttttctttctttctttctgtttttttttctttttgcaagagtttcagttagctagttacgtactgtgtgtgtgtatatatcagagatatatctctgtgttgaaatccatagtataaccagttccccgtcgaattaattgtgtcggacacctgatatgtacatactaatgtactagagatttataagatgtggtaggtctgaataaactctgaagaagatggtgatggatcatcgtgcgggctaatatcgacaggtgcatgaccattcagaagcatgcagtgctagctccattgatcaggagata

SEQ ID NO: 30332 - DNA, 887 bp, Oryza sativa
gggtgcggctaacgcgtgggacccacggcgccggccggcgcaagccgcgtgcacccggtccaccgtggaccgtgaggctgccgcgtgggccccactcccgtggacccggtccgcgcgcccctcccctcggctgacgcaataaatccgattttaaattaaaatttaaatgaagaaattcgtaaatatccatttaaagagcatataaacttcaaatggcatatcttggccatttgaactcggaattggaccgttcaagtctctaatttttccttaagaagtcaagaacccatttttgtgctttgtttctgcttgttatatggagtttagtagagtaaaagccttttcttttccgttggtcgtgtagacgctgcggcttcggaagatccgctcttcgtggaggttgaagccgacgtttgggaaagcgagcaaggcaagtcacatcatccttgagcatattgaatcccagtttataaaattattttaatttaaattaatgcattatcgctttatttaaattcccgcgttatcactgttttatttagccatgcctatttacctttgttatgaccttattattgttgttattgttattattaccttgttcaccctaggataaataaaaccccaactagtgggtattctattcatggttccactagtatgaatttaggtagatgcttcgctgattaattaggcaacattaggtggttttataactttagactttgggaattctcatatcatctggacagtatggaatggttggcttatgttggaattggacacacacctccccctctattcaaaacccccataatggttttaggctgggctcgaggtgcgtggttgggtttggttagtcgtacctcgggtactataaggattaa

SEQ ID NO: 30333 - DNA, 781 bp, Oryza sativa
atttactaaatcctactttaccaaaacagaaacctgtgtcttttcttttttaaaaaaaaaactttactgttcatggtgttaagtagtttgattttatgaatttcattggttagccggcactgtacatctattatcatctattatggtatcgattcaatcaagatagcaccagtactactcatccttgttaatggtgagactgtaccgttcttatggtagatactaagtattttagttttattttcttcatttgtctaaagcaatttgtctctgtccaaaattgatttcattttccaaataaaactttgtttaattctgttcccacgagtactgtacaggaagaaaatatataatggtgacactgtaccgttcttatggtagatactaagtattttagttttattttattcatttgtgtaaagcaatttgtgtctgtccaaagttgatttcattttccaaacaaaactttgtttaattctgttcccacgagtactgtacaggaagaaaatatatttgcttctttttgtttagttccaaagtctatgcccctgtataaataaaaattttcgaaaaaaattctgaaaaaataaaacgaattggtttctaaaaatttatgtttcggccagataagaaaaattcgaaatttaattaaaaaaataaaaaaattagttctgtttgctccttttcttttatttttctttttgggtcaaattaattaagtctagtttgtgcagctaacttaaatatatgcattaattccttctttctgtgctcctttaga

SEQ ID NO: 30334 - DNA, 552 bp, Oryza sativa
tgatgaaattgatgtaaacccttgaactggatgattgtaattgatatgaacattttagctatgggcgtactcttttcctttctagggttttctcacgaggtgtgagtttttacctataaaggtttttaatgaggcagccattgcacaatcacagcttatataaaccccttttatattctaactttctgaggtttgtgattctgagatggacttgatggaaaatagtagatgacttgatgtatgcatttgatgaattgatttgaactgattgtaaatctgtgagactgtgacttgataaattggtgacttgaagaattgttcatttgtttgtaaatctgtgacttgatgtatgcatgatttgataaactggtgacttgatgaattgtttgtgattctttgacttatttgatgaattacatgtgaatttcatgaatttgatgtgttatgtcaatttgttgtattcaattgaacctttgaaggggtattttgccagggcgtgcttgggccggcacgggcacgatgggctagccgggccgtcgggccagcccggca

SEQ ID NO: 30335 - DNA, 618 bp, Oryza sativa
tctacatatacgatactcgatactccctccgtttcaggttacaagatgttttgactttggtcaaagttaaactattttaagtttggctaagtttgtagaaaaaaatagtacaccacccattttaggtaattagacgttttgactttggtcaaagtcaaacttttttaaatttaactaagtttataaataaatatagtaatatttataatactaaattagtttcatcaaatcaataattaaatatattttcctaataaatttgtcttggggtgaaaatgctactattttttctacaaacttggttaaacttaaaacagtttaactttgaccacagtgacgacgtgctataacccgaaacggagggagtcgcatttgcaacccaagacaaatttattatgaaaatatttttcaattatggatttgatgaaactaatttagtattataaatattagtatatttgcctataaacttagttaaatttgaaacagtaagttaaaacgttttataatctaaaacggagggagtagtatatatatttgatatatctcttgtcgtcttgtcgaaatggctcggcatagcagaaaccaagagtgacatgccacttgcacctccatgaa

SEQ ID NO: 30336 - DNA, 364 bp, Oryza sativa
attaatgttctagtggtactagttttattgtgaggtttaaacggatgagggttgtagctgagtcaatgacatgtcagccacggcaaattcaaatggacgtggctttgcatacaatattttttacgaacgcaaaaaatttgcacgttaatatattataagaagatggcataatttagttacacaacacaaacggtcagaaagccgttgtcaggggccaagaaaaaaaagaaacaaaaaacaaatacataaacggttagctacagaaaaagaaaactcctaccacgagggagggatgggtatggaaacccactacactccggcctgcatctaggcagggagctggagaagagcgaagatagggcga

SEQ ID NO: 30337 - DNA, 941 bp, Oryza sativa
ccttccttgcgttgcgcgcctcgtttacgattcgggcaacaggggtgcgcgcgtaggagtatgtgtaccacgcggccggtccacggtaccagtttgcctggagaaatataacgcaagtactaagcgaaccttctgtgccgccaggcgcctgacgtaccgtgtcaggcctccgtgcgcgcgcttatagtctgtgtacgtagtaaaaatggccagctggtcaattaaactgcgacgtatgtacgtacattattcatcagtcgttgatcagaaatggttctaaactggctctaagccttgtttagtttcaaactttttctttaaacttctaacttttccatcacatcaaaacttttctacgcatataaattttcaactttttcgtcacatcgttccaatttcaaccaaacttttaattttaacatgaactaaacacacccctagttaaactgctgcagatatccagtgtactgtcattatcataatcatttcggtggtctagacttttgtttctttctctctagagctatatacttcctgtgctcttgtccctcatatcggcttatcccttgattgagccccaagctccagctcatagcgacaattgcaaagctagctagctcgcgtgcgctgaattgaatctgtttagcttggagccttgactacaccatccgccactactactccccgacgagcacaagatgcctgctaaacgtaggcagacacgcagttgatccataggcttcgtgtttgttgctttgtgtaaaagcaacaacttaaccagcaggcagctaggaccgcctgttgatgcattgctcgtctagtattgcagctcgtatttattgtggctgctgttgccacattcggtctctctggacaacgtgcagctagcgcacaccaaggaccagtccagactatagttggccatatggcccgaggcccga

SEQ ID NO: 30338 - DNA, 568 bp, Oryza sativa
tttaggatagtatgcactttcaggtattcttggttgctaaccattttaggttgaaattaagaacgagggtcatgcgatgcctaagaacacggtagctacatcaactgtacactttggtgatccttggtattggaacacactctataggagaatctgacatcacacacttggtttttgttgtcttgcgacacaaaagtccaagtgggggggagggggggaaaggtcgatgagcttttcatgacgagttccatcaaccaaggccatcttggtttgaagatggtgttagtcctagcttgctagaaaaaaaggaagaaaataaataataaaaaaaagaagaggagaaaagagagaccgaagaaaagaagaaaaaatgggaggagaagaaaagagcaagagagctggcgagctacatttggatcaaagaccgcattatgtgcgtgtcggctatacacctcactagtagcaatcatgctgcctggctacacctagtccctctctcaagctcatgtgccgccttggctcagcctatatccactcctagctgtgcacaacctttcgctcccgcagc

SEQ ID NO: 30339 - DNA, 1501 bp, Oryza sativa
ctcgtgtggcgcgcacaatgctctcgccgcgaacgccgccttgttctttgactgggaggagctgctgcgctgctgcccggcatggtcacgaagagctcccgatacacaatctcgaaggagccctcggcgctgactgcctccaccacctcctctgagcaaggctcgtaaatgggcagattgaacatctcgagcttctccttgtcaaccattccctgattagacatgtatcgtaccattacatcgaaatgaaatatggagatcatggaggtacctctattttttaacgttgttcatagtcatatgaaaatatatataagtcatgtctaaaatatttttatgataaaaaagtcaaatatttttaatatattttttttaaaaaaataaaacgaatgatcacatattattttacctgagctgccattttattgaggatgatggagatgtgatcccacatacgtgtgtctccgcttctgaggttgtctatacatttcctcccttttacggagattaccagccatcctcccgggatgatctccttgcctcgtgactcgagaaacaatgtgaagtcgttcataaactgtagagcgtatgcgtcacatacttccggtgaacatattttgcccgcacatatgccctccttgtttgtcagcttgccgatatgcacttcttcagggacctaaatcagtaatcacgattaatttcaagaataagtttctctgaaatcattgtttcttctgtgacagtaattaagtctctgaatatcctgaggacggcaacaaatgtgttaggaacgactcctaacttaataccatctgcgttacaaaaataattgacattttggggatagcaaaatggtcaccaggatactattttgattattagttactcgtaaaaagattattgttggcatcgaaaatcatttcagcaccaacatatagagatcatatagctcccttctgtaagcgtcacaccaagaagtgtaaaatcaaatgtgtttttgattattattctgtgatgaacaattgggcattggagattattggttttgttatttgtaatttattcacgaagtggttttggagatgattggatttcacaggtgaatatacaggaactgctgtggttttatgtggaccggtcagaccgggctctggtagccggtcagaccggcgtgtaatgcacggtcagaccggcgcagcccgtggtctgaccggccgatactgtgttggtttcggtttcgggttgtttatttggatatccgagtttatttcatgattatgacttctggatggatactatacgtatgtaatactattgtttgctgctaatgagtcaagttggagatagcttggtctcggaatatggtttctttgtttgttccatgtgtaggttactcgatgtctcgggagagtatttgcggtgatggaccgggagtcggcttggggataagacgacgtccgtggtggtcagagatcatgcggaatacttaggctagagttgt

SEQ ID NO: 30340 - DNA, 557 bp, Oryza sativa
agaaaaggggggaaaagaactgggccgagccggcccaagaagggaagggggggaaaagaagacttttagggtttttctttttataaaacctttttaactttgtttatttcttctcaattattatttgtgctctgaaaattccactaaaatttatttacacattttaggcttttaggaaatatacaaaaatcctccaagccttatttgacttttaaatttgcacattttaattgttggaggctttcacatggattttaattattctcggcacaattttgaggatgtattttagagtcgttttgggacgcgacaataattacttgataattaaaacctgattaaaggtgggttgtgagcacatggtttggatggtcgtgctcatgacaattaaggaccggttcgcgagctactattgtgaaacatttaccgtgccaaccacaagccagcgtgggcaacggctttaccttttgtatagcatggttcattacggggtgccagactgagaagcggcgagaagtccatggggtcgctagggagtccatgcctctggttgtaga

SEQ ID NO: 30341 - DNA, 501 bp, Oryza sativa
ttgaaccatgttgttcctctgaaattatgaaccctggtgcgtgcattctgcctctgaacactacccgttatattgtactccctccttttttttttgtttgacgttggttagctcaaaattgaactaaccaacattaaacatttggggaaggcggtagtatattagtaattgcaacataaaagaaagtggttatttcgttaaggaggcactatcttggcaatgttgtctaagtgtgattttacatttcttgagaggagaacagcaggtcagcaaggtatctaaataactattaaatgcaccacgactggcaaccaaccaatggtcctgtcctctactggggctaccattttctatggcaaaaaatggaaacagatagtcttagtgttttataccttaagtagtgggggatagttgcagtggtttacaccaaaaatagtgggggcttattagcaatttgcgtattttgattgggcactaataaactgaaaacatgacgcaaaa

SEQ ID NO: 30342 - DNA, 1501 bp, Oryza sativa
cgctccaagcgacgcaccatccaccgccctagtagtagagaggagagactagacgggttataactgaccgcgcgccgtgcagagggcgcgactgatcgcccattagtgctccccggcacaacacgaccagtgggctatgggccggcacagcacatgaacaacccataggcacgacgaaggcccaatgggcttcgcaatagccatcaggcctggccgggcgcatcaaggagcgacgcatgcttctacatactcatcgtgtgaaacgcgcctccaccaccacgcacgctcggcctgcatcctgcacccgcgcacattgcatatctttccgtgccccggcaacaagctcggcactgcaagtctgcagcgcatcaaagcatctctgtctgcccgtcccacgcgtatacgagtctacgtctctacaagacgctcagagcatctcctgcaaagctgcgacggtgtcccgcgattcccttccgcattggcgcaatgaatcaaagcgtccgtcaactgcgctaccactagtccactgctgtcactgcaaggtcgactggtcgagtaccgaggacagggacggccgaacggatgcagacgcgcggcgctgggcaccacttgtgatttaccgctggaaaaacgaagagctcggactagtactaggactaggtagtaggtagtatgaaggactgggaaggctgggtacctgtgattcccttgcttggttgatcctgtcctgccccgctgctgtccgtctgcatcctgccatcgccattcgccgcctcgccacgaccgcacgaccgcacgacgccgcggatgtgtgaagaaaggctggcgcctgcctcggattgagatggagatgggacgacttgagtttagaccatgccacaccggcgcgaaggacatatacgccgggtcgcctggtgtagcagtgcaggcgtagacgagtagagggccagacctccagttgccagaggcagagtggcagagaagctgcatgggcatggtgaggcgattggctgcgccatgtgcctctgtggagcccgtaggcagcaaatgtgttgtgtgttgtgtgcaagagcaacgagaaacaactagctcatgagggcaatttgttttataaattcctcctcctcttcttcttcctatcataaaagaaaaatgcaccacaaataaacagagcaacatagttatttcctttccacagcaaaaatgtggggcgatactcgtcggaggtcaacctcgtcgagaccctcgcaaaggcgccgccaatgctcgcctggtccttcccgtaggtcggtcgatgcccgccaactatctcctggtatggatgactatgggatggataaccgccatatggatggtctggagggagatggggatgatcctacggaacagtccatcatcgaggccaatgacgacacggtcttgtctttgccgggaggcaaggccgagccatccacaccatctgcagggagagcggattgttggcaacacatagaaaaaataa

SEQ ID NO: 30343 - DNA, 1501 bp, Oryza sativa
catacacatgtgcaacaggacggatgggcctcccagacacaaaattgtgcaattccacaagcttaggtggtagtatttaagggtgttttattggttaagatcattgaaacaatatttaatgctgtcttcctctagttttgatatgcaagcttcactttccatgttcatcgcacacgccattagacccatatatttacatctctttgtgagattcacaagtcatgattggggatttacatgaagcaggaatttctaatgtaactgaaagaaaaggaatgactgaaatagaagttgtcaaagtcaaaaagataaaacctcaaaggctattcacgtttttccttctcatacctctccaccatctacaggagtcatctcttctttctttctcctctagtccttccatagtgcgtcatccatactcctatagaaaccttgtgatcaactaactattcatgtaccagtcagtagaaccaaccaatgactataaacgtaattactaattataggaagctcgagagtatagaaaacaaataaattaataaactttcagatttttcaccttatttagttgttagttgaaaaaaacacacgttagcaatatcaagtattttgttatatgtttgatgtggttgtaggcttgacacaccatagttaaaatcatagatttggaatcaatgtattttaattttagaagtacggtgaatatatacacacacttacttatggtttgggagatatttgatacatatgggaatattttaagcctacgtgagattcatatacatgcaaatatagtgattcgatacaaaggagcgaaattttaggatttttgattcctctctctcgctggttttgatggttttggagtccatctttcacaaaggccaactctatcattggctggcgccgcttcgtttggggacctgttaggattatagtagggtttcctccgctccaaatctccctcttgtaggagcaacaggtacaactttcctttttcatagttttttcccttcacagttcctttgcctgtccccggtaatggtcttttcgtccgttgtgttgtgtaatatattaacatataatttttttacgcttttgcgtttttttagtgatgtgacgatgatgtatatggaccgtgtgttctcaattgtatactttcaaaggaactagtaccattcgtattgttgagaggataaacacacaagcgtttaaagtttttaacattgatgaaggggtagtaaacacgcgctgcaaaaaggtgagacaaggtaaagccgagagacgagtggtattaagttcgctcaaaaataaagttataaaaccagggaagcaaaggcggcccgggaaaaaaaagaacccatcgcggccacccgcctcgttcgcttccatcctctccgcagtccgcacccgcgcgcgcgcgctcgactcccgcaccagccgcgtcatggcgccattccagctgcgcttcggcctccggatgtccccctcgcgctcctcc

SEQ ID NO: 30344 - DNA, 274 bp, Oryza sativa
agggagtagcgcacaagctgctttaccttgggaagctaagtaaggccttgtttagttccccttttttttcaaaaaatatcacattgaatctttggacacatacatgtagcattaactatagataaaacgaaaactaattgcacagtttgcatggaaatcacgagacgaatcttttaaacctaattagtcatgattagccataagtgttacagtaactcacgtgtgctactggtggattaattaggcttaataaatttgtctcgcggtttctaga

SEQ ID NO: 30345 - DNA, 159 bp, Oryza sativa
ccgtggaccgcccctttcgcttcccccttccctcatctctctcgggtgccgctccgccgcgccgttggtcgccggcggcgaccatcggggcgcgggtgcgccgcctcctgtcggccgtgccggagaggccgccttcgggcgcgccccgcggctgccagg

SEQ ID NO: 30346 - DNA, 348 bp, Oryza sativa
tgggcgcccctttatgcccataagactatttttttcttaaaagaaaggccaagagctttgcctattacattaaaggaggatagaagtttaaaaggagcaaggaagaagggagtaacacaaaagcgataaaactcatgcaagctaagctagaaaatctctctcctgttgctcaatatcctcttcgatcttgtaaatgatttgttgtggctgaagacactgatcttgaaaagctcacctactctgctccttccaaatgttccaacatgtgtaaatcactaggccatataacctatgcctcaagtccttttgcatcatgagcaagctttatgccaccaataagactatcag

SEQ ID NO: 30347 - DNA, 1501 bp, Oryza sativa
gggggattcgcctgcgtgacggccgacaacgggagagctcggtctcttgaaggcacgacgcctttttcaagatgatgggaaggccgcgccgtctcccgccgagtgctatgtgggcaccctgttcaccaaggcaagggatgaggtgctccacaagtacaccacacccaccgctactccatccactccgaaggaggagcgattccgtattcagggagtgcgaactaccggcggtgggtatggtaagggtttactccggcttttgatggcatcggagaaggagggggcagcggagtcccgtagccctccacctatgaaggtgaagcgtcatttgacgccccctccaatcgtaagggttcccagccaattccaagaggatgaggtgaaatcgccggagccctcgatccacaagctcgccgctcaagtgaagaaactccgcaaggagaacatagagcttaggaatcgcaatgcggagctaggggtagaactttctgaaattagaaatgatttcgatacccttagttgcggtttgtgcgctaagatcaagcgtgcattcatagaggtgggaaaggaaaataagtattatgctaattggatgtttcctttcccatgaataaagtagtagtaggtgcttggtttttatctttccaatcatgtaagcacttgctataaataatatggctcattggtgttaaccccaatgtttcccaaagtttttttttgttttatgttcaataaagttcaggttttgaataagtgtgggggagatatcccagcttctggcgtgcatatactctgaaaattgctgaatatttgaacacctgtgttgacggtcgttatcgatcagtttcgaccgtcaatattaccaaaataaaggagaactagtgatgcttgcaatgcgtagatatgttagaataataatatttcactagtattaggtttactaacctttcgcagagaatgacaataaagtgaaggagaatcgacatcaacacagacgataaatcaatcggatggtgtcgagaaccagacttatgtatgaatgggccaagaactcagaattgacatgatgaattgggccaaaattcacaagttctacgaacaggagcaacagaggaggccgccagctcaaatttggctgtattgggccggccccaggttcggccgaacctggtggttcggccgaacatcccttgcctccgttggatccaggttttggctggacggttgagatgaagccccaatgactgttggagggtattaccgaccattccaaccgtcacaaccatcatagttcagctataaaaggagttcactcgcttcacttcaacacacaccttaagcaagagctctctcattcctctcaagtttagtttggtagtatctagctggtggaatagaattagaataggaatcaagagtccagaagccttcgaaagagttcgggtatggctctagtagctttcctttcctcttttgtaagctttgtacttttattagtata

SEQ ID NO: 30348 - DNA, 1016 bp, Oryza sativa
ccgtggaccgcccctttcgcttcccccttccctcatctctctcgggtgccgctccgccgcgccgttggtcgccggcggcgaccatcggggcgcgggtgcgccgcctcctgtcggccgtgccggagaggccgccttcgggcgcgccccgcggctgccaggtgggcccggccgtcagccgcccgcgcccgcgggtgcggctgacgcgtgggacccacggcgccgaccggcgccagccgcgtgcacccggtccaccgtggaccgttcggctgacgcaataaatccgatttttaattaaaatttaaatgaagaaattcgcaaatatccatttaaagagcatataaacttcaaatggccataacttggccatttgaactcggaattggaccgttcaagtctctaatttttccttataaagccaagaacccatttttgtgctttgtttctgctgttatatggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccctatgattgttattgttattattaccttgttcaccctagaataaacaaaacctcaactagtggacactctactcatggcatcactagtttaattttaggtagatgcttcgcaatttaattaggtaacattaggtggtttttcaattttagactttgggaaatattcatatcacctggatactctggaatggtctggttattgtggaattggcttcacaccgctccctcttttcaaaacccccaaaatggttttaggctgggctcggggtgcatggttttgatagtagcacctcggccatataaggaccggt

SEQ ID NO: 30349 - DNA, 1501 bp, Oryza sativa
taggactgtagttttataaaaaggctttagaaatatatgcagacgtgttgctatgtcccattctcccttagtaagaaacaaaatctcaccatcaccatcctcatcagtatcattacttctaaagtgcaatgaatcgatgaaaacagaaattattttctcataccctttcagttgatgtagcatgaggtatgttgtgttccacctatgtttcacatcaatgccaaacatcctcacaagtttattctttgctcggcaatagtcttggaacatctccttcatcactagctgatccccaacaataaaaacagcttaatggatcttgttgagtaaattagtaacaacagtaatcctgcatagacaataaattccttgtcatagatgcattaaaattgataaattatttacactaaaaaaatcaataaattctcaacgactcctaatacatgcttgcacagtcaggttgatgatgtggcagatgcatctatgatggataacataacctccaatgtagctttacaaatttgtctccaaaatcgtcatggccgttgtatttgctgatgcattgtcaagagtaatagaaaccaccctagattctaaattgaattcttgtagtacatcaagtacaacactaagataagaggttctttggtgcttggatatccaaatgtcatatgtcacagaaaaaggaaagctaacagtactgaatgagcatttcaactcatccaacctagaacgatataacacaacaatattgttcttggtagttttccttgaaacttgggtgtactgtggacaaaaagcatttcggatcatcctctgaaattttttgcttttgcccatcctaatcggtagctcctcagaaactatgtaacaagcaatttcatctcgagctactcgtggctcataggtccatgtacttacagaaccattgggtccggagctcagttatgtctgccaggctcctgccgatgctttatccttgaggtgcgtcaaataatgtcggttttgatgtcctgttcctaaactagaagatggggataaagtttttccacagtgtttacaggtagcacgtgttactagttgaccgtccaccttacccttattttttctatgtgttgccaacaatccgctctccctgcagatggtgtggatggctcggccttgcctcccggcaaagacaagaccgtgtcgtcattggcctcgatgatggactgttccgtaggatcatccccatctccctccagaccatccatatggcggttatccatcccatagtcatccataccaggagatagttggcgggcatcgaccgacctacgggaaggaccaggcgagcattggcggcgcctttgcgagggtctcgacgaggttgacctccgacgagtatcgccccacatttttgctgtggaaaggaaataactatgttgctctgtttatttgtggtgcatttttcttttatgataggaagaagaagaggaggaggaatttataaaacaaattg

SEQ ID NO: 30350 - DNA, 1501 bp, Oryza sativa
aactgtaattatcatcaaaactcaaggcaatgacattatttcctcacaaaacggatctagaagaaaagaccgacgagagcggatgtagatgtgggtgatgcaagtgagccaccccggcactgctgaagaggagggagccaccactgtatcggtgaaggggaaaaggccatgttgttgaatggggaaacaaaccgtggccatggttgggtcgggggagagaaccgccacagtcaaacagggtacactggctagatccggtcacccccaagctcattgcaaccagatctgactactcacgacctcttggtggctagatctggcagtccctaagctctagattgcttccacaacatgggagtggataggaggtgccaccaaagttgatatcgcgatgaggatgtggggggtggtgaggatgatggccggcggagccacaatggtaggagggggactagtggttgttgactgtcgttaagtaccaaattcgaacgtcaattaccttaataaatagaagagaactagcatttcttatgcgcatattagttacaaataatgtagttccacttatccttggagaatacattgaatgcagggattatacaataaagtgtaggagaatatgtgccagcatgcaacacctccggtgaatcacgtgaaagcacatggactgaagggcccaaaagcgagaccaaaccaacatattttgggtgaacccaacgtgcaccatcataaggacccatgatgaggacacaactagctcggatataaccatgactaccctatgtattaatcaaccaaagatgcatatgttctacattagatttacttgttatatatttgaacaaacgttactacataatgagttttgtgtgtttgtttgcagaggtacttgcttggacgaaggaaaagaggccgagcataacgaatgcttggatgatcaaagaagttgattgaggaccaaaccaagaccttctccatgtcttttgtatctcaccacgtcacttttggtccatagaagacaagagataaagttctacacgttttggattcggattcgggcctcctgatagcatcaacttcaaacggacctagccgctgatctagaaagaatttcgaggcccatgagtacttgttggaaagcttatgtagctgactttcagatggttttattactacatcaaaattcctactgagtttccaggaatctgaaaaacaagccacgtatctcatccagtccgaatctgatttgggtttgggccttgtaattgtgtcgtgggcttagcccatcagggtgtgcaccctagggcaaccataggatgtccctaataatacttaaccaatagccgtcatcgcttagagtcgggttttgcttagattactctgtcaagaacagtttcgctgctagatcggtttgtggaacccaaattcgagtgcttaatcattcataagcaatttggttgcaatctatcttgttcttgcatgtgttcttcgattcgcatgc

SEQ ID NO: 30351 - DNA, 1501 bp, Oryza sativa
taacaaatattttctatttttaatcaatataattaacgtttgcatgcttgaaaacatctttttacgacaatatgcaaactattttgcatgttagtgggtagaaaagatttgatgcatggaacttccagagagttaaattgttttatataagaaatattctgcatcaccaaatcttttgccatggaactgtgcttggaacctttcactactaaaaatcgatttttcatagcggcaccatttttttttcattggcggccctgtgcacgcttcacctgccagattgtaatgatgggtgggggctaagaactgccagtgaaaatgactcttcgctagcggttgagttacgtagaccgccaacgaaaatatagctattttcactagcggtccacttaagcaactatcagcaaaaatctattttccctggtggccaccaaagagcaccgatgtattaaacaattcggctcgatctcaaccgtaccgaactctttatgtctccttctccctgccccaccggcgcacccctcctcctcctctcctccatctttcttccccaccggcgcaaccctcctcctcctccttgctgcttcaccactgatgtgcacaccctctcctcctccttcccaccggtggccgcatccatgggtggcggatccggcggcagcgagtgttaaatatatgatccgaattttgggcccacaatatatttagattagttttctaataggctttgtattataggattagtttccgattaggactttgagtctttgtctattaggactcctagatttctcctatatatatcccttgtaagccgcacggggagggtgcgacagcccaatgtatcccctgcgtttgtatccaactcctctatagtgattattgtcggttggcgcccatggttttttcccgcaagggttttccatgtaaaattcgtgtctccgttgtgcatctattttcataacggtgagtcaagtgagaggtcgatccagaggcagcgaaccaaatgggagtggatctggcggcaacgactttcacgtgtggcggtggcgggatggcagcagatggagcactggcgtcagcgccctactcccctcccctcccggatctggccggaggggaggaactaggcagtggtggctaccctactccctccccttgcctccctctttctgatttgcccggaggggaggtggccggtggcggcgcgacaacaatagatgggagagcggcggcggtccctccacttctctaccagatctggccaaaggggaggaggcgaacaatggtggcagcagtagagggagcagtggcagtggtggcgactggcaggtggctccgacggtagcaacagagaggtagctctggcggcagctcattctccaagatccccggcaagcttgtccatggctgctagggttgctagatgtgaaattttttatgtgtttgtttttcgggttctcttacagatgatttgatccatttgatgcacatttcgtgt

SEQ ID NO: 30352 - DNA, 263 bp, Oryza sativa
cacaatgtttctatattgttttttatggttgtatttcacagtttcagctgccttgttgggtaattgggaattgttggttaatgatatattgggcttgattacctttaaacctacagtgatgtaatcaaaatgttcacaaaaccttgtgccactaacttgatccattatcttaaaaaagtttagtaggtgaggcaggtgatgtttagcagatttcattttgtgtgagcttattactttgattcgagcacaaattcatgtttggc

SEQ ID NO: 30353 - DNA, 1501 bp, Oryza sativa
ctcgtccctcaacttttccttgtaggcgtcatgtttcttttacgaggaggcgtcctgtttgaagccttctttccaactcagcttagaggatacgcctctaacccagcctccgtgctcacggttccccagtgcctggcttagcacatccttctccctctgtggagtgaattctcctttcttttccttggttgatagatcatctatcttgtcggcaactacctgcagctcagggtcttcaaattgcactttgccttccgcagtgatcttcggtgttctagctttcatccattgcttcgatcgtacgttccagttttccatgggcaccggaacccccatcctcttcatttcctcctcctctttattccattgttctatcttgggtgcgtaaccaccggaacctagtcgatggtgccatttgttacgcttcgccaagtcggacatcactttactcttctccatttcttccttggaggtcttgaacttaacgaattcgtcccattgcgacagcgttattttcccatatttcttgtatggtgtcttgcccttcttcacgtagtttctgtttaaagtgtttttccacccacgccatgccttgtccattgtttgcaatgcgcaattccttgccattgcttcagatccgtcagggaactggaaccttttctttatctcatcctacagaagtttcttgtcccctgctggcactttatcccagtccttgtaagtgattaggatcttgtcccttacaattaccccacactgtgagctgaactttgcgcgtgcagtggcgggagcgagaggctcccctttgggacttatgtgggtgatgacgtacaccccgttgtttatcttgttgatgctcctctcgccctttctccttttaggagactttggtttattcttggtgtcagaggtcgtagctgggacgtcttcgatttgggtggatttttcggctcggcgtctagatctgcatggggccttttcctacaaaaatcatgaattagtactttcaagtcaaacaatgaattagcaactcaaacgaatatgacggaagacccaccgctttcttaagggggacataatcggcgtcgtcttgttggccatcaacttttctccgccgtttagggcttggatgtgggtcacttggcgaggaatatttgccgggctcgtcagagtcgtcactgctagacccatcggccggtggcctggtcggttgcgaagcaaccacaatagccgttgacgcctccacgttcggttgcgaagcaaccacaatagcctgtgatgccggaggagaggccttatcctcatctcgtttcgcactatctgccatcgttctatattataggaatgacaataaaaattatttaatgtgcgtacatataaaagaatttgaatttattactaactcaaagtcatataaaaaaattaaaaatatctaccactcggacaatgtcatataaccgaaatctcatatcaaagcaccatcatttagcattaacagaaa

SEQ ID NO: 30354 - DNA, 168 bp, Oryza sativa
tttcatttcttcatgttttactgcttagtttacatgtatagatttaatgatgcgttaatgctagtatacatctgcaatgtcatgatttatttatggaatatattaaatcattatatgtctataatctcaacaatccaaaaaccttattataggcactgtgattttaca

SEQ ID NO: 30355 - DNA, 311 bp, Oryza sativa
gcaataattaatatatgaaatctttagcatatgatatgaactatgaagcaaggtggaaaaatggctaaaaccaaattagtaacagatgttccaagaactactagccccagtaaatccttttaattagtggaaggtgcttcagtaagttttccatatagtgttctcatttgggatctaaacttaggattgaaagacacatgcaacaactttattcaggtggagtgtagggcagataatctatgcaaaacgagtagaaacagttgtcatgttgtgtcttctcatcatttataattttaaaatttccaatcagg

SEQ ID NO: 30356 - DNA, 1501 bp, Oryza sativa
aagttatagatattgatgagttatacaactttcttgttgatgactttttcagttgaaatcatttgatatttaaaaatattgtttgaagttgtcataatttgaaattcaaattcaaattattgaaacaaagtcatattgtaaaatgacctaaataaaagttatagatattgatgagttatacaactttgttattggtgactttttcatttgaaattatttagtatttgaaaatgttgtttgaagttgttataatttgaaattcaaattttatataggtcaataaaactcaaatggagaaataaccaaaataacattggtagatctcaataagttatacaactttgtttttgacaaccttttcaaataagttcatttatatgattttttgtgtgttacttcacaatgctacaataaaataaaaataaaaaaaaggttaaacagaggtggactgaaactaggcctattatgggccagcccttttgctaattcctcaccgaaaagttcatattacatccctcctttcaattaatttcaaaatattaaacttcgaatcgaattttatcatactaaacgaacttacgtgaaaaagttgtcaaaaacaaaattgtataacttattgagatgtaccaaatttattttggttatttctccatctgagtttgactgacctatataaaatttgaatttcaaattatgacaacttcaaccaacattttcaaataataaatgatttcaactgaaaatgtcatcaacaacaaagttgtataactcatcaatatctaaaacatttattttggttataaactataagagatatgtaaattttatgaacaatgttactatcactttgtcggatgaacaaatgaccaaaataaaaattatagatctagatggattatacaaatttgttgttgatgactttttaagttgaagtcgttcactaataaaaaattctatttgaagttctcaaactttgaattttaaatttcaaactattcaaatagagtcagacggagaaatgaccaaaataaaaattttgcatctcgatgagttctacaactttggttctgacaacttttccatttgaaatcatttattaacccaatttttgtttgaagttgtcaaattttgaaaattcaaaatttgaattgttcaaatgaacttatttgtaaaaaggagcaatacaatagttgtagatctcgatgagtcctacaattttattgtttatgatttttgcatttgaaacataaaaatcagcctaaaattaaatttaaagttctcattaatttaaggtgaaatgcccattttgaccatacaattttgtaactactgagaacacaccagggacagtttggtaaattcgcgtcggaatgcttcttatccatatataccttgttctccaaaccctagcctaaactccatccacagtatccactccgccgccaccaccgtccccttcctcctcctcctcctcctcctcccacccgccgccgcggccgcc

SEQ ID NO: 30357 - DNA, 1501 bp, Oryza sativa
atttaactaacgacctgtttgtagcataatttggctaatagtttgttttatttgggtaagccagattatttagtttagctgtcatgatttggagtggttggtttgagagccaattaattgtgtgcgcggctggctagggagggttagcatttatcatggaatggaaatattatggattagctgagcttaaccatagtcaaggaaggtttttgcgttaataagtactatttgcattagcatgcagatagagatcagagaggtgaagactcgtgcagctggttgcaagtggagattaatttgctatagtcgacaagcttctggccgggctgatgatcacatacatgcaggcgagcagaaatttgccgtgctctcgcttggctgttttgtgcggctgcgtatttgcacgaaggttggagcagtggcgttggtttggagatgatgaggcgtgattagcgcgtacggctgttaggaagataagagatagatagattttctattttatcagttagtttccttttcggttggaccatggtatctgtatatatacaggtctacggtcgattgaagaaaccccgatcacaatttatcaatctactatttttctcgttctttacttttcctgttttttctattttgcttttatggctgagttctagcaaccctagaatttggtttatctttgccgttttgcgttgaaaaacggtcgtgcttctccacgaaagcgaggaggttatcctttgctagtttgctcggaaactagtcgttcgtcgtcacgtaagtacgatatttatcttctttactaatttgcttgtaaattagtcgtgtgattccgcgaaagtgaattaatctcgaaatcggtttcactagccgattttgatatatcgattttggcgactctattgtttacaccgcaaatcgttaggtgatcttgtgttggccacgaaaaagcgtcgacatattttggcgactccactggggacgagaatttcgggcatattaatttgacggaaatcaatcctgtaccatcgatctatttggctgtagttcggccgaatattttgatctactatttggtttttgtcgtagaatctttcggccataatctatctgctattcttctcatgcgcgcgctgacggttatctgatcaatctgacgcggttggtcattgccgtgctggagcggtggagccacgccgatctggaattctgctagccgcccagtcaccgcttgagataaagtgtacgctaatctagaaacacaacagcagcacacttgcattaacagaagggaagaaagaagccatcaggtcagtgcttgtctgcgttttattttgataaaatttggttgatgtacagatcaattgcacaaaaaaaaaagacttgctggaaaatacatggagtcatacaggagtgctacaccgctgcctcattacgtcaattgcgaggtacaatctgcaaatactttgcctgttccttcaaattattttgctagtacagtgaa

SEQ ID NO: 30358 - DNA, 1286 bp, Oryza sativa
agaaagcaaggaaggacatgttaaatggcacgcacttaccggacagaataggcctccaggggaacgacatgacgcagctgaaacgccagtgtccaattgatttgtcctgcaaccacaagtccagaatcatgaatcatcttcagcagcagccgcagcaagatgggttagtggatttgccctaagcatcagcaacgagatatatagcatgtgttaaatcgtggtacctccagatcctcccatttggtgagcttcatgttagatttttccaagagagaaccgaagtttgtgcagtttctcttgaagcgctgcaggccattgaacgaacctgcagggtcggcgaactcgcagtcctcttcataagccttcagcgtgagattccctgcaacaagtaggaagcaaacacagaaatgtgcacggtgaagcctaaatgataaacaaaactctgaaaattacataaacaatcgcgcgctgcatcaccgatcgattgttcatcagaaacgactcgagttatttaagcatttcacagtccgtcgctgacctgtgacgaaatatgaccgcgcgaagtcatccttgacagcctcggcgacctgagcgcggccctgaggctccgacgctgcttcttctacggctccggcgctgtccccctccgtaggcggctgcgacggccggaagaacgaggcggcgatgccgaggagctcggagccgtaccaggcggccctgaggacggcgttctccgagctggaggacgtctcgttgcccgcgccaggggaagcgggcttctccgcgtgcagttggaaacggcgagcggagcggcgcgttggacgccggaggagcacgccggatttctgccggtgattcgctgcggggagggtagaagttggagagcggacaagcatggccattccttttcctgcggccgccggaggaccggagctgatccggcctcgccaacaaagcgaccaagaagaaatggacttttttctagtagtttttatttttgaggccgaaatatgtttgcctttttcactttcagaaatatatatgtggtgaccaatgacaccatgtactacaccacgcctattatttgagatcgaaatatggaaatggaaaaaagaaaaagaaaagaagaggagtgtgatacaacgttacgcaaaattaaagtatttataaaacacgatttttcaatttaattattatttgaacggtaggtttgtatttatttcataaattttaagatatctataatattctttgaagctactcatacggaaagaatatatgtgtgt

SEQ ID NO: 30359 - DNA, 1501 bp, Oryza sativa
ctcgctgtcatgccgccctgccgccgcgccctcttccctgatttttccccgcgcgtgcgaggcgggcgacgacggtggtgacgaggcgggaagcggcggcggctccccgtgcgcgtgagcggcgacgaggcgggcggtgacggctgcagcggctccacgcgtgcacgaggcgggcgacgacggcggcgacgaggcgggcggcgatggcggcggcggctccccccgcgcgcgagcggcaacgaggcgggcggtgacggcggcggcggctcccgcgcgcgcgagtgggcgacgacggcggcgacgggtcccaagcggcaagcgcgcgaggcgggagccgacggcggcgaatgacgaggaagccccaccgctgccatggtcctctgctatttgggcaaagagagatgggaggagtggtgggacccacggttggccagccaaaatgactctctaagtttggccggtgggtgctgtggtttagctagccatatggcttagccaaccggatagagaggctgttgaagggtattttttttcttcgtatttgccaaaatttagtttggatagccatttggccgttctcttggagatgctctaacaacaacatatgtagtatagtagcaggagtttccagtcgccgagtatattgctagttgggacgcaaaggatgaagcggttgcattggtcactggcacaggaggaagctgtggtggtagttgtagttgcagtgagaagtggacatcatcatcgatatcaagggtgacggcatacagggacgaggcacataaggatgcatcggccggcggtgacaccgaaccaaaatggatgaaaattcagataatcagctaggtagggatctttttagaggaatcgatcaagtagggattagatacagtttagcgttttagcgttctcatcatgtgtgccttttttccacattcagatgcaatgtcatgctgcatatgaaaatggtacggtattcagtagtacaagattatcaactatttctccaaacgaatttattttcacatgtgtgccacactgtgtgctaacttgtgtggggcttgtaggtagcattagaccatcaacctgtcacattagtaaaaaccatttctcaaaccaccaaaagaggattgtattattgtttgcactgatttttcaagacaaggaaggtgttattgttagttgcgatctccggggatcaggaaaccgatccctactccgcctacgcgccctgatcaggggagccagccgttcgtggctgtgggcccctctcacgcaacgcaatactaaatagggggagctgccgggcacgcgaaccaacgttcgccctgtacttggactccccacacaaaccctagtacccaccgatccgggataggcgctgaagtgaggggaagcccgctacagccatcgcccacaccaacaccgtcgtcgtcaccgatgccctcacactgccacaccgtcgccatggctgcatcaagctctaagaccaatgaaggta

SEQ ID NO: 30360 - DNA, 482 bp, Oryza sativa
gacggcctttatttaaagggccgtcagagatgagttacctgtgacgggtcctaactcgccctaggctagcggagaccaacacctctgacggccttctagtaacttgctcgtcagaggtgggtgtcacctgtgacggccggccacccgtcaaaggtgactggactcaccagtgaccactgatcactcaccatgcgcgaagccgtcaaagatgagggtttgggctcgtcacaggtgaccttggccagtgtagtgaacgtagtgcatgttctgtcaggaagagttcagtatttttaagaaatacaattgtgtaccacttgggaggaatcaccatggtgatgttatataaggaaaaaatgatggcgtatatattaattgatttttcattatttaaatgtaccgaagcacaaactagatcaaatttgtaaaacttcaaaagtaattattaataaatcaaaatgttgaaatggacactcgctaggtgt

SEQ ID NO: 30361 - DNA, 1168 bp, Oryza sativa
gttgagttcaaatgtatttaatatcggtagaaccataaatagacgtcctattaattactccttggtaaatgtcattacgttcaaaacgacaaaaaatatagaactggagggagtatatgttcgaattcatagttaaaaattggttttttctggaacggaatggctttggaagtgctaactagcggctcaccctgttccttgcaagtagtagcatcctgcgggtgtaaatatgtctcacaagtcacaaaagatttcccggcgacggtaaacggtggggcgcttataagttataacgtcctgggaactatagacaatagatatagatcatgctagttatatatactaggtgaaataaaccgagtacatgacatggttagaaaccacagtaacctattagcttctttttagagcacatggaatagccagtatattttcatagggctagcttttctaataaggtggcttgttgtcttgttgagtgattttacctggttcctttttctttatcacaccctgtgcttgatatgcacaatgttcagagccccacaggacacaaagtgtctgaaaccatttgctcctgagatgtcctacaagtgtatggaagccagtagcgacacgtttctaatgttgaatcggtgatagataaagggttccattatattattactttgacccaatagtttatttaataattttagctcaactggggaatacaagtcacgtaaccttggatatttaaggaacccatatatatatatatatatatatatatatatatatatatatatatatatatatatatacacatacatttgccctatgctccctatcatattccggtcgcttctaatcaattggtctgccttgccaggaaccttcggataagtcccaactggcagcattgcaaacgaacaaacttgtcaattagcaactgaacagttgaacagtatttaaattgatggaggatagcacatctccttgagagtaaagaacggcagccagggaatactaggccaccagacagagaatactagggacctaatcaagaggaattttaattctttccctatttgggataattttctagaacatagtttctgcaggaagaaaaaagggttctgagacacatgatacctttgactttgtcttgtcacatatccttctatta

SEQ ID NO: 30362 - DNA, 270 bp, Oryza sativa
ccttttccaacacttcggccaccattacattttttttcctaacttgattatacaacgaaggatacatcttatcaaaagaggaatcaccactccaacaatcctcccaaattctcaattgtgtgccattacctacttgaaaagcgccacaagaaagaaaagagttttcttaacctccatcagccctgcccaaaaatgagaatcccctggttgttttcctacaagtgtaattgttttcttagccacgtatgttttttctaagtagcttttgcc

SEQ ID NO: 30363 - DNA, 1501 bp, Oryza sativa
gctcttcgcctcgccgcagccagcgagcaacatggggctctacaaggcgagcggtgcacgccaaagcaagaagccacgggtggagatacccgatgacgacgaggacttcttcatcgttcctgatcttggatgagatgttgttatgtaacagtaatgctatgcaagtgatgtaattttgtatgtatgcaaagaacactgccatctcggttgtactaagtgtgctaagtacatcttactgtgggcgtatgtaattgtaagacaatttgggcccaatacttatcagcatggtgttgggcatgaactatgatgtactatgacatgacgaaagtttgcttgcagcgtgtgttctgttcgtagattattgttgcatatgttctgttcatagaatttttctgtcagatgcttaccagtgatgtggagaatatcattcataatacttaataactacctgggcgtcctaagatagatgaaaacactgagcagtaccgacttaaaattggaacatgacccctaattgaatatgaatagtagaacacaatattcgttcaggagacctgaaaatttcatccttacattccttggctccgggaacaggttacagcgaacatatctgtgatctatgactatgaactgaaacctttggtaaatatgaggctcaaaatagagttagaagatcaacacaacagacctgaacattccttggctcggtgcaattattttatccaggaacaggttacagcgagcatatctgcgatccatgactatgaactgaaacctctggtaaacatgaggctagactagatcaacaaaacagacatgcacggttgaacttgatgaagtgaaaaaacaaaggatcatcactggcccacaatgcagattacctcgccgtataccatttactgaaaaccaccacactttcttataaatcataacatggctaccctaaacaactgagaaacggaatggtgtttcagggaacatgagagcaaacgccagaacctcccaaaccggttgcagtacttcaggttaaatagctcactaaatcccagcaagattatgaaataccaaatcctctccgctctcagcagcatctgtgaattaatacatgactttccactttgttaccgatatatctcagatcttctttcaagatgcttgtgctgcatataaatgctttttggcagtgcacattagatgtcgtgaacactgtgtacaaattcccaactgtcaccttttcttcagcaatgaactagctctcaagaagattttatcaatctcatcaagctcggatactttgagttctttagcagatgaatcggtcctatcagaaagggaagcaatctttcgtagatgctcttcgaaatcatctggttcattgtcattattttctgagggaaacttatccagcttatctagatacaacggttgctccttgctttcctgtacctgctcctcctctgagtccgtctcaaaaatgtcagagagatcctcggattcagag

SEQ ID NO: 30364 - DNA, 163 bp, Oryza sativa
aggtgtgcaggtcggtaagtagggggacgaagaaatgcagtcatttttaggagcagagagagagatagagagagagagagagagagagagagagagagagagagaacacacagatgttgcgtcgttgtgcctgacgaactgacggattttactgtcgtccagg

SEQ ID NO: 30365 - DNA, 1501 bp, Oryza sativa
tctaaaaaaaataattagtgatactgaatatagaatatgttctacatctttttttggctgtaaaagtgacaaattctccaattagtagttttttcatgcctactaagctatgctaatttgtcgcaattccattttaaatcactattacataaatcgattttgatagacaagaccctctccaggctgaagatggctgtaactgcatctgcatgcaaaaatggctctgttggatcggttcaaggctgcatgtgaaaatacattatcccaaacagccacttaagaggtctgcctccaagtcctaccgttctctcgtccttctcagcatgcatcttcaaaattttccaagtcctaattattatctcctcaccttctctctcaccccaatcctctcctcatctttatctctctcatctcccctctctcatttctcacctcctctctctcccttgtctacacctcccaagttgcagcctgctagcgggcgggtgcgggcagcggtgggctcgagtgggagcgcgcaggcggcggcgagcttcgtgacgcggatcgacaggtggggacctaggcgatggcaagaacctcgagcggggtggcagcggctcggtggcggcgacaacaggatcccttctctctcaactcccctcctgcatggatctgtccgccgcctcctcttcgaacgggatctgccgccgggtggcaccacgacaggatcggccgccgggcagccccgtgacggggaagggtgaatccgctagggtttcaggttttgggtttcaagttttagttttttttttcatgatttttcttttagcagtgcagtgacataatttaccgcttgtgaaaagtggaatttcatggacgggtgtgccatctgcttgtaaaaatagctacttttactgacacctccgagcaggcagacggcccaattgcatgcgaaaatttgttttgacggtatgggaacatgcatttttgtagttttgaattaccttatatttaatcaatatacatattcaagttggcatgaatacattttcatattctgaattgtccgggctgatcaatttgtgatagcgaacagaatatgtatttagttcacatgtacatagtatcttcctctacatgggcatattccatgtactatctgatctaaatatttaatgcatatacagccattattgatgggtggaaataaaaccaaattagcacatcgatgtccagatatgcaattcaattggtttgccagatccaagtcctcgtgaaacaaattatatacttaaagaacaaaagtttgcgtatggccaatcatctcctgccatttaatcttgcattctgcaagtatatatgctatttgtacgtactcatgctaccaaacaatctttcttcaagtttgagcttgaatagttgttaagggaaaggctttcatgagttagtagcggaagtttggagaaaagagaacaagggttctatgatgatggaaagatagcaaaataagatccataga

SEQ ID NO: 30366 - DNA, 172 bp, Oryza sativa
cttgcctatgtgggaagaaaggatgattgatcacgcttgtcttaaaaaatatagtagcaagtccttcaccttctttttgagaacaaaatagcagtcataattagtgatactggcgaaagggtctgtaacctattggttacaagagcctcagtagtacctgagatcctcccca

SEQ ID NO: 30367 - DNA, 962 bp, Oryza sativa
gctttttccagtgcaaatgcatgttcaggatcactccttgatatattccacgtcttcctacaggcacataatttttacttttttgacccatcttgaggaaatagaagtgctcttcaggtgtaagcacctcaggatcatgggtaggttctgatgggtcatccggttcaatcttcgtcaaagctgcaacaagtcgttcttccttgtttcgagccttttaagggccattgcaaaaggaaacaatgaaagaccaatatgttagaggagtgaagattccacaacagaaccataacaaaaacaagcaaatatactttcattgtaatgtgaacactggcacatagatattgttgcaatgcattgagtatagaaaagacaatcaaaatctaattagactcttcggcattgaaaattttcatcatgagactatactcatgaacataatgaatgatgattagcggtgtgtggctttgcttctctgatatgctagctttctgggtgggttttgcctgtgtatgacaatgttcttgttttgttttctatggtctgtgaccgtaagctggaaaacccagcaagaactacagtacttgttatgctttcttctaaagctgggcgtaatgccttccctctaaaaataactacttctgtccacaatgaagtttgggtatccttgtaattcccaacatggcatgacatggaaagcagtattaaaaaaatactcaaggtcaagttaaatttgagtagaagtaactctttttgcatgaaaaagaactcaaatcaaatatatgagctacaaaacatataaaggcaatggcaacagaatttactagcttcagtttgtacaaaatcttctcctccgcagtcatcctttgaaactcccttttcttcttccatctcagggatttcaaaaatcttgtcactgccctccttccttttaactttttcctctttgctttgggcctaccaga

SEQ ID NO: 30368 - DNA, 1501 bp, Oryza sativa
tctatggatcttattttgctatctttccatcatcatagaacccttgttctcttttctccaaacttccgctactaactcatgaaagcctttcccttaacaactattcaagctcaaacttgaagaaagattgtttggtagcatgagtacgtacaaatagcatatatacttgcagaatgcaagattaaatggcaggagatgattggccatacgcaaacttttgttctttaagtatataatttgtttcacgaggacttggatctggcaaaccaattgaattgcatatctggacatcgatgtgctaatttggttttatttccacccatcaataatggctgtatatgcattaaatatttagatcagatagtacatggaatatgcccatgtagaggaagatactatgtacatgtgaactaaatacatattctgttcgctatcacaaattgatcagcccggacaattcagaatatgaaaatgtattcatgccaacttgaatatgtatattgattaaatataaggtaattcaaaactacaaaaatgcatgttcccataccgtcaaaacaaattttcgcatgcaattgggccgtctgcctgctcggaggtgtcagtaaaagtagctatttttacaagcagatggcacacccgtccatgaaattccacttttcacaagcggtaaattatgtcactgcactgctaaaagaaaaatcatgaaaaaaaaaactaaaacttgaaacccaaaacctgaaaccctagcggattcacccttccccgtcacggggctgcccggcggccgatcctgtcgtggtgccacccggcggcagatcccgttcgaagaggaggcggcggacagatccatgcaggaggggagttgagagagaagggatcctgttgtcgccgccaccgagccgctgccaccccgctcgaggttcttgccatcgcctaggtccccacctgtcgatccgcgtcacgaagctcgccgccgcctgcgcgctcccactcgagcccaccgctgcccgcacccgcccgctagcaggctgcaacttgggaggtgtagacaagggagagagaggaggtgagaaatgagagaggggagatgagagagataaagatgaggagaggattggggtgagagagaaggtgaggagataataattaggacttggaaaattttgaagatgcatgctgagaaggacgagagaacggtaggacttggaggcagacctcttaagtggctgtttgggataatgtattttcacatgcagccttgaaccgatccaacagagccatttttgcatgcagatgcagttacagccatcttcagcctggagagggtcttgtctatcaaaatcgatttatgtaatagtgatttaaaatggaattgcgacaaattagcatagcttagtaggcatgaaaaaactactaattggagaatttgtcacttttacagccaaaaaaagatgtagaacatattctatattcagtatcactaattattttttttaga

SEQ ID NO: 30369 - DNA, 1501 bp, Oryza sativa
acaatggcaacgccgctgacggtttggcgggatttataaaaagtaaaaaatgaatccgaacaataattatgttcgatttttaaaatcccaatgacaataaagagaagagatagtggaggggccgtagaggagtataatggcagcgtttaatgggacttctagaaattataaaaatgaaacccagcgagataataaactctacaaactataagatccaatttttaaagatttaaaggagaatgaatagaaatagtggtaaatcgagcaagaaaataaaggagatgacagaaataaatggtatttgacttttaaaagctatataattagaagcacggagatagctatataattagatgacagaaggtttggtcttttaaagttttaagacaacaagattgctacttaataaattttaagtaaaatcatactaaatatatatgattttatctgggtgctagccatgcaattacgtgggccacccaagctatataatagcccacaagaattgaagatctagaaagaggtcggaaaagcagaaacaacaacagaatagagcgctgggtgacaagtgttaggcaattttttttttcttataatggaatttattccggcctgtgcaagcgacggccaattaattacaaaggtttcttgtcgaagcaaattaattacgaagattgctagtcgaaaactgcgacttataaaattacaacttaattctaaaaagaaataattcaaacatcaacccaaaacggggaaaacactattggcagcacaccagcagaaatgaggctccaatttgtcttttctgaaagaacaatgtccattttctggagtgccaagctgctttgaaatgccttgttggctgttggttttttcaccgagtgaagcttatggacgcgaaatggagattgctcgccgacccagacgagcagattgtcgcgacgtcctcgagcagctccggcggaccgctcgccatcatgcggacgttcgtgccaccgatctccagcaatgtggagattatagataccccatatctacatgacagttataatttagtcggatatacggtaccaaatatagatagaatatctttatgaggactcgggttagtttctaacttgtatgtgaaggaaatacccgagatcttagtcggttacgattgtattttatctgtgattccatattctgttaagatatggactactgtactttgtaaagcggactccttcccctatataaggagggtccgtgtgcctctcggggcacggtactttttttccagtttatacaatcaataacacactcggcggaatcatccccggacaggagtagggtattacttcttgaataagaaggcctgaacctgtataaaattccttgtctccaaacccatccactttccaagcttgatagccacccccttttattattgccgaaatcttgtttcgacagttggcgcgccaggtaggggtagcgtcaagtttatgccgactaagtgcga

SEQ ID NO: 30370 - DNA, 1501 bp, Oryza sativa
gcctcccactgctcccgagtgagatggagcttcccgccgatggtgatgggccccgagagaggctgtggctcatcaccatcgacgaccttgaagcgatctaacgcctcctcgatcgacatcgtggagaggtctagcagagattcgatcgagcgagcgatctgcctgtacttctcagggacgcagcggaagagcttctcgacagctctctcctcgtcgtaggtgtcgtcgccgtactgcaccattttctgtaagagagtgttgagacggagagcaaagtcatcaacatcctcacctggcttgaaggccaggttctcccactccttgcggagtgcctgcaatgtggacttgcgggcgcggtcgctgccgatgcgtgccgcagcgatggcgtctcaggcctccttggcagtccgcttctgggaaagcgagaactgcatctcgggcgggactgcagcgatgagggcatctagtgcccgccgatcctcgtcgtagtcgacgtcgccgtaccggactgcctcccacatgtgccgcacctggagcctcaccctcatcaccgcggcccactcgatgtagttggttttggtgagggtaggccaccccccgcggggaccaaagtccctgaccaccgtctggacgccgtggtgaccatggcgccggtcaggggagagagagccgcgctgcctgcgagggccacgtgcgggctccgggcttccgccggcacgcccgcgcccgtctgggttcccgtcggcgggcgcgtggtcccttgggccgccgccaccgccgtggaggtgggctgctgcccaccgctctgcccgctcccgtgcccttcctcttgccagctcctcaagctccctgtcggcggtgatgtcgccggcgatggagccgttgatgctgctgcgcaaggtctcaacctctacctccgtcacacgtgccgcatcttccgacgcctccgcctccgccctggctgctgccaactccgctgccgccagtctggccgcccttgctgctgctgcagcggtctgagccgttgctcgcctacgctcttctgctgcggcgagctcagcgtcctgctgacgccgagtgctcgaggcgacagaacgccgagaccgagcgtcggacatggcgcacctccggggggctgctgcgtggagagggggaagggaaaggggaaggaggagcaaccggtgctgctgctgctgctggctgagagctcaaccgagcttgggaaggggtggaacaagagatgtttagcctacaggaaagtgtggctctgataccagatgttagaatttcaatggttactctcattgagaagaggatggcactcgagatggggcaattttctggttttcttcattcataaaacacaaaagccatacctacccgagggaggttggatgcatatatatagccatagctggctgctagcctattgctgcaccctcctagtctaaaatttgaaatttgaatgagatgttgtcctagagggcatccaaactgaata

SEQ ID NO: 30371 - DNA, 157 bp, Oryza sativa
tgtttgttgaatcagttaacaataaaggatatcacgcccaggaatttgctttgatgaaatcggatcccccaatcgctcaacgccaatcacctcgctgccaaactggtcagggaagcggagaaccaagaattcggtctgaaacccaaccaagtgcttc

SEQ ID NO: 30372 - DNA, 1501 bp, Oryza sativa
ccttgccaggacacctcgggtagtagagaccgtggtcgagagtccccgcaacgtagcggatgatcctcttcacagcctgctggtgctccgtcgtcggtcgctgcatgaaccgactgacgtagccgacggagaaggccaagtccggccgtgtgtgggtgaggtagcgaaggctccccacaagacgccggtactgtgtagcatccacctcctccgccgtgctgtcgcggctcagcttcagtctctcctccatcggagtaagagctgggttgcaatcggtgagcccagccagctcaacgacgcgcttggcgtaggcggtctgtcgaagcgtgatcccggagtcgtcctggtgcacttcgatccccaggtagaaggagagaggccccagatcactcatctggaaggtggccttcatctccttgaacgccgcgacctccgcatccttggtgccggtgatcaccaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccggggatcacaaatctcggcggctggtgcacgtagacctcctccttcaagtcgctgttcagaaacgccgacttgacgtccatgtgatcgacgccccagccttcctgagcagccagcgcaaggagtcgcacggactccatccgtgccacgggagcgaaggcatcatcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcatcgcacgcaaggtgcaactgcgccttaggtcgcgaggcaccagtcccggcaccggctggtcgccgagaagatcctccatcgtacggtaccgtagctgctcgccgtcgtggtacgcgtcgatgcgctccccgtcgtgggagagcggagtagcgaactccaccgggctgcgctcaacacgagctggcgtcggagtagacgtgcttggaggagtggctgttggtgctggagcatgtggagtcactggctggggtggtgtcgacgaagagctcgtcgtagtcgaagtcgtggcccgagggtgtgttggtgtcggagtcggtggagattcgggggctagggtagacacgctcggtgaagaagagctgcctactcccccagctccctcgaagtggacgtactcgacggtgaagtcgtcgtacgtcggagtcgaaccatcgtccaccgcc

SEQ ID NO: 30373 - DNA, 1501 bp, Oryza sativa
cttctcaagaatgataaaattattcttataggactgacacacattactacacacgcaatacgttcacatactcacgaatgcatctcctaacaaacggcacattcctaatattgataaaattatttttaaaagtctacttaattacgcatgtgtaatatccgttggcacccaaacttgaatatcggttggtccctaaaattaatcttaaaccctagcattccacgaatattttaaggagaaaaacaaaagaccataatgcatttaattaatataaaagttgtatttgttgaatttgtagatgtggggtattgaagtaatgaaatttctcgttttgcgaattggtggtagccaagaaggtagaagttgatttattttgcgacaaacttcaatctttataagttggtttatttcgggacagaggggagaagtgccgtacaagatgacctggttgtccagacttattaattaacaaaataaaacacgtgtagtgtcgacgtgtagtgtgggcatgtcggatcggcgcgcacacacacgcgatgataacatgatagccagccggcaggtagatcgaaaatataggaaggagcttaattagccatggatggcgcgcaggtagctgcttcattcagttgcgcacccagagcatgtcgtcctgaggcaggaagtggcagactgccaccttcccgggcgccacgccgagcctcttgtacgcctccgccaccgccacgccgtgcccgtccacgtccccgtggcacgccgccaccgcctccgccatggtcccgtcggcgccggccagcgtcaccgtgtacgccgcgcccttgatcccgtgcaccccgaacacggcgtacgcgtagggcatcctgtggcatgccaccatgtcgcccccgggcaccggcacgggcctcacggcctccaccctgtacgcctgcctcggcgtcggcccggccctgttgaccacctccgtggacacggcgtggacgtcgcgggtgccgaggctggaggcgacgagctcgaccatggactcgagcgacgtggcgcagtagtgcttgtgcttgggcgccgtctcgctggcgatccgcgcggcctcgcacacggcgagcgtggaccgcatggcgtcggcggtcggcgagccggcggggatggagagctgggagaggatctccgggagcttttcggaggcgaacgggacggagtcggcgcggccgcgagggagcagcgcggcgccggcggtggcgcgggtgaagtggagcgtcatcttggagcccgggaagaggtccttctcgaggaagaacacggagcccaccgtatcctccttatccttcgaagctgaggccgctgagctcgccgggctgatgaggtcgcgaatggcgccgggcatcggcgaggtcgggagcgcgatcttccagtacatctccgccggcgacgcggcatggctggctcccgcggctgcgacctgaaatgcagtcagaaacaagttgaatttaaaacggttaacttcaga

SEQ ID NO: 30374 - DNA, 1501 bp, Oryza sativa
ttctaatgcatatcatctagaatatgcttaatgcttgggctggaatatatatacacggaatggtcatcgtaggcgggcctggcctgagtaaggtgtaaacatatccgagcccttaaatggccttcctgtgaaaaaccaagtcctcttcataggcagccagttttacagccagcatactatagatgaaaacggagcggataattcatggatagtccggataaagatatttttttatatgaatgtgaatatggtatatcagagttttcgatgaatatgaataatagaaggatatccgatgaacaaaatgctattcagatatccactgaaggcatgagacatatctcatttctttctaactctagaccttcaacttacttctttagaattttaatagtagcccatctcatgatactagcccacactattaatattacttaaatatttaaatatttttttgtaaattttactatattttatattataatttcagttagacatgtatttatatcaactctgatgtacatgttaaacttaattagcattgttgactctatgatcaaacttattatataaaacgatatatttatatatgatagtatttgtttctattagaaattgaagtgtttttcatgttctgagaaatatttatttccctattcgtgtccgatcatattcgatctttattcatattcgagataattcatatttgttttcatatccgagctttcgtattcgttttcctatccgacagaaaatacggaaagaaatattgtataagcattatccatccatatccgctccattttcatcctaagcacatacaggacactcaggagacccgcttgcgaaaaaaaactcaggtggagtgcttaagaacctatttgtgaagatgactttttcgcgggcagcccgtatactctcgggagcctatcgtattaccggcgagccttctcatggccggaaacggatcctctgactttggatggaaagtcacggtcttgcaattcacttcatcccagccaaccactgcatccaacggcacacatccatcttcccctcatttgcctgcatatgttgggagtagctaagaaaatattttacgtagtggtgtatacaaccgtgtaacattgtcatacaagatgtatggatcgatgaatcgtacatgcagacttattaacatgctgccacaagtatagtagtggcatttcgggtcgtcgcatacacatatgataagacatgatacgcatatagctccaaaatataggaaggagctatcttgagatcacacaatttttatcccctttcacgcgcgcgcgctcagttacgcacccagagcatgtcgtcctgtggcaagaagtggcacaccggcacgctcccgggcgccacgccgagcctcttgtacgcctccgccacccccggcgccgcgtcggcgtggcacgccgcgagcgcctccgccctagtcccgtcggcgccggagagcgccaccgtgtacgccgccgcc

SEQ ID NO: 30375 - DNA, 1501 bp, Oryza sativa
gccaagtgtaatacatgtcccggtgctcaataaccgcgagcacggctattcgaatagatttggtttactcacactgcagtggatgcacactttacccgcactccgtgactgcccaacacatgagcctcgtcccaacacatgagatgcgtcacggcaaagcttttcgatgacctcgcattggcagtacccgctccataaacttaaatcctcatgcactctaggcgtccatgtttctagcagtgagaggagttctggcgctcccgggaaagagaagtctcacacatatattaaattatggttcaagttaagttctctctctcacacactcatggcagtcctaccaatggcgacaccgatgtagggcacgcctctcggccctacctcaacggctgttccaccgtagcgcacctgcctcactcaggggtgaaccatctatgcagggatactgcctccgctcggctatctaatccgctaggtctatacccatatgagaagtgcggttgtacgggggtcgtttcatgcttaacttcatggctcggtccttaattgaccggggacggtactagccttttccagataccacccaaatcctccgtccgccccaggcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcatcattgcatgcaattttatttgtaaacaaaacaatttcgcaattgggatcaacatgttcaaggaatagtgatgacttgccttgctcaggatagtccttattcttgatataattcttgatcaaccttcacctcctggaaattgctgacgttgcctcacgactaaccgatacacaaagtctataatacgcgagaaaaaccaatattcaaacaacaatcaaatatgcacaaacaaaatatatttgttgaggttgaacctaaggttgctcatattattcgcgcttgctaatgggttccaacatgctaagggctaaagtttcttaatctttctgttatcatggtggtctatttaggagctagccaatgtagtatgaatgagatacgtatctggctaatttgtggtttagtctagctaatggctatggaaggattatggctacacatgcatctatctaaataaaatggtcgtatactagaggttctgttgtcgggtggatttaggatcaatcaaataattacagtgaatcatttgtattatttattttattgatggaagctttactttaattatgaacatattttacttgtcacaataaattataaaaggttaataattatcca

SEQ ID NO: 30376 - DNA, 1501 bp, Oryza sativa
tatcaattcctgtaaaaaagcaaatcaatgaaatattaaacctattgataggatttattactaacaatttccacgagtgttggtgaatattgttgacggtccttaaatcataatatctgaccgtcaatacctgtatataatgaaataaaacatggtatccaacttagtggtaggtattattactaatcatttccactagtgttggtgaaatatgtgtatgcaagtaatttgaggagaaaacacatccgtcatatgacaaaatgcatctccgcgtattcaggacatatttacacggattagatgcccaataagtcaataaaaaccatttagaattgggccaaaacatagcccaggttgttgggggcccaataagcaacctcccagcccaaggagaggccgggaggagagtttttgggttcggccgaaccaatcctagcgcttcccgccatctgctttcacctagacggctcggatttcttcccagaggcggttgcaggttgttttagacaattcccatgcccctaactgtcatttggagcctatataaggaggagctcactcacattccaatagacacaactttgagctgaattacaagaggctctattgtatcttttgtacattagaataaggtagagagtaaggggaagctctggaggagtgcccggaagtttggcgctcatccgatttctacctcgacgagtgtagcttcttaggaggaattctagaggagtaccggagctgtcggtacactctgctccaggttcggagaacttcttctataaagtaagcattcgtgttcctttcttatgttatttaattatttagtctaagtaagataggttttcatctttgcgggttcattgtttagtattcatactaagtgctctagtactaggactcttgataaagaaggaagttcatgtacaagtattagagtagtaattaataacttagacgtggtgtctaggttacagattacctttgtttattgtgtattccacggatttgtcagaggtaggcggcaggtggtgatagctttgaatcccgtcccaataatcctccacgttcggatacatcatagagctatagccggaaccacgctggcagaccagcaggggtcggtgcccgaagcaacagataggaaattacctttgcttagcttagataattaaaacacatagaatgctcttctctagcttgcctagcctacctatagttgttgtccctggattgccttagccttaggtagattacacgcgttccctgagttcgatatctttttggggtcaccgaaggtgaaagtgctacagcggtattccgtgcgcttgcggatttatctgtggtcgtaagaaataccaacaagcatttctggcgccgttgccggagaacggttgctaatctttatttttatttcttcttcttttattcctttccttaatggagcaacccacaattcaaaacctttctgctcctcgggctaatctttgtgagccatcgt

SEQ ID NO: 30377 - DNA, 1501 bp, Oryza sativa
tggcacagtggttggccctatttgcaggtattctattggatttgtaagcccatccatccataagtctgccacttctcggacttcgattgattgtttggttattttccatcgattcacctccatttatgtggagatctatgtattcaaataaaattcgaagtacaagtggagatagtgttgatgcaaaaaacacacacaggcctgggagatctgcttagctccagtgcaggtccaaaggttgatgaggtgcgggcgtgccagtcagtttgatcctgcaactgacaagatacgtaaacaacatatcaaatagccagccgatgccgataccagccgatagtgatagggttctgagctatcggctatatgtccaatgtagataatgatataaagacaatcggctgatgataatcaatataattatacaatataatccagtagaaaccaatcggctagcaatgatataatagaataagcactgatccgaaggttaaagcatatacattggctggaggtccgatgtcatgaaatccacaagattagattcaacaatgaaacctttattgcaatcggctaaatccaacttatatgtaatctttgtaagccgatgcaacgtccagataacttattagctagcaccctgataaaacattagcatgaacctatcggattaacaagacttatattatcaacaacaatctagtaggtcgaacctaaccgatgcagcacgagattgtatatgataatctaatactcgatgagccgatagatttgtctaatgtgatggatataaaaaatctatttataacagcattgtgattgtaaagatatatcggctaaggcagaagattggacctaactgagacagtcccaactaaaccgatgcatctctagacacaatgcaactagagatagaattgagatatcaggtaggcaaatgtatcaaccaaaccagagcgatctaagatattgaagcgatgcagccttgaacaacaccaacgtagccggcagattcaccagggctggtggaacgtaggacttaccccttcgctggagatcgaactgaaccgatgcagccccgcgtcaagtgccaaattctgccggttgatatgtaaaaacctcgggaaagagggtggcgatgcgccgaaagtagtattattgatcaagagataatttacaataaccccgggtgtacatatttatacccatgggtaaatactagtccttgtagaacaagaaagaaactttcctagagataaaaggaaaacataaagtccttatcggacactaaacacacattcctaaagataaaaggaaacttacaaatactgcctaattaatagataaactgccatgtcacatcctccttgaactcggactcttctagataagcttcctttaattgatccaactccaccaagaacacaactgctggcgatttgacgactcccatcggccgattctaagactctgaagccgatactgactctaggccgatgatgaa

SEQ ID NO: 30378 - DNA, 1501 bp, Oryza sativa; identical to SEQ ID NO: 30160

SEQ ID NO: 30379 - DNA, 1501 bp, Oryza sativa
aaccgtttggtgacatgatttattttccttaattttacgaaactggagttttccataattttactactatcatttctgtccatacaaaaccatgataccatacagacaacaattttctgtacactgacgttttacatggaattgaagacaaatattaaataatatttctatggcacaagcgtaaatacattggtaatatccttcaaaactagatcaaatcttgctagtacatatgatacgttcgataaaaaatacttgatgatatattataaaaatcgacactgatgaaaccaataatacctactcaggtggtgtttgaatcttctgaagatgaaaatgaagattagatgtttcacgcaaaacgaggtgataataatatgttattaattaagttttaattattataaactttaaaaataaattaatttgatattttagagcaactttcatatagaaagttttcgtacgaaacacatcgtttaacagttttaaaaacgtgccacgataatccgaagtggatggcgcacagttttgacggactcatacagggatgaggtgtgactgaggtggctgtcatgtagtagaggtgcatggaggaggcagcatgggatgaatcggctgcttccatgcgagaaagtcacacttatcacgtttatactgtcgacaatatacctacaattgcagcccctgaaaagaatattacaacccccttagaaaaaagaatgaaaaacgctatatgatgttatacaacccagatttctattaaaaaaaaagataaaacgattactcggatcataattgagggtgtcaaagtatacttttttttctttcatctctaaacactaggtatgagtaatccgcgtacggatgcatcatatatgggccgcattgctacactgggcctaactatggtttggacgatggtcgttccaggcttcggtgccagtggcaaaggcaagaccaaataaccacttccatttttcttttccttcgcaaagaatcaaagtccagttgactagtttacgagttgcataaattccacggatgtgaatcagattccaagcattcaacagcacgtccaacgtacacgacaagacgaaatggttacaactaatttactaatcatcatctgggattagcatttttttttctgcctgccagatgctgagatgatttgctttgctgatcacaaaagaaagaacaaacccaacctacagccagctttgaagccccgggtttgttgctgatgcatggcattttccagactggaaacgcagagcaaaaattcgcagcaacggtcctccccccatgtgagccggtggggcccaccgccgcccgctacacgccatcgcgatcccagcgaggtccagccgtgtagtgagcgagagcgagagagagccgttgtgtatacttaacaatgccaccgttgtatatatacaatccgtgttgcaagaaaatcaatcgacataagcaagggaaatatcagcatctgcaaaaatca

SEQ ID NO: 30380 - DNA, 349 bp, Oryza sativa
cgaaagtactatcctgatatcataaacttattaaattttaaattaatgtaatattgatctaaacgtcaaatatttatgactgaagggaatataacattacctcccacaccaccaacagttagtattgactgagcagctacaccacaagcctctgcaagagccattactccaagtgcaatcagtcctaatgacgagatcttatcaaatgctgacaacctggtttgatcaatacttgaggcagcaactttagtgatgaagtttgttttccacctatgaaggaaccagacaaaagagagaacaattgcacccctccatgcctgtggaagataagctgatatgcttggtgcgg

SEQ ID NO: 30381 - DNA, 1501 bp, Oryza sativa
aacatacctgctgctcccttccactactgttattctcttgagactgatcctgctgaattggcaccggctgattagcttgctcgatattaacttcattgctttcattagtctctgttttgatctcaccaccgatattcaactgttgcgactgtccttgaccagcagaaaaaggttcaccaatttggagtggcttgatacgctgtctctgactactaccttgtgcctcctggaaaacagtcattttccttttacggttatccatcctgttcttcttgtcttcaagtcgaattgctttgtcaaccaactgctgaaaatcagcatagtcatgagagatcaacgtaactgacagttcatcctttaagccttccaagaacttctcctgcctttcctcgtcagtacgcacatcttctggagcataacgtgccagacgattgaactcatgaagatactctgccacggtttgatccttttgcttcaatgccctgaactcacgcttcttcaaagagacaactcctgtaggtatgtgtgtcttcttgaatgcttccgtgaagtccgcccaagtgattggttgtccttctgctctgttcattcggaaatgatcccaccattctgatgcaggtccttgcaactgatgtgaagcgaaaacaactttctcctgatccgtgcactggagcagttccaacttcttcccaatagcgtgcaaccaatcacctgcttccactgggttggtagtgctagaaaaggtaggtggcctcacacgaagaaaatcagctaacttgttctgcggcggtggagcattgttgttcccttggttaagctggttctgcatctgctgtatcatcatgttcattaactgagtctgttgagccagaacttgagcaagagttgggttatcttcattgttattgtttccacttccactggcgcgagtgttcaccatctattgcagattagagaagataggaggataagggttacactaaagacaagaccttaaccaggttaacactgatctgatgtgtgtagaccattatattgtttaagttgattaagcaagcaacctagtataattacacactcatcattgaaccactccaatgacgggaatgcaaccatacctacacacaaagcaaacaacaaacgttctaccctactaactattcttcaaagacactttggcggcataggttctaaggtaggatgccaacttcattccatcttgacatctgggcacttcagatcgaccatcaccttcttattcatcgatccacttgacttaacctccataagttgcccacatcaacatcttctagtttcaacaactagtttcagaactactcaagttgaaagagagaggggagtagacaatgaaacaatttgcaaagaattctagataaggaagaaaggagaaattttcacaaatcatgttttcggaaaattagtccttaaggtttgaccatttggcttatcctacagtcgagatggctctgataccaacttg

SEQ ID NO: 30382 - DNA, 1501 bp, Oryza sativa
ctataagagaaaaggaagaggagatcgagaagattatttcccctcaaaagatttcaccggagaaggaaaggatcggccgaatttggaaggagacggcggcggcttgcgctagggtttcgggcggcggcggcggcgcgaggaggacgacgacccagacaagtgggacccacctgtcagcggctgagagagagaggagagcggcggctcggcggactgggccgacttgggccgactggccggggaggaagaaaaggaaagagagaggttttgggccggctttcggcccaaagccaaaagaagacttttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatgttgagatttagcaaattaaaattagatcttctcttctaggcttttaaaatcatttctaataattccttttaaacaacaatttataatttaaggatttttaaacaagaaaagctcttaacaattataattagatcattaatgatcaaataattactgaactgttctttgtatcatttaggaattgagctctgaaaaatccgagaaaatttcagagagttgaattaaccatggagaatttaataaaaattaaatccatccatgctttatatttaggaaattttatttcccacatttaacttcacttgtaaattaaagaacacttaatataaattatattattaatttattaaataatttataaatcctgaaacaaaaatcaggatgtgacaaactaccccccttacaaagaatctcgtcccgagaatcggaacggctagaaagaaaaagggaataggtaaactgcagtctatcttattccataactccgataattattctaaggctttaaagaaaactactgcttctttgaaactggtggctgagttgtaacacttgaagacgcaactcttgaagacgcaactggcactgcattggctcctgtgacgacaatattgttgacctgaccttgcggctgctgatgcttcggcttcggacactctcttgcaaagtggcctggcttgtaacagttgaaacatacctgctgctcccttccactactgttattctcttgagactgatcctgctgaattggcaccggctgattagcttgctcgatattaacttcattgctttcattagtctctgttttgatctcaccaccgatattcaactgttgcgactgtccttgaccagcagaaaaaggttcaccaatttggagtggcttgatacgctgtctctgactactaccttgtgcctcctggaaaacagtcattttccttttacggttatccatcctgttcttcttgtcttcaagtcgaattgctttgtcaaccaactgctgaaaatcagcatagtcatgagagatcaacgtaactgacagttcatccttt

SEQ ID NO: 30383 - DNA, 1501 bp, Oryza sativa
ttttacttgcaaaaacaaaaacaaatacatccatatatatatatatatatatatatatatatatatatatatatatatatatatatatatatatatatatatatatatatatatatatatatatatatatatatatatatatatattaaatttaacatatatggtaattatcaagaaataaagtcgaccaaaataataatatatttgtaacttggaactaatatcattattcattaacttaataaagaatagaaccccatcatatccattgcttctcatgaaaacgtacttcttcgggcatttcttgatgcaaaatcatcaagaacgatattaagaacaatagtgtccaagatatccttctcgattgagcacatagccaagtcatttaacctttcttgcaacatagttgatctcaaatagttcttcaaaacttcaattttgagaaacttcttttaggtgaagctaccgtcacaggtacagataagagtattcgataggcaaaacatttggatagaaatctgcatccataacaaactttagaatctcaggcacggacatcgaaaaatctggcaaactcacttgcaacacctttaactctgaataaaaatcgttgatctcaacatcgcatgaggtactagactactagtattaggtgttggccccccatcatcatgggcccccaccatcatgggcctcggcggtcgcctcggctacatagggccagggccggccctgccaagacctatgtaataagtggttatagttttaactcagttgaagcaaaggctgggtttataaccattattaaaaaagggaggtggtgaaatattatattatatcatttaggtatattaattaaactcaatgtaaagaagagagacaacttgtgaacttagggttggtttggtttgtggcctaaataggccttaccaaattttgtcaatgccaaattttgacatgattaatttcggtaagacaaagttgtgtttggattgaagccaaaatagtctaagttcactattaaaatgatctattttcttaggcatgtcaaaatctggcttaaaccaaatagacattaaacactattaaaattgtcaaatattggtaaatgtaatttatgcctcaaccaaacgagcgcttatttcctcgatggaattcgaattcggaagccgaaggcccagaagaccgcaacatgcggagcacgtcttggggtggccgggtggagcgggatggaagggccccactcgcagtgtcacaaggaggacgccgccatttcctcccccacaagaaaggccgaaagcgaaagcggatcacaagggggtagcccgtcaccatcagcgctcacgcctcgcgcacctgcgctctccctcccccttcccggcctaggtgtcggaagcgcggtggggaggaagcgaacgcgccgccgtccgggtctcctccgcctcctcctcccgagaatcgtaagctccgggcatcctactccccctcccgctcccagtcc

SEQ ID NO: 30384 - DNA, 1501 bp, Oryza sativa
aacaaccatacccggctgaacagatctaatctccaaaccaggagctaagctaattattaccaggtataacatctataattattatgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctttgcataacacaactcaccacagtgcaccattcctggatcataatcacccccttataaaacaaggcatggactccccagcgacccccgtgggcttatctccgccacttctcagtctggtgctccgcaatgaatcatgttatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattaaccatcgtgaactatcattaaaccatcattaaataataatgaatcataagttatcccaatagtgtgctaatgtttctaagcatggctaagcaatcacatctaatatctagctgaaccaatatataaagctcaactagtcaaattataataacccaaggtatcaaggaataaagtaatcaagatcaaaagggccataacaaagaataggttaattccacccaatgacattcgaaaataaatgcacagttgaaataaatagagaatttaaatataggatcaacatgctcaaaggattgtgtttaggatctgtgtgacttgccttgcaataatcggtattcaattaatcttcttgaatacttccggcgcactcgcgaaccttcgcaacgacggaaacgacaagctaacacacaaaacgaagaaaaagactaataaaaaccaaataaacaatacataaaaagtaaacaaacatgtagatcataattttagatgaattatgagtcttgaacggcctcattctgacttcaaatgaattttacaagattaaatctatttaaagcccatttaaaaagaattaaataaatttaattcaatttatggacaattttaatatgtagatctttattttacacaacttttgcaacttgaaccacattaaactgagttcaaatgaattagttatgaatttttaaagattaaatcggattaaaacacttatatggattttaattgaattatgacgcaataatgaattatttttgaaaaggaaaagaaggattattgcgtcagcggctagggtttgcggtggaccgggtgcacggcaacggttcacgggaacaaacggccgagatcaaccctatccaaaacggacggctgagatcaaacggtccacgaccggctcacggcggacgactccga

SEQ ID NO: 30385 - DNA, 318 bp, Oryza sativa
gtcttcagcataacttttggtctgtacttaccaacatcacagcgtcatgtttggtccatccaaattggtagtcgtctgttgctgttctagagatagggctgcaataaaattgaggttacctaaatgtgataattccatcggaatcaacacctttagcataccataaattgatggtgttcttattcttacaggatttacgtccattgtgtaatgttgagtccgttcaacttatgagaacttgtttactaagtaggagagcagccaaaattacctatcgctgactctctatgattcgtcataattctttgtgtattacag

SEQ ID NO: 30386 - DNA, 939 bp, Oryza sativa
agccaatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcatgatgaggactaagtgcctcataagtaagtatttatcgttttagttaatttgatgaatctgtatattaaattgtcagtttgtgtacctcggctgattcctggacgaggattttatgcacaaataagttcggaaattactagtgaatttccgggcgtgacaagttggtatcagagccatctcgactgtaggataagccaaatggtcaaaccttaaggactaattttccgaaaacatgatttgtgaaaatttctcctttcttccttatctagaattctttgcaaattgtttcattgtctactcccctctctctttcaacttgagtagttctgaaactagttgttgaaactagaagatgttgatgtgggcaacttatggaggttaagtcaagtggatcgatgaataagaaggtgatggtcgatctgaagtgcccagatgtcaagatggaatgaagttggcatcctaccttagaacctatgccgccaaagtgtctttgaagaatagttagtagggtagaacgtttgttgtttgctttgtgtgtaggtatggttgcattcccgtcattggagtggttcaatgatgagtgtgtaattatactaggttgcttgcttaatcaacttaaacaatataatggtctacacacatcagatcagtgttaacctggttaaggtcttgtctttagtgtaacccttatcctcctatcttctctaatctgcaataga

SEQ ID NO: 30387 - DNA, 1501 bp, Oryza sativa
cagaatcaacactagcagtagtccagtctccagtgtgccgcgccgcccaaagctgagcaatcatcgcatatcccaccacgatcccctcccaaacccaaagcgaaatctgctgctgctgctcctggtggcgcgagtgtgattgattcgattgattgccgcatccacagttcttttcctttttgtgagtttctttttcttcacctccacttcttccagtacggaaaagagtgagagcactgcaagcaaaaaagaagagaggaggagatttgttagcgcctaattttagcagcagcaaagctcggattcccctcccatggcggatggcggggcgacaggaataggcggaggatagggagagattgtcggaggagaagtgggagaggtggtttacatgcgagcaggaggaagaagaaggaggtggcggggcaccggccgggcgatgtagaggaggccgcggcggcggcggcggcggcggtggtggcggtggtggtggagcagagacggcgaaggcttcatcttcatcttcttcttcttcttcgtcctcgcggtgaggtgattcttgttctttggccatcccagtgctccaaacatctcgctatgcaaatcttggatggatctactattggcggtgcttgtctgattggttatgtttgatgccaatatctttagggttggcggcagtttctaatctttaggaatgttgtaatgcttagcctgcagactgcagtttgttagtattgatgaacaaatgaataaaagggtagtagaggtgctgttttgatttgattttggggggcaaataggggctttcttattttgtttgtgttgctgaaatggaattgcatttttgggcatacattcaacgaactgggcatagagattagatcttcatttgtagagaaggctgatttgttatggtcttccaatgttgcgatccaacgaactaggcctgaatgctgatttgtgtggtctacacaggtctgaattctgaaattagtaatgactgtatcatctttaattgtttgttgtcctctaaaatagaaaatgtttcatgttggggattgttagaaatgaggtgctgatagaagttgcttccttcagtaacacatgaatacgtgaacatgatgtttaagacccttttttattgaaatgattcaataatagtatatctgtcctactaacatttctatccatggctgttgcattacaaatttagaagataaagggtgtacctgcaattcatctctttcttcttattttgaaattagtactttctctaattgatacttgcatcacattgcttgttctgccacttattttttctgtttgcttactttcttctgtctcttgcataatacagatttactttcacattccgaagtttgctacacttcccaggagtagagaatatccgagacacctctcatctatgcttatcagagtctcatctatttcctgtctttgtcatagacagatattctcatggctagaacctctcctt

SEQ ID NO: 30388 - DNA, 1501 bp, Oryza sativa
ttttcttcgttttgtgtgttagcttgtcgtttccgtcgttgcgaaggttcgcgagtgcgccggaagtattcaagaagattaattgaataccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgatcttgattactttattccttgataccttgggttattataatttgactagttgagctttatatattggttcagctagatattagatgtgattgcttagccatgcttagaaacattagcacactattgggataacttatgattcattattatttaatgatggtttaatgatagttcacgatggttaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtataacatgattcattgcggagcaccagactgagaagtggcggagataagcccacgggggtcgctggggagtccatgccttgttttataagggggtgattatgatccaggaatggtgcactgtggtgagttgtgttatgcaaagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacacctctcataataattatagatgttatacctggtaataattagcttagctcctggtttggagattagatctgttcagccgggtatggttgttcagaatggttgggcctgggcagcacgggtgtgctgttcagtgttgattaaaatttctgattaattactccaatgttttacttctcttaaatgttttgctaaatgctgcttttacaaatgagccaatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcatgatgaggactaagtgcctcataagtaagtatttatcgttttagttaatttgatgaatctgtatattaaattgtcagtttgtgtacctcggctgattcctggacgaggattttatgcacaaataagttcggaaattactagtgaatttccgggcg

SEQ ID NO: 30389 - DNA, 1501 bp, Oryza sativa
atcgcctggggcaattgtcgacaccaattatgctgctcccatcatggctactgcagccatccataaagtcgtcctctgagaagctaaggtttgttggtgctgcaggtgggtgtacacctgagagaatagtaggagctcctccagtcccagcaaaaatgacatcggggctaacagttgtcgtgatggtgtaacagggctctctgatggtctgttctgcctgtcccgagcctgctcaaggtttgcaagcacattgggtattgctctgcatcttattgtttctgcatttgtgtcctgaaaatgaactgtggatgcaccctgaggaagcatcgaagcattcagtcaatcagtattctgggtaaagataactgaaagcaaagatatagtaaattgataatcatcagaagcaatggaaagatgaaaataccttcaaacaggcaaaaatcccagccagaccagatccacaaccaagctgcatcaattttcaaaaggaagtgagttatgcatgagtccaaattatcaagttgattctgattcgatgaaagcaaatgcaagcacaaagcatctactaaataactaaatgaagaatctgtaacagctagccaacgatgccagttttctcatgggaagttacctctagaacccgcttgcccctgaagctcaactgcccatcacggatctcatttttaataatgttgacgagagtaatggaactctcccaatatttcagagatcctgagaagaagtgatgaataagactccatggtatggaggaaagaaaatataagatgtgcttattcgttatgcccttaccatcatatttggatgcgactacttcagaaggggagaaggctatcatatccgctacactgaccttcccctgaagcataaggagaacacattaaaacattagtgtttgatgtttatatttgataacttgatggtagcaagggaaagaaactagccaacttgaaaattaacaaaataaggaatatgcatgtgctgcttaccttgaaaatgtcaagaccttgaacatcaaccttctcgccagcatatttgtaaggatgagcactctgagataaaaaggatcaagacatacttattaaattgtttacccacgaaaacaatcccaaaaagaacaccaatcgacagtacaacagacagctgcaaaacatttgaagtatttcttttggagttttatatacaaatgacagccaaatcagaaaaaataaatgtacctttgatgggattatctcgacagctggtgatggtagctgtagatccctttctgatacaattggcacacaactcgtagccttgctgggaagcaagccagggaaacactgaacaagcagtgatggcgtcttcatcgtgccacctgttaacttcagttattaacaacagttgaaattaattttgtattgaaggaagaaaaaattagatgattggactgtaccaaacatgagaatcacaaattttcaatatgaacaccatcttaaactaa

SEQ ID NO: 30390 - DNA, 1501 bp, Oryza sativa
gaatctgaacttgtctgcgttcttgatcaaataggaaggcagatgaacagcagatcctgactttggtatgggtcccatcttcttgaagagatccttgaatgtgtactcttcaggcagcatgtcaaacaggtcctccccattacatatgaccctctggattctgtctggatttaggaagctgtcctgcttcacccggtctgcgtggctatatgccttcatcttgaaagcaaactccttgatgtccttgaagcagaagctacaatgccagcctgcatcagccagcagaaggttgctctgacgggagtggcggtacaatgtatgctcagtgaacacatgtgctgtggccctccagctgttgtagtctataggaaattcaaaggagtacatatagttcttcagctcgagatgcatgacttgcggtattccatcacaccacttgagcaactgcaccgtctcagggctagggatctcatcagcatcagccatgatcaatacatcccccacagcaatgcctgatcttcgcagcagcatattaagcgcacgacggtggccggcctcaacatggaagggctgacggtgagaaccgggatccatttccatgacaggaagcatgtcatacacaatcttggagccagcgaatgcaaagcgattgatattttccaagaaagagagtgacttcgggatgccagtgaatgtggcattagcttcaaggatgacaaacctgtcaacatacggaaggagctcaccgtagcgaatttctagaatatcaagttcattactgaagaggacggcgtcaaagacacggcgaggggtggggaggataccccaaccatggagctgacagagctgcggcatggagatgttgggggcatagtagtgtgggatgcggataaatggcttaggtggtgtgtcccacagtggccgcagaaggtaagagatattatggaaatactgcgtaacaacaataacagccactgaaagaactagaacacatggtatcagcaacttgagggaagcgattttccgtctagttagaggtggaaaaggagaggttctagccatgagaatatctgtctatgacaaagacaggaaatagatgagactctgataagcatagatgagaggtgtctcggatattctctactcctgggaagtgtagcaaacttcggaatgtgaaagtaaatctgtattatgcaagagacagaagaaagtaagcaaacagaaaaaataagtggcagaacaagcaatgtgatgcaagtatcaattagagaaagtactaatttcaaaataagaagaaagagatgaattgcaggtacaccctttatcttctaaatttgtaatgcaacagccatggatagaaatgttagtaggacagatatactattattgaatcatttcaataaaaaagggtcttaaacatcatgttcacgtattcatgtgttactgaaggaagcaacttctatcagcacctcatttctaacaatccccaacatgaaacatt

SEQ ID NO: 30391 - DNA, 221 bp, Oryza sativa
acctctagcctcctcaacccaactgtcgccattcccatgttgaggaggctgcgactgccggagtggcaccacaccttccagaagattcctcatcgcccttgttcatcgggccggcttacagttgagtctagcccagcacggcctattggtgacgttggcccactaggagtgggagtgggaggaacagaggacgttgatccttcttcctcctctactccaga

SEQ ID NO: 30392 - DNA, 1419 bp, Oryza sativa
agcctcctcaactcaattgccgacattcccatgttgaggaggctgccactgccggagtggcaccgcaccttccaaaagattcctcatcgcccttgttcatcgggccggcttacagttgagcccagcatggcccattggtgacgttggcccactaggagtgggagtggtagtgggaggaacagaggacgctgatccttcttcctccacggcggcgagggccgaggaggcgaggatggacggccatcgatgaagaacaaaaacctccagcctcctcaattcaactgccgccattcccatgttgaggaggctgcgactgccggagtggcaccgcaccttccagaagattcctcatcgcccttgttcatcgggccggcttacagttgagtctagcccagcatagcccattggtgacgttggctcactaggagtgggagtgggaggaacagaggacgctgatccttcttcctccttcactccagactcctccaccaccgccgcgcaccccccaacaactctccctccacgccaaaggtaaacttatctggagacttgctcatcgttatctatcttttggagatttctacatctcattctcattctcatgtatggtgtgagctaaagtttattattatggatctgatgtttgcttactgctttgcatccgtcaatttcctactctgcctattatattatacaatattagacagtagagcgagagactcaaaccaactctgaatctaaagaaaaacaatagagagctggttgtgtcaataatatgaaaaatcttttcttgctacatagaactacctttggtttttgggtaccactgtacatctagtataaaaggagctctgagatatttatgattttagtgtactaacatcagtaactaaaagaggtgatgatgaatttctacgcttaaggcccttcgctctgaatatgagagcttttattttagggagattaaatactctccctaaacagtaaaccctcaaacctagtttaaatctctaatctttctttggtctaaaatgattaatctctcaaaaattactgctgtgaggtaagtcttttccttttccatgtccaaatcaatctaggctatgttctgctattgttcaatctccactgctaagtaacctatgttatgctctcaaagtggattgatattctaacactgactagctagtatcatcgaaagttgtattacaaattctcacttttagttatgctgtgatttaaaagacaaacactagtttagtcctgaggctacatcagcaaaccatatatatcttcagttcaaattcgtatatcccatatagctctgtgccttggctaaggtcaactgacatcagtgtggcaccacttcttcctgttgctgtaacattctcttcttcagtttctgcagcaaccggtgca

SEQ ID NO: 30393 - DNA, 215 bp, Oryza sativa
cttctcattacccgaccatgtgttgttacaacattttcggtacgcgttagacaaggagtctgccgcaaatctcgatatttctgctggagaatcgttcgcacacaagacaactgccgaaggaagagaactcttagatttgatcttagagaacgattctttcggccaaagcgaagccatcccggaggtcgagattatccatgaggaacctctgcaca

SEQ ID NO: 30394 - DNA, 1501 bp, Oryza sativa
catccaacaagcccccgggtgctaggaatcggcccaaaggcaactatccattggcaaaccaaacggaaagcataggaagatggaactccataactcgataggcacttttgtactcagaatatgtcgcaagcaatcaagataaatattatgaaaattgtttaaaaaatatgatataacatctgtagccctcgactcactagtcaacggcgaaccagttgatgtagtgaggcaaaggaaaaggcaaaatattatataaagaataaaataaatgatgacttagctttgtcgtattccctcggtgacagcaaaagtagccgatgtgggaacgaagtagtccatcaatggtgacaaaaacaccagtcggcgccagtggaaccaagccagtggtgtagacgatgaagcccattaacggtggcgaagtccgccaaccgtataggcgaaaacaccagtcagtggcggcagaggcaggccggtgataaagtcgtagacgcccaacaacggcggcataataggccagccgtgcaagcagaaacaccagtcggcggcggcgaaggccagccggtcggtgaagacgtagacgcccatgtacggtggtgtgaccaaccaaccgtataggtgaggacaatagtcgaaggacgcccaacaacggcagcatataataggccagccgtgcaggcggaaacaccagtcggcggcaacgaaggcaagccggtcggtgaagacgtggatgcccaacaacggcggcataataggccagccgtgtaggcggagacaccagtcggcgacggcgaaggcaggccggtggtgaagtcgtagatgcccaacagcggcggcataataggccagccgtgcaggcgaaaacaccagtcggcggtggcgaaggccagccggtcggtgaagacgtggacgcccatgaacggtggtgtgaccaaccaaccgtataggcgaggacaccagtcggcggcgacggaggcaggccggcggtgaagtcgtagactcccaacagcggcggcataataggccagccgtgcaggcggaaccaccagtcggcggcggcgaaggccaaccggtcggtgaagacgatgactcccatgaacggtggtgtgaccaaccaaccgtatagacgagacactagtcagcagcacggagcaggccagtcggtgaagatgttatctccatcagcaatggtagcggcacacaccgaccgtggaggcgaagaaaccagtcagcagcgacgaaggcggccggcggtacatgtaaagagacagaagaaatctctaattagaatcaagaaaactaatcttgcggatatatgtctgcacataccaacgcatatatgccacatgcatatattgttaattagccaattaatctcccgtggtagatgcattcacacatgcacatcgttagactgatccgtggtcctgcacatagatcgcaggtccgagtccgggtcgaatccaagtcggagagaatcagactcggggcagccaggtacatg

SEQ ID NO: 30395 - DNA, 1501 bp, Oryza sativa
ggcacaaccctgccatattctcttttgttccaagggataggagattaggggtgcaacgatgcacaataatcaatggatgcgcgacacgccgacacccgcggcttctctctaagcagacattgttggagtaccccaatttgttggtggtctcggtaaatatcgacctgaaatcgaatgccaccaacgaactaagtcggaagtccaattcgaatgaatagtgttcatttacatctgcttatcggatagttttccttgggaaaaacattggctccatgtggcaaattcattcggaaaagcaaaaatcccacgtagatgcaaagttcttcgtgttcttagcaacaaggggcagtcacctaacatcggacaaacacaaccttgtgtctagccaagttgtccataccatcccttatgtgtcgactgtcgcattgccagatttgtgcacacttgttcacccaatatccatacacccaacgggttcaggagaatattaaacaactgaatttctcaattgggccataggtatagcatatcatcaataattggtggtcccaagcatggcaagccatggcaaaacaaagtagagcagtgctcgacacgaccatcagcctagtcacttcgataatttgcagatagcgaaacaccttcgatggtgttagcagatcgctaagtgggttagccatcacaaaaaaactggtggacatggcgtgctacgggactgacgggggcaacccttaggtaaaattgtagctttcccctaataaagtcacaacaaattttgcaggtgtgtcttgctcggctcccatcaggctgcatgcttgcaacttgttggctttgtaaggttatgtaaaattcctccacgatcttaatataattggcttatgttctcctagatggtaaattttttgaaaaaaaatatataaaaattgcttagaatatttttttcctaaaacaaccttttaactttagagtagttaatttatccatttgtaaatttaaatattatcacaaaatcatataatacattattcatccatccaacaaggcccaattttgaagggatgaattcaacaagaacgattcaataggccaaggcataaagtaacaaattcaatgttggtttggtttgaagccctaccaaaacgttgatagtgtcaaaacctaggcactaccaaatttgacagagtagatttgctaccacctaggaaaaaatcggtcttaatccaaattccaccaaagtattgtcgaagttatcaaaatattaatagaatccaaattagcaccaatccaaatattgccctcatagccatttttttggggttctgctttttatgagcctaataacttgcagcttatctgaacatgtctacataacctgcttacctggattttccacctagtgtgttttcaaggttgctataagttgtcgaagcccacgacacaaagcctattagattcgaggcatgcaaagatatggagctcacagtggtgaccatgcccaaat

SEQ ID NO: 30396 - DNA, 195 bp, Oryza sativa
tgcgtcgtgccccctccgacgccatgattctctcagcatctcgggggaaggccgtgtagattggaagttcatcgttctcaatgctgcttaggaggggggttttcctactttaatggacagacactgaccacatgaagaatttctgttgttgtgaagaactgaaatgttaacacatgttcctgcattgtgttcagg

SEQ ID NO: 30397 - DNA, 216 bp, Oryza sativa
ttattttttcattaaagatatgatgcgagctcatatatatacttagttgcagttaacagttaagttccccatggcagtgcaagacctggtttgtggaagctcaataaaaaaatttcaactgcaatgttttcagcttgaacttgttccgtttatagttgaatgttaaaagaacttaaactgaaaactgctaatgtgtaggaataatggaataaaata

SEQ ID NO: 30398 - DNA, 1501 bp, Oryza sativa
aggcgaacggggacgttgggccgctgccagggccgaggctgaggtggagccagtccctggcgccgttgtttcctcgacctccgttgctgctgctcctgtcactgctactaccactggtcccggcgacctcctactggtggtggtggtggtggtgggtgttggtggcggtggtcgtctccgttgcgctgcagctagaggtgctggttccgcgtcagcagcgatggggacccacccatcacctccctccctcccgcggtggtggagagagatgagaaaaaaagtgtggaggatggagaaagaagatgaatctgataggtgggtcccacgtgcagatgaggaagaagatggagatggatggaaaatgtgatgatagtggcacggtcctaattttgtaaaatttcaatggcacggttacgaatagacgaattgtagtggcatttctctgaatcagcatatttacaatggcatggatccaattaatccttttcttattgccgatctagaacatcgatagttgactgttgacggtcgttatagaccaatttcgaccgtcaatatatccagaaataagaagtagcaacgcttgcatgcatatttgtttaagtataatctatcagttaacgccaaaatttggtaagcccaaattcatcatcggcctagagtcagtatcggcttcagagtcttagaatcggccgatgggagtcgtcaaatcgccagcagttgtgttcttggtggagttggatcaattaaaggaagcttatctagaagagtccgagttcaaggaggatgtgacatggcagtttatctattaattaggcagtatttgtaagtttccttttatctttaggaatgtgtgtttagtgtccgataaggactttatgttttccttttatctctaggaaagtttctttcttgttctacaaggactagtatttacccatgggtataaatatgtacacccggggttattgtaaattatctcttgatcaataatactactttcggcgcatcgccaccctctttcccgaggtttttacatatcaaccggcagaatttggcacttgacgcggggctgcatcggttcagttcgatctccagcgaaggggtaagtcctacgttccaccagccctggtgaatctgccggctacgttggtgttgttcaaggctgcatcgcttcaatatcttagatcgctctggtttggttgatacatttgcctacctgatatctcaattctatctctagttgcattgtgtctagagatgcatcggtttagttgggactgtctcagttaggtccaatcttctgccttagccgatatatctttacaatcacaatgctgttataaatagattttttatatccatcacattagacaaatctatcggctcatcgagtattagattatcatatacaatctcgtgctgcatcggttaggttcgacctactagattgttgttgataatataagtcttgttaatccgataggttcatgctaatgtt

SEQ ID NO: 30399 - DNA, 1501 bp, Oryza sativa
cctcgccggcgcctgcggaccccatgccgacgcctgcggcctcctccgcgttggcgcctgcaacctcctctccgcgccccgcgtcaccgccgacacctccttggaccaccgcgccgccaccgggcattgcggcgccaccgctgtggatcaccttctcgcagcagtcgccgaccaagagaggtgcgctgtcaccgggagagccgcctggatcgggtctagtgttagggattttcaccatttcatctcccttttcccttttaccgtgaaatactgggtatgtatatttgtgagtgagggaaatttggtctttgtaaaaaaacataacggttgtaatggtgtggaatcaacgggatgttgacggtgatggcatttttggaagaaatatgcttgtacaatggtatttttgggaagttgcacttgtcgatggcatttctaggataagggtgtttgttgatggcatttcatggattttctcattaattaaataacataagaaaggatcccgaatgcttacttaatagaagaagtttctccgaacccggagtagagtgtaccgacagctccggtactcctctagaattcctcctagaaagctacactcgtcgaggtagaagtcggagagagcaccaaacttccgggcactcatccagagcttcccctcactctacctattttctaatatacaaaagatacaatagagcctcttgatttagctcaaagttgtgtgttttgaagtgaagtgagcttctccttttatagtctccatatgacgttacaactatgggaattgtccaaaacaccctccaacgatcattgggaaaaaatcaggagtgtacacatggaggtgaacgggttcggccgaacccaaaaatccacctcccggtctctcttttggctaggaggttgcttaatgggcacccaacatcatgtactatgatttggcccaattctaagtggttttgattgacatgtgggtcctccaatccatgtaaatgtatcatgattgtccggaggtgtattttgttgcatgacagacgtgttttctccttaatatgcatgcatacttatatttcaccaacactagtggaaatgattagtaataatacctaccactaagttggataccatatattttatttcgttatatgcaagtattgatggtcagatattatgatttaaggaccgtcaacaagttagatggctttgcctctgcttttcaaaaccagctaagttttaacaaaatgctagaaactcaactagctcagatggctactcttgtccctgctaatgaatctaggaggattccagggcaacctgagccctctctagagaactttaatgataaccacaaggggaggaaaatccactcgcgaccagccacatcctaacactgcaggaacaagaaagaacaataaggaggcttcaccatctaacacaaatggagaagaagagacaattcagcgggagaaggctgcgccgcaggagtactgcgacaccaacc

SEQ ID NO: 30400 - DNA, 1501 bp, Oryza sativa; identical to SEQ ID NO: 30168

SEQ ID NO: 30401 - DNA, 1501 bp, Oryza sativa; identical to SEQ ID NO: 30170

SEQ ID NO: 30402 - DNA, 1501 bp, Oryza sativa
ctatcactttcttctgtcatatcaatatgcacaattgaagcacacaagctatgccataagggggtggctcattctctctctctcctaacttctctcctccaccttatcaccaatgtcacgtcctgataaattcatcccgaattaaaaatcattctctaaaaggaataatagaattaattaaaattcgaaaagaaattgacaaacactaaaatacatacaagaaaaattcgtgttgcccggagaatttccgttaaatcctccttggtctaaaaggtgccctcaaattttacttgtattttcagagcacggaaaatagttattaagaaaaaaaacaattattagagtttattaaaaagaaaaactaaaaataaaccctccttcctcctttgggcccagtccggcccaaagtccccctcctctccctcggcccgcggcccaagtctctcttccctccctctcttcttcctctcctctctctctcccgggcctccctccctctttccctctcggcccagccgcccggcccaagcatggcagccgcgcctatccgcgtccaaactaaaaaatattttcaatttttttctggaaaatgctacgcatacgaattttttgtacgatattggtaccatcaaacgtaacaacgccgacggcagggaacctaactcaagcgcacggcgcatgcgcacacggcagtcaagagcgtcatgggccctaaagcccaattagcctctttgcatctaactttacatcttcctttgttaaaccctaaacctgactttccctattccatgttatcagcgcatctgcaattctgcatttaatccagagagcatacggcatacgaagacataggtatgccatcttatttgcctgaattcctttagcttcgcaatcatcttttttggtacactagtctccctctctttcttttttggtcctgggtaatgtccatggccatgaaatgcttcttttttattatagaatgaatctgaatttttgctttgcaaaacatgccattgtttcaatttacatgtttcagtaatggagaccaatttatctaccaatgaagtagaagatgatattgccatatcagacaaagatgattttattattgaggaggtccaaaatgaatcagatgaccaagaaattgagaagtttgtttcaaatgagcaatcaacagaggaagctatgttacaagaaccaaagaagggaattctatttgatagtgcaaggtgcaaggaacatatatgtatgagtaatttgcttaacctgccacatgataaatgagtgctgagtacaattactatataacatattattaggaagaatattgcttaagatatgattagaaagaagattgctttggttggatgtgcaaccagaccaacgagaaagcaggccaggtcgtcaggaggagcctgggctttggatatgggctttgcagtgaaggagggatctgtttcgtcactacaaatgttaggagagacgtttcatcgtacaa

SEQ ID NO: 30403 - DNA, 1501 bp, Oryza sativa
attatacccgtacctatgcatctcccagataagctagcagtataatcagtataacatgaatataaaataaagttggcattcatagacttggaacgtatttcattaccagaaatgtataaataagaatattctaaataaagtacaaggcttacaaaagaggaaaggagagctactagagccatacccgaacacttccaaagacttccggactctgatttctattctattcctactccactagcttgataatactaaactaacttgagagaatatgagagagctcttgcttgaagtgtctgaagaaatggagagagtgaggggtttatatagcttgagactgacggttatgacggttggaaaggtcggtaatacccaccaaccgtcattggggactcatctcagccgtccctccaatccctggatcaaacggcggagaggggggttcggtcgaaccaggggttggcccaaccagcccacagttcggttggcggcctcctctcttgatccctgttgtagacttgtgaactttggcccaattcatcgtgtcatttctgagttcttggcccattcatacataagtctgattctcgacatcatccgattgactgatcgtctgatttgatgtcgattcttctccactttattgttattctctgcaaaaggttagtaaacctaatactggtggaatattattattctaacttaaatatgcattgcaagcataactagttctcgtctattatggtaatattgacggttgaaactgatcgctaacaaccgtcaacaaatgcttgcagaagttgtcggtgagaaagatgaaaccgccaaaacaaaatgtttgccttggagggaagacgaatttgacaactcctgaagatgatttcatcatgattgtcactgaaaaactcaatgcaacccctacctggcgcgccaactgtcggtgtcgtatatcaacaatgctaaaatgggtagtatacaaatacaagatctaaacgtggattgattatcgggacaaaggtttagacaggtttaggccctctcgatgagaggtaataccttctcatgtttcggaattgttgatagtcctttaataccaaatataactatcaattcctgtataaaagcaaatcaatgaaatattaaacctagtgataggatttattattaaccattttcacgagtgttggtgaatatttgtatgcatgtaattatggaagaaaaccacctgccatgcgaagaaaaccacctccggccactcaaacgctagcagaagatccatgggccaactaatcatatgaagctaacataattgaagccaatttactatgcaccgtcatgaggacccataggacaatgactaaggcgaaaatgaggaagaaaggcggtgaaagtgattccctctgaaccatggttcggtcgaaccaagagtgtgactgatcactgccacagcttccacatgtcgcttcctcaggcctcccctatggcggttatgcttgattcc

SEQ ID NO: 30404 - DNA, 1501 bp, Oryza sativa
ttaaatgaaatattctaatacaataaatttaaataagaaacgttccattgaatactagattggttttctgcaggatagagagagcagtgcctaaagctggagcgaagctatgcagtcccgaggggttcctaagaacccgggtaggaaagtaaaattagtgattaattaccatgtgggcacccctggctcatgtatgtgtacccctagatggagaattaagctacgaagatgtaaagcccaacgcgtgcattgcagaccaccaagccgaacaggtgctactaggctggtataatggattcactcatattggttagtacttttaatcgttgtactcctcttttgatacaattgacatcacatattgatttatctcttttaataattgatgggaggcgcaattatttagtacaatattacatgaaaattctatatgactccattggtatggacacatgattaagtgaggcaacccctccgccactgcctaaaggctaatggataaaaaaatgtgacacatttctaaaagaaaatatgtcgacagttttcttacctatccattgatgaataatgagaaaaatctatagcactggatcccgttctccacgggataatccgaatccctcactcccctctgtctccatctcccctccactctctctcttttgggagaaggccaagaaggtggagatgaagccggacggtagaaaggggtcgtcgtctatggcggccaaggaggatgacgatggcacggcctcggcgaggtcaccctcaagatcgcctcccttgctgcaccgctctggctccccgccctcgtcggtcttctcatcggatgggcatggcgcccacgctaggctatcgccatcgtcagggatagggaacagccgccgctggtcacccctgctctgcctccaccgtgcgtcaccgaggactcctgccgcaagaaccaagtaggagctagtgggtgcgtgggtgcagagctgtggtggctaccgctgcgccagaggaggatgagggagctacaatgagcgcaggtggctccaccgccaccaccaccaccgcagaagcaaaagaagccggcgatcccggcaccccagtcccggtatcttctctaccaggtatcagtcctgatacccagataccaaagtctgtgatacctaggtaccagtcggtaccaggtatcagatactctgatacccaaggtaccaggtgtcaggggaacgcatgtggaagctcactggaagacagggaataagtcacttaaaattttccattctaacgggatcccgttctgtagtctctctccatcggtaagtggtacaatattccatatttgcatccggagggctgctacaaaacaggatcccgttgcaacggaatagacatattaactattgtcttgtacgggtatcacaggtatcaggtcctaggtatcaaaggtaccgagtaacaggtatcacaggtatcgggtaccatgcaactgtaccacaacaggtatcattta

SEQ ID NO: 30405 - DNA, 1501 bp, Oryza sativa
atatggaaaatattagaatagaatgacttacattgtgaaacggagggagggagtacaatactagtttctttctccaacctactaccatttattattgacgtggcggcgaaaccgtgtatctcgttgatggtattcatgcacatccttatcctctctacagtctacacccttgtaatagcaccaccctctcctccatcgcaccaaccaagcacacagtcgctcgctagcgaagcacgcgatctcgcaattcgcaagcaaaccaaccaaaccaagaaaaccgaggaagaaggaggcgaaagccattagccatccatggaggccaacaagagcagcaagccggagagatcatcatctcagcccacccacgacgccgtcgtcccggcgtcggcgagcggcggcgctgcggcctcctgcgaggcgggcaggacgccatcgtccggtggcttgccgttgtccaccgccgcgtcgagcgagaagaggccgggctccggcggcggcggcgagctgccagggtggaagctggactgcctctgcagggagtccggcatgtcggcggcggtcatcagcgggggattcccctgcttctgatcgagtacaactaggctaggctcctgtatttggacgcaagaatttttgtttggatcgcgtcggaattcaaactattctcggtgaaatctctctgaaattctcgcgtttcaaacagggctttgcaaagcatactttactacgtacttgtcttgtctagtttggttgtgttgctgtgagctatgatccatatatatgatatatgttcatcatgttcatttgtttgtttcttttcactcttaagtataaggttgtaagagatcatgctgatcaagttctactgatcttgtaattcaggtctgccaattcttcttagaaaagcttatgattaatgatttattttatggacatagacacaccaaccaaaagcctgtctcaaattaacccaaatatcacgaattattacatgagaaaacattaggaaaaacaagaaatggaaggtactacatcactaatagcagtatggattttggaggcagggttatcggggttagtagcttccaaattatgaaaaacaagaattggaaaggtactacatgtggaatggcagtatggcacatgttttgaaagaggtgttcagttgagttcatagtcagcttcatcatgtgctaattgatttgatgctagtttgtatgattcagatccatatctgctactaataaagattgcaaggttcagttgtaatatcagaagtttcaagtacaacccagttttgcatgcaaagcttcaagagataagtaacaaattacaaaccagtcttcctggctgacatagacattagacaagatcatagttatggataatgcaaccgctgacgactttctatactctccgccagtgacagacagtgatggaaaggcaggctttccttgaccccttccttgagaccaaaaaaaggacagtgacatcttagatc

SEQ ID NO: 30406 - DNA, 496 bp, Oryza sativa
gttttttaggtagtcccataagtctatattgttggctacttggcttgttgcttttggctagttttatacaggtttttggttagttcatgcggtaagtcgcttggaaaaattttgattgactactaaaaattaaactttcaaagttctgcataatgaagataaggccacccaaattcagcagtcatgcaattgatgagcaatactagggacaaccttaggagcaaaagattatgggccaaaaaatatcaatctgggaagaaagatgccaagtattaaagcataatttagatgaaaaaaaaagattaatcatggtagtaaactgacaaaagaatcatgctgacacaagtttgatgagttgtacataatgagttgatagttgagatatgttatgttgttttgattatcttgatgtgcatgctactcaacaaacacaatatgtttaaacatgcataaatcttaataagcatactagtatttacagcttgtgtaagcatca

SEQ ID NO: 30407 - DNA, 1501 bp, Oryza sativa
cctcgatttctgtttccatcggccgccctgcgatatgtaccggaggtgtacttgctatagcagtgtgctggtgtccagttgatgcacccaaggaggctcaaatccaagttgtgatgtggcgatgatgagcaagtcagacaagaacctatatcaggttagtcttctcgagaatttgcatatcaacttttaacattttgcttcaccttgtgaatttgatgtgtgattgagcttccagggtcatcagctgatatactacggctcccatcggttgccattttacctaaaatggcttatttggcttattagaaaattaaaattagtttataagtaaaacttttgtagatttattcgtagcgacttaaaagccaaaattaacaaaaattacgttaaaagcatttcaaaatcaacttcaaaattaaattcaaaaattcaaattttggcttattctttggctgtttaggccaaacgatagggctgtacataatgatattctgcggactaaagacatgatattctttcatcatacaattttttgagcttcatgtatttggctaatatttcttatggaacacacatgttgatttcagtctttcaaatttgttctgccctttttggtatggaatttctgttaccttggaacacctggtatgttctttcctatatactatatggcaccttaaagtgctacttattaaacagcgcgtgataaacactgcacgtccccacccatagtgtaactgcactccacccacactgatcccggctcaacacatccccaaattttggcagtcaaaattttactacttagacaaacacaaaaactcaccatataagacagcgtcgtttagtatttttttaactaatcatatatacatgcagttaacaaatcttgaacaacgggatatgttagggcagtaattttttaaccgaaagcaagttaggttcctttttttttcatcgaatgatgacatgatctagagttatttttttttactagacatgccattaaattattaatttttgattctttgtttccagttttttgaaataattgttttagaataattctaggaactatcatttttgtacataatgctgaacgagtaattttttaactgacagtaatatagcttctcactcacccaacggtgtcagtatatagagttatttttttactcgatacgtcatgaattttatttttttgttgaccgatgcaattagtaatttatttactcatagaaccatatgtatatatacagatgcggtccaaccttaccgtgtgtatgaaccacacacttttccatctctctccgtttcttcaggatctgagcagaccgggcgtccacccgatgattgtgttatgtatcgagttactgtagttgccaattgttgtcatttctcttttgtggtctcactgagtcaagtgtatgtctagacctggtgagtgtgagtcgcgacgtgccgtgctggtctggcggacgcgtcgggtgtgtgtttgact

SEQ ID NO: 30408 - DNA, 1501 bp, Oryza sativa
gactttattaggggaaagctacaattttacctaagggttgcccccgtcagtcccgtagcacgccatgtccaccagtttttttgtgatggctaacccacttagcgatctgctaacaccatcgaaggtgtttcgctatctgcaaattatcgaagtgactaggctgatggtcgtgtcgagcactgctctactttgttttgccatggcttgccatgcttgggaccaccaattattgatgatatgctatacctatggcccaattgagaaattcagttgtttaatattctcctgaacccgttgggtgtatggatattgggtgaacaagtgtgcacaaatctggcaatgcgacagtcgacacataagggatggtatggacaacttggctagacacaaggttgtgtttgtccgatgttaggtgactgccccttgttgctaagaacacgaagaactttgcatctacgtgggatttttgcttttccgaatgaatttgccacatggagccaatgtttttcccaaggaaaactatccgataagcagatgtaaatgaacactattcattcgaattggacttccgacttagttcgttggtggcattcgatttcaggtcgatatttaccgagaccaccaacaaattggggtactccaacaatgtctgcttagagagaagccgcgggtgtcggcgtgtcgcgcatccattgattattgtgcatcgttgcacccctaatctcctatcccttggaacaaaagagaatatggcagggttgtgcccaaggtaatctataattcacagggggtctaagatcaaattcaatggctctctatgaatgtctgcaactcaaagaatcaataaacatgctgcactatcattctatgatctatcagcacttcattatcagaacatgtcaacacctgttgagcttctattaactaaataatacttactcaaagaatgttccgtggtgcatagatctcgagggtctaatatcgagcacgttaggacacatcctaactccacaaatgaatgcaaatggtgagttggtgaccggaacaaggagtgggaaacgacggtgatgaagatacaagctgtgctcgagcttgacgtgtgcgctaaggctgctagggcgctggatgctgccaaccctgctcgctcgcggagtcacgagcacggccaccgcagtatgaaaagcgccgaagacgcgggcttaagcctgacgagcatggtggccaattgacgaggtgtactggaacgtggtgttttggcttggccggatgctcgatgctgcatacccaacaaatcactaatcaggccccgttcgaatctccaacaaaagttggataaacttttagataaacgtggcacgtttttcaaactattaaacggtgcgttttgtgcgaaaactttctatatgtaagttgttctaaaatatcatattaatttattttttaagtttgtaataattaaaactcaattaatcatatgttattaccatctcaattcattttt

SEQ ID NO: 30409 - DNA, 1501 bp, Oryza sativa
acttgttccggatacatgcaacatgaatttgataatcatgggtctattttctatgctcaaagactggactatttattattccccgtatgggttatcaactgaatacttgcgccagtcggaattcaattgttatatctattttggagtatcccataaaggataatcactcagatcagaagctattcatatgagctacacttggtctatatcacccgaaagatttattactcgggagcatgttacatgcgtcatcctttaaagggtgtcgaatgcatattttttggcctaggcctaatatgtctgcagcccatattttcaggtgtggcctgtcacgttcttttagggacttaggcatctttttgcttaggcaaaagtgcgcgtgattatgtgcccaataccttaaaattcttttataccgcagttacttaactttttaggagttggtacaatacattttaaaaggtgccaaacagtaatgctttatatagctccccgctgacttttttatataagtcaaggcgttgtttgggttcataaagcaattgattggatacaatatcattgctttttgccacgtaagtgtgcacttttattgaccaatattatggcttaggctgattatatattttggtcattttccacgcggttggtaaatcctttatgagtttatttactcggattttataccacatatgccatatatttccaggtgtggtggaaccatgtgtcttctagggacttaagcacatctgttaaaacagtgtgcgcatgatgtatgcccaatactttggaaatttctttattcacaacatacaagcttctttatagctggtttgctatgtgaattttcaatgatgtagtcaactttaggttacactcatcatattttacaaagcagtcggtatatcactcggatcatgttattcagggattcacaccgcatatgctacatattaatatcaagtcacttggttgactataattatcgaagccactcggttggttggattatttattccttgactatatgcttagtttgttcaattaaccacatagtcgagggctacacctattaggtgcatctagtcgatgcacctgactttatttttcagccctccatagtctttagatttggtaaaagtactcgggagaccatggcaaagatgattgaagcactcggctgtggagtaatctagttcgaaagaagattatcttttcgactgtgaaggtctcaggggctactgtggagattatgggtaccccatacccacacggcatggttatccgactagttataggggataacttatatatatggaatatgtaacagattatgacttgggtattatgtttccttgtatattacagaacggcctaaagtcctggtttgataagattgtaaagtagatttaggaaaccaataccgtattggataaggtttctatcttgtaatcctgccccccatcctatataaggtaggcaggaggccctctagggtgca

SEQ ID NO: 30410 - DNA, 199 bp, Oryza sativa
tgttaccttaagaatgaccaacatccccattctaaaacttaaagtggcacacagaagtctgtaaaattattttacaataccacaatagttttggttggtttattagcaagcatttcattctgttgtgagatatttctgttctcttatcatgttgtatatgtatctctaattctcttttttctgatcaaatgaattcagc

SEQ ID NO: 30411 - DNA, 1501 bp, Oryza sativa
gggatgtgcgtctcgcccatctccaccacccgcaccggccgcccgtacggcgtcctccccgccgccagcgactggatcccgccgccgaagaagtactcgttcccgtacaccaccacgcccgtatgcctacccaacaaatcaaatccgatttaatttagcccaaacccaaatccaaaaatccaccagattaagccgccagatctgattcactcaccagatggcctcgattggcttgccgaggaaggaggtggagagctgccgcgcgaggccgttgctgaggtcgtacacgttaagaacaaccttgtacccttcctgccacaccatcaacacccaaatccctctccgccattagcgattgttacaggagcagcagccaatgaagaggacgagttcaggtaggggaccgacgagccttacctccgccattagcacgcggcagaaatcttagcagcagaagtagttcggatttcgcagcacgaacacgccgaatctccgggagaagacgaacaaaagcaaccgcaagtccgcaacacgcgtggatctggaccaaaggcggaacggaggcgggcgagacgagggagaaatataaagaaataacaaggtgattatatgagtaatcaaaaagaattaatggaggaagcttctggagccgtgtgctcctccgggtggggagaagggagacggaaacggaggcgtgcgggttttcgtggccgtccgatcgggggatagggggtgacgtggcgacggatggaggcaggtgcgaggccgctttcgttgaaaattccaagcgcgtcgcggagtgacgggaatcttctagaaggggagtggctcgggtaccggacgcgtggttggttgggaatcggttgcgtccggctcagctggcagctgggtcctcgagtgtttgaggcagcttcgacttccgaataaacgtgctttttttatacgactttcgaatttgttctagcatcagcatgaatgcatgatggcgtcctctcgtctctggctctctctggacttctgcagacatgcggaatttttttaagccgttttatcccacttctgttttgtttttcttctaaaatgtatattagaaataagctttgcaagcagaatttatgtgagtagtgagggagccatcatattcgcggaataagcgaaacgacatatttgcaaacgaaaagtaatttgcgaataaaacttttatatacgtgttcttagtgatctaaaaataaaggctagaaaataaatttcgataaaaacaaacctcaaaatcagtttcaaatttaaggttaaaaaaatcaaattttggttgataagcataagaataaatgaaaagatgaggccctaagattgctcacttagaggcggttcagtttactaccattttcaaccacaccaaactttaggattgtgaagcaatctaaacacatctcaaatactccacaatatcttaccatgtcaaaattcggtgattttctgaaaacttcttcacacaacggta

SEQ ID NO: 30412 - DNA, 202 bp, Oryza sativa
cccccccccccccccccccgggtgctcgatcgaggcttccgcgcagctctatgttctaataactgcccttggcctgaatctgaatttactctggacgcgaacccgagcaatatcgcatcgccaacaaggaaatctgtcagtaattagcttcagaggcaatcagacctgcctgcgccatcctcttcgatcttcttcgtctagc

SEQ ID NO: 30413 - DNA, 379 bp, Oryza sativa
tcattgatggaccggctgagatcggcatcgtggtgtaaaccgggaagacgatttcgccgacttgagtccacaccagcattgttgaagcaggaaatacttggttgagttggtgttgacgctgttgtcgacgaagctggatgacatagtagtagaaccttgagcaccaagtcctcctgcctggcgcgccactgtcgacgggtgatacccgtagaccggatatagaaggtattggggtacgttggtacaagggtctatgtagtacgacatcaagcagacaaaagacgaagattatactggttcaggccccttgataggtaatagccctaatccagttgatgtgggattatatgatggaaaacacaggttacaaagggaacaa

SEQ ID NO: 30414 - DNA, 1501 bp, Oryza sativa
gcatggatgctcgcaatcaagtctgctggcaggaggcagagagagcaactctcagccacaggtaggagtagctctcatcgctagcagacacgtacagaaaagcactgtaattccagctcgaattccccttcaatgcgctcaagatgtgtaccggccgtccgcagaatagaccggagcatgcatgctgtagctttcaacatcccaaccaccttcgacctactacgactgctatgtacacccgaccactacgtacaaatatactccctacttccctaaatatttgacgtcgttaatttttttaaaaatatttgaccgttcgtcttattcaaaaacttttgtgaaatgtgtaaaactatatgtataaataaaagtatatttaacaataaatcaaatgataggaaaagaattaacaattacttacattttttgaataagacaaacggtcaaagatttttaaaaaagtcaacggcgttaaacattttgagatggaggtagtattagttagcatcaaaaagggaacgtcgtggtctctcagggtacatcgatttgccctttcaatacgataaccatgcatgttgttatcgcctcatccgtgagtatgggactactcctaacggctaatacaaacctagggtgtgtttggttcacgatcatatatggatgagatatgctcatccatattttgttgaatatagtgatttaatattttttttttcatttggtttgtacgcatatgatgattcaactttttgtttgggtggaacaatgtagcatggataggagaagccaaaatttagtaggacccatttattatatatactctctatgtttcatgtgataagatgtttgacttttttcgtagacaaattttgttaagtttgataaagtttatagaaaaatatagcaacatctaaaatattaaattagttttattaaatctaacattgaatatattttgataatatgttttagataatattaaattagttaagagttctcttctgcagtcatctaaaaagagttcttctacaggtaattaatttggtctatagttctatatacgcatgtaggcaatatgggagaacaaaatggcaatgtataacaatatatgagaatagaatataaaacacttaatttttatttttatcttcatctccggaggattcaaacaccacctaactgatactgttatagtaagagattttagatggacccgcatgcggactcctattttaagctcatgattttctaaaaaataaaatatccaatcaaaatatcaaccagcgtcgctgggttggacgacaggagtaaaagctagctatcgtcttttgatccggccctgatcaatggatttccactctctcagctcggcctatataaagctaacgagtacactccactcccacagccatctcctctctactgtcaatctcaagtgcgtgcccggtatcagctcgaccggtctcgcacctgcaaccaaaccacacacagctagctatca

SEQ ID NO: 30415 - DNA, 307 bp, Oryza sativa
catttcgaccaaattagctgatttgcaaatgatttccaccgtggtgtgacaaaattgcccctgtgaccatttagttgacttgcgtggaggagatggatccctgccctggcaccggcgcggctggggacggatcgacgcctccctcctcgccgacaacccaaactccaagctcactgtcacctacttctccccgctcgcctccgtctccctcgccccgtcctcccccatcgcttctccccgctcgcctccgtctccctcgccccgtcctcccccatcgccgtcgccacgctcccgcccttcgcgcagc

SEQ ID NO: 30416 - DNA, 339 bp, Oryza sativa
atacccccaagtctttcatgaaggagtttatatagtttcatttttggcatttagaacatatcatacatttattaattgattgactagagaggtatataactaatgcaccacatgaaaagtccatagtgattgttcattaccttgacttcaagagttataccgaaaaaaaaaacaattgacaaaaactagtcttttggagaaaatggaaagttgaaaaaaaacactgaaattaaatattttgtcttaacaaacaatagtgcattttttgaaaaagcaaatattttacactctttgagagagaatatttgtaatactctgaccaaattgtcttttggcagc

SEQ ID NO: 30417 - DNA, 250 bp, Oryza sativa
tctacaccgatcaatctgatgaccgcttactttctctatttgatattgtactagcaaaatacccgtgcttcgctacggtgtattaaaactaaaaatttttggttctaaccgaagttattcttacactgcttttggtacttttgctcgctagaaaaagtctcaaatgatagaaagaaatatagttccgaggaaagggagataaaaaaacaaagccggtttgatttccacctttatacggtgcgagtcaaca

SEQ ID NO: 30418 - DNA, 1501 bp, Oryza sativa
agcaacatatatagttcatagctaaaaactgcatatattttaaggcagaaaacgcaatactataatgtaagcataactttggccatattaagatatgactaacattgaagttcattaatccattgtcgagccattaaagtcatagttctctccgtccaaaaataataaatgcatccatgtaattcaaatttgaactacacgtctactacaattattttggaatggaggaagtactccctccatctacttttgatagtcatatttcatcttggcacacagatcaagaataagtaattctacttatcatctatttaaacatgctactaatatttcctcgtagacaagtgattcattagtatttacatttctcgatgcccatacagccaatcttgtgtggaagaatggagagtcacacattaaatttgagaaagtcattaagatgataggttgttggattgaaatatgcctattaaaaataaaattttcagatttaaaaatacgcctatcaaaactagatggagggagtagtatttagaagttgttcggattgataccatttcgaaccataccagtaaagttgccaaacatgtgtatctatttagtttttttaccaaactctagtaaatacaaaagaaatcctgtcaaaacttggtaatattgctaaattgctaaaatttttgtaaggtttattttagctacaatctaaacagacctttagatataaaccagtgcgagatataggggttattcatattataatggtaagttggcaatattaccaaaaatttgatatgatttcttatatatttatcaaagtttagaaaaaaactaaatgcatatatatttttgacaactttataaaaaaataatatgatttaaaatgatatcaatctgaacacccatgtaaacgggtgcgaatgataattggcacattattgtccatgaaccattgcgcaaaaatgcgtgcggccgtctgccatccgaaccttcccgaaccgggttcaccactgtaagaaccaagccgcactcaaaacccacgtacaccccatgccttgcctcatctggctccctctcttcctctccctccctccctcccttcgctcgctttctctctcctccccttccctttcctccccttccatctctctctctctttctctcatctcctcctcgcttcttctcaagcaaagctagcggcgagctcggagtagcggcgcgctctctcgtacgccaaccgcccggctcctcctcctcctccccttcgggaccccgtgcccgagctcgccgccgccgatcgggcattggatccttccaccaccggtgttcgttcgtagcggattttatttttgcggggtttctcggcatcccctgagtcgcgggatcgcgcccaatcggtaatgtgggctctgatcccttcgtttcacgcgaatttggggctcgattcgttgctgatttctgccgcgtttggttctggtcggtttaatctgtttttgcttgcaga

SEQ ID NO: 30419 - DNA, 1317 bp, Oryza sativa
  unsure (1)..(1317): unsure at all n locations
attatttatgtatgcacctttatctggtgcgcattcaaattcatgtatgttcaaagaagtttgccggattgcgcttggtttggctgggtctactctagattgaaaatcggatctgagaggaaattgtgacaaaagacaagttagttctcaggttattactctatccccaaatggtcattctttaaggtgactgagaatagnngggattagatctgcaacatgtaacactgaaagttcagcatgtgaagctgttctgtttcagtaatcnnnnatntanttaataatctgcacttaaagttcaaacatctattaacttgtgatctgaaccagcatacatattggtgtcacgaagataaccattttgttcgattaatttcctggggcaaggcagctgcagttctgattcgattgataatttcacagattctgacatctgctaccaaattctgccccccttatattatccaattgaaatccttaggtggataatttcacagatgcttacattttgttatatcacttgattggcatgactatggattggcatgactatggattgcagaataaaccaagttgtgccaaaaaattctttgcagaggatgacttcttttcccccttgatttgtgccattgtggttgggtgggtttctttaggcatgatgggtacattgatcaactcctttgccgggtgttaagccgaaatgcattaaacaatgcaggcactaatggtgagctctgatcagctgagattcctcagtagtttattgaattggatagaatctccagtttgtcgtcctctcagtcgctggagatgtattttatgagacttaaactgctgttacctgctctgatcttatattgttatactaatgccattatagtgtatatcacgcaatcctgataagaacagatgatttttttccctcttgtgtttaccggacaaaagccagaacaatggagataaatgatacttcctctgttttatattataaatttatcctaagttaaaccttttcaagtttgatcaaatttataaaaaaaatatagcaatattttcaacacaaaattaaaaatatactataaaaacatattcaataataaatttagtggaactaatttagtgttgtaattttttctataaactcggttaaacttagaaatgtttgagttaggacaaatctaaaatgacttagaatatgaaacagaggaagtagcatctactgcatcatatatgttgcagaatggctgtatttcaggctttcagcagcattttcaattaccaagatacgaaaatgccacagaaaaaaaactcataatt

SEQ ID NO: 30420 - DNA, 1501 bp, Oryza sativa
tgatgtgcttgtttatggaatgtgcactgtcggtttgggtgcaagtctcagaggcgtaggtctacagccagatgaaagatttgttttgtttcttatctcttctcaatttaccagtttaatttgattgcattgctaattagctatctccgttttactaattatcgtatatctcctagttcatgagtcggcaccttgttgtttttgttttgttataaaggttgctagtgtttataggagataaattaattaatgagaagtatcacaaagggcttttcagccacactctagcattagctgatcggccgatcagagccgcccgacaacatgcagggatgagccctcctcagcttgagggttgttttctctgttcctactaatgttccctcttcccccacaagatatttggcctgttcttgacagacgcaggcttccgtgtatcatgttagtccagcacttctagtataattactgtgctatatgcccttctattaacagtctacagtttaatgttgaaaatagggaagaacataatgagaggatgctcaataaaaattactgaaatgtagagtattccacataattatcctgaaacctagttagtgcaaatatgattccacacttcttgccttaagataggtctatgactctggtagattatttgtctattgcatgaccatttgttatgccaaacaaattacagggtattcaggaaaggcattatactgtttttgttgagcattctcttgttttgaggttctccattatgagcattaatgcttagattgcaacagaacaaaaaaagagcattaatgtgaatcttttacctgtgctcaaattcattagttattgcatgcctttgaatttcagaaggtccgaaatttcagatccagaaaaaatcaaacagtactattacagtatttgagaaattaagaaccgcagaacatgaaattatagtaacacaattgcaaaatccacaagttggaatgtgacgttgcaaaaggcgttagattaacaaaatatcattctgttagttgttacattcacttgatggttggtcccacctgatagccacctctctctttcctcttctccaaatctgaatctctctctctctctctctccctcgcccattcattactgaaaacagtgaacttgtaatgtaaatttctcagcactaacagagccacagagaacacatgaactaaacggtggtgttattttcataattttgatctgatctttataggatgatagttgataaagatcttcttttgtggcaatatttccctaatttcatgtccctgctatggtagaaaaatagttttctcaatatattttagggttagtgactagtgactcgtattgatttcacttgttttttctatgtgcatttatatatgcttatattattaaactcatgtcttaattaaaatatgtttctaatgtagattgtgatactccaaaatccaaattggattagattctacatgacaagagaaca

SEQ ID NO: 30421 - DNA, 1501 bp, Oryza sativa
gggctttagggcccatgacgctcttgactgccgtgtgcgcatgcgccgtgcgcttgagttaggttccctgccgtcggcgttgttacgtttgatggtaccaatatcgtacaaaaaattcgtatgcgtagcattttccagaaaaaaattgaaaatattttttagtttggacgcggataggcgcggctgccatgcttgggccgggcggctgggccgagagggaaagagggagggaggcccgggagagagagaggagaggaagaagagagggagggaagagagacttgggccgcgggccgagggagaggagggggactttgggccggactgggcccaaaggaggaaggagggtttatttttagtttttctttttaataaactctaataattgttttttttcttaataactattttccgtgctctgaaaatacaagtaaaatttgagggcaccttttagaccaaggaggatttaacggaaattctccgggcaacacgaatttttcttgtatgtattttagtgtttgtcaatttcttttcgaattttaattaattctattattccttttagagaatgatttttaattcgggatgaatttatcaggacgtgacattggtgataaggtggaggagagaagttaggagagagagagaatgagccacccccttatggcatagcttgtgtgcttcaattgtgcatattgatatgacagaagaaagtgatagttttagatggaactttcatcaaaatggtcaattcacagtttgatctatgtatttagctttaataataatggttatattgagaggaataagattaattggaaacttaagatgcctctcaagattaagatttttacgtggtatctacttaaaggaattgtgttaactaaggataatttggctaggaggaattgaaatggtagtttaagatgtttttttataaaaaatgaaaccatctaccatctattcttcgattgctatttttcgagatttctttggagttactttggtttacatcctccacaaagtatatctcatatgtttgggaattggcttgttggtgttgataaaaaaattaagaatcttattcttgttggagcatccgctttatgttgggttctttggcttagtaggaatgacatggtttttgatatatcaccatcaaaattttatttgcaggtacttttcagggcaacgtaattgctccattgttgggcttaattataaaggtgtgaagaagatatcagcttaattaatgatggcatgtcgtaaacttgagtcaacgattatgcaactctttgttaactttggatggaggttctcaaatagaattaaatagttgtgggatctttatcttgtgtcagtatatattagttgtgcttgtttgaaattttcattggactcactatgtgagtttgctattgtgtgaactatgtaataattggttgtagctcgtttgagcaaatgccgggatattttattccattatcaaaaaaagggggca

SEQ ID NO: 30422 - DNA, 1501 bp, Oryza sativa
tgattgctcggtgtgacggatcggagtccgggaggcttcggattgttctcaccctcaccacttcatcgcatccgaccttggtaggtataaagatagttatcctcttgctgctcgtagctagttaccctcttgtgtttcggtttacgccggcactctgtcttgaacctactgctgtgaagatcgggccacccctcgcgagtgtgttcgtatcaggattcctatatgtaaataatcttagttaagttaaggtaaaactctattagtttcttcgagcaacggttcactcctggtctaccaagggactccagcatgtatctctatgatgtacccgaacgtgaaggattaagaaagacggacatgattgtcaccacatgttggctgttgcctacgtttgcattccatggagcacacaataaatgaaggtaacttctaacctagacaacacctctacaacattgattacaactcggccaagaactttcttctttatctacaatcttagtactagagcacttagtataaatactaagcgatgaacctgtcgcaaagataaaaatatatcatacttaaataagaaaagtaaataccaaagaaaatcatgaatacttacttatataaaagacaaaatcgtcgaggtacaagataggagagagtgccgacatctccggcaatcctccagtacaccccatggagagaatgtcgacatctccagcactcctccaaaactcggagagaactccgatattttgggcacttctttcggagcttcccctcattctcttcctatattctaactctactatagagtaggctaaatataaaagtgagttgtactcaactttctggtgttttgagagtgggaacttctcctccttatgtagcctgggaatcaagcataaccgccataggggaggcctgaggaagcgacatgtggaagctgtggcagtgatcagtcacactcttggttcgaccgaaccatggttcagagggaatcactttcaccgcctttcttcctcattttcgccttagtcattgtcctatgggtcctcatgacggtgcatagtaaattggcttcaattatgttagcttcatatgattagttggcccatggatcttctgctagcgtttgagtggccggaggtggttttcttcgcatggcaggtggttttcttccataattacatgcatacaaatattcaccaacactcgtgaaaatggttaataataaatcctatcactaggtttaatatttcattgatttgcttttatacaggaattgatagttatatttggtattaaaggactatcaacaattccgaaacatgagaaggtattacctctcatcgagagggcctaaacctgtctaaacctttgtcccgataatcaatccacgtttagatcttgtatttgtatactacccattttagcattgttgatatacgacaccgacagttggcgcgccaggtaggggttgcattgagtttttcagtgacaatcatga

SEQ ID NO: 30423 - DNA, 1501 bp, Oryza sativa
gcataatatcggacgtccgatttgtagcgctccccgaagacaattttaagcgttgggtttcacacaaataatctaaaagtgttgagtgatgaatgaagaatgaaagaatgtaaaaatgataaatgagttagtgatttattggatagatattaaatactagttgtagttattcggggacatccggtgaaaacgagctaagtattggaaaccggtaaaaatcatacttaaaagtttcataaattcatgaaaaaaaatactagatctaggtgtagatatgaaatacattctcaccaaatctcaacttcaaacttaactttgtttaggagtaacaaaaagacaaattttaagtgaataataacatgacactattcacctaaaatttgtttcttttttttctctaatgaagtagagtttagagttgaaatttggtgagaatgtatttcatatctacacctatctctagtattttttcatgaatttacaaaacttttagatattattttcatgagtttcgaacacttaactcgttttcaccggatatgttctcgtagtttatatacgttcatgatgacaaataactttgcttgaaattgaagttaagagcacttgacagtgcagtgagaagagatatatagtttcaactaagtctcgtgttcaatcccgaatacactcatattttttttctcaaaaatgtttgaagagacgactcttactctaaatctctcttttttttaaaaaaaaaatactccctccattccataatataagacacaaccgcttttattagatgttccataatataaggcatgcatgcaagcatgcaatttactatgacatcttctctattaaattactactccctctgtcccacaatataagggattttgagtttttgtttgcaacgtttgatcactcgtcttatcaatttttttttgcaaatataaaaaatgaaaagttgtgcttaaaatactgtaaataataaagtaagtcacaaataaaataaataataatttcaaaattttttgaataaaacgagtggtcaaacgttgcaagcaaaaactcaaaatcctttatattatgggacggagggagtacttttttaaatcctccactctcatgttatctaatcctattggatacatgcattatatttattaggatgatccaaactacaagatgataatctttggattaatggtggttgtgtcttatattttggaatggagggacttatattttggaattgagggagtacatgagagttaagaaaagacaaagtctcaatcataagaccatagtaaggactgcggcccagtggaaacggatatccgcaggtaaaatgccatttttcatggctggaactgagaaggatatccattctactccagaagtccagaatcgaataagtaaaagacaaaatcaaaaattcagaccaaaaaaaaaatcagagaaatgaaaagaggctgagcaacaactcacctcacggcggcaatgggcctcc

SEQ ID NO: 30424 - DNA, 1501 bp, Oryza sativa
aagaaatgttaattatatggaagacttgctaattaatagtacggcatgtgaaacatttacataattgaccgaataaaacattctgtattctagcacattaatatgtttttacttgttggcccattatgcgtcaaagccaagtctcttttgagatgttattttgagcttagatttttttgcaagttttcatttatctaagttatcacaaaagctaccgattattgtcgcttagttaatttttactctatctcatatatatctaagaaatcaaactaattccaaactagtaatctgctcgtgctaacgctacggctgtttttgataatacaaatcaaaatatatgtctaaaaatacaaatatccaagcaaagatatgaagtatatgttcttatgtgaatgctaaaggatcaacacatatttagccttaaaacaataattccatattcttaaatttatagtattttatgaacttgttgaaaaatataaaattatggtcaaacgcacgccaccaatacaaaataattcaaaaatcatataacttttaatttttgtataagggagtagtaaatttagatggactaattaattgcatcttatgcatatgcacaaacggtaaattatttgaatgtttgcacaaaaggtatatgcaccgatattataacattataacctgaactgtctcatttcttctccaaaagggaatatctgacaattctttatccacaatttgcatacaaatacatctgataaatcttaaatctctccatacatttactatcagaacttccgcatgtctaaatgtaccagaccccgcataacccatcaacacattttcctggaggatatggacaactccaacagcttatcagccaagtgcacctagatgacacgcatattgatatcttaggattgttgcggcaacatatttcatataacacaataaatttcatagcatctttgaaacctcatttaacacgctgaacttttaaaataaaaaatataatcaatacttaacagtacactattattgacttgttcgtagttcatacattccatttgtaaaataaatttaaaagcatcttacaacacaaacatgcatttcttcactgcacaaaatatcttaatgagaaaactgcaccagaaggttagcaacgtaccatgacaaagcaaaaaaatcatatcatatattcattattggaccatttgctcaggtgaacagtttggtgccatacaaactcctgggaacatgaaaaagcttggcgccatataaagtagggtgagtggagataagtgtaggcatacatcatgacagattgaaataaacagtatcgatctatgaggtgtaaagtattttgtaggaaattgattagggagagaatagttacctgatttagagggatgctgtcatggctttaattcatgctatttggtccaattcggcagtcagtcaggattttctttttcatgattcttaaacaatggagccagaacagatcctcctt

SEQ ID NO: 30425 - DNA, 1501 bp, Oryza sativa
cttggtaggtgggtgctgaggtttgctaaatccttcaccgcttgcctctttattcttgcttaatgaaatgatacgcagatcccatgcgtattcggaaaaaaaaaatcttctcatagagttttttaagccttgggaaacaatttgcatggttattgcttgaatgttcatactggtaaagatttctctcaagaacaaccaactaatgaagatagtttaggcaagacaggtaataaactgattaaacaatgtaaaccaaacagacaaaaatagtatcatatcaacaacatgaactaccatacaagcttcggtattacatttcatccaccaaacagttcgcccaaaatcttaaaagttgctgacatataaggatgacccatacttcaataaaatgtgtaaaattacccatatataaagaaaaaaaagaaacggtaggaatgtactagtttcccaagtggataattataagaatgaacataaatactgcacaaaaaagccacatatgggttgtacctcattcagtgaatgcaccagtgcatcctcgccaagagatgcatagatagttacaactgttagattttgtcgaaagcatccctgacaaaataaaacaattattgtcatacaggttcataggttctcacaaatgtatacagaaagccacactatttattataatcacctgagcagcaatgatccactcagttcttgtatcagcaaatattgcagcacgactatctcgttggtgacccaacttgatgagaccagaagaaaaattacatgcacgactaaatgcttctgcgtaggtatcccattcatattcacctaaatgcaatttctcgaacttcctgccatcaggtgactccacaaattctctattgattagcttccttgtgccaagacacctgtgtcgagggtattttttgctagccatctcaaataaagctgccattgtggtggcaccctcccatggaacttcaactaacatggaaaatctactgtttcgcatggcaagtcctgcctcaccacccacatcagcttgtactgctcttttctttccctttttgttgaatatggaagaaagcatgataggaataactacagcaagtagaatggcaccaataattccaggcagaccatactctttcaccagtggaacatcacttgtggcaattctttgaagaattgacatgtttggattatcgccagtattttctcccatgattttaagatttcatcaactgaaagatttcacaaatttcgctacaagaaagtataaagtgttaataaccgtcatgttagtatgttgcaaataagtaataactaatttcttctcaattttataaataattgccttgaacagaagaaatgagtataactagattagtgcagcatggagaatgctttcgcactacagtagcattctatttaacattatgaatcatggaaaaatgaaaaatactagcaatgaacaatatttagaagcactggtactcttcttccaact

SEQ ID NO: 30426 - DNA, 1501 bp, Oryza sativa
ccctgccttcctgccagcaatgatgagagggaaaagataaacgtcattgataggtgggtcccacaaggtgacatagcaggttagaccaaatcaaagtgccacatcagcaaaacagtccttcaaaaccgtctgagggagttaatagtcgagatatccgatattgcagttcatggatatgaattagatttaaccactaaggagtcaaagtggacttattcccattggtgctcgactcactaaggcctgcgtgactgcacaattaagaatgtagcccagttactcctcccccactgctccatccatttcaaattacttaggtcccgttcgtgtccactagaaatagttgataaaattttgaatatttgtggcacgcttttcaaacggctaaacggtatgtttcgtgcggaaactttttctatatgaaagttgctctaaatatcaaattaatctatttttcaagtttgtaataattaaaactcaattaatcatacgttaatatcaccttgttttacgtaaaacacttaatcttaatcttaatcttaatctttatctttaggaaaaaagaattattctaatcaaacattttaatctttaaccgttaatttctatatataaaaattttaacatcataagaattacacttttgacactatgagaaatatttttataattaacaattcatatgtggttaaactgaacataattctaaaaactaatgttaaacatagggatgtttcacttaggacaaagcctataactttaagtaatttgaaattgggaaagtagttattagtagtatcaatagtaaaccaacatgcatattagcgatcaccagacccgttccttttacacccgcaacagtagaggcgtgagaagatataaaacacatgtgtccttccttttacaaaaacatagacaatgtacttcctccgtcccaatatataacaacttaggatgggattagaccaatcctagaactacggatctcactactacaaaagtgatttttctgtacgagagcccatgaattttgcaaacggaccattactagtggcgtctgcaaaaatcgagggtcattgtcccatacggctccttaagtggcccgtatggaaaaatcgattttcccctacgggcctcttaagatggccgtatgcaaaaatgagtttatttttgcatgtggctgtttgacgaccaaatttggtaaattatgaaccacgttcgacattgagatcgaggcggattcaacaaagaggttgattcgaagaacagagtatgcatcggctagaatctgcattggctgagatggatcggacagaggacagccgatacagccgatagaggtgatgcagccgatttcgatgatgacagtttcgaagatgtttctagaatcaatcaaggtgcttcatgaagattgctgtgatggagatagggctcttggataggcaattgtatctattaattaggatattttatgtaatttctttagagatatgtttgggca

SEQ ID NO: 30427 - DNA, 1501 bp, Oryza sativa
actctacgttacagatattaaaacagatagaatatatcaaacagaagtctgatatactttattgcgataaaatcttaatataaagggcagacttagcatattagttaagcatataaaacataaagctaagtcaggtaagatcggctgaaaccccgatactatctctctcgatgatcataaaacaagctagatatcacaattatgaattctacttaatagatcgaactcaaccgatgcagcattaaacataaagacaagtatgagatctaagcaggatgatgaaaatctacaagagatggtagatatatgatacaatctaaattaataataaaacataactctaccgattgtttcctaacgataagaaccagccgataacaagttatatagcgccactagcatagattgcaacatgtatatgataactcgatggattacataaacagggttaaagtatcatagagatggaagcattaacctcgataacgcaagccgccataacaagttttacttctagttgaagatcgaatcgatgcagctcaacccgaaagcaagaactcgtagaaataaacgaaagtaaaagggtggctgtcgacgggtgatacccgtagaccggatatagagggtattggggtacgttggtacaagggtctacgtagtacgacatcaagcagacaaaagacgaagattatactggttcaggccccttgataggtaatagccctaatccagttgatgtgggattatatgatggaaaacacaggttacaaagggaacaatggaactcgatggatctggcgagatcgtagtcgagttggttcgactaaatccccggcgatttggctcctgcaggctccgactttgtaggctgtgggggttgtgttggctctgagattcgatgccttaggtcctccttggggggtcccttttatatcgcaggtcaggcggtttccaagtagaactcggagacatcaaacctcacatgatacgttgacgacccagtctggtccgagtaggactctttccatccgtaaattccgtgaaggatttccttaatgcatgcggagggtatccgtatgcgcgtgggtatgccataccgatatgcgacgtatatcaaagggtaaagggtatacctaactcgtaaccctgatagtagcccccgacttctgcttaaatgaactcgtgtaaccatttgcgacttcttgtgtcgagattgttgttgttcccggtgtgaggaccgtagagataggacgtagtcgagaacaccatgtgaagcccaacggtcacgagtgaatttaaactgaagtccaagaaactaccacgcgtaacggacccagaaatttccggcggccatctctctcctttccttggaattcgcaccgtcagtagtgcgtctatttaaaggaattttggggatccattttgaagtccgcctactgtgaagaaaacatcccgcctgcaagcgttcttcgtcttctccgctcccacaagaaaccctagc

SEQ ID NO: 30428 - DNA, 382 bp, Oryza sativa
agcatgtgacagaacctcatttagcaaattagcagactgatcctccagaaatgtcattattagacagctaaattcagaattagtaagaattaagggaggagcagtctaagaatgttctaaaaatgcaggcttgcaacaacgtgaggaggacaagaaagtgcaatatatcgctgattaccaatctgggattttctgtattactaatgatgtaatagtagctactgacgtgtggacctggacccatatgtcagtgactgttactacaccaacaatactggagaggatgatatatgccgctaactacttttaggatacttgcatgtcccatttgatagatgaagacaagatgaagagctttttttcttgtgatgtatattagcta

SEQ ID NO: 30429 - DNA, 331 bp, Oryza sativa
ccacaccaacttttgccagatgttcacccaattgtgggtagtaggtattaaatggagcaacctgttggtacagaaaaggagaaatttgactatagtaaaaggttaaaatcaaagcacagtatgttattaatagcacatcaataagttcagcattggacaaacttcatactttcttccagctgtaacccaacaacctaaaaactatgtaagaataagtttagagcaagtttaatagtagagctaactgctagttataaacccacattagagttaacatgtataatagattagctataaggttggctaaatttttcatctcctctctcttagg

SEQ ID NO: 30430 - DNA, 271 bp, Oryza sativa
tgaacgtggacagctagctaataaaaaggcaaaaaaggaatggaaatttcggcgtacacgtacattcagtagcagatcgatttggggggagggggggtggggggtgaaaacggtcagggagattccgatcgaccgggcgccgtttccttcaaggagtatcgtttccgagttccgatcataacgtttttttgactattttttaaattttattttttctaatttctttctgtaccatattaatgttgatattgaatagtttaaatgataaata

SEQ ID NO: 30431 - DNA, 1501 bp, Oryza sativa
tcaatgacgccgccacctgatggtccacgagcggcccgacgatgtcagtcagaggaagagcctacgcttcataaagtcacaaagtgatctcagaagaaaaacgcagaatgtctattgagtacacttacattgatggcagcgtcgtgttcggccgcccccttctcacaaaggggaacggggatgttactcgccgttgtcgggccactgatcatcacctggccgacacgacgtcccacggtttcattgttcagacctgtaaatcgagaaccaaatttcgataaatcaggaggaacgtgcacacgagcatgtcaagataaatgcaagaaagataccccgaggagaaacccgggtcgcgtcctccggtccggaatagtcaaaggctagatggactcgagcctggagcggctggatccgtctaccaacgaagtcagcagcgatttcatacctcgacaaacctcgtactcggagatcgtcgacaatatcgatgaacgattgaagagaaggggtcaaagggggctttgcggtccaagacaaaatcttgtccggttgttccttagaacgatgaagacaggatccaaatcttcgatctgaagatagaaccacctcgtctaccatttgctgcaagaggaagggcactggaaggggatataacgcgacttcaggccatcccgaagtcggaacccgacgcatccagataccctgttggactccatccaacgcagctcatagtagaagcgaaagagatcaagaaagggctctaccccaatgtaggccgtcacaaagatgtgaaaaaatactaaggaaggcgatagaattggggttcagatagagcaaagaaagaccatagaagttcaaaaccaagagaagaaattcggaaggcggagggagaaaaccgcagagaatgtagtcctcgatcgcaaccatgcgacctaagacgggctggggttcagtacctcctgcttccctttccatggttccacgactgggaagggcgccgtcctcctgaagcttctttagcgacgcgttggtggaggatgatttgccaagatccatcgccgatcggagatcgccggagaaagggctaaggtcgacgagctagggtttcttgtgggagcggagaagacgaagaacgcttgcaggcgggatgttttcttcacagtaggcggacttcaaaatggatccccaaaattcctttaaatagacgcactactgacggtgcgaattccaaggaaaggagagagatggccgccggaaatttctgggtccgttacgcgtggtagtttcttggacttcagtttaaattcactcgtgaccgttgggcttcacatggtgttctcgactacgtcctatctctacggtcctcacaccgggaacaacaacaatctcgacacaagaagtcgcaaatggttacacgagttcatttaagcagaagtcgggggctactatcagggttacgagttaggtataccctttaccctttgatatacgtcgcatatcggta

SEQ ID NO: 30432 - DNA, 1501 bp, Oryza sativa
tactatataacgtgagagatattactctctaaatattgagatttacttttttaaagttctcgtctcgctggaacgatatagtaacgcgacgatcattgtgcagtagcacgactactttctacagtaacaatgttataaaagcatttttgtctcgatcattgtgtagtaacatgactattgtctcgctgtaacatcgttttaaagcattatggtgaaaacgattctaaaaaataatatgcgatgtaagagatattattgtttaaagattataattataaaagtttacttgtactaagcttgctactatgtatgtatctttgtatgggtaaagagaattactttagcacttgtgttaacttgtgaccatgcacatgcacttttttagcacttgtattttgcacaagattgagatttaaaacttttgctatgcacaagttgtggtactgtagtagtaccgttactatcatatgctctctgttactgcaatttcatcataatgttattgaaaaaatgcagtaacgacctataaatttcacagtaacgacctataaatttcacagtaatgtatcgtgttactgcacttctgcgataatattactaccgaatcacagtaacaaggtatgattcctacagtaaacataacaggtttatgttcataaaatctgaacagatatatagagaaagcaaacaatgatcccaaatcacatagtgttatagggtgaattggttaggagagtttgttataccatgagatcatgtgttctagtcttgaatttaccaatttaaagagaaaaaaggagaagggagggagagatcgggaggaggggagggagagatcaagagagatcggcagggagggagaagagaaaaaaaaagaagggagggagagatcgagagagatcggcgcgcggaggaagagaaggaaaaaaagagggagagacgcgcgtgggggctgaagagggaggcacgcgcgtggggtgggctgggccggattgggggagttgagtggagggggtgtagaataattattctaagggaggggtgtacaataaagcttttatatatatatatatatatatatatatatatatatatatatatatatatagtaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggagtgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtca

SEQ ID NO: 30433 - DNA, 1405 bp, Oryza sativa
catcatgtttattttacaacatttgctattataccactaaggagacgtatgaaagttttacttacaatttttttagtaatttttagaaaactacaattttagtgacaaaactatcggtttgctacaacaatagcgacatatgtttcagtttgctacaaaactactctttttttaatttgctaataagtggtgcggataagtataaggataagcaaaacgatggggcttaaagaatttatatttgatgatagttactccctccgtctgacttcatttttagttttttatgtccaacgtttcaccatccgtcttatataatttttttttaaaaaattagtaacacataaaatactattcatattttattatctaattatctaataacaataaaaatactaatcatagaaaatttttaaataagacgaaaagtcaaacgttatatcaagaactgaaaaatggagtaattatttaggccctgtttctttcagcttgggattattataatccagattattgggagtaagctgaaagaaacacacaacttattgaagtagcttattataatctggagcccagcttattataatctgataagctcatttaggtaagctttttccagattattggtgaaaaattacccaccatgccaccccactcactgtttagacttgcaaacccaataatctaggctataataatttagaaaaaaaaacaactagtcgcttattctactacagattataacaatatagcttatagtaatctggcttaataatctagattataataataccaagctgaaagaaacagggtcttagtagaagtacatttgggtcttgtgcctcttgtgcctctggttgcactaatggccattttactcgtgaaattattgacttgctgtacacatataactttttcacctattcgttaattatatttaccggttcagcctacgatattgatagtatttaaaaaaagaaacaactgtcacttaattattttattgtaaactcaccaatcatgccaatccagtcacttacctaacacaaaagtttcaagccattgtatgtgaacaagccatcaaaaaacgaggtgaagcacacggaaaatccctcgagcacatgtgaaacttccccgtgatcatgtcttttaaacaggagtactaacaagtacaccttgattgaagtggattttattattacaccatgaaggatcatggttatgaacatcaatacatcatcaagttgaattcaagcaacttcaaattcaaaaccacacacgtttcttttgggaaataaaaaaaaaacaataaatgaaccagacagggaggggcaaagaagtaaacttccactgaacacatgaaccgaagcccacactgtcccctgcactcggtttcactctcagc

SEQ ID NO: 30434 - DNA, 622 bp, Oryza sativa
ttcctgcacccctgtttgacttagtgcttatactcatataagtcaaaatttaaattttacagcttaatctgaatttgagcttttggttttctggtcgtagtttattttaccgtatctgtcttttagacactaatgacacgtatataaaaacttcacccacaataatcttttatatcgggtgtgtttagttcacgcaaaaattgaaagtttgattgaaattgaaacaatgtgatggaaaagttgaaagtttgtatgtgtaggaaagttttgatgtgatggaaaagttggaaatttaaataaaaagtttgaaactaaggctgtgtttagatccaaagtttttcagtcctttttccatcacaatgatcacatcaacctgtcatacacacaatttttcagtcacatcatctctaattttaaaaaaatctaaactttacgctgaattaaacacagcctaaactcggccatgataataaacgattgggataaacatataaataagaaacaacgagactcttgatgtaccaagccgagtctgaagaagagaaaagagagagagttcagaaaaaggaaacgaccctattctgatcagaaaaattcaatctttctctctctttctctcaga

SEQ ID NO: 30435 - DNA, 462 bp, Oryza sativa
catcatgtttattttacaacatttgctattataccactaaggagacgtatgaaagttttacttacaatttttttagtaatttttagaaaactacaattttagtgacaaaactatcggtttgctacaacaatagcgacatatgtttcagtttgctacaaaactactctttttttaatttgctaataagtggtgcggataagtataaggataagcaaaacgatggggcttaaagaatttatatttgatgatagttactccctccgtctgacttcatttttagttttttatgtccaacgtttcaccatccgtcttatataatttttttttaaaaaattagtaacacataaaatactattcatattttattatctaattatctaataacaataaaaatactaatcatagaaaatttttaaataagacgaaaagtcaaacgttatatcaagaactgaaaaatggagt

SEQ ID NO: 30436 - DNA, 441 bp, Oryza sativa
atggttgatcacttgacctcagttaaccgagcgaagtggactcttttacatccaagtcacgcgtggctagatgtattaggaaccgtttaactccacaagtttggactcaaatgagccggcgtgagcatggagatgctgctcggaatgctctttctagtgaactctaacaggcaggtcaagccttatcttcccctgactaatcactttgtgcctttgtggtcggctccaatacccttatctttcctaaccgtcttgcattctaaaaagatacgcatcctggcagtgtatcagcttagctgtatagttcgttgtctggaaccccgggggtaacgatgttcgttagccagtgaccaatgaactataaacacgatgccatgctggtcctgatcaactcacaatgctgctcgattcagtcacatgcatgacatgcctgttctactg

SEQ ID NO: 30437 - DNA, 1501 bp, Oryza sativa
gataatagcacgttttgaaaatatatctttacttttttattataatataataaaaaaatatatctttcacttttattatagtactagaaaaatgctcgtgcgtggcaatgggtgaaagttattttaatcttattattattgtgcggcttagctaaggtgaaattcactgcgggaatttgcttggattttttatataaaatcatgagctgcaattaggagtccggtccagggtttatattaccagttaaccactaaatttcgagccccatcggtatcacgattttcgataaacttcgactgaattttgaccaaatttactttttaaccttcgaaattccaatcgaaatttaattccgagccttgtcaaaatatcaaaatttcgcggaattcgaccggttttcatcggaatcgtgaaccctggtccggttgtctcaggttagcatgcgagtttttctaaagagatttcttatgcggctccttctgtatttttaaaagcgaacaaacttgaaaatcgactcaaacacggatttgtatttctagaagcgaataaacttaaaaaccaactcaaaacacagatgatgtaccaaagtaacgacaaaaacatcttcaatttttataatagtagagattttgtagacaaatctatatatgttgttttagtgcctttaaactaaatagttttgaagttattgatagttaaagttataaacgttattaatatcttttttgagtcattgatatatgaaacccaatttattgaaagacaacttgtcacaactatcattataaccaaacagcctcaaacttgcctttttttttaacgtggcaacatgtgacaaagtatggtcgacaatcgaacatccctttattcccttcgtccaaaaatttagtagcctgggatgagataaaggctctatttggggagcttaacattctgagaatttgctagttggtagctagcttatgagaatctatatgggtcctagttcattttttttttgagattttccagttttgaggttctagttcattttttagattctacaattacatattaggtgacaaccaaaactgtttagaagagttggagatttaaaaaaagctgcagcagctaaaaactcccttaaatagatcctaaatacgactactgatataggagcattaactatcaatagactacggtggcggataagccgccaaagcagcagggccgaaggtgggggcagtctggtaaattcgcggtggagcaccacagtaccacacacactagagtaaaatccagatccagttggcacgcgcttcgaaacgaaaaaccaatctaatccatcagtgctttaccatctccgagatatttattgcttcatctctcgctggtttgtctcgcactctcgctctccgtacggtacaaacaaaccagaaaccaccacaactgaacaagaagagagtattttctcctctgttccttctcttttgcccttctggttgggaaacaagtaacgac

SEQ ID NO: 30438 - DNA, 214 bp, Oryza sativa
tgggctcttcctttcggttcttgtgcttatcatcagttcatctatttctgtttgtaaccgtcagttcatcttctgaagatcaacggtcacaccgcaaacttggttactctacaattcaatgtgaatacaagtgttttttctcatggattttgttggacaacatacaattcttaactctgactgggacgagtgtttctctgtcagatttgcatac

SEQ ID NO: 30439 - DNA, 250 bp, Oryza sativa
ttaggcgatatatatatatatatatatatatcgatattgacgatgtcaccacgaactctcgttatcgatgggtgtgttccctatcgctgaaagaataattagtcgtaaatattgtaaatgtaagcatccatgctaaatttataacttgaacatttgtggacaaatccatcacaacaaaactagcatgttgaatcaccctcacttcacggctcacaaaatttattttttttgaacgactcgcacgagacga

SEQ ID NO: 30440 - DNA, 1155 bp, Oryza sativa
ccttgagctctatgcatgatgtacccaaatgtggaggaatacaaagaacggacagggctatcactaccttccgcctacctcactttcggtggagcacacaactaacgaagataatttctaacctaaacaccatgcctaacttattaattattactctagccttgcgtaggtacttccttatttatccaagagtcctagtactagatcactcagttgcacactaagcgacgaatctgcactgatgagaatatatctcacttaaataaactaattaaagaacatacagaaactcaaatacttattttaataaataactatccgctgaggtacaagcgagagaagaaggccgacaatcctggatttccctggaactccgttgaaagaatgccaacactcatgcactccataaaattcttggaggaacaccaatttttcaggacactccttccagagcttcccctcactttctaccaaactaacattactaaatactccctcagtcccataaaaaacgaatctagtaccggatgtgacatattctagtaccatgaatctggacatatgtatatccagattcgtagtactaggatgtgttacattcagtactaggttagttttttgtgcgacggagagaatatgaaactacaagtgagttgtactgtacttgagctcaaagttgtgtgtgtttcaagtatgtgaagacctcctttataactgccaacaatagttaaatgacatttttccccttacaaccgtcattgggacttcatcaggacactccatgtggaaggccaggatggggcgccactatggtggttggttcagccaaattgtggcccccacctcctagcctctcctctagctaggcccttatggcagttaggactggttggtcttacttttaagtcggtttcgattgacttgtcggccctccttgtactcgcgcttggttggccggaggttcattttcgtcacatgtcgggtgcatttttcttcttaaataacatgcatatatctatttactaatattagcagaagtggttagtagttaaactcgtaccactaagttttgataatatatttgatatcttttatgcatgaattgatggttaaagttttgtacttaacgaccgtcaacaagaactcactaaaaac

SEQ ID NO: 30441 - DNA, 230 bp, Oryza sativa
tcgttttgtacattgatgcaatttattttctgaacattttttttgcaatatcatcaacctacaatgaaaacatggatgatgaaactagttatcagataaaacgatgcgattgcgaagcctggaccatgctatctgaacaactgaataatgatatggagaaagaatgccaatgtcatttttattagccaaaatttcaagctattgattacggttctatccaccatgattaa

SEQ ID NO: 30442 - DNA, 227 bp, Oryza sativa
gttctttgtattcctccacatttgggtacatcatgcatagagctcaaggccggacttatcctggcagagcaggggagggccggtgcccgaagcattcattagagttttacttttaactttattaactaattaaaagacataggaatactctctagccaatttatgttaggttgttgtatccttggattgaatcctggtcatatataatacacatatgttgcttgtgt

SEQ ID NO: 30443 - DNA, 1501 bp, Oryza sativa; identical to SEQ ID NO: 29668

SEQ ID NO: 30444 - DNA, 1501 bp, Oryza sativa; identical to SEQ ID NO: 29669

SEQ ID NO: 30445 - DNA, 1501 bp, Oryza sativa
tgctcatctccttccttctcccgacggcgacgcaagtcatcaagaacgaacgctatcgtcgtgccactcatattcccatactcactcaacacatggcggcttgccgcaagctttgctggctgcagctgaagctcgccttctatgttgtcaaggatcgcacggccaccagggtgcactgcccagaagaggtcatttcaattaggatccacgtttccaaccgattggaatgtgtcaagcaagcactgtcggatgttgttcttgatcagtgttggcacctggatagagaggtggaaatctatgccgctaccggtggtctgcatgccaagtgcttgctcataacctggtatcgttgtttgcgaggcaacgatcatctcgaatagtggacgctctgcattgaccaatgggccagtgccgacaatgattgctccggcaccatccccaaacagtccatgaccgacgatttttctttcatctgggtttgagaagcatattagcgtcagctcggcgcaggctacaggaacgcgtgcctcacggttgttctcggcgagctccttggcaagttggagtgccctaccgcctccagagcaaccgtggaggctgaggatggtgcaagagactgaagggttgaggccgagtagtgatgccagcttgaggtcagcgcttggagcattgcacccggaataggtgctgaagatgaggtgggtaatgtcagtggctggacggccccacttggcgatggccttacgtgcggcggactcggcaagcttcgggatctcagtggtgacgatgtctacgcgagtttcaagggagggcatgtgtttgtcaatgatctccgggtgctcacagatgagcttttcatcaaggtggatgtagcgtttctctattccttatctgtgacctgaaatggaaaaggaagcacccacatctcttacatttagtacatagctctccgaggttataatggcaggacatatttcaatttgaccgaactccaacatcattacaatgaactatggcaggagtgtcctgaaaatttaagtgcatgcataatttattctcattagagtttatgaaaaataactagagataatgatgatcagtgcaacgatcaaagtggaaggattgatctgcttacatattctcttcattttatccttcagctcagtaagatactcgctcttggttagaccgaagtagtaatcggcaaacccatcttgatagacgatatttgcggggtttgcagtgccgatggcgaggaccgcagcagggccttctgcgtgctgtgtgcacaggcggctgtcaacaacagcggcagtagctgttccaggcatggctgatgaccggaagaacgtgtgcttttgcaactagttgagggaggtggcagtatgatgcgtttatggatggatattctagcttctggttgtgtggctttatactagtttttggacaacctagcccaaggaaacccccaactatgtttgcattagtaaatcacttaaaa

SEQ ID NO: 30446 - DNA, 1501 bp, Oryza sativa
aaacggagtgatgaaggatgctttggggatgtcaagcgggttcatgtggatctggtggtagtcggaatatgcgtccaggaaactcatgagctcgcatccagctgttgaatccacgagctggtcgatccgtggcaaggggaagtcgtctttcggatacgctttgtttaggtctgagaaatcgacacacatgcgccatttgccatttgacttccgcaccaacactggattcaccaaccactccggatggtcaatctcttggattacccctgccctgagcaatttttgtacctcggctttcgccgcttcttggcggtcggcagacatcttgcgcaacttctgttttcttggcttaatgtccagcttgaccgccaggtgatgcatgatgagatctgccggaacaccccccacctcgtcagggctccaggcgaatgtgtcgatgttcttcttgagcacctctaggatactctcaacttcttcttcgcccatgtcgccccccagtgatacaagctttgtggggtcggcatcatcaatctgcactttcgttatcttgccgtgaggggtgggctttggcatgttcttcggctgttcatgcggttcggtctcaacgctgtgcactgctctgttgattatggctagatcgcttttcgaagcggccgaagactgaagccccttgactactatcacccctgccaggccgggcatcttgagcttgaggtaattgtggtgggaaatggcttcaaacttgttcagggttgcacggccgaagatggcgttgtagttgtacgggatgtcgacgacgtcgaacagtatttgctcttcacgtctgttctcccccgagccaaaggctatcagcaagagtgcttggccgagtacttgaactgcttctccgccgaaaccgcggagtgatgctggtgctggggtaagtgcttgggtaggcaaccccatcttggcatatgcttcggcaaagataacttcggccgaactccctccgtcgaccagtattcgtcggacctcgaaactagattacgaaaggatcttgatgcgggaacataactccttctgcgtcttccggcccaaaagaaattagctggtttagatattgcggcgccccttcgcccgccgaagtgatgctgtggaccatacggatctgcatcttcttctgccgcttggacaactggcttggcgggtcggcccttgtaatcacttggattatccttcgctgtgcatcttggcgttgtttggctgggggtgtttgctcctgaactgcttcgcggggtgcttcgacagttgttccctgctgcagccttgggtcttacgcgttgccacattgcctaatgtttcggcattgctccgtggtgtgcgaagagcgtccgtgaaaggcgcagtagaggtcttttcggaccttcttgcgggctggctgctgatggttgcttgcttgctgggcgtctcatgatatatgcctgcatatacatttgcgtataaaaagacacaatgaggttca

SEQ ID NO: 30447 - DNA, 1501 bp, Oryza sativa
agcactaggactgcccttatagattactcgtttaggattcacccttcttttaaaaacaaatgttaagagatggccgaattcattaattaatatacaaagtttcaagttaaagttatatttttcgctcattactaagtccggttagtgctggagtagatatacttagttttgttgttatgttagttgatttacattgcagttcgtggaagctttgtccgtgatcgaaattgttgcttctgtacggtagccgtgatcaagaggaatatgacattatcttacagagcatcagtgatctataaatttccaggacaaactgatctagcacagaatgaagcagcagagaaaccaaaaatgagatatttggagcctccacccggagcggaccaccagagagatggcggagtcggcgaaagatggaggtcgcggtggacatcaccaccattaatgggaaggtcgatgtctcaggcttgcggttgcagctgagaaacctcacagagttttcagctgtgaccacatttgattgattgaagtgctaaggactaaggtaacgtgatttctgcaataacgctttggaattttgggtcgctgccgaggttcttcaaacccgaatactctgttcacagttctgagattatatttctttttcctagtatatattgcggttgtgatattcttctctcgatgtttgcaaaaaaaaaacagagaaggaaaataaataactttcttcttctgatgttatagctgcacgctatttgtttgaatgaaatagctgagtggacagctacgtgacatggtccgtatgtgcataagtttcataaatatttgaaacctcttccaaggttatatagtcatatggaattcttttttaatataaagcaactatattgttgttggaccattcattgtgttggcggatggcattgtgttgacggatggcatgaggcccttcgaccaaatctgccgaaacccgtggcgaaggctatggagcaagaacggcgtgaggcgaagagtcgtacgagtgtcttgccaggccagaggcgtctcaggcgaagggtgcaaggcgaagactatctgccgaaggaagacgacttcgccatggcaagttcgcccccgcgagggccgaggaagcctttccggcccaacaagcttaggggctatagggctagcgatcgccagacggcccatcaggggcccatgagcccctataacattatgtacccctgtaaatgtccctttcgtaagggtaatcatgtaaattcccctgtacaacctaaaccctaatagtaaaaacctgtaatggggctattaatagtctcctagggccatgtaatggggggaggggaaaaaaagaaagaaaacaattcaaaattcaatacacttcgtttccttccaaccactgttgagtaaccacgtctttcgacgtatgcagttgtcatttcgacaacagctggcgccgaccgtggggacctccgagcgaaaccactgagagcgaatgctaccg

SEQ ID NO: 30448 - DNA, 1501 bp, Oryza sativa
agagatggatgccctaaacgactatgccaccgggacaacgatggtttgacaacaccataggcctgcttatgtgatgcgctggacaacttgtcagttggcagagggtagaggccgcactcacacttgcctcgaagaagcggcgtcctcgtgacctgatccttaaccaagaagaaatatgggtgaagctctatgaaagctctattatctctagtaaagcaatgagcggatatgagacttttatatgcacttggcacatgaaggatatttttgagaaataggtcacgttttggggtgcgaatagtagaatgaccaacataattgatgtccatacctgttccactagccgtgtggacttgctcattgctggtgtacttgtccttcaccgccagcttttccatctcgccggtgatgtggtcggtggcgctgctgtcgacgtaccagttggtgtcaacgctgtaggagcttgatgcagcaacgttggcgttcttctcttctccagtgaaggagtgatcgaagcatttccagcacttgatgacggtgtggccgatcttgccgcacagctggcatgtcggccttggcttgccgtcgccgcgtccacgtccaaagccgccacgtccagggtttccgccttgaccccggccaccgccgcgccctcctcgcgacacagaattggccaaggcagatgaagagccttgaagaagttctagccgactttcaaagccaactagcagtgcataggcctcgctcatggtgatggagtcggctcggccagcgatggaagacaccaccgagttgtagtcgaagtcaaggccggcgaagatgtaagacacaagctcctcatcatcaagaggcttccttgcagaggacatgtcatctgctaacgatttcatcttaccaacatattccgcaatagtgcgtgttcccttcttggtggacgagagcgccattcggatgttgatgatcctagcgcgggactgcgacgcaaagaggttttcaattgcctcccacacctccgtcgcctttgtgaaggtagcaacttgagtcagcacctcacgggacagagacgatagcaagtagctcagaacttgctgctcctgagccctccacagcgggagagcaggatttgccaccttcttggtggtctttccatcatccttggtgatggtgatggttgcatctggcgctttcgtgctcccatctagggagcctgccatctgcgcgccgcacaaagccgcaaggatctgcgccttctagagaacgaaattgctcttcgtgagtttctcagaaacagcctgtccattaaggacagatgcaacggtggaagaggatgatgccatctaatctaaagattggtggaggaaggattcgggtggagggagaaggctctgataccatgtgagttgaagtgatacccttcctccaggttcatgtacgtgttaatataggcgcaggaatcacccctggcatggtgtttacaagtgagagaatcacgcattatctc

SEQ ID NO: 30449 - DNA, 408 bp, Oryza sativa
ccgggactaaagattaaaaggcagctctaaacttttgaaccgggattaaagataatctttaatcccggtttttattgcaaccgggactattatggattttggccgaccgagcaaagatggtttctccaccagtgaatcttcaacccaaaaatcccgatccagtttcaaattccggaattcgaatttccctctgatacctttcataaatttcccatcaatttaaggcccgtttggtaaggctccaaactccaactccgagctccaaactcctactccagtaagagctagcttctattggagttgaaggctcgttgaaaagtgtttgggtacgtttcagctctagcaaaattgaaaaaaaaatagccgccggccccaggcgcgccctgccggtcgtttgccatccccagg

SEQ ID NO: 30450 - DNA, 682 bp, Oryza sativa
ccgcggggtccggtaaccgtgccaaaaatgataaggggaacctggttacgtccaacaaggcaacaatttgtgagatttggacaaaaccacttccccatataaaatacatctataaaatacttcagtggtggaattttttcgctcatcaacgggcaaaatggtttacttttaagtaggttattagaatttttatttttaaaagtaagttattcgaaagtttgtttttaaaattaaacaaaaagaggctgaaaaaatcattaaaatttacatcttccaccaagcattaccatatgtatgattttttaattagttttttagataaagttacttttgcttaattagtacgtaatttttcttatagattcaaagaccactagatgaagttcgcccaaagacatattcaagtagataactttacatgggtttaattaagggttaattggatccatgccattgcaaatttgtttattcagaaaaataccattacaattcgtctattcgtaatcgtgccactgaaattttacaaaattaaaaccgtgccaatgccgtcacgttattcattcatcatctgcattttccgtcttcttccatcaccttctatcctcaccggcgcaggaggtaggccagagcacggtggcggcgtcaaggcagtggaggatggcggcagcaatggtgccggcca

SEQ ID NO: 30451 - DNA, 1501 bp, Oryza sativa
cgtacgattatcatacggttaccacgtgcagtaatattttcaatttttagaaccatatcatatctcgtggtacccatacgttttttttggtaaccgcttaccgtcaaaccgtgaggtgatggtaatcccatctaaaacggtttggtggagtatataaaatgaaatgtagtatagaggacatacacttgtaaacttaaaatctatcaaaggattaaaaaatttagatttctaagatttgttaagagcactcttaataatcttagatttaattatgagtagaaattttgctaagagtaaaacctaacaaaattcttaattatagttacatgtgatatatacttttcattatgtacatggagtacagtcgtactccctccgtaaaaaaaaaagacaaaccctagactttcgtgtctaaagtttgaccgtccatcttatttgaaaaaaaaatataaaaaaaagacaagtcacgcataaagtattaatcacgtataaaatactaattataaaaaatttcatataagacggacgttcaaacgtttggacacggaaaaacgcaggttttgtttttttacagagggagtacgaatcaaaccgcgaatcaggatggatgagcccacagtaacagttctcgtatacccgaaatgatacggcggagtgtgcagttgaatgtcacgtcaacagacagatgcagtgcaatgcaaaagcagagacgacatggatacagtgctgtaatactgtctctcatatgctgcacagtgcactgccactgtaccagtatttcgccgctgctactttttattttgttttatttcttcatgttcaactttgaaattcatagtactatcaatcatctgtttcaaagtatttcatacaaaatttccttgcaatattaaatactccaaatttcatacgccttatttataaatcaaagagagcttaaatggattaaagagggagtcagggagagaatagagacaaagagccaagttatgttggtctttttaatggagaactaaaatgaagttgtatttaggtgacatgaaagtatttttgatgatgtgataaaaaaataataaagtgtcataccagtatttttttatgaaaccatgttaacattgttttcttacaatttatctcttacatgtactacctatgaaacaaaaaaaatgaaacaagaaagaaaagatgacattttcaaaaattttcatattcatattcaagtacctatgaaaaatcattttcatattaaatatcttattacctaacacttttaaaaatatgaaaatgatttctttcactgggctactcatggagcaagaaagaaaagaaaaaaaagaaatttactatgcatacgacctaactatccaactcacgtagaattgaatttgatcaacgtttgtaaacggttgcagtgcatatgacatattcttctttaattgatttatggtttagtacatatctctaattatatatgggttataaaattggatagtacatacta

SEQ ID NO: 30452 - DNA, 1501 bp, Oryza sativa
aactacttaaggtaaattatcacccgacgagccaacctgtcaaatatctctaaaactaaatataccatgagaaaattgttatgtattgatttattgaatatatgacaagtgagacttctacaccattatgaaagatcaccatgaaaattaaccaactaatacaataaccgatgtgtgatatgccgtgcatatcaacacgaataaaacctctgtggtttgatgtcatcggcctttaggatgcatgatatctgagaagatgactcccagtcccgcaacactcattattaccgtgaaccatccgcatcgtacatcaatgaacatttctcccttggctcatgctctatccactctgtgaagcacttcgtagccctcatgcgcttcctacacctcatggcactggtagattcatttggaacgggttctaagccctcgggctccttttgccgggcaaccaacaaagatccacgttagtcgctactattgcaggggtagttttacagaggagttgtgtatgctataaggttgaaccaatctgtttgaagaagtttagacaagacacatgcaaatttaagataaaatataatagtggattagatgctgaagaaaaacgttttgaatggagcgttatcgtggattcttaattttttttcagataagaaaatattataaatttagagtccatacatacaaaggtgtacttgtattggaacatcaatgtgagttttacatttgagattcaatcaagagaattcctatatgtcactagaaatttaccggattcctgatacgccattcaaaattggctcttcccttgtatgccattgacttaaaatttccctacccttccatgtcactaccatcactaaaccgtgcattgactaacaatggacattggtcaactgtcagttttttacataaatgactaaaatgacctttggcccaacctaagaacaaggcccaactgacccaaacccaacctcctaaaatcaatcgcccgcttcggtacgacatacccaaacagcaggtaggctctggtattgagtcgaggctacggcgcagaatgtgtcgtggtcgaaggcgacgacggttgcggcatagaccaggatacggcggtggcacctgtggtagaggcagcgcccggagcaagcaatggtggctcctgcacgtcgcaggcgctgcccgaagcaacaacagtaggttcgggcgaccagcactactagaaaaagcattttcccgacgtggggtctttttttcgcaggcggacattgttaaacagatagatagttcggataggaacatatctgttgataagataagatagagtttagtttgtttcttgtttttctgtttcctttcttctcggtgaagatgtaatctgtaaactcctatgtacacgccacaccaggggctgtttctggctatataacatggaccgtggaaccgagagaggcaatccacgttaaacccatctttacatggtatcagagccttcttcctcttt

SEQ ID NO: 30453 - DNA, 1501 bp, Oryza sativa
  unsure (1)..(1501): unsure at all n locations
tgtttgtgtgtgtggctttttctgttataaaaactattttcagtgctggatatactcctacatgaactgtctctgaaaatacagcggtgcagctggcctgccacctgctcagctcagctcctctgtactcgtgtggttgaaaagtttatcgccatttcaaactaaacttaattatcttggtttgcaaaaattccggactaataaagcttgagagataactgaaaaagagagatctacacaatcttcagtcattttctccctcagtaaatgaacaagatgtcggtggtaaaatatttgaatattagtagtaggatatatttgaatattagtagtagaatagtgtatgaaactctgtgtacactccagtgtcaccccatcgtccacgatcgattatactctggatacagtccagtgtcaccctagaggctggagaagatagtactttatccgtttcacaatataaatcattctaacatttctcacatctagattcattaacatcaatataaatgtaaaaaatattagaataacttacattgtgaaacgaagagagtaatacttattagcgtttaggataaagcaattttttaaaatttctctagaactttgacatagcgttcttagcatcttaaaaaccaatgctaaaaataaactaccatgatgaactctaaaattaagttaaattttaattttgttatggttgataagatgaagagcaaacgatgaagcaatctgtttgcagataataaataatatttaacctttttatgtctgaattatttaaaattaagccttggctgcagataataaagccaactaagacaacatttttgcacaatggctcattgaagatgaagaggcaaaccacactagctaagtcctccatgtcaaaataaatcgaacaatcttaaaataaagcaaaaggctgatatgatatatatcatatttcgtatcaggccttgtgtagtttctattttttttcccagaaacatcataacgaatctttggatacatgcataaagcattaaatatagataaaaagaaaaactaattgcacagtttgcatagaaatcacgagacgaatcttttgagcctaattagtcttataattagctataagtgctacagtaaaaacaacgtatgctaatgacggattaattaggcttaataaattcgtctcgtggtttacaggcgagttatgaaattagttttttattcatatccgaaaaccccttccgatatccggtcaaatatcggatgtgacaccaaaaaattttcttttcaccaaataaacatggactgaatttatttcgaatcggaggtagtacgaaaaatcaaatgatgcggtagcttgcatcaccgatcgctcaagctcaactttagtccatgtcactgttcctgtgcagncttgcaaatccaaacagtctctctctctctctctcactgtgcctcacctcaccagctcacctagatcttctgagttctgtctgatacaccgcaa

SEQ ID NO: 30454 - DNA, 1228 bp, Oryza sativa
ttctgttaaaaaaagtttatttttcacccatacatcctatacataacagtaaaaaatcataatacttccactttatcaatcataatacaattaatcctcgttttatttacttccattgcattcatcatctacttttttaaatctgatattaataattatttaaaaatagatttactttaaaataaacggacgaagttaaaacttaacttagagcttgtttgggggagtttccaacaaccgaagattcttctaaaacctaccgttgccagaaactcccccaaacagtccagattttcacacagtttttaagaaactcctccaaacagcccagattttcacagcggttttaagaggttgtttctcaaaaaaaattaagctttccaaacagcatcttattttaaaattgaggaaatactcctatatactgtacggtactcgagagatgctccatgtcagtactgtacagtacttactgtacagtacttgtttaggccgtgtttagtttcaaagtttttcttcgaacttttaacttttctatcacatcaaaacttttttacacatataaacttccaacttttccgtcatatcgttccaatttcaactaaacttttaattttggcgtgaactaaacacagccttagttcacaccgaaattagaagtttggttgaaattggaacgatgtgacgaaaaagttgaaagtttatgtgtgtatgaaaattttgatgtgacggaaaaattggaagtttgaagaaaaattttagaactaaacactgcgtaactactactacttacatgcaaggcaaggcaaaggcagcagagttaagcctgcacagtaacgtactcacaagtagcaacagatatgttgaccaccacccatagccatagccatagctaagctgcatgcgcgcgtgagccaatctgtttcaggctggagacacgacgacgacgacgacgaagagctcgatcactgccatagccatggctggctcatgcagctactactccgatgcagacgtatagataggttggagtagataggatagcatgatagcagtgagccatggctgctctgatctgaatcttctgttgttcgcagctgcttttgtgcctgcgtcgttgtaacttccatcccttttgcccccccttctgctgctgtctgaattctgatcgatgccatcaatatatgcttctgtctcgtgatcgattcatccttgtgtacacattgaa

SEQ ID NO: 30455 - DNA, 1501 bp, Oryza sativa
taaatgcctttaaatatttaaatgctttgaaatgctagttttctgcaaaatagccttataaattaattctttgtactcccttgcattatatttacattttcccggcatggcttgcttagtacggtggttgtactcagccttgctcctttttcccacttgcatggcttgcttagtacggtggttgtactcagccttgctcctttttcccacttccagcagaggagtatttcagagatgatggctttgatgtttagctcgtgcctgccgtcaagcgtatgtggtggcccaacgtagcttccggtttttatcgtttatctttcagtgttgggcatttggtcgcccatgtaataaagtactctatttacgcttccgcttatatactttgttatttatcaactttgtaatgtgtaccttgccttctgagataaggaattatgcactcacaaacggaatatagtgttctattttccgggcgtgacagtcatccacatcatgtttccttcactagtcatattcagaaggctgagaataaatgcccaagtgctgccactgttcagaaggcttacttgcttagtactccctccgtttcacaatgtaagtcattctatcatttcccacattcatattgatattaatgaatctagacatatatatctatctagattcattaactaatatatgaatgtgagaaatgctagaatgacttacattgtgaaacggaggaagtatgtttttttttctctttcaaaaaccatttagaccaaggtcacccaacgacagattcaagcagataaccttgtatgggctaaaaggctaactaaaactcacctgtgaacacacgatctcacagtgatctgttgcaacggccttgtactgcaacctccgtctctctcctagacattatatcgaacacctgtcgaacacactgttgcatgccatgtaaacaagcacacgatctcaccacaccattaagaagtgaaaagataaaggcaaaatacacatctgtttgactaatcccaccaaaggatgggggtagtaattttggtattactgcacaattaatctcaccttgttggacctcgccatatccgagccaccggtgtccaactcccagtgtctgcggtgcctttgcctgtcctcgcccggcgtccgctttgccgacgccgcttgccgactgttggccggagccgcggagcgtcgttgcggcgacgtcgtccagcaaccgctcgcaactgggcgtcgccacggttgatcgatccattcaaccttgtgatctttgttggtttggttaatagccaccgagttagaaatttcaggaaacgaattaaccatcactatgctggtcatatatgtctactgaaacccaacaattaatcaaaaacaaaaacccaacaattaagctctcggaattctctttccaacggatccagtttgatctccaaattccatctcagacaatcgtaataacagaaacaaggtgttgattatttaatatgagaga

SEQ ID NO: 30456 - DNA, 303 bp, Oryza sativa
aaacattgtctaactttttgttaaccacacacttttatgcttatttgttgttacatcaagttcactgtaagtgttgtttccatggttaagaattagctagtaatattctttgtctatacagatcataaaaagtggagaaaagttaaattgcttttgaaattatagccttcacacagattagcacgctatttcttaactcttattcattactgaagttgactttagtatcttcataaaaatcaaactggatgacttttatttctgtttcttgcaacaactaataattttagatgttctaataca

SEQ ID NO: 30457 - DNA, 1501 bp, Oryza sativa
ggcttcaaggagaggctggtgtttttgcaattgattttatttgaactcttttctgaaacaactaaatgagtgcttctcaaacgacacggatgagacagtgcgtctcgtccggtcggagtatgtgcaatgtatcagtctttagattttgaaacgaggttggcacccggccaacagcttttcaaacggccacccgggccaacaactttcaaacggccacccgggcctagctgattccatcagctacagatttttcaaacatcgaacccctttccacaacagcaatttcacaagcagtagttaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagctgacacaggtttaccatatgccgacgagaggggtcccagaccaacaacaggttaggtcccagaccatattgtgccaggaagcccaggggtcctccccgacaccaccccggcgaatccacatgtctctcgacatcaaggctcccctgataagctagttactcagccaggggtgtcccattctacccatgtggtcgtacttgtcttatgtttggatgaaattccaaggaaacggtccttaagtgcaagagcgggaaaccatacacccggtacgttccccggtccgcggttttggaaatttatttagttcgcaagcaccgacccaggtgtcgggttttccaagtcttttgtaaaactcaagttttacccaagttgttttttcagattttaagtttgaaggcgtccgtcgatactcgcactgggtgcacgaatatcgagacgcaactagatggttgcaaggggacatggtatcacaattaacaaaggaaggatcaaatccaacaaattaggtaggtctaccaatctgccttgcagacgggacaacagattaagtgcgatcctatcaattcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacagcgaaaataaagccctattaatgacctctaagcatgccattagatagatctcgagatttgaggaattttggaagttgaacggagtcaaacggacttacggttgggaagatattgaatttctaagattattggatttttggtctaaaggaaaaggatttaattaaatccttttcgaaaaagaaaagaaaagaaaaggaaggagggagggaaaatagacttccccgggcggctagggcgcgacccgagagaaagggcggctcggccgagcttaacgggctggccggcc

SEQ ID NO: 30458 - DNA, 1501 bp, Oryza sativa
cgtaaataagaacttcgctggtcagaaaccgattgaaagaagaagaataaacataacatagtataattaataaataacatagtataattaaattgaagtaaaattttgtcttatgttttctgaattacctattctcgatgtggatacccaatctaccacgggagcacatggagaagcaggcaattgtgccggtaaatgttggcatagataaacaaaaaatcatgaggcaataaaaaaaatcccatatgctgtatttggtggttcctttccaagaggtgtaaataattgatctacacaaataattgatctagaaaagaataattgttataaatacatataaacaaaaactaagaacataaaaactgctccaccttctgtagcaaaaaaaaaagtgatacatatattctgtaccacgatatcctaaaggaaggtgctcaatttagcttgtgagcctcatctttattgcaggcaccatctccacacaaaaagtttgcaccaatcagttggcatctccctaatgctcataatcaatgttttatttaagagaaatttcatcttagttttttttatcaatatatatggagaacttggtactgaagtataccgaagtgagattaatactattttttaagatgatggtgcttgatagcgatagccgtgctcatctacgatgttcaaggccaccgacaaatcaagatttaagaagaccataatattctgaatcttaacaagttaatggcagaataagagagcaaaatttccaaggagataaagatatttcacatccaaatagaatctgtattaacaaataatgcacatctcatattccttcttgcattgccatgaaaaaagagcaaataaaaactgatttttgcactcaagtaagatagggaaaaaaatggcaattggtagttaatacctgatcattcttttgtgaaactattttaaattagaagctctttatgcatggagcaaatcagcaatcaaacatcgcactatatccatcacaaaaaaaaatgatcatacatggcaacttcataaaaaaaatatagatttcagtaaaaaaaaacatgactcaaatttggcactaaaatatttattatttgaggatctagaaaaggaggacatcaccttaacctacagtctgttcaggtgctcgttgatcagataagtggctatggctcactcctcaccactgcatagtaccctaggccaccagatgcttagtctgtgagtgctacgcagcagcaagcaaacaataccacagtctgctcatcagcttgcccattcgcccatattcattgttgctttgtgtttcccactacttgtacagctaaaaaaggtgtcacaatcaggcagaagctataaagggaggtcaaattgagacaacctgcatacataaagccaacatacttacattttttcagacaacctgcttttataaatgaccaatatttgatgtaaatttaacataacacttggtttcaaaatacaagctatc

SEQ ID NO: 30459 - DNA, 1501 bp, Oryza sativa
caaatacagtactgcttcctccgtttcgaaatgtttgacgccgttaactttttatcacatgtttaattgtttatcttattcaaaaaatttaagtaattattaattttttcctatcatttgattcattgttaaatatatttttatgtgggcatataaatttacatatctcacaaaagtttttgaataagacgaacagtcaaacatgtgctaaaaagtcaacggtgtcaaacattttaaaacggagggagtatatactatctgcaatacaggcggtagcggcaggcaaacggcgttggtaggccattcatgtggtcggacagtaggttacctgtttccccacgggccactcgttcgcttcctggattgccctgcatctcagggagatgtatatgcaaagtatatactcctataatttttaaaatactttctccgtaaaatacttatcattctaaataattaaataatttagaactataaattaaggtatagtggaagttagggtagaatagagggaatttaaatgggagatgattgatgggaccaacagtacttgaaagtgataaatattttgagctaatttttgaatcctagaaagataatttgtaacagagatagaaatatatttttcaacaattgaccgctcgttttttttctataaaatgaataatactaaaaaggttttcatattattaaattgtatggcatcctaactataagtccagaactttagtttgtcatggtttaaccaattattggtcaaatgtgaaaccataccgttaacattgtccgttacttgaaaacggagggagtattaatttagctagcttacctcagcggcggcagtggcaggtacgtacggcgatgtccgggcgatagactgaccaggcgtaattaattggtgattatatctctagttattatatactccctccttgacgccgttgacttttttaaacatgtttaaccactcgtcttattcaaaaacttttgtgaaatatgtaaaactatatgtatatataaaagtatatttaacaataaatcaaatgatagaaaaagaattaataattacttaaattttttgaataagacgaacagtcaaatatgtttggaaaagtcaacggcgtcaaatatttagatatggagggagtactacgtagtactaagaattaagtacagtgtcatacaagaaattaacgtaagtacgcgtacgcgttaaacaattgagatagagatatgaattgatcgctaggacgatgattgatgattgtctatcactattactgctatattgctcaatttgttccccatttcggttatttgtgatatgtaaacagctggaatttcgattcggttattatactgcaggaatagttgtgcatcgaacattttaagctgcttcggggtatgcttttacgggtttcccctgatcaagtaagcgcatacacctcgcgaatgcatacccaataactaaatttctattaaagacacatattcatgtgcc

SEQ ID NO: 30460 - DNA, 1501 bp, Oryza sativa
tctagtatatgttgtaattaaactctttattgctttaatatgctctttgattgttaagttttctggatttgtaaaaaaatgtaataccatgtgtatatttaaaacaccatattgtttatatggtttgcttcaatccgagttttgatcaattgagatgtatttttaaagagaacacttcgaaagtgcatccaggccttaattattttggtggttaataattacagttctaaattattaaagagtaaattgcattagctgtacatgaacttgacaggtaggtgcaatttagtatatgaacttgtaaaatgctcgttttggtgcataaacttgtctgatacatgcaaactaaggctaaaatggcatgacaagaccgatttttctatgttgaacattataaattataaattagtagatgacgtgcatgcacatagtagaaaggttatatttataaacttagtttccactttatctttctttgtttctatcctttacatcattactcagttttttatttttttatgcaatcattatgccttattatgtgtttatccttcttcgatacatatttacatagagtttaaatcaacaacaaaatcaacaagattaaccttgccatgcgattttgaccttgttcgcatgcaccaaacaagtttgtgcacccaaacgagtgttctacaagttcttgtacaagattgcacccacctaacaattcgtgtaccgctgatgcaatttactcattattaaactagcgacggaactaaaataaatatttctccaaaaatgaattggacaaattagaacttccataaattttgttttctcattaaaatgtgattttttttatatttaagcatgatattatgtttgtaagttatatttgaacttccataaatttagttttctacatgatcattgtattgcttgagatagaaatagaagaaaaatatattcaattgtgtgctagatatcgtgactctaatgatatggcttgttatgttgttcttactacacaagttgataatgatactgttgaaccatgttctaattctaaagccatctcatgtgaaaattcttctaagtggttgactgctataagtgaagaaattgagagtcttcataaaaatcatacatgggatttggaaaagctttccaaattcttcgaagtgcaaatggattgataagaaggattgtatttctagagttaaatctgcaagacttcaatgaggtattaacttcattgatgttttgaccaaagggaaggtattaacttcaatgaagtttttttatctgttgtacgccacttctccattcgggtgatgattgcttttgttgctttatttgacttggaattagagcaacttggtgttaaaactttcttacatgttgatttagaagagaagatttttatgatacaacctgaaggttttgctattctaggaaaaaaacatttaatttgtcatttgaagaaatctctttatggtcttaaacaagctcctaggga

SEQ ID NO: 30461 - DNA, 1501 bp, Oryza sativa
gtctatcaagatgggtttgccgactactactttggtctaaccaagagcgagcatcttattgagctgaaggacaaaatgaagaggatatgtaagtagaacaatcctttcatttcgatcgttgcattgatcatcattatcgttagttgtttttcataaactctaatgagaataaattatgcaagcgcttaaatttttaggacactcctgccataattcattataaaccatacaaatatttatactatactacgtagaaagaagagtgaaatgatgttggagttcagccaaattttctttatttcgcgtgtgggatgcaatgtggatgcatggggtgtggttgcatcccaaaatttttgaaaaaaaatctactatatacagtatatacttggtacatatacgcagtatgctcaatacgaggcccacttaaggtcatccaggactatatgctccatttgaatttctacattatttatgtcattgtatttgtactcgctatatttaagtgttttgctagtatatttttttcactttatctcttatcttgaatcataacagtaaagttttgcatctccatctctgaaatcctggatccaccactaatacctcgttaaatatgatagtttgtcatataatgtccctcctgctcatcaggctaccatctcgcacccatgccactgtactcgtatagatttaaagactacgcttttaacaaaaatacaagagatctacagagtagtcatagcaataaatccgtggatcttaataaatttgtactgaaaaatagcacttacttgtctatatgttggcaccgggaattgagtcttagtggatagagttatgcacccacaagtacatcattagaccatgtttgaacgaaacatatgtgctaatccaatctttcagaacattaaactcatgattatcttcctaaaaataggacatatataaaccatttttgttttattacggaaaatgcttgcataatatcatatattcttgttttgtaaatattcggcatcttaattgaaatgtctcatgttattcttataatctcttagtgctatgtactaattgtaagagatgtgggtgcatccttttccatttcaggtcacagatcgggaatagagaaacgctacatccaccttgatgacaagctcatctgtgagcacccggagatcatcgacaaacacatgccctcccttgaaactcgtgtagacatcgtctctactgaggtcccgaagctcgccgagtcagccacacggaaggccatcgccgagtggggccgtccggccattgacattacgcacctcatcttcagcacctactccgggtgcagtgctcctagcgctgacctcaagctggcatcactactcggcctcaacccttctgtttctcgcaccatccttagcctccacggttgctctggaggcggtagggcacttcaacttgccaaggagctcaccgagaacaaccgtgatgcacgcgttctcgtagcctgtgc

SEQ ID NO: 30462 - DNA, 1501 bp, Oryza sativa
tgtgttgagaaaagaagaccgagaataaagtattaggcccaaataagtatatacgtatgtaatatgtaatatgaaaaagtatatatacatccctaaactttatattgaagtctgtctagcacattgcactttaaaatcgaacatccaaccccctgaactttgccataccatccatattaccgttaaggtggttttggatgatggttttgcatattttagaagcttaaactgttgagttgtgatccaaatttatttacacttaataaaggctagattctgccgtagtgaagcggaggcccgtcgccggtaggcttggttcagagccttttagggttccaccttttacggtacggatcgtaataccttttagggttctacctcatatatatatatatatatctcttgtaagccgccgtgcggcattgtaacctcacccaatatagtgaagatattttactggctagcgcccgtggctttttctctcctgctttgggagggttttccacgttaaatctcatgtcttctgtgattgatctgtattgttctttatcgtttatttgcctatcgtttcctaacataaatgacaattttgaataactaatgtaacatatttacgtatcatcagttataaatcatcaatttatcattatatagtgatatcatgatattattatattggtgcttgtttgttagtgagagcaaataaaaggcaaaaagaatgatttaagtcaaaatttttgtatatatgtccaaagtatatgacatgtgatcaaactcatccaacttatatacaaattagattaaaaaaaccactatgcaaaaccatcttagggggttacatcaacggtattctaaagtttagggggttgaacgtccagttttaaagttcagggtgctagacggaattccatcagaagtatagggggttattaggattggaaaaagtttacatgtgttgaattattttcggacaacttttgagtattcacttgaatacccacgaatctccctgtgtccacccctgaagcaagcaaaccaggaagaacaataccaacagcatgggtacacattttggcctccctgtaaactctataactcaaacaagaaatcggcagttctaaattattaaattagaaactgacctaatatatatatttctccaaaaatgaattggacaaattaaaacttccataaatttaattttatcattaaaatgagattttgttcagatttaagcatgataatctgcttgtaagttatatgatgttatatggaccatgtgatgattttttaaatattcttttaagtgatttactaatgcaaacatagttgggggtttccttgggctaggttgtccaaaaactagtataaagccacacaaccagaagctagaatatccatccataaacgcatcatactgccacctccctcaactagttgcaaaagcacacgttcttccggtcatcagccatgcctggaacagctactgccgctgttgttg

SEQ ID NO: 30463 - DNA, 1501 bp, Oryza sativa
actgtttattacttgtcgttttgtgtaccctggctggtcctggacagggatttaatacacaaaatagtctggaaatttgggctaaatttctgggcgtgacatctgggttgtcgcttctttgcacttcaggcgggagcactatcgttgcacttggattataattcaaatccaagacatctctaattgcttccttctcatcttccactatcatattgtgaaggataacacaagcttgcattatgttgataacgtccccctgcttccataaccttgctggtcgacgaataatatcaaagcgtgattgcagcacaccaaatgcgcactcgacatctttcctcgccccttcttgctttaatgcaaataatttgtcttccgccaactgaggggccgtcactgtcttcacgaatactgcccattctggatatattctatcggcaagatagtaacccatgtcatattgtgttccgtttacgttgtagtgtaccgttggagcttccccttttattgcttgaataaatagtggcgacttgtttagaacgtttatgtcattctgagacccggcagtaccaaaaaaagcatgccatatacgaagatctttagttgccactgcttcaagaatcatagtaggaacgcctttgttaccactagtgaacatgcctgcccaacctttcggacaattcttccatggccaatgcatacaatcgatgcttccgtacattccaggaaaaccacgagcctcattttcttgtaagattttttccaattcatcggctcttggcaggcgtagatattcgtcaccaaacttttcaatcaccccttcagcaaattttcccaaacattccaaacaagtgcttgcagcaatcctcaagacttcatcaagttgatcagccgcggttccataacctaacatcctgatagctgctatacacttttgaagcggtgaaagactattcctaccagttgcatcaactcgttgggtgaaataaggagaccactcactaagttcatgtacgatacgcagaaacaacggccgtctcatcctaaatctcctacgaaacatttcatcggtgtagataggatttgcggaaaagtaattagcgacaagatcatcatgacctcgttctcgatttcttggtatgtacctccttggtccactctgtcgacgacggcgagatacggacgaagcttctccatcacctgcagccttgaattcttctgctagcaactcttcgatgatctcatcctctgccagcaactcttctacggtgaacacttcaaaattgtcggcttctaggaagtcatcatcttcatgcggctccatttacagaatgaaaaggagtagagggtacggtagtggaaaggagcacatatacataatgaaaaggagtagatggttccattttatagtataaaattgaggcttgaattcacgttcacattcacagaaacgggcatgcacataactgaagcattcacataataaaggagcacatatacataa

SEQ ID NO: 30464 - DNA, 1501 bp, Oryza sativa
cacttttgagcaggctgggatattttcttgtaaaatccaaatacagaaaaataattagtacgaattacataccaatgccatgcgctgcaggtgcaattgaaatatcatgatatggcaatatcggccacgttgcagcgtcttctaatataataagtgtttattgcctactttgcacgatcttggagctaatcacacgaagtggacaacaagttcgtcgtccagataccacattagctgctttgttatctttctttgtgtgcatcgcatggcagatctcgagacaataatcgtcttcttaaataaatctatacgagtatcatgaaagtacattaaccattatattacttatatttttcatatttacattaaaacttttcataagacaaatgatcaagcataatattaaaaattaacagcattatattaacatttcaaaacagagtgagtgagtagtttggaacgcacataagtaactagtattaattttaaacaactattaattttaaactttgaaaattattatagaaccggcgaaacaagatagtattagtaaaattaaaggcatagtatcactttttgggttatccatcttacagtacattgctgatacaattgtttttttaccgccactttgaaaaggcaattaatatttatctaaatctttggagaattatcaaaactaaaaagatcaatattcaagtaagacattaatatgtttcggtaaagcaacgccagtaacagacacgggacttcaagactagatattcactcaacaaatactgataaaattcaatagaacagaacaaaataatgtcagaagtagattctgagaaaaaagactgagaataaaatattagacccaattaagcatacacatatataatgtaaatgcatatattgaattattttcagtgaacttttgagtgtctgctccagaagcaaaggaccaggaacaacaataccaacagcattttgaccataagatgggtagatatgttggcattcctacacatttatgtaaactctataattcaaatgaccaggaacaataccaggagcattttgactgtaagatagatatatatgttagcaatcttcacattttctgtaaactctacaacgcaaactagaaatgggtcgaggccagttcagaattacaaaattagtacctgcactaaaatatatatttctccaaaaacgatttggacaagtcatacaaaaatttaattttatgatcaaatgtgattttgttcagatttaagcatgatattctgcttgtaagttatatgatattatatggagcatgttttgattttttttaaatattcttttaagtcatttactaatgcaaacatagttgggggctagcttgcgccaggttgtcgaaaaactagtataaagccacacagccagaagctagaatatccatccataaacacatcatacagccatctccttcaactagttgcaaaagcacacgttcttccagttccatcagcca

SEQ ID NO: 30465 - DNA, 1501 bp, Oryza sativa
ccatagagaaaagggttcacactctcatctaaattagattagccaaacatccagtgatcaagtaacttctcctcacacttcttcttttcccgcatcactttgtgattcccttcaacatccatagtccacacacagaagtaaggtattatgcacccgtgcgtcttgaacctatgtactcgcttggaaatttggagcaaaagactttcacatctcaatgttctaatctcaaattcaaacaattccattgtaatgttggacaatctaaaagaacaaaaaccactttccattcaaaatggaacttctggctaatcctgagagaacacatcctaaagctactacactatagaagtacattttggaaaaaaaaaaggtgtagtatcatatgggtgaaatttggagacgataataaaaaaaattcatgctgctaccacaaaaagatatagaagtaacaagatttctcaccttcatctccatgatgggattgtgatttcctcacatgcagacaaagcacttgctttcttagcacttttaaaaataaaatgggcacctcaaagcaaaatcaaatgattaagcaaaatcaaatcattatcaatttgcaggagttatttacaccttaggagggactctctacctggcttctatgatgaaatgctcgaaatcatcaattcaatgccttgagatagagatcatgggcctgatggtttcaatgggatgttcctcgaaaaatgctggcaaattatctctgatgatatctattccttgcagattcagttttgttttggcattatatctgtgggcagtcttaatagttcactagatgaataccacgccgcgttgctgcggaaaattaagttacataatatgtacaaataaaatatatttttattatcaaaactaaaacaatttgatacaattttgagcctaaaaataattgagattgcatgtttttatgagagatgaaagacgagacaatttagatcatagatctatcatccaaatgctagaaataattggggtgatatgacttaatgggagaagagagaaatagcattaactatacttagtgtggaagaactatataagtatataggattcgtcactctaattcctaagaagccaaccctggaaacaacaaatgattagttaagattcttaaaaactagttaagcatattagatacatacaatattattaatatgtcatgataattactagcaaataatgcaaaatttataaataatatatatcacagaacgtgcacaaacgaactggctgatagtgttcagctaccaagtttagtgaccacaaaatagcaatatcattatcgaaaataaacaccgccagagaaagcatttgtaaccccggtttgtaacccctttagtcctgggtagcaaaccggggctacgaatccgggactaaagatcgctgtctttagtcccggttcaaatacctgggactaaaggttttttttttctactttaatattgatttcaaaccgtcc

SEQ ID NO: 30466 - DNA, 1501 bp, Oryza sativa
gaaggcgatgagtcgtggctgtggcatcgttatgggctgggccaacggaaaaacgtttcacgtaacagaggctgagtaggatgggctggtctggcctggcccaatattgttgaatgtcgatctaacgtccatccggagacctgcaaataatccaatggctcaagagaaaaggatgacgtggcgcaatgtggtgcaagctttatagtctagtgggtaccaactatataggaagaaagaattagctctataggaagaggccttagtttgaagcagattgggcctgttcagtagccccttgactacagttgtacagctactacctccgtcccaaaataagtgcagccgtggatattcgttcccaacgtttgaccgtccgtcttatttgaaaaatttatgaaaaatttgaaaatatttagtcacacataaagtactattcatgttttatcatttaatagtaatgaaaatactaattataaaaaattttcaaataagacgaacggtcaaacgttgaacgtgaatagtgcaaaactgcacttattttgggacggagggagtatatctcttgtaatagactagttgccgtgtttcttatacaatagctgtactgtaggtgtaactgcaaccgctgcaccaataatctaagctgaacatgctcattattgtgtggattgtacacaacatttgcctgattatagcgataaattaaatattttgataataaacttaataaatactagaagaatgtattttaaggaaatatattctttagtcgtgaagcaaataatccggcaaataaactaacaagaattgagaaattttgatttattttttttcccgctgacttgactcatgtattggtatcactggaccagccgcttttcctgcaggagaatgggatccggatcaaacccgccacgcccgcatggacgcaatagtcaactagaagtcagaggatggccctgaccaagagtactacgactatgaataagagtatgatgcgcaaatacgcaatagctttgaccaactcatcttcctggccccttagcgcgtactcatattttagcagcaggttaatcgagtataccctatactactgattaatcagcccaagtgtttggatccaaactttgaatccaaacttctaatttttttcatcacatcaacctgtcgttttcagtcacattgtaacaatttcaacccaaacttccaactttagaagaaactaaacacaaccaaaatttcaacttataatctctccaaagcatcgagtactgacaatttctcatctcgagattcttgtactgacaagtttttattataaaaaaaggaaaaaaaaatcgtaaattagaaggcggcgcctacaaattaagcgagtcaaacattttggtagaatgcaagcaacggacggcagatgtcgcggaccaccttaaaaccatactcctcgatgacaagagcgaggattaccactagttagctttgtaactaggagcctaagccaggg

SEQ ID NO: 30467 - DNA, 1501 bp, Oryza sativa
tcaaacctaaccattattcgggtgttattctatagttttaatgtcacatcaaccatcatcaccatactcctttatggctcacccttgtgccccctctctttagtatcatttgtgactattgtattctagatagattgttcttttaatattccttatagtttatttcgaattttttatttctaaattgtattcctacttttaactctttttataatttcaaaatttatttttatttttattccgtattttgattaatgttgtattgtgtttaacctagactgttctttcattattcctaatttttttattcccgcacaattgcacggctagtatccatacaaaattatatatttttataatgattatctttaaaatttgttaaattcttattgtcttaaaaaccttatcatcatcaggtttgccgtccctttgtttacttgcttgacctactatggttctatttatccttcttggaacctcaaaagttttttttttcgaattttagcatttccacgtgtattcttacttggactcttttttctttatctaattttgtattttattttattttttattccgaattttaattgtgttgtaaatggactcttttttcaatattttttatcccaaatttcaattatttcttaaatgtattcctacttgaaattttatatttattttttaattttggaatttattttattttatttcaaaatttaatctgtcgcaactagatttcggcaatactaaaaggggtagcgaacaagcaaggaaagtggatgggttatgagacaaatgctttacactggttcagaccttctcgatgagaagtaataccctactcttttccagggaaatattccggcgagtgtgttattgatctaacgatctgattgtggttattattctcgccctcaacgagtgcccgacccctccttatataggcaaaggaatcaggattacaagatagagacttcatccttacggtataaagctctacatatactttacaattgtaaccgattgggactaggggatattaccttgatacacaagttaacataatacccgcgtccttttatatacatattctatccacatgaactatcccctatagcagttagatagcatagccatgtgggtatatggtacccataatctccacagtagcccctaagaccttcatagttgacaaaataatcttctaccgagtcatctgtactaatataaaaagcaccagttcatcaaatccagatgttttctaacctttagatctaatcatccgacagctcatatcaagagttggatcaaccactgcgattaacgatctcccacgtctaaacagtggttagggatcgatcaaagcgaaaaagaaaacgaaaaaagcttctttgctcgccgcctcctcgtgcagtcgcgcgccctacctcgcacgcaccgggcgccgctgccgactccgggcgcgcgcccgccagagccgctcgcgggttcaccggcagaa

SEQ ID NO: 30468 - DNA, 1501 bp, Oryza sativa
agtccatatatagaatcaatcactgaaaaaaaatgagtttagataagtcacagccattaggactatattaaatgagtaatgaatcattgtatttgcactttttgcagaatcatggcagtaattacatggtcaggttgtgaccaaaaaaaaaatcagagatacatatgctcaggttttgatcaatgaaccacttgtagacattctcagattttggcaaaaatgcacagatacactacaaactcaagacacgttctttgaatttctgagtacagacagcgaacacattcagaatttcagattgcttcatcagtcatcacagaggacacaaattcagaaaagccctgttgtgagaaatgatgattattgacacttcttgtgtcttaaggtaggtctccagcctctagccactcgatggtatccaaaacaataagttttacgggcttatcaagtagcaacaaatcaggaacctgaacaatcaatttaagaatgtaaatgcacacaaaaaacataaaatttcaattcgatcactaggataaattcaaaaatccagacccaattcataaaatgatgcagttagtacgaaaataatatatctttaaacgatatagctagctcttgtcatgattctgatggtcatttaaaatatctatttgtcaagattttataagtgaacaggatcaatggcttaggttgctttcctttgaatgtagatgcgcgtgctggcatgatatttagaaaataggttttcccttgaatgcacattctattagttaatttaaatgaacaaaatctttatgcattttttcattactttcgagagaagaggacactgtaacaaaggccaatatagaggtaactttctgattgttatatacatggtaatcctggcggcggctatcctacccacgacgaggctacccaggtttttgcttgactccctgattgattcaggttcttgttgccaaaccattctccttcggggtatcagggctactccagcgaggagcagcagccaccttactactaccttgccgtcgcacaatttctgttcatctttttactggaagttatgctaattgactaaaactgtgatggtactacacattgacttgacaattgacatatgtattgcctacaatgagggttctgtagtaggtgcttgatggaataccccagtgaggaaatttgtttttgttctgtaccagagaaaaggtagcgaggagatctgtgagtgaaaaaaaaataacagttcaatgtccaggccacccctttatatttaccagttgtaacttcctcttttgattgcattcagttgactctgcaaagtactgcatcactaacgtctgtataaacctaaagttgcattcaagtgtagtgtttttgaacttgttgtggtctatgagatttattctgaaggattatactgatgatgatatattggtgtgctttggatcaggaaggctgtctcatcctactagtcaatcaaggggaatctaattgg

SEQ ID NO: 30469 - DNA, 1501 bp, Oryza sativa
cactaggaagtcatctcaatcgggacaaaaaaaagtgcccgattaagatatagtcacgtaaacatattagatgggtataaaactcagacccatcacggatgacatctatcgggccgtagtttaggaccgattgagatagcattccatatctcaatcgggccccaagtttacgcctatcacggatgacaatcatccgtgacgggcgccaacttaggcccgattgagataacaactaggcccgttacagatgactcattcgtgacgtgctgtatactaatgcccgattgagatgacttaatctctatcgggcccatcaccgatgagtatttttctatttttcatatgaaatgtttatatttgtaagttgacctgtagtaaaataattaactacagtataataatttattttatttgtcaaaataattttttgggtagtaaataatttcaaatggaaaaattatcaaccacaaggttatataacttatcaagatttacaacttttagtttggtcatttttctatataatttttttaacagtttgaatttgaatttgaaaatatgacaacttcaaaacaacattttcaaatataaatgatttcaaatggaaaaattgtcaacaacaaacttatataccttatcaagatttacaacttttagtttggtcatttttctatataacttttttttgaacagattgaatttgaatttgaaaatacgactaattcaaaataacattttcaaatactaaatgatttcaactaaaaaagtcatgaacaataaagttgtataactcgtcaagatctgtaacttttatttttgtaatttcttcatccgataaagtgttggtaacattgttcacaaaatttacatatatgtgttatagtttataaaactagatgaaaaatatgtgaattttgtgaacaatattattatcactttgttggatgaagaaatgaccaaaatgaaagttataggtcttgatgaattatataactttgttgttgatgactttttttgttcaaatcatttagtatttaaaaatgttgtttgaagtactcatattttcaaattcaaattcaaactattcaaaaaatgttatatagaaaaatgaccaaaataaaagttgtaaatcttgataagctatacaagtttgttgttgacaatttttccattttaaatcatttactacccgaaaaattatttgaatttcttatattttaaaattcaaattctatgtaattcaatcaaacccgaatagagaaatgaccaaaataaaattggcaaatcttaatgagttctacaactttatttttgacaactttttcatacgagttcatttagtatcataaagttcaatttgaaattcatttttgcctaaaagtctgatttacctcctcttccctctccaccacttcaaaatttcagcaaccttatcttctcttctcactcagtcctctctcaatctccaccttatcttctcctcttccctctctcactcagg

SEQ ID NO: 30470 - DNA, 230 bp, Oryza sativa
gtttttctgtttttgtgtttagtaaaatatttgctgttagtttttctttccgagttttctgtttttacagtctccccacatttcaaaactaacgaatttactctggcccagagttttccatctactcccagactcccacatctgctcatttaaaagtgacaaatttactcacataaatacccccttcaaaagtaataaatttactcacatcatacggcaccattcctaga

SEQ ID NO: 30471 - DNA, 1009 bp, Oryza sativa
aagaagattgctggttggcttgtggggtccacgtgggccctacactgactcagccgccacgtcaacaaaaccggaaagcaatactatcttgaattaaaagtgatccggttttacaagattaggggttgaggaccgtttaaaactcaacgacaagataagggaccttagatgaactattttgggagacgaaaaaactccagcctcatgggcctgtgcataagacccataggcaggcgacaccgcggcagccgagcgctgcacgacctctgcctccctaatccgtcccgtctcctcgcccgtcgccctcgactcccgtctcctcgcctgccgatctccatcctgctagcagaggtggcgccggcgtcctcctgctcccgccgcatttgcatcctaatccatcccatctggcctcggcctcgaatttcgtctcctcgcccaccgcttgcgccgatccccatcctgcgagcagaggtggagcccggcgtcctccttcttccaccgcatcgtcgttcgccggtgagcatccctctctacccatacctcatcaggtattctgcgttatccctcaaaaagtttgggggttagatctgcctctacccagctccacctactttcaagttgttaattttgatttccgtttttagctgatgtaatttggttactgaatctcatccaaacacccttagaacgaaaaatgtaagctcacatactttgtactcatccaaactcacataaatttcttaagaagaatctagaccacaaactactcatagtcacacaatatctttttatcaaggtatactcttataagaaattttcatttctcaaaattttctaaaggacatactgtgacacttggcattaatctaatttaacttttttttctttatcaggttataaattttctaaaagacatttgtgccacttggcatgaatctaatttaacattctttctttatcaggttataaattgacaccattgaacgtactttatctttctgtccacaca

SEQ ID NO: 30472 - DNA, 592 bp, Oryza sativa
tttcgcggaatggttatacgagatcgacggtatatttcttctaataaatttacattctgaatatttttgagaaaccaacgaatgaacagtgtatttttaaatttaattcttctctctgaccatctggtcttcattttagtaatgccgctaattaagcatatacttagcactccatgtagagcttgtttagatccctggcaaattttttcatcctgttacatcgaatgttggaaacatacatggagtattaaatataaacggaaaaaactaattacacagattgcatctaaattgcgagacgaatcttttaggcctaattgctccatgatttgatagtgtgttgctacagtaaatatttgctaataatagattaattaggcttaataaatttgtctagtaggttacggattaattaggcttaattcgtctcgcaatttaaccatttttaaattatttgagcccacggtttttattatttttccgagatataattgctacgtaagcgccacgtcaataccacgtgggacgaagacctagtcaaaccagccatgtagttggcacgtcagttaaaaccgccttctaaatcgtcaag

SEQ ID NO: 30473 - DNA, 724 bp, Oryza sativa
tttgcgcaaagcaagttttgtaattcttttcacaagcctaagacctagcattgactgatcaaattttagtaccagagtttgtatttacacaacgacggttctgtccaccatccattgtgatcccaaggatagcttcccgccattgattcgtcatggttttctgaggacgtccaccttcccgcctctcaggaagtggctccaacagcataagattcatcatgcaatatcccctcccacacaagttaagaatttagagtctagccaagtgtaatacatgtcccggtgctcaataaccgcgagcacggctattcgaatagatttggtttactcaaactgcagtggatgtacactttacccgcactccgcgactgcccaacacatgagcctcgtcccaacacatgagacgcgtcacggcaaagctttttgataacctcgcattggcagtacccgctccatgaacttttcatcctcatgcactctaggcgtacacggtttctagcagtgagaggagttctggcgcacccgggaagggaagactcacacatgcattaagttataattatgttttagattctcacatggtagtcctaccgatggcgacaccactgtagacacccgcctcgcggtcctaccaatggctgccccaccgtagagcccctgcctcacacatcaagaaaccactatgcatggatactgcctccgctcagctatctactccgctagg

SEQ ID NO: 30474 - DNA, 198 bp, Oryza sativa
cacaccatggtgccgaaagacactgtccctactgccttcactcgtcaacacattatcatgggaggcatagaagagccaatgtcattttcctttgcacgaatggatcctagcatgaacacatcgatccaatggcactggcccaaatgctatatgcaccgttgttttaaggaaaagttacatgtatactttatttagaaa

SEQ ID NO: 30475 - DNA, 175 bp, Oryza sativa
accatccaatacatgtgaaatttcaaataacagaatgcattttttgtccagaaattatcacttgtttgtgttttgttagtctttttttttctcaagtacaaggttatgattttttatctatggacagatgatatggagcgagagcgatattacacaaacttgatcaatgatgaga

SEQ ID NO: 30476 - DNA, 450 bp, Oryza sativa
tattggataatgatggtatgcccttttgttgtaagtcttggaataagagttcaaatatgcttatatcagtcggcaaaatgtattgttttattgttgttgtggtctaatagacacatagtgtgacaacgaggctgagagcctgagactatgcctgtggtatggatcaagataggtaagatatgctagcaatgcagattgaggataaggacatccatagagaggttgactcgatgttttagtccgatagtagtggagcaaccaataggctggtgatcaggagggtggtgccacgacgagttcgagaagatgttgagccaagaggtggtgaggaaaccaagcctaatggcgatggtgtggtggagtacggagtggtgctagctagcaagcttagcttgagaagatgttgagccaggaggctgcagtgaggtggagaagggattggtgctggga

SEQ ID NO: 30477 - DNA, 1501 bp, Oryza sativa
agctagatcctaactagcacagtgcacacggaaaacagagcggtcagttagcacgtgattaattaagtgttagctttttttttcaaaaatggaacaatatgatttttaagcaactttcgtatagaaactttttacaaaaaaatgcatcgtttagtagtttggaaagcgtgcgcgcgaaaaacgaagtggagggagccaggaaccagccctcctgaacaaacccttagattcgtccaaaacagatattgttgatgagcttattctggtacgtgaaacatgacggatcatttggatataaataataaactattataatcttgaaaactatatttatttgattttacaaaaattctacatataaagttttttaagaaacacattgtttagtaacgaagtagcatagttgagatcaattttagaaataattctatatataaagttttttaagaaacacattgtttagtaacgaagtagccaagtcaagatcaatccgatccgaacgcagcctaagaaactagagattatagtagaaactacatgcgcacttactaaaactatcctaaacttgacctatgcgacagggatggactcccttcgacgagtttcctccgacaatatcgatccagcaaccaggtcagctcttttcttcaccactaccctcctccatgttgccgttcgccctcgtcggcgccgaaaggcataaacctgtcagcgtggcccgtctagttttgtcccagtcccagcaccagctcaccacttgctatcaaccgcgcgtctcttgcgatcacggtgtagtctcgccaaccacccctcctccgccttccagaccatttctctaagcccaattctccatgtggtgtttttttctcctgaagataaagataaagataacgatgaagattaactgttttatgtagaacgtggtggtattaacgtataattaattgagttttaattattacaaacttaaaaaataaattaatctgatattttagagcaactttcatatatagagttttcgcacgaaacgtactgtttagtattttgaaaagcgtgatacgaatatccaaaattttattcagtttttgcagtgaaaactaacgggtttgtctcctcattcacatccggaatcctaaaccttgaacctaatcccacagctggtcgcgacgtggtctgaaaacgttcacgcgcgcgatggacgcgctcacgcgcattcgttagttagttagtttggatttccggtggaatgcgatcgggagacgggcaggccaggcttccgaccgagacgccgccgaggccctagagcgcaactcccaaggctgtagaacaatccgtggaccgcagcgtctctcagccactcaccacggcgacgtgtcatcccatccagccatccgtcgtaccccacgtccaaatcccagagcaccaccacatctcccccaattttcccagccgcgaactcctccgagttggttggcctacgcgcctagccagctagcgacaa

SEQ ID NO: 30478 - DNA, 1501 bp, Oryza sativa
agcacgagtcttcgaatttctgaaatttggtttatgaggcttgccatgacttcagttaggttgtcataatcaaacaaaatagcacaacctttcgctaatttgaatgcgaggttgtaaggagttggaggagatctgttgttttagctgactcgttatatccttgagtcttgtggttattcctactagtatatagcaagcttcccgtatcagtttacatgatctggatatgcatttcttggctgccaaattaatggaacttgattcacatcatatcttccactaacatcatgtgctttgaaaatacatcgttttccacttgacatctaatcacgattttctgtatccagcagtaacaaatgaacaaagcatcattcatttttcttgaagaatactctgtagctgaaagtattcttttttgcggtaggcacaataaccttcactgaactgcactgaaataaataaaatcactcatcagtggtgatgtacaaaacatatatcgagttttattttattttttgtccatgttgcttatgagaattgttcctgtaaattctgagagtctggcaatccaccaagtttacatccagaaacaaaggggcgttgcatgagctactgtctttctttgcaactagtagaagcaaaacaacctagatgaccaaccctctttacttaccttaatgtattgttacagggtatgaatcacgcataccaatatgtgccacggtctgtaatcttttgttgttttttcttaccattcttgtataagaactgtagtcatcaaggaccatccattccattgctagtttgaaattatgcaattagggaatagaaaagtaccaaaaagggttaggctattaaaaggtgtgtatggtttttatggtgagaatggtgttccaacatttatgatctatgtactgatcatttgattgtacatcaccaccacggaatcgtggatcacccagtatggccccacatgatacatactttacttctaaataactaattacttaaccagttctcatggtggaatcttctgcacctccttgtattgttggagggcgtgtcacatgccacttccttaactcttgagattcgttttagccgtagatctgctgcacgagagaatagaaagaggaaggaagatcccacctggatgcaggatccacttgttttttttaaaaaaaactttatagatcattttgaaaccctctgaaatagtcccctttcatttcgcaaattgcaaaaaggaaacaaaatcagcaattttacttaagaaaatgtccaatgccttgttaactcatgcatgtgcacttggatacttgatgcaataacaaagatatttgaaaagcagagaacatatattatgtttgcattatgcttgttgtgttttgcaagatcaacagttccaccattccactgtatgtttccatggtgtagtagtaagctttaagcaaccaatggatttgtttttggcgtgttgctaacatcttatatttctctc

SEQ ID NO: 30479 - DNA, 1279 bp, Oryza sativa
taatttgctatatagacaaggtggtagtgttacaatgaagtttgaccaccaactgtcattgagtaaacactattctttaaaaaaggtgaaagttatctaggagagggatattgtcctttttatatcattctaacttcttccaggaaagttaccagtttgatgtgaactcgttatcaacgaatgtcaaaattaaagctaacactatcccagaatagttattctagtgctaaaaaggaaaaaatatattagacaactatgtgatcttctaggaaaacaaggaacaataaataactcattaaattgcataaccatatcacatatagtttattaatatctaaattggacttttcgattttataaaataacagttaagcataatctatgaactcgcttggttgtgctagctatgggcaataccaatagctaagccaagccaaatttcttctagcaataatagggcggctgcactagccggctagccctatatttttgctaatttttccttatgtctttttttttgcaaataaattacttaaattaaaggggtgttcgataatgttagatgtgattaatttacaacctacagctacagtaaaaacaagaggatctatggtggcagctgcagctacggctgtacaattgcaatgtagcatagccgaacatcctctttgtaattttattggcatccattcagttgataaagaccacagagtcatagtaacacagaggatcctagcaaaaatactcttcctctttctctcccctccagcgcagcttgcaagcctccacgacccaccatcatgtcatccgtggcttaatgacaccccttccataatcttctccattttgacacttatgcccctgccacctcactgcaaccatggtgtcatctgcaggggtagacatgtaaatctctcccaagttcagggtggctttctggccagcccattatatatcactctcatggcaaggtggctcctgtactactctgcccattgataggctgctggtgatcacaagctacacaacacatcacacaagcaataggcatctctctcttctttctctttctcctccttgcttcatgtaagcttcttcttctctagcttactttgatcatttccatggtttcatgcatgcatgtttagtttcatgatatatatgaaatatcctatggatttttgttctgtactttttttaagaaggggtttttgttatggattttttattgctgttggacagttggagtactagagattaatttcttgaaggagagaaa

SEQ ID NO: 30480 - DNA, 912 bp, Oryza sativa
gcaggtcgactctagaggatccccggggtcttcccaagatttgtttcttcccatgagcactcaattagcaaaaatcatctaatctcgcgagccttcgatgcctcctcgactgcaagctcgcgagccaaacgagctggacattctccgagaccgagaaatttggcctgtgtcttgatcggaagctggttgagctgcggcggcgggggcgagggatagctatccttttcctaggttaaaaaagtgtcagcttaagtatgatactcccttcgtttcaaaatatttgacaccgttgactttttagcatatgtttaaccgtttgtcttattaaaaaaattatgaaatatgtaaaactaaatatgtacatgaaagtatatttaacaatgaatcaaatgatatgaaaataataaataattacttaaattttttaaataagacgaatggtcaaacacgtacttaaaaagacaatagtgttaaatattttgaaacggagggagtagcaactggctggcttgcacgatggacggacggacagtttgtaatgggacggccgaaaaaacgacgaatccagccaccgaaaatcattcgacaaatgtacagcaatttcgtttctgttatgcgtgagatatttacctttcagcctaaaagtaagcactactactacattagtgcaatttacagtgtactgggcaactatgaaatgggattcttttttgacagagtatgggatggaaattccattaatgggaaatgctctctaggatttaaccggagatgtgtaaaagaatacatgtacgctttagctattcatatctttgtcttttggttgtatgattagggtgtggagaagtattgttcggaaaggggatactgtggttgatgccacatgcaggaacagcaatgatacattcgcta

SEQ ID NO: 30481 - DNA, 723 bp, Oryza sativa
agctgaagagccggctcgttcctctccttcccgttcacatttcaaaacctcaaagcccccacaaacttcggaatcgaggtgagcgggagttcggagagatcaacccgagggccgccggccgatggcgatagatcagcccatcaaagcaagttctttcctctccctctctatctgtatctctcgtttctcgattaaacccagtttttttgggggtcatttgcttcgcttattcactgttcatccggttgattagagaccgagggttctttgatttgttccactctctcttgaatcatcgattaatggcggcggatttgggggctaaaagtttttgtcttttgtgttagatttcatcttcttagctgcttttcttgttttgattcttcgatccgagtgggagactgaagagagtgttctgtgtgtgtgagagagagacgtgttcttgaaaatttccccatgctttttttttcggatgacggagtgatctgatatttcagctatgttatatggttatctgtgatcttcttggagattttgcttcctctttgatcaatttggttgtactgctcgttcttggatacgatttttgttttctgtttaatgactgaaatattggtgtttacttccatgggtaatctgaatctaattcgcttgtcctttggttggttgttcttgagcagaagagagggagaccaccaggttccaagaacacgaagaacaaga

SEQ ID NO: 30482 - DNA, 1501 bp, Oryza sativa
ggcaagattcccttagatttgctaaggtgtggctaataatttgatcgtattaacttaagcaagtgtggcaatatttattgataaataatggtaaagtatggctaggaagcaaatacaccggggcccctttgaattgtaggaataaaaaaacgaaggaataggaaaaacatacgattctaatagggatgtaagtgtaaaacagaggattacaaaatacaggaaaaacacaggaatgatcgtttgattggactgcaggaaaaacatagaaattggatgagagagattgtcggtgacatgaggccgggagtatcatgactagaggcttgaggcagacacaatcgcccacgtggcctggcaccctcggggggcgtcgggcccgagggtgatgtgttcgccctcctctttgtctccccgagggggtcggactgctcccgcctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtctgtgaccagtcacaaaccggtcagatcgtgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaccattacaagcaagatattgtatgaagaagaagggcgaacatgcagattgataaactgacgcgtggtggacaagaatgaccgatttgtgaccggtctgacactggtcatatcgtcagcagacagtcatgttcccacgtcgcgcctgcttccggcggaagtggaggtaggtatgggccgtcccatcagaaggtcattcagacggcaaccatacaaatctccgtccatttatgaaaagataggataagtccccacacaaaaaagagagatggtgcatgtggtatccccttgagatataaaaggaggaccttgcccacttagaaaaggggaacgatccgagaacgatcggggactggacttttccagattgggaacccagaacaagggagaggttggctcatactttgtagctccttcagacacagatctcccaaaacacaggagtagggtattacgcttctcagcggcccgaacctgtatacatcgcccgtgtcttgtgtgtttccggtctcgcgaaccttccacatacagagagcttagaatctcaccctgagtccccggccgaaccggcaaaggggggcctgcgcggtctcccggtgaggagccccacgctccgtcagagatggactcaaaggatttttaccaagaggttggacctcttgctaagtttccttcaaaacctatatgcaataagccattccataaaaattttgtaggatttagaaaa

SEQ ID NO: 30483 - DNA, 292 bp, Oryza sativa
tgaataagacgaacggtcaaacatgtgctaaaaagtcaacggcgtcaaacatttcgaaacggagggagtactccgtatacacaaagcatgagtaccgcaaacaccaaatacaacgacgagatatataactttccttagaaaatccgcaaaaaaaagtcaaatataagtgtagactgtagtatactcatattgtacgaaaatgctgccgctcggtcgcccagaggaggaggagaaaatcgggcgctcccccctccctccacgacgtgcccatgtgtttctactgggaccccac

SEQ ID NO: 30484 - DNA, 582 bp, Oryza sativa
aattgacacacgaactaaacacggccttagtcactggatacaaaaattgagctgatctgacgtctcaagtcaatttgtcaaaatgaatttccttttcaactagctacaatttttatgatacttcttatctgcctttcacagggttgggctaaacatccaaatgtgtcgttcatgaaattttaatctaatgaaaaatatgagatagatagttgctctatctcggggttgtcgatctgctggtgaaaaataaaagaggtaaagtttgctcctcgggtagtatgttgtttattctctctctttttaccctggaactattatttgattgtttctgttcacacttttgggcaagaatagcacatgggtgatgggtctatcctgcttgtactgccgctgtagtatatagcaacacatcaatggcaccaggtacacaacattgtaatattctgctggatctatcttaacttccctgttggatggcatcaatggcatgtttggctgtatcaatggcaactgggctctgatctatcttaacttccctattgaatcacatgttaccttgatctggtcaatccaccaaaacaa

SEQ ID NO: 30485 - DNA, 1501 bp, Oryza sativa
acgcgtcgggcgtccgatctggggtgggaaaatcgaccacccacgacagctgacgtcagcatgtatacgtgcatgcaaaactactttaaactattttttctgttaaattatttattcaaatcatgatccgattgtaccattaaattcgttgcaattaaatgtttaaaacaagacaacacatggatatatttcgatgaaaattgttttagcttattattaaattatttttaaatgttgcacgctgttccactaagtatatcagaattgtttcactaagtaaatcgaaaatgtttcaatcgtttaaatcgggcgttgtttgaccgaagttgaccgtctacgtggcattccacgtaggcagctcatttgcaaatagccccttcgcgctacagtagagcactgggcaccacaaaaatccccaaatctctcggccgcctccgtcgtcaccttgcccgccgccgcctcatgtcatcctcgtcgccgcacatcgtcctcgtcgcgcaccacggctgtgtcgcctcgctcgtcaagttctccggcctcgccgtgtccctagacgtgcactccgccgcagcgatcgcgtccctcccggcgtcctccgtcgccgccgtcgcgctcccggaggtcaagctcgacgacaaccccaccggtgggctggcgccgtacagcccgccgtcgctaagtacctcaccatggacaccccgcaggacgccgcccgatggcgagatcctccacctgctccacctctactacctggttcttgccaccgaaggacaggacaagcgacagcggcggcggcggcgtgggcagcaaggaggaggaggacgaggcgtgggacgagtggctggcgaagccgatccacgagcggatgccatggcagatgccgccggcgacggagctgcaggacgccggggtgatgttccgcgccaagaggccgccgtgcagccttgtcgacgtcacgttcagccggcgtacgtgacggcgtgctggagatccccaccgtggagaactacgccaactgcgccatacccgctaacctggtggcgtacgagcagaaccggggccggtgggagatgcagcgggtggcgagctacgtgctcctcatgtcgtcggccgcagctggaggccgtgaccaactgctacggcgagctgtacggcgacatgatggagtattgcggccggagctggaagcctggaaccggcaccgcgccatgctggtgcatgactgccatcccaccgttcaaccctactacctgttaggatttacgtgaaatattgtttcatacggtttggatagggttgttagctctagataaagtttgttgttatccctctgtattaggagatgagctcaacaaccctgccggctgtatatatgcatgtataacttgtgatcagcctgatttgaggcttctgaattaacacgaaaccacccaccgaggtgttctccacgcttgcacctctgttctttacatggtatcagagcaaaactccatctagatta

SEQ ID NO: 30486 - DNA, 548 bp, Oryza sativa
tgcacgcgccgtcgctccgacgcccgatgcagccgccaccgctcccgcatcccgtgaggccgcgacggcgcgacggcgctctgcccctcgtgccggtggcaggcctgcccccttcccgagtcccgacagcgccgccacggctctcttcccctcacaccagcggccggcctgcccgccttcccgagtcccgactcacgccgttgcggttgcaccgcctccggcctccccgacgcgcgtcggcgcgcgcgtcccgccccggcggccggcggccgccgcccggccggcatcccgcatctggcggccctccccctccggtgagcattgcgccactgcttctccggctgtccggctctcctctccctcagtccctctgctctcccccttccaatagtcagcaggtagtactacctccgtcaataagttctttatatccatgattccccaattggagatatagtaatttgtatagattaccacaaaattgtgcgccacaatgaacctcatatgacatttttgcatggtgtgatggttgtcaggagattgaggaa

SEQ ID NO: 30487 - DNA, 1501 bp, Oryza sativa
acatggtgaaaaatgttatggtgggatctaaacagggcctagggcctcagagttatacccattttgtactcaatgaacattccaagcacattcaacatattaattagagacaaatagacgatgggtgagcatagatatatatatatgtgaactgatggacctttaccttgcaaagcatacatagctcaccgcttaactggtagccaagttcgaaattcttagactaaggaaaatttacctaaagttcttttgggtgcaatataggataggatgatgagatgaccgaatgatcgatggtgttctcctaatctctactgaagaaatggaaggcatcgggaaaatgagtaaaaccgtcatgagagttgcatctgaaattgtttaactaataggatcctcgttcgttcagtccagactgtggagactaatcaaactgggccatggccccatcgagatgttttacaaataactctttatagactacaaattactcattaacttgagttaagacagatagaaagacaaggcgcctatttcagatatgttttggcacgatcgacgacctcaagactctcactgtggcacccaacaaactaaaacttcaaatctgcacatttgatcaaatttcaatgtattttgacggaaaaaaacagttactgaatttccttatatgtcattttgttctgagattttgacatatgcaattaaagcttttgagtagtgttgtttttgctagtattcaattacggataagtaggtttccaaaaaaaaaaaatacggataagtacggcaatacaaatgtccttgaattgcttcagcagctagctactgtgccgagattttgacatatacagcatctttaagtagtgtagtttttgctagcattcaattatgcataagcactatagatataaatatgctttcctaagagcatgcccaacagtcactcaatatttgattcccaaaaaatctgaattaggaattccaaaataagaattaggcccaacaatcaccccctcctccaagagaggcccaaaaattaattccctatcatttgttagtttgccacataagcaaggtgggcctagttcggtaccgatcaatcgtctccctcctcgcaccagcgccgagacttctccctcccagcaccttctccctcccacaccagcgccgccatctgagtaaatcgcatcatcaccagccaaccagtgtcctgagtgctgcggtttctacaaaaacggaataccaaggatatgccatagctattcgtgtcatcaaggaggtaatccctagcaaatcctattgatctcttgtgccctagtcaatatctgtctctatttggttatgtggatatctattgttggaaaatattaagtttgatctaataattaattttatagattgattattgttgtattcctgccatcggttctctccattgcacttcatccctgtggtaaacgctccaaccctgtggcaataaaaaagagaagatgagtcgtcg

SEQ ID NO: 30488 - DNA, 233 bp, Oryza sativa
gatcacacgctgtgcgcgcgctcgccgccgtcgccctcgtccgcttcactcgatcgtggagttggggaggaaaagcgacaactcgcgtcgcgcggttgcgatgcgagactaagccatatatagaacgagattcgtttttttttaaaaaaaaaaaactgccattaatctttttttttcgttatcccgacaaaaaggaggtgttttgacacgttcttttttctttcttttttaga

SEQ ID NO: 30489 - DNA, 244 bp, Oryza sativa
aaaacagagccgtgtcaaaagagcatcgcgaagaggcaaattcaagattttgtattgaggccttagcaaatggaggccaccggctttggtgcttcgctaggatgtggcatgtagacctacacatataggactgggaaacaccaggaaccaaaggggtgcactataggtaggcaaaccaagcctactcaagaatatgtgttgaggtagccaacataaaacttgtatggtttcactctaacacagc

SEQ ID NO: 30490 - DNA, 438 bp, Oryza sativa
gaagggcactaccccaatgtaggcctcacaaaggtgagcaaagatgctcaggaaggcgatggagttggggttaaggtgcaaaagcgaaatgccatagaagttgagagtcagcaaaagtaattccgaagggggagtcaaaaaaccacagcggatgaaatcctctaccactaccatacggcctaaagcaggagagggattagtacctcctttttccctcgccatggtttgcttgggagggatggccccgtctgtgtagagattcttcaaggaggccgcatcggaggaagatttgccgaggtccgccattgcaaggggatcgccggaggaagacgaagaaacctaaggcttttggggagacgaagggtccgaggctgctatgaagctggaggatttttggcaaacgaacttgaaatggatcccaaaacccctttaaatagg

SEQ ID NO: 30491 - DNA, 1501 bp, Oryza sativa
taccacttattagtaacccaatagaaccagtgcttaaacttatcgcatcacatatacaatatcactcatagaaactagctaatgtataattaaactacaatatattcaggaatcacttggagcattgggtagtacactttctaaataagctcatgtagagtaggcgaccaaaaccttatacgttgttgcacacatatattgtacatcccattatagttacacaattaatttatctttttcatatattaaactgggagtatataacaaacatgaatagtagataagtactaattataaatcttgacctcatatgttcatagttcaattgtaactccggattgttcattaagagataatatgtaactataatattataaacttcccgaatttaacatatagagcatggataattattaaccttttataatttattgtgacaagtaaaatatgttcataatcaaggtaaagcttccatcaataaaataaataatacaaatgattcactgtaattatttgattgatcctaaatccatctaacaacataacctctagtatatgactgtcctatttagatggatgcatgcttagccataatccttccataagccatttgatagactaaaccaccgattagccaaatatatatgtatcccataaatgctatgatggttaactcctaaataggccacgttgacaatagaaagattaagaaaccttagcccctagcgtggttgggatccattagcaaacacgaatagtacattttgttgcgcatatttgattgttgtttgaatattggtttttctcgcgtattatagaccttgtgtatcggttagtcgtgaggcaacgtctgcaacttccaggaggtgaaggttgatcaagattatatcaataataaggattatcctgagcaaggcaagtcatcactattccttgaacatgttgatcctaattgcgaaattgttttgtttacaaataaaattgcatgcaatgatgaacatcctacttgtgattatgccatgccttgattattgtttacccttaaaatccttgtacccatgattacgtatgagtccctagtcaattatgacaattgcttagaaatgctattctagaatcatgcatactcatatttatcaaatgctatatgcttgggcaattacctttgggaaggtaattgagatgcggcatgtggagacatgagcgccacattgccatgatgttgatgacatgatttgtgaaaggagaaataaaattaaacaactgttttcgactggggcggacggaggatttgggtggtatctggaaaaggctagtaccgtccccggtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacgatgggacagccgttgaggtag

SEQ ID NO: 30492 - DNA, 1501 bp, Oryza sativa
cttgtcggtacgcttgcgtatcccacaagatgatcggagtgcggtcttgttctaggtctcgttccccagtcgactgcctgtggcatgttaaccgggcccttatgttattttgtcttccgctgttgttctctgatagttgttggcctacctggccctaatgtaagtatttaactcctttagcctaaattcattcgtgatatgttgtgatccaactatgtatgtgtgtaccaactactgatccagggattggtacggataaacacagaagatttccgattgccaaaatcgggggtctacagggttggtatcagagcctatcgactgtaggtcgagaccctagatagaatggccgttagttgcaggaccttatattttacaaatatatttttaaaatgctaaaaaaaagaggttatgaaaacattcaaatattgtttctcatcttacctctcttcaaaaatatctgattccgatacgccaaaaagaaaaaaatatttttgataccttacatctcaacccttcctttgacaaggcgattttatcacttgatttgtgattgaaaaatattggttctacattctcatccacatttcaaaattttagaataagaaccgaaagcaattaagacgctatagggatattattgattgtgccgaaacctcatcctcgaaagtagacgattgcatcatgattatatgaaaaacaaagtaaagaaaaacaaaagaaaagaacagaaattaactcatcaatcatgataactcatgattgttagtactagtttgctctagtcacacactcgtatagtagaagtgaagtctcgactaagccgttagtgaccatagaagctcgacctgcgacatggaagttcataaagaacaataaagagaaaagaaacagactacgtatttatgagaaagcccagcaagaatactaaacatacaaggatctaaagattatggatcaagaaggaacataagatgctacgtagatatggaaattcaataaaaggaacccttatttggataagagtacatggacgaatgatgaaagagatttgaatttattggatattagcttgagggttgcttcaaaattccaaggacaagtcgaactcatatggcttaaatcctctgaactttattttataaaatgtctttagcaaaatatcgcgaagcaaattaatttttgcattttgaaatatagccttacaaaaaaaaattacttcaaaaaggaagaaaatgtttgtttcaaactatgtaattgcaaaattgtccccagagccgcactgaacttatattaaattttgggaatggtcgaaattagccttgaaaagaaaattttctctgaaaattatttgtgaaattttgattccaaataatgtattgcaaagttttccaaaataaaacttcattcaaaaccaatttttcagtgcatgtcttcgaaagcctcctttcaaaaggttttccaagctgaattccaataattatttgcctaaagctttgtt

SEQ ID NO: 30493 - DNA, 1501 bp, Oryza sativa
acgaatgatgaaagagatttgaatttattggatattagcttgagggttgcttcaaaattccaaggacaagtcgaactcatatggcttaaatcctctgaactttattttataaaatgtctttagcaaaatatcgcgaagcaaattaatttttgcattttgaaatatagccttacaaaaaaaaattacttcaaaaaggaagaaaatgtttgtttcaaactatgtaattgcaaaattgtccccagagccgcactgaacttatattaaattttgggaatggtcgaaattagccttgaaaagaaaattttctctgaaaattatttgtgaaattttgattccaaataatgtattgcaaagttttccaaaataaaacttcattcaaaaccaatttttcagtgcatgtcttcgaaagcctcctttcaaaaggttttccaagctgaattccaataattatttgcctaaagctttgtttaaaaataataataataataataataataataataataataataataataataataataataatagtaaaaaaataaatttctttcatgagttttcctttgaggtgttcaaaattattgttgtttcaactttgaaccatgcatacaatctatatggtattttggccctattggcaagagtgctcttttgcgaaataaaatcaaatgttgtttaaaaaaaaaaatttgattacaaaagtttttagttgccatgttgctttttgttaaacatatgtatgattatacaaaatcttgcttgaaaaatctattttcaaattatatttggtgagaaactgcatctcttgaatattttaaatgttttgcaaacatcacttccaaaggatatttctgcaaaatcattttgaaaaaaaaaaatcttctttgtgaacgcaaaagcatatctccttttaaattgctttcaaaatttcttattttaaggggggtagcctatgatggagaaacctcgaggaaatcaataacttgtgggaaaatatggacaaggaatactatatatcaaggtatatttgcccttgtacagggaatttgaagtatcattggatagtaaaactgcaaagggtgtgaccttaactctcgtcggcaagattcataataaatattaaggaacgaaggattgaacaaatgaagaagaaaaacaacaattcagcattgtcatgctactattgatgactagtatagtagtttactaactttcaacctactaacttctaacaagagaaacctaccacaggacgtgaagacatggacccaatcgacatcgaaaaacaagaattcctccaatctacaagaccccaaaatatgggaataaaccagcccatgctactctttgaagatcctccccaagcttccaggaacaaaggacgagtccaagcctcactaaagcctgaagactacaccatcaatctgaatcacctaaagcaatattcttcgaatgaaaggtgccacctgactccagcaaaacgaaggataaatgtcac

SEQ ID NO: 30494 - DNA, 1501 bp, Oryza sativa
  unsure (1)..(1501): unsure at all n locations
atgctttgcaccatcgtcgccgcgagggacgagaagctcgccgagatcggcgaggagaggatcggcgacctcgtcgtctactgctccgaccagactcacttctcgttccagaaggccgcgcgcatcgccggcattcgccgtggtaactgccgggagataccgacgtgccgggagagcggcttcgttctcacggcgacggcgctgcaggccgccgtggccgcggacgaagcggcggggagggtcccgctgttcctgtgcgcgacggtcgggaccacgccgacggcggcggtggaccctctgcgcgagctgtgcgccgccgtggaggggcgcggcgtgtgggtgcacgtggacgcggcgtacgccggcgccgcgtgcgtgtgcccggagttccgccacgccatcgccggcgccgaggccgtggactcgttcagcacgaacccgcacaagtggcttctcgccaacatggactgctgcgcgctgtgggtggcgcggccggcggcgctcgtcgccgcgcttggcaccgacgacgacgtgatcctcaaggacgcggaccgcggcggcgaggcccgcgaggggcgaccaccaccaccacgccgcggtggactacaaggactgacaggtcgcgctgagccgccggttccgcgcgctccccctgtggctcgtcttcatctgaaaagaaaacgctggcttgcgcgccgtcgtgcgctcccacgtccgcatggcgnccgcgctcaagcgcatggtgcgcgccgacgcgcggttcgaggtgcccgtccgaggcagttcgcgctggtctgcttccggctgcgcggcggccggcgccgccgcacagctcgtcggcggcgacgagctcacggccagcaacgagctcaacaggaggctcctcgaggcggtgaacgcgacggggcgcgcgtacatgagctccgccgtggtgggcggcatgtacgtgctgcgctgcgccgtcggcaactcgctcaccgaggagcaccacgtccgggaggcgtggagcgtcgtgcaggggcaggccgccgccgtcttggccaccgccggcgccgccgctgacactgctcgtaccaaggaccacgccgccggcgacgaccatggcgcagatcagccgcacgcgatgacgacgacgacgacgatgggatgtcgctccggtccatgggagctgtgaactgtgtatcgaacactccgttcttacgctgtgtatttcctcttgggcaagtaaattggattacctttggttagagaggacagctggacatgccagttgttttttcaaaaaaaaaaatcgtatttgttaggcgagtttgaccggacaattaattataaattagtttttgatgatatgatatgccggatatatatatatgctgtcggtaccttttccattgttttggaggccgtacgtctctaaaatatttgatgatcagcgtaaacgttttgcacgagcttataaacaatgggcggaaacaaaaataaggcaattgggtgattgttg

SEQ ID NO: 30495 - DNA, 1501 bp, Oryza sativa
tagacccggtgaccggcccatggctccgcgcagcccacgacgtcgcccgctgatggcatgggctcctcctcgcctcgcgatgtgcggctcggacaccggaaaactcgttccggcctgtcgctgcaatgggacgcgctccgcttgatgatagtcgagtctaacattcgttcctaaaccgaaatatcaggtgtatcccatcctcccactcactataccatgcctaagtgttagctttggtccctcgacagtatagtgaccggttttggctccctcctctccctctccttcttccctctcttccccatctctcagactctcaagcgtgcctcggacatcgtggccctgctcatcatcatcacctcgtcggcatcctccacctccaccgacctcgctgcccttctcgtgctcaagggcgtcatcccccacgaccacgactctgttctcaccacctagtcctcctccaccaccaactactaccttaggcgtggtgttccctgtcaccccaactacgccgcggtcgccgccatctacctccccatggactccctctttggcgccctccaggccttcctgcccccgcaccttcaccgcctcgaccaatccagtaacttattcgagctcatccctgccgtctttcttgcctccccgacaatttgctacctcaacctcttcagccacctcttagggcctctccccgctgcatgtcggagccagtcactcacctacctccgcctctccgccgccaatgttgtcaccgtccgaaatctccagggctcgtgcaatgccgctccctcggcctcatcaacctatcccacaacgtccatgaggggtccatcccttgctccctcgctatactcgccaccctccgtgtcctcgacgtccctcgcaacagcctcaccgacaggatccccacacacctcatcgcctatcaaaacctcgtcgtgctcctgctcacgaacatcatcgccaaatcacagagggaacaaccaaagttcaacgcctctccctcttccctctcttgccttgtcgttcctttccacacgcacacagtgtcgtcaagctcaagctcaatatacttgtggtcatcgtcgacgcgtcgtcacctccattcaccgatggccccagctgacgtcatatcccctcttgtcgggcatcctctagtagctgtggactgtcgtggcccctacttcgctgttgcgcgccgctggagcccccttcttgccggccgcctcgctccagggagaggggcaagagggaacgagttggtcgctaacatgtggggcccactcgcctcgttagtcaaaaccagccattatattgctgagagaacaaggttgacacgatagtgttagtagggaatgagctatacctggtattttgattcttgaatgaatttcagactcaacgacaaattgtgagggaataagttcaccagccgtccctccactttacgtcgagtctgtctgaggcccctaatctccaataccaaaaatcttcaccc

SEQ ID NO: 30496 - DNA, 1501 bp, Oryza sativa
ccgcctctcctcctcctcctcctcctcagccgccgcgtcgcctcctcctccaccgccgccgccgccgccgcagcgcggtctgagtgaagtgaggttcttgggtggaagcgaaggagaagatagatagatagagagagagagagagagagagagaggattaaggatggaggttgacccatcgtcgtctttgccgggcgcgggggaaggaggaggaggaggaatcggcggcgggggtggggatttgtggccgttcgactcgctcaccacgtcgctgctgttctcgtcggtgtcggcctcaccgcagccgctgccggcctcgtcgtcgtcgtggctcacgccgccctcgccgctgtggctgttcgacgagcgccagctgctcccgctcgacatgggcgcccccgctgcccccgccaccgctccgcccgccgaggccgccgccgtggtcgaggaagtccatcggacccgctccggtgagcctccttgcttcgtattggtcgtgcgtttcttttcttgttgctggatcatacaatttggaacgaataagggagaaaaaagaaagatcgaaattgaccttcactgggattttgttctcatctttggctcgggtttgtagatttgttcgttccttgggaatctttctggctgctccaaagttgaagcagaggggcagctggaatcttgctgttattcctgtcgttgggacgctaaccttttacctccagtgcatgatccatgaagtttccgagctttatgtttgacttccttgccttctttttggcatatttcttggctgtataaagatttgccctgttgatttatggaacaagacagaatctttgcactcgctcttgcaacagaatggataaaatgttgtaaagttagttggtatgtgttttgtttcaatgatatgctcgttttgtttaatttgtgtgctttctttctatctactagtttttatgtgttaatttttatgtttctttctgtctgacttcgtggtggtagtgcgcgtttttttaatgcaaatgattgccaagatcggttgatggttaattggattccactataggaggtagggggagtatttgctgtactaaattaactgtgcatacaaaaaaaagatgacccttttgaagtgctattgttgcctgactcattttactttatagcaatgcatagcactgctttcctgtgtgtctctaatggtgtggtgcctctaaagcgtggattaagtggtggattatgacgccatggacagtactagctagattgtatagttgaagcagttggataacgctttgcttgtctcattatattatactagtatttaataccaggacaatttaggactactccatttcattaattggtgactcaagaaatggttttggatcggtgatgggatttgcagcattgttgattcgcttcacttcattgaaaaataacatgaagcaattacagttatcaaacttgataagaaacatagtgtatcattactgaaaca

SEQ ID NO: 30497 - DNA, 1501 bp, Oryza sativa
tgttccagaaggcagtatgctaatgggttgaaaattacataaacttctttgaaagagtttaagattctgaattagttggctggtagtaaaagcatataagaatagaaaaaactgaactttcatatattctgatttatagttcgttttctaaattttatatctatatagattcccccaacagtctcttagattaaacgttctagtagtaacacagtttttaactatagcaaactgtctcattttttagaatcgtcttacgtgcacaatgaaatattttacttccaaatttgcatttttttttaccacactatattagttaacgtggcaaggcagtactccctccgtcaaaaaaaaaaaaaaagacaaaccctgatttccgtgtccaacgtttgaccgtccgtcttatttgaaaaaaatatgaaaaaatttaaaaagacaagttacgcataaaatattaatcatgttttatcatgtaacaacaatgaaaatacggattataaaaaaatttcgtataagacggacagttaaaattggacacacaaactcggggtttgtcttttttaggacagagggatgcagttgcagcccacaactgtctctttgtacttgagaaactattcacgcacaacccaaccagttgaacaacgtaatgttactatgtcagagggtgtttagatccagggttctaaagttttaacgtgtcacatcagatattatatagggtgttcaagcactaataaaaaaactaattacagaatctatcaataaaccgctcgacgaatttattaagcctaattaatctgtcattaacaaatgtttactgtaacaccacattgttaaatcatggagcaattaggcttaaaagattcatctcgtaaattagtcgcaatccatgcaattagttattttttagcctatatttaatattttaaatagatgtttaaactttcaatataacagggcgtaaaatttggaagtgcgtcgtaagaaaaaatcatgcgaggtggagtggtctcatggtgtgggagtgttctccaaccatgccacctcggatcacatggccagaatgtccactctgcttttaaaatagtaagattttagagtgtgtggatttctttaaaaactgtgtgggtggttttggaaaggtgtaaaagcaggattgtagttaacttgaatttttagaattccacacacataattcctaaacttagttattttgatacttgaggtaaaacaatatacaaatctagagagagaatgaacacaaacgaagatctgcatgagatttgagcccacgctacattcttgcaaaattactatgaattagaccatcccacatgtaatttttaggatttgtagaaacctttggtcaagcccatcccgtagtaaaatctcaagtctaatgagcaggagctgtttagattgatgtcatttctaactatactttttttttggcaaagttgttaaatgtgcatacatttagtttgttgccaaactttgg

SEQ ID NO: 30498 - DNA, 1501 bp, Oryza sativa
ccactcaggaaccttttgtttgtacacacgcccaggtagccccagctctccagcattttctccatccaccgagaacatgtacatcatggatacagccctgtactgaagaagcccaatactctgctggtcaagtacaaagggctgtcctgaagtagtaagcacataccggtctccactcttaaccggtgcccaaacttgaaccagcagatgctgatctgtggactccttgaagtatctaagagcctgtgtaagcctctccttaaacaagcatgagctgtccgtgttatcatcaatagataggtgaaactgccatttgctattaatctgatcaaccctcttactagtcgtgtcagaattccctaaataacagaaaagcatgcaatactatcaggaaaagaaggcaaaaagtatataaaagaagaagggataataacattgctaattgaatggataataagcttcactacgcctgaccattcgttccaaacctagagctattgcgacaaacaaatccatgtttcagtaatgatacactatgtttcttatcaagtttgataactgtaattgcttcatgttatttttcaatgaagtgaagcgaatcaacaatgctgcaaatcccatcaccgatccaaaaccatttcttgagtcaccaattaatgaaatggagtagtcctaaattgtcctggtattaaatactagtataatataatgagacaagcaaagcgttatccaactgcttcaactatacaatctagctagtactgtccatggcgtcataatccaccacttaatccacgctttagaggcaccacaccattagagacacacaggaaagcagtgctatgcattgctataaagtaaaatgagtcaggcaacaatagcacttcaaaagggtcatcttttttttgtatgcacagttaatttagtacagcaaatactccccctacctcctatagtggaatccaattaaccatcaaccgatcttggcaatcatttgcattaaaaaaacgcgcactaccaccacgaagtcagacagaaagaaacataaaaattaacacataaaaactagtagatagaaagaaagcacacaaattaaacaaaacgagcatatcattgaaacaaaacacataccaactaactttacaacattttatccattctgttgcaagagcgagtgcaaagattctgtcttgttccataaatcaacagggcaaatctttatacagccaagaaatatgccaaaaagaaggcaaggaagtcaaacataaagctcggaaacttcatggatcatgcactggaggtaaaaggttagcgtcccaacgacaggaataacagcaagattccagctgcccctctgcttcaactttggagcagccagaaagattcccaaggaacgaacaaatctacaaacccgagccaaagatgagaacaaaatcccagtgaaggtcaatttcgatctttcttttttctcccttattcgttccaaattgtatgatccagc

SEQ ID NO: 30499 - DNA, 1501 bp, Oryza sativa
actctcgatctgtatgacttgcattgactttgccatggtaaaaaacctgatcttttgttgtgcttagctcaattgctcaaaccagtagaaagagtagtagaaaataatctgggagaagcagtggtggtactgtttttgtcggcagaacattttggctggtgaaatgcctatatcctgttggaattatgattaaagtttgtagctttggatcgtagtagctcctgatcaagttgtgttttatttgcacatctctttcctaggaagagagagcttagcaatatggagtttatgagctgatactacaagtgaaccgtcggtgggaaaagaccaagaaaatttccctgttgtcaccttgaactctgaagagtttcgggatctcgatgattatagtagcctcatcagcatgagaaatttctcgaaattggaaattagtatacagcactgtcaaacgagagattctcagcagaagcgtgcattagaaacttccgtcggttctaacttctgaattattgtcccaagaacaggaaaaaatgtagccctgtcatcaaacccaataaaattctcgtgttagtacagtatgctataactatctagaaaatatgaagcatcatgttggttgggtagaccatgttactttgtttacgtatcagtactatctacgtataaaaaaccgtatctacacagttaaactattactacaaactttaacaaagtattttttttcttcaccgatcataccaaacttactgagtactgggtaattcgccatagaaaaactcttatggcacatcagtagtaaaatgtagcaattgtcaaacgacagtgttcgctggagtagttagcaaaacgaaaaataaattggcaactacaacagttgaaaactgtcgtacttggttgatgccatgtttacctctgaacatgggagaagctaatcacaaccacctaatctgactattttagtcgcacgtctttgagacagattccccggatcatgcttgcctggtgcccaattagctgcacaccgatgcgattaatttccgcgacgggattagcaaaattaggccctaaaaattcgcactttgtggccgtttcgagacacggctgaaagctgaagcttagttggcagtttgactatacctgaatgaaaattgaaaaaaagccttgtcaaacatcacattaatctaagtaactatcattagctgtggtctacatctctaataatctcatagtagactgcattaccatgtccaaacaatgaaaaaatggaggaggtcagaagtgaaaaaggaaaaccagaaagcatatataggaggctcacacttggcgttgtcggtgcttagtcaattggtcaccacctgcactgcaggaaaaggtcgtctacctaggcccgttcttcaaaacgaaaaaaaaaagattaacgtgggcatatgcttcatgaatcatgagcttgtaaacgatgtgattttcataaaaactttttgtaaatatttttctaaaaaag

SEQ ID NO: 30500 - DNA, 1501 bp, Oryza sativa
ccagaagaatctggtcattgatctggtctctgattagatgggttataaagcatgacactgataatttgtattaaataaatagtaaaatatacgattggaaacatcacggactctttactgtcagttttttgttttcaaaatttaaatatcaaaattcggaacgaataagtatgaagctgtaagttgcaaccttcttgaactctcactttaatatactattattattaccaatttaatttaagaaattgtaactgccgaccggggcggactcatttttaatcttacgccaccacatttaaaaaataaccaacacatttaatacataccatcaataacacgggttaccgacatgcgtacaacgagccgtattttttttcccttgcatcatatactccgtatcaaattatttcgtttactatctgatgcgtgacgatcataaagttctaagcactatattaaactaaataaatcgagctattaatagtgccttggcctagggtgcaagctaagtttttctttattttttccttttctagttacgccaatcggttatattccgttacctttcccttcccttctttccagtagtttccacctttcccgcatcttccgccgtggggaagggagcaatcggcaagccaatccaatccggttgcttctcctccaatccaacctcgtcggcggcggcggcgacccgcgccgcgcaggtgaggcctcctcgcgctccccctcccgcttccgccgccgccgccgcttgggttgcccgtcgatcatgcgtcccgcggattgggggctcggtttttttgtatttgatctggtttgcgtggagattaggggcgatgtacggggtggatttttggttatgggttggattggatgggagagatcgtatttcgtatcgatgctccgtttggccttaggttttgtatttagtggatggctcgagtccaagcgtagaaaagagagaaagaagtgattcggaagttctatgttgttgtttcgatgtagatggaaaagtgtattgcgcatttattgttttgggattactagcaaaagtttcatgctcatttgtctcttgcttgtaaattttgatggaacaatagagagaagacacagggaccagctaagctgtgcatccttgttggtgatggttttttacaaatgatgaatagccgcctatcagcaaaattctttcattttacagttgctgcatttggaatttgattgaacaattatctccttttgttttggtcaagtcatggaactggtagtgccttgcattctgaaaaggggctctagattactgtacctcatttaagataatttggcagcagtacaatattatcctatatatattgtgatatgttcaattaatactgtaacacttatatgtacaatattatcctatatatattgtgactgttcatgcttgtacattgttcaattaatactgtcacacttatatgcatctctgtttgtgttcctcattaggctgttgagt

SEQ ID NO: 30501 - DNA, 1501 bp, Oryza sativa
taactttttctgtagatattcatggatatattatttgcttgattccgagtccgtatgagaaagttacgcatattttaataaatgacatattttgtccgttttggtagagctttggaaaattctacgagtcatatattttgtccgtttgagtttattttttctatggtttagttcatatgttcttctaagtgtgaaaaaaaatatcaaaaaaataaaataaaataaaaaattgcatctctctgtactgtttaacttatggctatcatttcatgtggttatattttgaattagattaagtaatttcatatggtgctagagtgcattatgtttaacatgctgatcaaagggttttactaaaagagttatggtctaagtggtattctagttattttcagacttagctaagtggtatatttcgttcgagtttaaatttttttgtggttggctgtatcgtgattctaaatgtgaaaaaacatctgaaaaaataaaacaaaaatgacaccgttacaactacatacagagaaacaggaatggagacgaggggtgggtagggggggcgacgccaacatggcaggtgccctcctccagccacatcggttcgcgtgtgccacggtggcagggtgacggcgcctcccgttggacgacggcgccagccactccggcgcttcaaaaaggaccatttctgggataagtttttccaggggcctatttgcgaaataagtttttcaaaaggaccaaaatatgaaaaatccagcgctaaccacgctagcatcctcagatccatagggcctctcgacgccatgcaggcaataagccagtaacggcatcgcttctatccagcccggacaccacgatgagcgaccgggaatgtgccatgtcctaggatgccgcctaccatgcccctcacacatggcccttctcaacaatgtcctgctgaagggaagggagagcagcgctgtgtgctagagggaatggagagagggtgccgccatgctggaggaaagggagaggattgccatggccctgttggttcaacccaggtcatttggctttcgactggttcacctcaagttcactgtttttcaagctttaccacataatacaccaagattggacctcacctgccactgcatacatcactggccatcaccaaaaatgatccatggacatcaataactgttttcacctttagttcattcttctagctccgatttttcgcctttggttcatgaaagacggaatacggttgttgaacggagaatgtactattcaacaattaatcgggatacatttgatcaatcgggcttatgcagaaatttgatgtacaaaaatatatggatggtctcattgctgacaaaattgatctaggcaccatgtgtcggctcttatcacaaatctattatattataacagctttgaaagaagtcactacgttcgctgtggggctaaaaatttccacattaatcggagaaaaagaaaagaagagtccaaatataaatac

SEQ ID NO: 30502 - DNA, 1501 bp, Oryza sativa
aactccccaagtcccaacgaagcctaccgcccttcgcggatgggtaatccccgtaaccacagatcaactctatccagaacctcacaccaccctcgaatcggcgactactcctaaaccctacaactgagaaacaacaccaactcgaactaagttgtaacccacacacacccccacaagcctcggaacaaagcggggggagcctgtagaacggagctacgcgcctctacgcgaccaaccaaccgccgccccggcgagcaaggagagtggcgtggcagacgagacgagctgggaggggaggggagggggacgggatgggggttgacgtacttggcgtaggcggcgatgatgcggcggagtgagctgatctcgagcgcctcctcctgctcggtgtaccgccgttcggccatcctccccggcggcggcggcggcgaggcggaggagcgcagctttctccagatgaattggtgggcctccgaatgatgggtcgcgtctcgcgtcgcgtgggggaggtctttgcttcagttatgctcaggggcaaagcccactaggaattttgccgggtgaaccaagccaatatggaaaagaagaaatggaatttcataactcaaatattcgtctcagaaattaactactcctatgatgataagtctcatcggtaagcgatgatattaactactcctatcacatcaaactaagcatggatcatcatattttgatatttatatgctggcctaaactcttgaagatcttcatagaaatagagttcatggatttggatttgaaaggatgagtgcgcatgtgtataaaagagtttgcatttgcaatgtgttttgaaggggaaaaaaaggatagatcatcccattgtttcatatcataagacttgtcttgagttaaaattttttagtttgaccaagttcataacaacatagcaacatgccaacatctaacattaaaaaatccacaattaattataattttgaagtatattttcttgtgttgaaaatgctgaaacattttaaacttgaatttgacttggcacaaaccgatggagtagcttcatccgatttatatactatgaaacatattgacacagcgatttatatatctcgatcttcatttcgccctattttagtataaaatataggttgcaggtttatatctatttgatttttgtagacgcatataaagctaacacgaacacacgatgcaccgagaacgatatgtatggcttttccgatgagatgaaacactatatacgctgctaaccatcgaacgatgttacttgatacggtctgtgacgaccatttcagttagtactccttccgttttaagtttttgtttgtattgtttgaccactcgtcttattcaaaaaatttgtgcaaatataaaaaaaaaaagttatgcttaaagtactttgaataataaagtaagtaaaaaaataaataataattctaaaattttttgaataagacaagtggttaaacagtgtaggtaaaaactc

SEQ ID NO: 30503 - DNA, 1501 bp, Oryza sativa
tgtgttgctctagattcagatatggatgtcatttagataagaacaataccaagaagatatagatggacattgtaagagatggaagccatttggcttgtccagtagtctagattgggggcatgaagaaagttattcaggagagggttttaccttgtctgatcacatatgaggtaccgctgattccaagataaaaagctcaacttcgtggcaatagtttttaagataaggagaatgattacatcccaacatatgtatggcgaaagtttgaatagcttacatcccaacatatgtatcccaacatatggctcgtttaatttgttaaaaaaacatctactaaattttggtagggcaatgaactaaataagactttacaatcacaagcttaccaatctctatcaatatttagtaattatagtcacgaacatattgacaaaaaaaaaaggcaccgaataagccttaagtgatcttggactgtatgtttattgccaaagtactaggctcctcttcagataaaaaataatgtcctcaaaaaactttttttctattgtattacttataagatttgttttaagctatttgttaagtttattttttaaaacctttaatctatccctatgatcacatggataatctgtcgtaataatatgcttaataatctaatcaaatggtacattagtctcccaattcaaagtttaaactcaaaagacgtttagttttgcataattatgaccatagttcatttatttcaatgataaacctgaatgatcgagaaaatgacatagaaacacacgagaaatatcaatacgtatatatggctgtcccgacgagttatcaatatataagaacactcatattgatatttatttatttatttgcgaggaaaaacagccatatttatgtgaaaacattgataaaatcaatactgtaaaatgccttggtgaaaataacaagactaagctaaaatttcacaaatatcatcagccagaagcccacaactcataggtttcatttgcctgtgctcccatctcaactcaaaatgctaaacgttgtattttttaaaatattcctttcttaaaaaatcatattaatcaatttttaaagttagttttagctaacacttaattaatattaatgtgctaatgagctgttccgttatttgtgccggagagggttcccaaccaacgcaaataaacgcagccgtagcagtacacatttcgtttcaataggaacaaaatttaaatacaacaaaactgcacattgaaacagttccccactaataaatactgtaggatttaaacaagtgaccccgactgtgcacttgttccgctgccccaccagtcgccgtcgtcacggcgtcacctgtgcaccataactggcgggggctttgggtgccatccccgtctcccgtaaattcaccatcctacccacgcagtccacgtttcccagcccccaaatcccaggggcaaaatcgtaaaaccacactccgtcttcctccactggg

SEQ ID NO: 30504 - DNA, 1501 bp, Oryza sativa
ctttttgcttttgtttttttttaaccatgccacggccattttcttcgaagatatatctaatctatgaattgtgttatgtgatagcaaaagtaaagcatctttaccatgtttgagtgtgagacttaatcttctagtaattgtcttctttgggatgagctgcttgaaatagaaatgggtttgcccgctaagaatgtactaccggttatcttgttttcagtagagttttgtttaattgaggctggaatcttctcctttagctgattggcaatttggcatggcacagataagggattattgttatggtaaattggttctgtgcctaattgacaactgtgctcttttcgggtgcctcacaatgcatatcagttgctggtttcattgattgtgaaaatatcagctatgtcctgcaagtggtacagagtagtggttaccaactgctttttattcagataagccatcccactaattgtagccttattcaatttctactgccacaaagaactgttttttttacgttgtattgggaatgattatttacttccatatcttttgtacagggtaactgtgcttacttggcattgttacttctgcatacaattatgtaaaataccacggattgttgtagcatttttacatgctcaattactttgaataattgcctgcttttgaatagttatttcgtaagaagaatagccaatagataaaattagcaaatatgctaagtaatggctgttcagtcggtgtggttgttgtgttagcttttattatgcacacccctgctgatccatgatgcactgccttgaagtacctccgcccaaaataacttcacttctagcaagtgggattcaaattagtatggaggcttttctgtgtgttcgagaaaaaaaaagttagtatggaggaaaaaagaacaaagtgcccctcattaataggaaagtagcattagtgggtgggcaagtaagagggtatggaggagataaaactcgatttgcagaccgagggtatgaagagggatagatatgaacttattttgggacaaatgttagagactagaaatgagttatcttgggacagagggagtacaagacaatgtgggtccttgtgggatatgtaaataaaagggagcaaacaattttttttaaagaaacaaaatattacgcttttctgttttttttatagttttggcgttggtaagggctaagctcacttaacctaattccagcatagaaattattaagttctaagtactcagccttccaatgtctttaaatgttgcgaaagcaattctttcaaggtagcatggttggttatccatggaccatggtgataacatctatcatttttcttcatgcattcattagttgatcaatgccatactgtgttcatttatacgaatacttaaatattgggaacattttccaggcccaagctaagaaggaagagcttcggaagcagccagaacaaattattctatcagaagttcgtcaaatggttcagcaga

SEQ ID NO: 30505 - DNA, 381 bp, Oryza sativa
atatagacatttttagcctaatgtacagtcaccatttttaactttgactattaatagaaaaaaataataatataatcatgtaaaattgaggttactagatttatcattaatcaaactatcttaatatgtaacttttttatttaaaatattttatttttataaatataatgtgaaaatagcatgcatctcgaagactttgtcggagtacaaaaatacttatattttaggacatgagcattaaaattcgtctatttgtaagggatgttgtgcgtgaagctccacaaggagatctatgctgctgccctccccggcggctgcgacggcaacaccaacagctgagagcccgagaacaacgcatcaccattagtctttgtctttaga

SEQ ID NO: 30506 - DNA, 580 bp, Oryza sativa
cctaaggcagtcaagtgcatatgacggcaggttagcaaattgttaagcactaagtttttctatgcacaccaagtgtttgtcatttttcttgtacgcagatggcatcttaaaactttaccctgcatcttattgtttcaatttttaatctagctcacagaaactcttatattaaccatataatttaatctgtacaaccaaaaatattggctcatagtgcagtttaattcctcaattatcatgtaaagtccttaattctttattctgattgcttttgtcaatcccatctgcagcaatgtctgatccactcatgtactgctttgctatttttctgatctagccagtagataagatggtcgttttcgtttggttcaattaaacaagcatcagggctgcatcgacgctgtatctactggatcctaatcctaagcttccaggtacagttaacctcacctacacatgttcggtagacaaatttcttttggcttgaaggcataattatagaatcaaaaatatttagtggttgttgtcaaattaggaacactcatgtattaactatatttcttattttaacacagaaaat

SEQ ID NO: 30507 - DNA, 393 bp, Oryza sativa
attttcatagatgattcttacaaggggaacttgaaattagctagtgcacactgcacagactgacactgtagattggcatatgcccgcagaagtcttgagtatcacagactggcactgaagactgacagtgcatgagtgtagtagcaatgcatgacagataaatgtcactcttttgctggtgtgcaatgcaacaccctgcagttgtttgttcactctgacgattgacacattttgacgattttgctcattatctatttaacaaggtcactcaaaagttgtagtcgatgttgtggtctaaacttttctcgatgaattacgcaatgaacgaactctctttcactgaagaaatgttatgccttggttcctgatgacttccattcatattatatcagg

SEQ ID NO: 30508 - DNA, 275 bp, Oryza sativa
ctagctagtcaaacaactacatgcatcgtgcatggatattacttcccgacgacaactattgtaaaagtctgatcttaagttcaaaccacgtgagctgaccgcatgatcaacgcattatgcggataccttaattaagttcccaagtcaatcaaattgagggtacaagacgaaattgattcccccacacacttgctccttcttccacttccatcctgccctatataatatatatatatatatatatatatatatatatatatatatatatacttagt

SEQ ID NO: 30509 - DNA, 282 bp, Oryza sativa
agctcgtagtcccgccagtacaaggtcaggtcaacctccgctaacacggcgtcacgccagctcgacttttgttcccgtcgtgccagccggcctcaagctcaagctcgatagatgtccgctagcgttgtccctggcttgatctcgacttccgcccacactcacacgccattccctagcttaatttcgatctctgccgctgtcgtcccctggctcgacctcgacttccacctgctctcacacgcacgcatttccctgtctcgatttcaatctccgatgtcgtca

SEQ ID NO: 30510 - DNA, 1501 bp, Oryza sativa
tgcagcctcctatgtgatgagccttttgcctcggactcatgggctacctttagaaataacttttgtaatgtgtttacatataactactttagtggagtacttaacccagaaggtagagtcgaagcttttacacagtgaactattttagtggagcacttaacccgcaaaagtagtattgaatcaatctattccattggttacagaggaaaaaaaagttcattttacatcctaacgatattttattcttttaaactttttttcttctctacatacaagtcatatttcactttgacacatcaggagatgaaggtcaatgataattaaacgaatacactaaattccacgacctgcatgtaaatgcctctaaggtgtcaatacaaaatcaataagcatttcgtataacgatatgattagaaatttcctactaatttttattttaagactcatattaacttggtatttttcttaaaaatactgtaggatcctacgcataagaatcactatcttacatatgtatatttggtcaatttaaaaaggtgatagcaggttagtaaaaaatatatatttatgagcaattaaagtttctcaagatttttaaagaaaaaatacaatgaacattcaattaagaagggaaacacctcactttaatttaaacttattttgttagacatgttttcgaaacgaaataaaaacatgcccgcgcaaatgcgcgggctaccttcctagtttataagaaatgtctcttcacatgcaagttttgaaggaaatttaacatgaggtatatcctcatggaaaaaatctttttgagtctttatctctccttaaattcctgtgtcttttctatggcccaatcaaatgatcattcttatgtttttcatgtgttttaaaattctctgttttacacttatatttctatcagaatactatgtttttcctatccgtccactttttaaaagattgtcttcggttagaatgctatttttttaatatcaaccaaataaaaactttaactctcggtgggatcttaaacttccatatctcttttgaaatctaaaaccagtgttctgtacgatcagagttcaatagaaagatttaactgtaaaaatcccattcattgtatgtttccagattaattgatctggttcatctgtcataacaatgttctgacactgcttattcaagcttccccagtttttttcattttcgtacatagcaaagccaaacggatgctgaaacgatataagctactactccctccatcccaaaatatttaacgccattaacttttttaaacatgtttgtctgttcgtcttattaaaaaaatttaaataattattaattcttttcctatcatttgattcattgttaaatatatttttatatatacatatagttttacatatttcataaaagtttttgaataaaacgaacggtcaaacatatttaaaaaagtcaacatttagggaacgagggagtagcatggaatttctcgcctcagcca

SEQ ID NO: 30511 - DNA, 569 bp, Oryza sativa
cacacaataactccatcgtataccatatggaatctccatcaaccacgtgcatcaactctagcctaagtatcctgcatgatctttgaccaccacggtcgtcgtcttaccaccaagccgactcccggtccatcaccgcaaatactctcccgaggcatcaagtcacctacacatgaaataaacaaagaaaccatattccgagaccaagcaatctccaacttgactcattagtagcaaacaacagtattacatacgtatagtatccatctagaagtcataatcatgtaataattacggatatccaaataaacaacccgaaaccgaaactgacatagcatcggccggtcagaccgcgggctgcgccggtctgaccgcgcaatacacgccggtttgaccggctaccagagcccggtctgactggtcacataaaatgatagatcctgcgattcacctgtaaatccaatcctctccaaaaccacttcgtgagtaaattcgaaataataaaaccaataatctccaatgcccaattgttcatcacagaataataatcaaaacacctttgattttacagg

SEQ ID NO: 30512 - DNA, 976 bp, Oryza sativa
gtcattgtttggtagggccatgtacacatacgcttgcacattcattaatttgcgtttaatttcttctgtactccttgggagccacatgtagtaggtaggtattcatcgcgcggtcagctcacgtgctttgaaattaagaccagcctttatgccaagtaatacccatatgcaagtacacctgattttcgagtttcgactaattacttttgctgttctcctcgttattaatacccacttggtaattgctaaatatcgacttaaaagatttttcaatgtaactgtggtgtaatattgatatcacgacagtgtaattacactataactatatacctttatatatatataacttactataaagtgacatgcattttaatacttatatatatacaagttacataaaatttttagtgtagttatagtatagttatattggaattacactatagtagttatatttgaaagttttcactcaaagaatttacgtcagttctttatctagtgtcgaccatattagtttgccttaaaaaataaacacagaagttataaattagtccgaccatgatagttttcattaaggcccgatcaatttttaataataaaaacagtatctctgtcaatataaacacggtcaagaattttaaaaagataataaaaagatacgaagttatgtgacaaatccttatctccttcctgacaacaatatgcagactaaaataccgaatagaaaacacatatattttataataatattatataggaactacgccattcaaaataaaactaagatatgaccattggaacgggttaattaaaagttatataactgtaaagtgagcataactcaattgtttagatttcttatggtgaaacttgcctacccaaattcaagttttagacgtggcacatgtgctcgtattaatggctaatagcatagtatcgataaagtttcctggtcctcctcctcctcttgcctagg

SEQ ID NO: 30513 - DNA, 910 bp, Oryza sativa
gttgagacaatttgcatattgttttccccttgccaatcagtgggtgaaactgcgcaactgtagccatagtattccaatagtgtttagcatgaactttcgacaaaattaaaaagttgagtactttttgagagtaaggaactccatgaatgtatctttaatgcttggtatgtataagttttaaaggattggaagcaatcaggattgagactatgacatgatctaatatgaattccctggaatctcgacgacagtgccatgtgtgtttgtattttagctcctatttgtgggttgcagataaatgcttgggctttcctcaattgtcagttagtcctgaaacataagaactgtacttggagcatctaaaatcgtgttgcttgtagtgcaacatccaatacaaattacttgtaggatctgtaagatcaatgtgtgttttgattcttattccgtgataaacaattagcatctgtgattattggttttgatatttggagattatcgtcaaagtggttttggagatgatcggatttactgttattttatgtgaccggtccgaccgggttgtgtatgccggtcagaccggcggtgatcgagcggtcagaccggccggcccgcagtctgaccggccgacgctgtgtcggcttcggtttcgggttgtttctttggatatccgtgattgtttcatggttatggcttctagatggatattatacgtatgtaatactgttgtttgctactaatgagtcaagttggtgatagcttggtctcggaatatagtttctttgtttgtttcatccataggtgactcgatgcctcgggagagtatttacggtgatggaccggaagtcggcttggtggtaagacgacgtccgtggtagtcagatatcatgtgggatactaaggctagagttga

SEQ ID NO: 30514 - DNA, 179 bp, Oryza sativa
catttaatatcctttctcatctttctgtgattgccaatcagatttatctttagcaaaaaattagagtctgataacctgtaacatcaagagcgacatgcataagagctacatgtaatcctactgccattgagtgctacaaaattttcaagaaactcactcagttattgagttcgtcgcca

SEQ ID NO: 30515 - DNA, 399 bp, Oryza sativa
ccgtcgtcctcctccatggtgcgtcacagatctatgggctaggatggtgaatcgatttagatccaaaaaaaaagaggaaaaaatgaagtgggggtgagagtggttagttgggtacatggaaaaatataatatataccagaagtagggaagttgattttatcgaaataaatcatttgcttcaataacgatgggagcgggatgatgggatgtggaaactggaaagttgtttttatcgaaataaatcgtttacttcgataacggtgggagtgggataaagggacgtggggcgaggtagacctgggctgatacatgtttggtgctcagaatactaggagcgcagcataattttatcgacctaagttcccaagtcaatcaaattgagggtaaaagaaattaagc

SEQ ID NO: 30516 - DNA, 307 bp, Oryza sativa
atattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagttgggcagagcgtttaaacgtaatgagtcatctgctcggggaaatcaaaattgacaagaggagaaatacatatttataaatattttaaaatacttgattttttctcgagtattatatttatatcagatactactcatcctatatgtttgttctgcagg

SEQ ID NO: 30517 - DNA, 1501 bp, Oryza sativa
gaagtcctcagatgagaatttctccctgattggagcaatcatgccctgaaaagccaaatcggctaactgagcattagtaaaacttaagttgtagcacttattcatgcacaggctcatcatgtctttgcttgattgctgtcaaatcagacaacttcatttcatgcaccccactatagaaatagctgtgaaaatgcttctccaaatcggcccaactgttaatcgacccatacgataaagaagaaaaccaagtgaaagccgatccagacaaagacaaccggaacaacctaaccctcaaggcatccacagccgatgcttcaccacactgagctaaaaatcggctaacatgctcataagttgatgtgctatcttgtcctaagaactttgaaaaatctagaactttgaaccggttagggagaggaactctctcaaaccattcaggatacgactgtcggtataaatttccagcatctttcggcctaagcccaaattgctccttcatgacatccgcaatcaaatcggcccatggtcgttgctaaggcgttccttgagactgctgtgacatgggctcaaattggttgtattgaggaacaaactggggttgagctgatcctgcctgttggtattgaccatgcggtgatggtggctgatactgataattcaaattgctcccctagtaattttgtagatccggctgaatattgcgcaccaaatgctcaggaataacttgaggaatcactgtgccatctggttgtacgtgatgaaccaagtgctccgggacaacttgatttgcagtatgctgcacaggctgaccactagtgtcacgtcctgataaattcataccgaaataaaaatcattctctaaaaggaataatagaattaattaaaattcaaaaagaaattggcaaaccttaaaatgcatacaagaaaaattcgaatgtggtccggaggatttttgttaaattctccttggtctaaaaggagccctcaaattttacttgaattttcagagcaccggaaataattattaagaaacaacaacaattaagaaagtttattaaaaagaaaagctaaaaataaaccctctccttcctttgggccaaaagtcttcccctctctccctcggcccgcggccaaagtccctctctcctccctctctttttcctcccctctctccctcgggccgcccctcttctccctcctcctctccttcccggcccactccctcctctcctcctcccgcttgggcctgccccagcccaagccgagccgcagccctcccgcgcacgcgcgctgtcacgcccagaaattcccgaatagaattccaagcagaatgtgcattaaaatccccgtccaggaccagccggggtacacaaacgacaatgttgacattcagatccacgtcttacaaacatcataaaagtcttacagaaatgcagcggaaaacaaaagaaactggagctaagccttgactcgaactgcagcgggaacaccactccacagg

SEQ ID NO: 30518 - DNA, 1501 bp, Oryza sativa
taagtgggatttttccaaaacaagtcagtttagggttttagtaaaattattgggatttattcgtcagtcagttggggtttgatgggtgaaatgcattaggtcctagctctataacatgggttgcaaggtgtttatgcttcgtttgttattattaatatgtatctaatttcccattattttatcgttatgtgagtccgtcttatttattcgctctcatgcaaaatgatctatgcataaaatttcgcttttattcgattcccttatttgagtcctttattgctttacttaaatttggatttgagcatgcattgatcctactcctttgtcttctctagatggccggtcacccacccaaccaccgcggagaaggcatgatcgattttgtggcagagctggcacgcatgacactggtggtgggctaccccaacgcgccggagtacacgaccattccgccgctcagtggcgagcttcctcaccgtgtccgcttggaggtccatggctacgtggggacttgcctcgctaacatggcggttgaggcgtcaggaggcacagcagatcatgcctgtcaggaggcagcctacttgatgatggccaggttacgggagcgccacgactacatcttccacgacacggcgtaccgctaccacccccgtcgagcccatggtgatggcgtcagctccttccgtccgacagctggcgagaacgacaccaccttcggtcacatgtgtgctgtgatgaggggattggaccggatgcactcggacctgcacaaggcgaccaaggccttgaatgatgggaagctcatgaggatcgtcgctctgaaggacgagatagcgcgcctgaagaaggagaatgctcagttgaagggtcttccagtaccaggaggagtccggatccgcactacgccccgtaagaggacgactgcacccgtgcgcatccagcttgcgcccaggaacccacctccaccagcagctcccgcagcacctccagttccgcccgcagctccggcagttcccgcagttcctccagctccagctccagctccagctcccgcgttcactctctccttcgctccagcatcagccgccagaggtccagccagtggtaccggaggttggctgtctgctactcccagtggcagcggcgagactgatccgtcaggctccaggagtcgctcagagggaccgggtgacgagcaggaggacgctttcgactccaccgaccgcaggagccgttccgagcattaggctcgtttttcccactagtttatcgatggtctagcttctggttgttagtttgtgtgtttaggttgcttgtttggggtcagttgacggtcgatatcatgtgcctatgatatggctgtcttaataaggatgtttgcttgctcttttaagtgtttttaattcagatcagaacaattgcagttttaattcctttataataaagcttagttcttgagcatctgtttttcttcttttccccgtctgctcttccctccaga

SEQ ID NO: 30519 - DNA, 1501 bp, Oryza sativa
atgaacactctgttactttctaaaatatctcaaaaataaaaacaattcgtttttatttcaatgagaaatgcaagtcttcatatatacagatgtcaatggctccatgcactatcctatgcatccaaagtgctcaatgttctgtgcaagaacatcaaaattcttagaagatggggcgttgctttaattttggaggcacaccaatccccaatgcgcattggatggatatgatagtgcatgttaatctgtttgggaagctatcccatttccactgcttattcagatttatttcttcatttttacctttcatgcttgttagtattaactattctgatttcataatactgagaaaagaatatacatatcatcattccttgtctagaattgtatttctgaacaataaacatttgctgaattggtcgacaggaagcacaaaacagagtggcagcttttgctctatatcaatttttcgctgatctttcattgcgccaattgcttattgaaccatatgcatcacttgttttaagatggcaagaaggttagataaattgatcttgctttcttctgtgatgaatcacgatttgttggggcctttgggctacatattacatggttttggcaaaaaagcaggggagttatcatcatcatcttcaagggttatggatactgaggatagtcgaagagctggttttgtggataagttgttggatatggatgcgaatacaactccacatcaagttgaggatgcgtcagatggtgctacatctgttgactctaggagcatcgaggacagctactctgttcatgagaagaaagagacctatctggtgaatcgtacaggtaagctttgaataaaatcatcatttcagttttttgtctttatgaataatgtgtgaaacaatcatgatttggatggtgaccattttttaccttccataaccttttaatctgtcactgatgacagacttatcttctccattctatcaactttctcgacaccaatgaggtttctcctatgtagaatctattttcacagaattataacaccttttagctatatttccatttggaatcttgctttatttctcttgctcacaacatgcatgccgtgtattttgacctcattagttctctgagatattcatgctatatctttctttttcttctaattgaaataatctttttttttgttttaactgaataatgatcaaacgaatgtattaagtatttttcctttatagattattccttcttgcctctactagactgctaataatgtaagtgtaagtataattcctgtcgggatatctaatgtggcttttctatgatcaggatcgagatccgcagagcaggtggaaagcacagtgttgaaaaaacatttggaaaataaaatgaagcagtcgagctatttggtaagagtgatatacattctactatactgttcttctaatttaataccttttcttttgcctttgactctttgtgacgaattgcctcatctttg

SEQ ID NO: 30520 - DNA, 1501 bp, Oryza sativa
ttttctaaagcagatgttatttttaagagaaaggaaagggttttcacataccggaagcgttgcggaggggattgacgaaactccttctgtaagtagcagaagagatttacgtcctatactcctattaaataataacacaaggaactagctagtaatctgtcgacagtttttgaggctcaaagctttcaaattttttaaccataggatcttagcatccacagttgagttgattgaatggtaagaaattattcaacatgtataaggaagaataattcaaaagtaaaacacatatgctcttgaaaaaaatttgcaaatcctaattttatacaaatgtaactaccctgtaactatcatgtaactactatataattagggtataactactacgtaattacggtgtaagtgctatgtaactactatgtaactaggatgtaaatgctatgtaagtagattaaagcatatgaatacctacggttgggctggcttagtggttggaatgctgccctatgtaagagcaaggtctaggatcgattcccctccacgacactatattctgctgtttttttccttgttgcccgcatgaatcttggagcggatataagggcatcaccaatgtttactacctactttgagaataagggtgcgccctgcgtcagtgggtattagttgttgttgtagttacaatggtgaaataaaaaaagttggtagtaagctggaccccacaaccattagccatgagagagggatgagagaaatcatttgtttattgcttatggctaggtaataagcatattaccatttattacttactatttcacaatgtatataatctggtagtagtagtattttatttcttactacccactttatatgcacattgtggatgccctaagggctgaaaatttgacagaagaaaactgtcgcaagttttctatcaattccgtaacacaatatatgacgtacatccatccactcaacccattctaccgtattaagccaatgataaggttgcgaagaaaataactcaaacatgcaagtttgcccttttgcttcattcaaaatctgttgggaaattcccttatctgggaaagaatcccaaatgtgtcgcctctatctcgcctcctctcactcccttttgtgcgcagacaggtaaccgcccccaccaccttcccttcccccatcgcacgcaacgccacgtcagcaataatccgcggtgtcgctgactcgtggggcccacctcctcctcaccccccgcgtcggtgtcctttatttacccgcgcgcgcgaaaccggaagcccgaagccgaagccgatcgagccagagaccgacctctcctccgccgcaccgaactccggcgagcccacgtgaacaccaccactctccgacgaccgtgcgtctcgttgcgtttggcttctcttctcgtcgtcgtcgtcgtcgtcgcgtacgtacggtgtggttcttgagggcggacgcgacgacggcggcggcggtgtacgagatg

SEQ ID NO: 30521 - DNA, 1501 bp, Oryza sativa
tcttcaaatctttcttttctgtaaacacataatccacatattcttcttcacatggagtaataaactaaaagtaccaaggctttgttcggcacattgagttaggaattaatccctcgcagacaccaaacagagcgactcattagcacataattaattaagtatttagctattttttgaaaaaatggattattataattttttaaagcaacttttttataaaattgttttataaaagatatatcgtttatcagtttgataaatgtgcacgtgaaaaatgaggatagcgaagtttagaaagcgcacatactagcacagcctaatgggaccacctatacatttgtcgacaaattttctactaaaaatttgacagatgtaattatagtacaatcgtagtgtaattacactgtaacttgtattaagtttcacgtaattttgaatcgttagatctattacaagattcgttccggtgaagaagaaaaaaatcacagcacacacatatgtgaaaagatttgttcctaggacctctattttactgaaataacatgttaccgagatattcttgaaagttacatacaaattacattatagttacagtgtaattacatgtaagttacagtgtaattatactacgattgtactgtaattacatccgacaaatattagggggagaaatttgatgacaaatatctagcaaaatcgcatcctaactactcttgagtaatatgatatgttttccttaagtatttgtaaatcttttgtagaaaagataactagtcaaattttaaagatgaatagtgccaatatcaactatggctgtgtttagaccctgtctagatgggactaaaacttttaagtccctatcacatcggatgtttgaaaattaattataaatattaaacgtagactattaataaaacccatccataatcttggactaattcgcgagacgaatctattgagcctaattaatccatgattagcctatgtgatgctacagtaaacattctctaattatggattaattaggcttaaaaaattgtctcgcgaattaacttttatttatgtaattagttttataattagtctatatttaatactttaaattagtgtctaaatacaaggactaaagttaagtccctggatccaaacaccaccttagttggatccaaagtttggattttggttgaaattgaagatgatgtgattgaaaagttatttgtgtatgataggttgatgtgatgaaaaaggactgaagtttgtatccaaacaaactttggatctaaacacagctatttaaaaacggagacagtacatatattgagtgacagataacagataattgtgagtgacatctgtatagtgatgaacagttaaagccacatttattaagtagcagatgatttttctttttggtcgtatatatgcccttgtagctggtagtagccgcgacggcttcagtggccgagagttgtaacgggcgcgattatccggcgagatgtcg

SEQ ID NO: 30522 - DNA, 1501 bp, Oryza sativa
ttattgggatattttcgtattggcccctctacagtagaaacgtgtacattttgctacctacattaggggtctcatcgtttggctttttttcataataagctaaaacggtttattagagaataaaaatgaatttgttggtaaaatttttatatatgtgttctcggtgacttaaaaaccaatgctgaaaaaaaactacgttgaaaatatctcaaaatcaatatcaaaattaagtttaaaaattcaaattttggctttttctttggctgaataggccatccgatggaagcctaggattagatgatgtgaaagttaacctttgttaattaatttggagcgagttgcgtttcgagccttttatcaccaaactttcactttagagtaagaataaaagtgagctataactatataaatttatgtgaaagtaaaagataaagaaaaaacgagaagtattggatcttgagtaatagctagctatacatttgcttcaagacatttacattaaatatatagttagagaaagagatgatagaaaaaatatagtcaaatctattatacattttagttttagtatgagctaatagctactagtaacagttagctatactattaaactcgctcttaaatcatcctttagccaatctttgtttcgcatttattgtactctggagcacataagtgaatcacccgtacaccgacaatctttcaggcttacgtgtagaccatcatttgtaaggtgagatagtagatgcactaaagatgggattagaagtaaaacttcgataacaaagaggtggaccaaagtgaaatctactaaatctgtttacacgaattttacaggtcttttaaatagaaattagtccatttgctccaatattcctccgtaagatcgtataaaggagggcaaacgtacttgatttagcaaattgtaccggctaacactcgtcctttgactaattattttgttaccttgtacccgtcaacattatttgacgtttggagtattaagattagtactgccttcaacgtcaaatattattgactgaagggagtatataatcccgtatgtgaattctagctgacgtactgatttgagtccaaaaacatgtgtgacctccaacatttccgacagattggcagattgcacatctctacaaataatctgaaaactaaaaaagaatatgaccaacatcttctgaaaagaatggactcgtgaagctctgaaaagcacgaacccgtgaagataatactgttgcaggaaagaacggtaagtacagcttttcagaaatttccagcaacaacccatcaagcagaaccatgatatagatgggcagtgcaactaaaatacaatcgtggttagcatattcaagaactcaggttccgcttccatgtataatatccacatcagcaaaagaaaacttgaaaggcgaggtgtaaacaagtagtaaacatgaattccaactatcaatttcaatcacaataagaaataaaaaaaaatatgagt

SEQ ID NO: 30523 - DNA, 840 bp, Oryza sativa
aaggatagagggcacatgtatcaaatcaaatcaatacaatcggggcaatatggtccatacgaaaatactaagtaaaaaaactaactcaagggtggctgaggcatatataatgatatattctaatttagagaagtataagtagcacctatctagtttcaactttttataatattccctccgtttcaggttataagacgttttgactttggttaaagtcaaactgttttaaatttgactaaatttgtagaaaaaagttgtaatatttttaacccaagacaaatttattatgaaaatatatccaattattgatttgattaaactaatttagtattataaatattactatattttctataaacttattaaaatcagtttgactttgacctgaaacggagggagtagtatattggggattttcagttgggtctgggggccttttaaagtgcattcaattagccctaaaaaattgatatctttactcgtatatatatactcctatcaatccgaaaattccccatttctattcccctgcgcccccacaccgaaaattctctgtcgcgcgcgctccttcctcccgtctcctctcctctcctccgctcctcgcgcgcgccatctcgcggaggggatcctggtgagcatcgcacttcctctctctgattcatctctctctcccgccctcgattttttcgcttgcgttcgttaaccctagcttctcttgtagatctgcaagaagttcttctcttaatttcagagccttaataacagtttgagtttgtttgttcccccgcaaaaaagagtttgggggggttcaattgaagttggatccgccgcccctgcaga

SEQ ID NO: 30524 - DNA, 1501 bp, Oryza sativa
tagagaagtataagtagcacctatctagtttcaactttttataatattccctccgtttcaggttataagacgttttgactttggttaaagtcaaactgttttaaatttgactaaatttgtagaaaaaagttgtaatatttttaacccaagacaaatttattatgaaaatatatccaattattgatttgattaaactaatttagtattataaatattactatattttctataaacttattaaaatcagtttgactttgacctgaaacggagggagtagtatattggggattttcagttgggtctgggggccttttaaagtgcattcaattagccctaaaaaattgatatctttactcgtatatatatactcctatcaatccgaaaattccccatttctattcccctgcgcccccacaccgaaaattctctgtcgcgcgcgctccttcctcccgtctcctctcctctcctccgctcctcgcgcgcgccatctcgcggaggggatcctggtgagcatcgcacttcctctctctgattcatctctctctcccgccctcgattttttcgcttgcgttcgttaaccctagcttctcttgtagatctgcaagaagttcttctcttaatttcagagccttaataacagtttgagtttgtttgttcccccgcaaaaaagagtttgggggggttcaattgaagttggatccgccgcccctgcagatttggtcgcctagcttccttacctatggcggttcaacctgcagagcgcggcgtggaggctccacctctgacgctgtcgatattcgagttcaacagtaaggttgtgtgtgtgtgcgcctccggtgacggtgatgccgcccgccgcctgttgatccggttcaatgctttttgttgatgcgagcgagtatgggaattcttcgtgtctgatattgggtgtgcgcgcgcgccttgctctgcaggtgatgcaggacgagctgcagaagctggcgctcaaggtgaaccaccacgaggagaacatcaggtttctcaagtcggagctcaatgccgtcgaggactcgtgcgctgacctgggcagtgagatcctaatgccctgtgacaccttgcttttgtatatacttttaatttacggattcgtggttatattcgtgtactctagtaatgctatatatcggtaccatgatgcagaataactgcgtagatcattaattaaacactatagtgaataattcgagccttgcgatacctagtttctggtaaataaggcctgttaattattaactatggagcttgtggtcattaatttttagtatgtcagatatattttctgtaaacttgagttttatatgtatgttcaagttggccagatgtggagtcatggatctgtgaagaggatgaatgacccatatgttggcatgaaaatatttatgagaggagggatggggtgtgaaaccaaccatcaccaacttaaatatttaaaacagtgaaaatacctaaatgtagttagtga

SEQ ID NO: 30525 - DNA, 176 bp, Oryza sativa
ctttaaatgcacaagaaacaggatgtagagacgatttgaaaattttagaaccggtactaaagcatctctagtattggtttttaatctaaccgagatatttatgattttaggtaccatgtcaaaagatcagttctctaatactgtgtggcataggttgggccggaatggtggtacga

SEQ ID NO: 30526 - DNA, 1137 bp, Oryza sativa
tctctactcctgggtattaaacggcagtaaaaatgacgatctttagtcccggattcctcctcccggtgttgcgaaccgggagagatggggcattctccactaatgttacgcatggaaggcatggccggctttctggtttaggtaagatcctcaatggcaaactcaaactgtggaaaatcatctcaacccatctccatcatatgttggtaggagcattagttttcccgatgccttccacttccatttctaaatctctactggtgctatgcatatcatatcggttccataaatgttacaaacccttttccttcctcttggatgcatgatcacttcacatactcctatatgcatatcctgtcatatgcaatttattactccatctgtcccaaaatataagcattttagcatagtgtaaagtcaaacatttttaactttgactattaattaaaaaaagatcaattatataaaattgatattactagatttatgattaaacaaactatcataatattcaactctttttatttaaaatattttacttttatagatattgttggtcaaagtaatatctcgaatactgtgttgaagtttaaaaatacttatattttgagacggagggagtagctagcaaagcactactgaattaaatgcagaataaatataactttgtatatgacttttatttgcacatgatgtagtaattagctgaaagggaaaaagagctaagaaaagaataatgcaaaaaggttgatatatcccacagaagaaaaaggttccattccctacccgaactattttggtagtccagtttacatcctaagttattttttggcttatttaaccccaaaactatcaataccagttgacttaattccctaaccttgtgtgttatttctaggatgcagatgtttgtactagtcaaggcacatcacatgggaggaggaatcttggtagtttggggtaaactattttactaccctaattaagttatttagggtagaaaattcaatatttttactatatatatatatcctttaaccacagtgttgttaggaaacgataagcgaacaaacgataaaaaacaatagatcaatcacagaagacacgagatttaacgtgaaaaaccctcccaaaaca

SEQ ID NO: 30527 - DNA, 1501 bp, Oryza sativa
tgaaaggggggtgaatggtaggaaaaaccaaaaacccaaaaacttttagcggaaataaaagttaccctcaaattgaaaatctcgatgtagtcctgtcgccgccgccggtcggacagctcacacgccgccggaacccaaagaaacacaaatcgaagaactctcaaagtagatgacaactttattgcttctctctatttttacaaagtgcaacaacagcactctttacaaaaatctcgactaaactcgaaaccctaactaaactatcaactcaattgttctcaaaagcgataccgggaagcctcacgctccctctctatttataaaaaaaaaaaactccctactcaaagtaggtgtagaactcctattcacaatagaactcaatccctgatattccaaatcttcacaatttctctaacaaatccacagccacatccaatcggactgcctccgtcccggtcgtcgcgatcgcctggccacctgagccgactcggcctgccatctaaccgagccgccgctgctgccaaccatcggcatgcatacatacatgtatcagcatgcatatatgcatacacgtcacgctacagtaccacgagtactgtagcacatatactcatcctccaatttcttaaccaatttcctcctcgaacaccgacgcttgcatgcacacctcgtgaagcccgttgcgaagatcttttccacacgatatccatccaccgtatgctatctcatatccaacttcgtcacccggtatccttgaccgtctggacctcaactcctccctgagtctagtcccgatccccaccgttgaccgaagttgatctccaagaatcctgactctagtcaccttctcacatggtatcctgaccgcactagacctctgttcctccttaaaacatagtcccgttcctcaccattgaccaaggctaacctcaagtcacctgcacacaatcagacaaaacaacagttcctgggcacagatatcacaacctgacccacattagtcgcacgcactcacaccaacatccacacatactctcaaaccaattcattgattaaatcatttacaaaaccaattattcatcacaaatattaatcatgacaataatttcacaactacttcagcatatgacaactaaaaaagtgcatgtaacatatgcagagtaattaattaggcattttgatgttataaatgcataatgcagaaggaaaaatggtgcacaaattactgctagctgtgagagtaataatccatacaacgactatgagcacatcctcaattaactcgctctttttgagaaaaaaaggttggtcgcttaagggtaaaatgttacactggaatagttctataacctcatctcgttccagctgatcttccgtggctgcaaatatatgtgcggtatgtttgtgctttttgtatatatgattatttgtttatagaaaaaatattgcatctttgcatattttttttcgcgatcgtaaaaaagattgcacgtcaatatat

SEQ ID NO: 30528 - DNA, 1501 bp, Oryza sativa
ggcgccgaatcaaggagaggtcttggctgtggcagggaaggaggcgggggagcccaaacagaacctgatccctggaagtacatcggttgtggctgggactccaagggtccggcgactcacatagaaggtgatatactggaggatgaagatgacgtggttgaagtcagtcttgatgcagatgaggcaaacctggtggggcagtggaccgtccttgctcgctactactctttgaagacgccaaatcagaatgctctctttgatgacatgcgtcgagcgtggagattgagggctgacatgaattacaagtctcttagggacaacctgttcattgtttccttcagctctgaaggggattataagtttgttaaggatggaggtccttggttacatcgaggtgatgctcttttggtggcagagtttgatggcctgacaagcccatcgcaagtcccactggaggtggttccaatttgggttagaatctatgatctcccgttggttttgatgacgaaggataggggaatcttatatggcagcaagctgggacatgttcgggaggtggatgtggaagcagatgggcggaacaagcatgatttctttcgtattcgagttgatctccccgttaatcgtgctttaaaaacacacatagctatcaagatcaatgtccaaggcaatgaggaggtttgagctgagatatgagagagtgccgcacttctgttttttctgcggttttatgggccactctgacagagaatgcgagaagaagctcactaatccagaccagccgttcagattctcggcggagctgagatgttctcccttgaaggcctttgagaggaagattaacacagtgaaggctgtgcaaagctctggggtggctaggaaactatcgtttagtggagcgggcagtgctagctccacttcatcgagacataagaaggttgagcaatgggatgaggcagttcctccaaggatggaggcttttgatggttttgaattaaatgagaaggaaggggatgctaatgttgacctgcagcttgccgatcagacccgcaatatgcaggtgtcagggggtggttctcaggatgccgaaggcctcacaaaaggaaggaaaactaaacaagctagaccggcaccttcaggtgatctggtttagtcaacggggaagctgtcgtcgggagagatgatacctgcaatgagggagttactccaacaagcgtcttttggtgaagtctccaccgaggacactactagccttaacaagaggaggtcgcctgattcgggaactaagtaggagggcagagtcaagcaagctgctttggagtacacacaggcaacaggggaaggaaagcagatcattgtgaagccggtctctgcaggaagagcactgaagcgtgtcaggaaggaggcaacgggggatacacagatggaggatatggaagcaaccagctcgggggctgctggtaaactgacgggtcccatggcggggtcctatcaggagcaa

SEQ ID NO: 30529 - DNA, 655 bp, Oryza sativa
actcatcatgttgtcctttgatagaattctgttcgtagaaagtatatgcacgttccttatatttgataccctggaatactctgtttggtttgggctttcttccaaaagccggggtaatatatgatcttttatcgaaaaaaaatgatggagatcacttggcttttttggatgtttatcacttggctcaagcacttccccaaaactatgtcaaaatagtggtgtctgatcacatgttagttgaagtaaactacaatccgttgctagagccaaaaattggggtcaatcgtgatgatgaggaaaagggttaaataatggctgtcaccatggtttttaagaaccagcagatatgtatacacactcaatctgcgcagttttgatagggtaatggggtgaggatagctatattctcagcctctctcagagcatctccaataatgctccaaagttgaagatgatagctaggaatttccgatatttcaaaatagcagatgccgttgtttcctttaccacatgtttgaataaagaaataaaaaaagctcaagaagtatggatatctttcccacgaaaggatatatatatatggaccaaaccatcaagcagtacatatgcaggcacacatatttggggacattcataggcgtattaatggtcttga

SEQ ID NO: 30530 - DNA, 1501 bp, Oryza sativa
ggactcaaggaaggagctatcgatgttcagttttgccaatcctgagggaggtcgtttacagcattcttttggcttatcatccttttgcgtttggcaaattgtgtcgccctggatcttcttccgatccccttcaccaggtcactcctttggccattctttatcatcagcaaggattggacatagctttccaagaaccttttcaatgcacttatgggtgttggtcttttatcgtgcactatctcattatgaatgtaccaaattcgccacaaaatcatcagtatacgcataccatcttctgccgaaactgtatctagcaaggctaacaaccattctgggcctgtctgccaccttaattctgcatatatagctgtcctgtgcaaatgtgcaattaattggtatagatgtccaagcatcagcaagtatatcttgcagtgcaacacggcgacaaaaatgtgcgtccaacgcaaccattgtacaatgaagaagaagtagaggccacagcatgcaagatatatccatttgcaatgccatgaagaagaagaaacagctagctaccgatgctagttaattagcttgcagataagggtttgaccagcactaattaatcaccacctacaggaagtcagaaattaaacaatgatacttacccccaaagcttagcagaaacaacatgttacagctgtttcaagcaccaagaggccaacgcccacctaccttacctagcttgtttttaatcaagaaactgacgatgtcccacgctttgttgcgggatatatattagataataaaaaaaaatgatgaaatgatttggattgaaacattataaaaatgatttaaaaatgatgatttagcatgtgtatatttagttatagaatgaaataaattatatatataattattatatacttacatgttaagcttttctttcttaatgggttagtgtagcatgtaggttttagaagctaataaatattatgcttgcatgctgagctttagatgtttagggtgtattagctttatagtagaaagaatggatacaagctgctcttgagccggccggccggcgcgcatgcatgcatcgatcatcttcgtcgtcaaggcgatcggaacagaccagtagccgtctcttggaattcctttcaacttaattatacagcttacttagaattatatcaaatattaatgcttaaagagtaaagatagtactcaagcaataaggtggtcatattgtgttgaaaaccattatactttcggaatttgttagaactaaatcttcagttatatactgattatatactgatacttgatcttttgctcgagacatcattttcaggtgtcattaatttttattttcatgtattagactgagatagaaattttttacctcaaattaagtattaagtatagtactctctccatcccaaaatataagcattttttgactttgatacggtctccgagatgctactttgaccaataatatatataaaagtaaaatatt

SEQ ID NO: 30531 - DNA, 1501 bp, Oryza sativa
ctttgtcatggtctcccgagtacttttaccaaatctgaagactgtggagggctggaaaataaagtcaggtgcaccgactagatacacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaaccgctttgtaaaatatgatgagtgatatagcaaaatagctataaagaagcttgcatattgtgaataaagaaatttccaaagtattgggcatacgccatgcgcacactgctttaacagatgtacttaagtccctagaagacacatggtttcaccacacctggaaatatatggcatatgtggtataaaatccgagtaaataaactcataaaggatttaccaaccgcctgaaaaatgaccacaatatataatcagcctaagccataatattggtcaataaaaatgcacacttacgtggcaaaaagcaatgatattgtatccaatcaattgcttaaaaacccaaacagcaccatgactatataaaaaagtcagcgggccagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcgtgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaataactgacgcattcggcatggagatgaaatgaccaacatgaagacgaaattgctcatcagaagtaacggaagatgtcagtggtagtaaagatgccgccaatcaaatgtaatgaagttgcataactatggaggtgaagaaaccagtcggcaacagtcaggtcagctagcagtgaagatgtaggcgcccaacaacaacgaaagaacagtcggtggtgacaaaagcaaaccaacgatgaagacgtagacgcgcatcaacggtgatggcgaaatccaccaatta

SEQ ID NO: 30532 - DNA, 1501 bp, Oryza sativa
gacgcaggtggcaggcgggcggatgtgcgaatcgagccgggaactcggtacgtggcgcggccgcgcgcatgtcggtacagtacagtacaactcgtgtagtacatgtgcgctgcacggcgtcacaggattttactggcgatctgacgggcgcaccgtgctgcttggagtttaggcctgggagcttcaggcagctgtaatttttttttcagaatcagaaactctttcaatgatttagtttttcattttaaatatagaaaattatagttatgaaatctataaaatgaatcaaaaagcaagcttttcagagaaaattgctaattaggtgtttttcagaattatctgggtttggagctgagacggaggcaacaacttactgccaattgtagtaattttttcgtccgatgggtacaaaagtggcagtaaactagttcgtcgtccagctcacggatgttcacatgatcccaaacgcgaagatttagaaggcgggctagtgaccgtgagcaataacaaaatcacaccactacgtcgcccttgtttccatggccacaaaggacagcaccagctcacaaaaaagaagctgctttgtaggactttttgggcatcgatcgtgccaattctgctcctgcctgttgagataaactaccatcttcaagggctttttctcctcgacgacaacgagtttaggttcacgaatgtttggatgacatggaatcacgttgcgtgattgcgttgctgttgcgtctgtgtgtgtgcgcgttgcggcgctttccgtcgacgcactcgcaaccaatcgggagcatgtgtgcgcttcgttgaatcggttgtcgttgtgaggtgtctgtactggtgcagtgtactgctgctgctctgtcttccgctgttacacgtttaaagatctttccaaaggtaaaggtaatcaccagatcacaaatgcggattattgcacgtgagccaggtaattcaattacctaatgccatgtttttatgcccttgtcctgtgtatgtcaaatgatgcatatgtttacttgtggaccatgatagatactttttctggataatttgaaccgatgaaagatactatcctgattcctgaatacacctgtacgtataaaaattaagatacttctagtagtatataacaagatggcagcaacagatacgctgaacccataactcaccaatcaattctctgcaccagaaatcatcaactattcatcaggttttaaaaatgtcaaagaagaaaaaaaatacaatttctgtcaggcctcagcactcatcagtgagcacttatagcacacagcaacacatcagcatccatttctccagttgatcctctcccccatgccaagtgctaacaccggagccatctctctgaatctcacctgcttccatgtctcaccctatataaaccacccctactctctacccggctactcaagcaccaaccaaaaccaaagcagagaagaggcaagaacaactagctgcatggcaatggcgggag

SEQ ID NO: 30533 - DNA, 217 bp, Oryza sativa
cctttctagcctagctatcctaccgatagttgttgtccttgaacagtcttagccttaggtagattacatacgttccctgagttcactatccttttgtggtcacccaaaggtgaagtgctatagcggtattgttgatgtttggtatcacgactacggtattttgcatagtatggggatcgttggtaccaggttatatgcgagattgaagtaaaagaaa

SEQ ID NO: 30534 - DNA, 1501 bp, Oryza sativa
tggcaaactcatgcatgtacaacttcacgaccacgccaaaagtgttcccatcgtccagatagctttcgactttcaaggaagcttgcagaatgtaagatgctgaacgctcataaaaggatgatctggcttttgacattctcgcagaatagtatactatttgggggataagttcaagaacgtccttttcccccaaattccaaaaggcaaacaaaatgcttggattgagctttactccaagctaaccacagatggatctgcagctagctagcatcgatcatcaatcaatcaagcagctggggctagcttagcttggtagtgcatgcattcatcaccatgtgggccttcagggagatatcgccaaaaaccccttcaggtcccatgcatactagtggccttgtgggggcatccacagcttcgtgtagtgcagcaattcgatcgtatcgtcgtggagcactgatgctaagttgctaacaagttacaggctaacagctgaattctcctgcagtgttggtaggacttgctgtttcttctctctgcaagctggccgtgcttaacaactagcacactcgtcaacgcacacaaaaatgtttttcatattttgatcgatcgtggtacagccggcgatcagttattcagactggtgatcagttatcactaattcaccatccaaagcatatgagcctctgaaaatggagtgttgcagcgattatattctcgtcgttgtctttcagaggaaacaaaaatctctcaccatgcatggctcctacaagctagctagcttcgtgatctagtaactggatatggtaggtggcaagaaaacaaaagaatctagcgattcatcatctactcatcatgccaagactgatccctttcaccttttccattaaacccttaattatggtgttcgagaccgggtcaaaaataaattaacatcctgcagatcacggcttgatcagccgccacttggacgcgaggatcgtactaacctcgtcgcgcactaacgcgaaagcggctttgcgacatgtgagatctcccccaatgtggcgagacgccattggcctgaccgtcctgtaagcctgaaacagccactcttttttgctccctgtgcttcacagctaatccctagcccagcgtcgatcgagcaagcaagaaacgcgtatcccgatttgtccccaatgttttcaccaactcccgcccgtttttataccctcgcaatcctccgtttcggtcgagtttagtacacatcttcctctaatataagccagtttgtttttttttacgatccgtactagacggtgcgaaattctattggtagagcaggccagtgtacgtataagtacgtgcatgttgatgagctgatcgagtgatcgatcagtgtggcagtgtggtgagcaatgtgagaggcacgtaggtgtggattggtgtgttgggttgtggcatggagcaacgggcggcggcggcggcgcagcagcggcaggggaggaggcagagcgcggcggcg

SEQ ID NO: 30535 - DNA, 1501 bp, Oryza sativa
ccacctctgcaccatccccatcaataccagctggttttttagtcaaaacaccaggtttggaactggtcccagcactgaaatctatttgcctgggagcttgaggctgcaactgttgctgactcactagttgctgtggctttactagctgatgtgatttctggagctgtggtagtttctgaagtggtggtgctttctgaagctgaaactgtgttgcagtagagctgtcaactcctccattgttgcgcggtgtggcttcattgctcacaatcaatataccgttgccaaacttctgctgatgagaattcaggccccgagcctgactccaagtgaaattctgcaaacctctttggacattggggagcaatgagctcccaccaccagtcctttgttcccacgacctttcatctgcctctgacacgccagttcctgggcctgctgaaggccggccaaggttaaggtccttcccaaaaatctttgccaaacctggtgacttatctgtagggccactcccctcgtgtctctgaactccagctttattgccaattgccccagcaaacacagatcttatggtctggagagtgtcagaactctccgctacctgttgcatcgaacccagttcaagtacaccggtctcaaatggaactagcacaatagttctaaatcctgcagcatttgcaaggtatccccggtaacagtaattggcaggaaatacgttacgttcagtgttgggaatccacaggggcacgcctgctgcaaatacttgaccagggccaccagcacggcgtggaaatgcaaagtacatagatgctagaaaaaacatctctgtgtctgtcacctgatcaatgcctggggcataatcctcctcgtcaacacctccgaatgctgagtgcaatcgctgcagcacacgcttgcgcatcctctgtttggcctcgtcactacctgcagaagcagcaggtcccatctcaccatcatgaggctcacggcaagagccatccccccatccaaggacaaggtcaccggactttgtgcgcgacagctgccagaatatggcatagttccaaccagcaccaggacgatctgattcgacaagctcctggagtctattttgcaagtccactggcaaagatgcagcaacaaggccctcggatatggcaccacctccttttgtcaagtaagcaaaagcatccgttccaagcacactggcggtgagcgctcggtcctcgtcagtccatgtcccaccagttccgccattggcaccatcctcatcagcctccatcttcatcaccataatacctactcaagatagtatatatatcaggccaaatatagcactaaaaatgcgtaatactcacaagaattgactggctggacgccacaagcacagttttagacaaatacacaagcaacaaaatatcatttggacttatgaataatcgggtgctgaactcagaataacaggaacaaaactctcagttatcatccagctaaaaacacactgtga

SEQ ID NO: 30536 - DNA, 359 bp, Oryza sativa
cgcttgtcaatggcattttatggattatctctttaaaaaaaactataaaactacttaaaaatcatgttaatatatgtttaaaatttaaaataattaatacttaattaataatgactaatatctcacctcttacgtgtcttttcaattttctcgttttcattcctctcacacacactaagaaaataagaaccgacaaaaacctgatatggaaatggatgagagtcacctccccaaaaggtcactagattgaaagaacacagatcacagatgtgcctactggcccatgtagcccagcttccccgagtaacatgccgaagtataaacaccaactcacttgagatacaaacaaaaacacagaa

SEQ ID NO: 30537 - DNA, 1501 bp, Oryza sativa
ctgtgacgacgtactaaaaccaaatggaaatgtcaagtgcaataattagggactatacagtacggagacacgcatacggcttccaaaaaacttccaaactcttaagtcagagagctgacaaatttgccttcgggacccattgatcactagtgagcattaaatttcatttctataacaatagtatcttgtaattttttcaattgatccctcaagtactcctccactactaactacttactaaggtgcattagacaatcgcgacaaaacattcctttaatcaactttccctttctttctcaacatagttaatgttatcaagttcgaatgctaaaactaccaatgatgcatctttactggaaaaatttagataaaactctagaataaaaggtgacctgatgggtctgctgacgttgatctgttacatgaacataaacttatccaattatctcagttcaatgtcagcaattaagtgacacatgacccaatcattttcatcaaccgatctaccaccactactactaccaccttcgcaataacggcaatgacaccccggctagatcgatcggacggcgggcgacaacttggtggtgcacatagggcgcaacagtcgccgtccgatctgatatataggtaaccagtgtcaaaacttttggctaaagtagcagtagtagtagatcatggccaatggggccaattgccaaccaatctgatgattctgtactttggtagtcttggctccttctatatttttaagagagagatgaaatggatgtttcgcggctattctgtgagttctaaaattcaatgagggggaggggggattctacacgattgagatagagatgggaaatggatgtttagcatctattcctttgagttctagaagcatgtatttttgaactgatgtttaggattaacttttctttatcttacaaatgtactatgagccttcattggcttgaatgttgtatcataaagtacaaaccatgaactcagcgtactatcatcaatcaataatgaacctggctgatttctcagcttgccaataacccattgaattattgagaatggttgaatatagtgtttcgtcaacaaatacgctgtcctagttaggcttgcctaaattctctacattttctagccatcctatcctggttgtctgccctatgaaaccactctctacagtattggattcttcacaagaacaggcttgggtcaagaacagactcgatagaaatcataattttcaagtcaaaaaagaatagtaaaattcataaaaccacatattctctagcagaactactacgcaactacagatttaacataaatttatcatgcaattacatatttttatagaggaatatgacaaatttgccaattatgacaaaacaacataagttagagtttagattctttaacactatggttttgctgaacctaataaacaatataggtttgtgataaatttttttattaaatatgtagttttacagtactatgt

SEQ ID NO: 30538 - DNA, 1501 bp, Oryza sativa
aaggatggagtattgagttaatcaacgtatctagttccggctttggaatatgattttgctttatggttcagatggttaccagagacacctttatccaatgactatgaacctttttttttgagagagagaaaaggactatgaactactctctccgtattttaatgtatgacaccgttgactttttaataaacgtttgaccactcgtcttatttaaaaattttatacaaatataaaaatacttatgtcaatgcttaaagaacatttgatataaatcaagtctcaataaaataaattataattacataaattttttgaataagacaaaaagtcaaacgttggtcaaaaagtcaacggcgtcatacattaaaatgcggagggagtatttgagatgttccacaagtacgtagtattatagccaattatcccatcgtttaccttttgagcttttagcttatgtaagttgtagccaaaatttaaattctaaaaattttgggatttttcaacatagtttattttccaacgtttgtgtttagattgctaaacactcacacatatatacaagttttatttacaaattattctttaattatcgatagtttgttacaaacaatttcaacgtagtttattttttccgacatttgtgtttagattgctaaacacacatgtatatataagttttatttacaaattattctttgattattgataagtcgttacaaacaacttgtaatcattgtaagcgaaacaataacagtacaagacaacatcatatcttgtaagcccttccaaaaaatacattgggtgtttggttgtttgtgccactataggctctagcttagtccatacttctttcatcctaaaaggaaaatccaattctagcaatgattctaaacatatacatgtacggattgtgatcctttaacttaaatcacatgactttcagttattgacatatggaccctctttgttacgtgctcacatgttagtgagcctaaagtcactgtaaatatttacaatagatgatctcaatatatagaaatatagaatagtcaggattagattttctttggaatgcagggtgtacgattcttcggttttcaccgtgatttggctgattagatgcaatttagtcctgccactgtggctaagattgatatcctgtttggtcaaatgcacgctctttttttttttttggcttaaccactaccactgatttttcgagaacgagaggaattcaaatatgaaatgaaatctaattccagtggcgcagaggtgcagaagcaaaactcgccaaggagagcattgacgttaacccggcatgagccgtgcagctctcacttgatcatcttatcgctactcagccactcaaaaaccatccttaatttgcctttccctccacaacttgaacacaagagagagagagagagagagagagagtgagagtgagacgccatcactagctctcacttagctccaagctgagctgagctgagcttagcca

SEQ ID NO: 30539 - DNA, 1501 bp, Oryza sativa
tttatgagattgtcagaagcaagaagcagaggccttgggctttaataaattggtcatgatctgtgcccatcgtcgttaccaggagttgttttacgatacacggtacaagtgacaaggggcactggtgtgagtaaaatccaaccattcatttgcgtgggcatttctttaaatggtatattaattgtaaaatttacccacctttccactgaaggtaattaagttaatagtttctttctctacagctacagtactgaacccttagcgcatcattactgcaaaaccctcataggtgtccgttcatttaaaaccggcacatatgaacctttccctacctccacaggatgaaaaaagttacagaaacgtcacctttgggtaactatatatgctggttgtagaggaaaatcaacacaaatactatatgtgtcggttttttttagaaaaacttgtacctataatttataggtaccggttaactaaaagccacccagagagggcgacgaataggatgacgtcagatgttggtggcgcctaatcaattttcaacaaaaatatttagattttgggtagacatggcagtaataaatataagtttctaataagatagagtagatcctataaggagtggagaaattgttttcacttggaaaatcacttcctaaatcctaagatcacaaatctatcaagtattgcttgctacatacctcgggtattccattgtctctctctccatgcagggtacctttcacacgtttgccattgtcgtcgtattcaaacaacatcgagctgacacaccaggaagaccctatactcattcggcgtactccggtgtaactgccagcactggcaccatggcctccttcatcccaagcatggcctccagttccaccccacggccctatcttcacacgctgaagtgtcaagaccattaatacgcctatgaatgtccccaaatatgtgtgcctgcatatgtactgcttgatggtttggtccatatatatatatcctttcgtgggaaagatatccatacttcttgagctttttttatttctttattcaaacatgtggtaaaggaaacaacggcatctgctattttgaaatatcggaaattcctagctatcatcttcaactttggagcattattggagatgctctgagagaggctgagaatatagctatcctcaccccattaccctatcaaaactgcgcagattgagtgtgtatacatatctgctggttcttaaaaaccatggtgacagccattatttaacccttttcctcatcatcacgattgaccccaatttttggctctagcaacggattgtagtttacttcaactaacatgtgatcagacaccactattttgacatagttttggggaagtgcttgagccaagtgataaacatccaaaaaagccaagtgatctccatcattttttttcgataaaagatcatatattaccccggcttttggaagaaagcccaaaccaaacagagtattccag

SEQ ID NO: 30540 - DNA, 1501 bp, Oryza sativa
aactgatgagcaatgacaagctaactgcctgatttgtccccaacttgtacagagcctgtgttgacgaatgcgaaaagacgggttccctccgagagacctccgtgaggcactgccaagttccaactgatgaccatcctgctgataaatcatggtacgcacatgaaccattgtacttgcagtggaaagaatggaactgcaagagtgaatgcagataccactgtatgatggagagggaaagtgaaagggagcaacttggattagggtcagttaagtatcatggcaaatggcctatgaagcgtgcatctgtgtttcaggtaatcaatcaatcatgtactaattaattgcttagcttttttataaacttgatctgtctaggcattcctttttcagttctaccttgtgtccttcacctatcactaattgcttttttttttcccttcttgcaggagcctatttctgctgctctttccgcgctctctctccttgtacaatttaatgggtggctatcttttttcctcctgctttcttacaagctgcctcttaggcctgaaactcaaatgacatactatgaatacactggcctatggcacatttatggtcttctggccatgaatgcatggttttggcgtgccatctatcacagttggtaagcccaatacattgatgaaaagtatgattccagtatatgtgtttgatcataattagttgaacttgattcttccattgcttgcagtgatacagtttggacagaaaagttgtattattcatcatttgctgcttttattgggtactcccttatcttggcaatattgcgaactctaaatctgaaggatgaagcttccagagtgatggtggcagctccaattctggcattcacaacaactcatattttgtatctcaatttctatgaacttgataaaggtaaattttagctggacatgatattgaacttttgaaaccattttacttattataggtttttcatgatgaatgcatcattcctgagtcatgacttcctgcagataattgaaatactgtcttgccaatcgatctgtatattttgtagtagtgactagtattgcttgtaaaacttaagcagtagtgaagttctgagtaggtatcatgttgctctatttaaacctgttactgtactaatgtcgaacctgcactctacatttctacactcagattatgtaataaactattgaggatctacctaactgttagaaaatatttgtgtgtcaatatttcagtaggtatgtgttaaaatgatattgcgtaaccttttagaaagtttacatctatgtatgctgatggttccttttttttttcttttcttttgcaggcctaaacacaaaggtttgcactgctgctagccttgctcagttcctcctatgggcagtatgggctgtcatgacaaaacatccttcatgttttaagatcttgtttgtcattattggaaacgtattctcaatagtcttggaaacctatgacataccac

SEQ ID NO: 30541 - DNA, 1501 bp, Oryza sativa
gtcattgcacaagatttgatggcattggagtctcagactctcagtggtggctctgacagacatttgggaaacagctcaacacaggttcagcatatgggtgtagtttgtacagttcaattgatgttcagatgattggaatgcactgttgaaaacaaaatgtccaacgccacaacgtccaagaagagtacgagagatgtgagtgaaaaatcagcaaagctccataggctaagatgaggatgatggaagcaatcaatcacatgaactaacaaattcaaaattatgaagtctatcaagaccaactgggattcatttttccaaagatgtttcagatattaacaggaggtaacagttgccgctgagtacctgttccctttgcctctacttcttggcagacatctcacttcccaaatttctattgcatcatgcataaggtgaaactgcagcataaatagtatccatgcatcctgacaaaaaacaaagggggcaatgggttcatcagaaaattcaatataacaacttatcactggcaaaaacaagacacccagtttccattctgcagaaatgtttgcataattctcatcatagagagaccaatagaaatgaaaagagagagaaatttcgtgaagtagagaagcttcgttgttagcctacttaccgggccttaccggccaatgcagctgaatcccctgcacacgggcgagccaggcaacgaagaggacgcggcggcgacctcgccggcgaacgggagtcggcagggggagcgccagcctccgcatctccgtctcacatcctggcctcggggaagcatcgcatcgccatgccatcgccgctgacggaggaaaaaagcagctggtggtgggacgccgggagctgcgggcgcgagcagcactgcggtgcgcccgcgccgccgcggtgtgcccgacatgccggtggtgtgcggccgcgagattcgggtggccctcgccggcgccgccgtcggggcctcgggcggccctgtgcctgtgaatgagtaggtgggccaaattcattttgtgggcccaattcattggtgagatatcgataggccaaattcagttgtgggccgaatttaccgacgagtgttaagtgggccaaattctggggtgggttgaatacgtcgacgagatagcatggcccaaattgatctgtggtctcaaattgttgaggggatttacttgggctgaattcctttgtggcctaaaaccgtttgatgggaatggaatatgatcacttgactccctcaactgaccaccgaatctaaatcgtatccctcaaccgcaataccagaaatcttgacccccgaacttacaaaaccggtgcaatttgactccctcggtggttttggagagtggtttcgctgacgtggcgcacacgtggcagtgttgacctagtctttgtaccacgtggcattgccgtggcgctgatgtggaattaaaataaaaaaaatatgcgggcccatttgtcattcacaaaaaaaaaatta

SEQ ID NO: 30542 - DNA, 1003 bp, Oryza sativa
atatatatatatatatatatatatgttacttcgcatttatcctaatacatctttttgtatcttgcagaaaagacgtgttgtcggagtcgtccgtcaagcctgagtggaagagctagccctagaaggaattggagtaggcaagtgacataataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacatgactattttagtcttagcatgtaatattatttaagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgagttttaatacaagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtatggttctaatgtacgacatttacacttagcatacatgacttagattgttaaaacataaatgtctcgtgacttagcagatgtttcttgtatcaacaga

SEQ ID NO: 30543 - DNA, 1501 bp, Oryza sativa
cgccggcagccgggagacggaccatcggaggggagcgagatcgagtccgaatctggggattcgctatcccgagatccccgctgcttagttcgtttctgacgaaaaaaagaggacgaaatttcgcgacgaattcgtcagatattttccgtagttaacactcaatgaagattttttttttttcgtttttgggttttgcgtgaactaatcgatttttttttcttttttgctgctcctcagctcctggtcgtcgtcatcgctgcgctcaggagaaaaatggaatgtacacgtggggccgtagatgctgggttgttggtgacacactgacagttggggcacacacgtctgggccagggttgtcagtgagagtgttcatcattaagctcctgtacaccaagggttggtttggtttgaggtctaaattagacttatcaatatttgacaatttcaatagtgttagtgtctatttggtttgaacccgaaatttgacatgcctaagaaaataggccatttcaatagtaaacttagcatattttggcttcaatccaaacacaactttgccttaccaaaattaatcatgccaaaacttgtcaaaatttggcactgacaaaatttggtaatgcctatttaagccataaaccaaaccaaccctgaatactctttgtatagacttagacttataaatcggtttattatgaaccgaaaagtcatctaaacagataaacagcattttcttatttaaagccataaatcatttttatattactttctaaaagttactttctctatcccatgtaaaatccaaccctaacatcccaatgcaacagtagtaaagagtgaagatgatcaaaataccccacatcattaaaataggtaaatggtatcgaagtaataaagcattgctaagggtaggtagtatggtagaagttggttttttgtgggacaaaattcaaactccataagttaagttttcttttggtacggagggagtagtagtttgaaaaaaaatagcgtaagatagtcaaatatagagatgtcattccacatggttttaaattcgtcggcttataaatcatattccctttatcccaaaatataagaagttttggttggatgagacacatcatagtacagcacgatgaatctggacatgcgttcgtccagattcgtcatactaggatgtgtctcatctaaccgaaagttcttatattttgggacggaggaagtagtaaacttaaaaaaaaaactactccctccatcctaggtgttcacattttgagattttatcttcaaaatattttgtgtatagtatgaattgaattttacttgctaaaaattatatcattgaattgatatttaaatttactttcatatggttataattttattactataatccttattataatatatgagaaattataagacaaaaattagtattagtgaccgtgttaagtttgaccatgcattttttatgggttatattatgggatagaggtagtaa

SEQ ID NO: 30544 - DNA, 1501 bp, Oryza sativa
attcctcagaaaatccggaggatttcggacgatgcgcgggggaagaagaagcgcccagcgtgcgtgcgtgcgcgcgagcttcgggggggagaagcgcctggactcgtggcctctggatacttcgttttatttttttttctttttgtcttctttttcatcggctaattcgcaaccacatcctatgaattatggggtatattttgctagatgcacaccatattatatccctggatctttaaagagtgcaaaaaatgggtctaagaaaagctctctttggtttatggctcaaattttggctttgcaattttggagaatggcaacggtcagctatccgtctaccactagtatcctatcgaattttggtaactctaaaaacttctcttaaaacaagaagagatttgacaaggcttactccaattatctctatatttttggcttaccgaaatttggttatactaaaatttggtaccgtttatttttagcaaggaaccaaataaattttttgctcaaattgcaaatatttaggcccaatttaggcttgagctagatcacattgtttttattagcatagaaacaatcaagaaactatatattttctatccgtatgagggaacttcctcagtaatattgaattggtgatgttacatcaataggaccatatcaaaagtataataataaattgaacagttagctctagtccaaattcatataattaataatcattgtagtagctagtttgtacaaatagtcgtgttataattttctctagccccagaactatatatgcttcatagccgacaagaactcacgaattattgtgttttgtttggctacaaagctgctaccagttgcacacacataatattgtattgatgtagatctctatagcttgttgggtcatttagagcatatatattaggtggttatgagcgtaaacatatcttgatggttatgagcataaacctatcttatttcaaatgtgtgggtatacatatgtgcacatatatgttacgcgtagattgtgtgcatccaaataaagtttctctttgaagaatacaccgctaggttgttagatttttcttaacataattaatatcacttcaagttttctttgaagtaaagaaattctaaaaaaaaactttaaagaatcctctaaaattttcacaaacttctacgttctaagcctctagtaggttaagctacaactaataaacgataaaaaaataagtgaaaagggtcaaagataatttatgggtaagcctaattttgactaggatgaaaaatcctaaaatcaagtccaaattaattttttcagatttaaattttaacttcgtggatgtttgacatagctccagcctccagatccaatatttcttgaagctgtgtattcctaactccacaaatccatcgagctggatctgtaatcatatgaataatattttaaattaatcattttatttctattttaaatgaaatataaaattttaaaccactgtagaat

SEQ ID NO: 30545 - DNA, 1447 bp, Oryza sativa
taagagggaaaaaaggaaaaaaaaaaagaaaaacgtccacgccgccgcctgccgcccggcggccaccgcggcccctccgtgtccgcgccgccgcttgccgcccggtggccaccacggcccctttgcgtccgtgccgccgcctgccgaccaacggccgccgcggcccctcctcgtccgcaccgccgcctgctgcccggtggatgccgcgccccttcacgtccgcgccactgcctgccacccgacggctgctgcggcccctctgcgtccgcgccgccgccgcccgccactaagcgctagttcaccactcctcagccgctcactcgcttgccactagaagaagaacacgacttagtagctaggataaagaaaagaaaatagagaggacaagaaaagagaggagaagggaagagtagttgctagagaataagtgcaaaggattatatactatgcgccaatttttagtcccggttggtgtttccaaccgggaataaaaagagtaggggacgaccactttttcatccaggactaaaaagatctttagccgcggttggtgttaccaaccgagactaaagattataaaagggcttgtaagatcaaacagaaaaaactaagccaaccagagggggtgaatgattggagtacccaaaaaccaaaacttttagcgaaattaaaagttatcctcaattcgattcagatcggtctgaccgaggttgatctaccggtctgaccgcgcctttgccatcggaatgaccaatatagattgcccggtctaatcgtcccgaagtcgccttgcctcctaacgccaccgccggtctgaccgccggtatctcgccggttagaccgccaagcccgagcaaatacaatttaaagaactctcagagtagatgacaacattattacttctctatgtgtttagaaagtgcaacaacagcacaccacatggaaactcgactaaactcaaaaccgtaactaaactcacaactcaatgctctaaaaaatgatacagggaggccacaccttccctctctatttatacatgaggtaggcagcctaaagccacgaatcaaactcgtacaagaagtcctaatccacctaggaaaccttcccgtacaagaaaccaactttacatactccaatcataccaaatttggactccttccaaattcgactccgcatcccatacgcacacacaatatctccatcatatgccatatggaatcttcaccaaccacgtgcattgatctttagccaatgtatcccgcatgctatctgatcgtctggacgtcgtcttatctccaagtcgactcccgatcattcaccggcaatactctcccgaggcatcaagacacctacacatgaatcaaacaaagaaatcatattctaagactaagatatctccaacttgactcatttttagcaaacaacaagtattagcatagcaaaagca

SEQ ID NO: 30546 - DNA, 235 bp, Oryza sativa
attcactgaatgtataatttctagaatttgtcattcattgtatggatctgagatgtataatctgtgatgtatttgatttgtgtataattacttataggatttgtgatgtatttgatttgtgtgtataacttaggatttgtgatgttaatgatttggggtttgatttggggatacgcatcctactcaatttgggagaaaatacaaggattaactctagccaatagcaaattaacaa

SEQ ID NO: 30547 - DNA, 304 bp, Oryza sativa
cccggttggtaactccaaccggaactaaagataaatctttactcccggttggtactatcaaccgggactaaagatcctcggccgctgacaggcttctgacagggatgaaccaggactaaagatgatttttagtcccggttggtaactccaaccaggactaaagatgattttttttttaactgggacaaaaatattctctagtcccggttctaaagaaccaggactattatggaaatcgttcgactctccaaagatcacttattctccagtagtgtgccttccactgcattttctaatttttagg

SEQ ID NO: 30548 - DNA, 1501 bp, Oryza sativa
atcagacatgattacatggattggaagcctcacatgtcaatcaaaactacctacaattgagcctaaccaaggtataacatgtagggggggggggcaccaggcaacctcccagccgaaggagaggccgagaggtgggccaaaaggttggccgaactataaggtcgcccgaacggaccttggctcctctcaccatctgcttccacgtgtatgctcttgatgactccccaatggcggttatgaaggtttcatcggcagttatcaccgatgtaaagcattgtaattatgagctacaaaaggaaaaggtcttcgcactctcaaattgcacaacaaagtagagtacaactcactttcatatcatggtagctactttagtatgtgggattaggaagagagtgagagaaagctccggaaggtgtgtcccaaatatcggagttttctccgagaattcttccatcagagtgccggagaagcgcatgagttgctggctttcttctctcgcttgtacctcggtggatgcttcttttaaaaagtaagtattcaagtttccttatggtatttaattagtttatttaagtgagatatattctcatcggtgcgggatcgtcgcttagtatttatacttaatgctctagtactaagactctggataaacaagatagttcttggcgaggctagagtagtaatcgataacgtaggtgtggtgtctaggttagaggttaccttcgtttgttgtgtgctacacggaaagtagggtagacgacaggtggtgataaccctgcccgtcctttgtatcccttcatattcgggtacattataaagctcaaggctggactcaacctggcagactaagggagggctggttcctgatgcattcgataaagttttgcctttaatttaagttagctaaatacgtccataggaatcctctctagcctatcactcatcatgttgtcctttgatagaattctgttcgtaaaagtatatgcacgttccttatatttataccctggaatactctgtttggtttgggctttcttccaaaagccggggtaatatatgatcttttatcgaaaaaaaatgatggagatcacttggcttttttggatgtttatcacttggctcaagcacttccccaaaactatgtcaaaatagtggtgtctgatcacatgttagttgaagtaaactacaatccgttgctagagccaaaaattggggtcaatcgtgatgatgaggaaaagggttaaataatggctgtcaccatggtttttaagaaccagcagatatgtatacacactcaatctgcgcagttttgatagggtaatggggtgaggatagctatattctcagcctctctcagagcatctccaataatgctccaaagttgaagatgatagctaggaatttccgatatttcaaaatagcagatgccgttgtttcctttaccacatgtttgaataaagaaataaaaaaagctcaagaagtatggatatctttcccacga

SEQ ID NO: 30549 - DNA, 1501 bp, Oryza sativa
aagaattggaatcgaattaccagcctgatccattgtatgaaccacgatatgttatgatgttgttactgctacagcaaagcaagattatagggagtgcgagacacgtcggcctcgggcgctccggagaccagtgacggcctgaatggtttgtggagcaccatcgtcggcgagtcgcgggtgagggagagccgacggcggggcagatgccactggtggtcgcagggaggcagagaggccgacggcgctccgctgtttttgtggatcaggattcaggagcaggtggggaccgcgataatagggaggatatacgcagggcaaccgtcagtggtggagaagcagcagcggacgacgtcgtctcgactcgggatcggcagcgcccgcgcccgtgctgacgcctgcaacgacgacgatgcatggtgcttgaggcggtggattgaacggcgcggtgtcaatctggctgcgaagggggcgaggaggcgacgccgtctcgactggggagggaggcggtgtggtggatgcaggcgagcaggggcgacggggcggctgcgacgatggggaggcggtgcggcatggaggagaaagggattgggagtgccggggaggacggcagcgacggtggggaaggaggaaagggggagagaacggatcgggcatgcgggcggttgagggggttgcggtggcgtggatcagggggttgagggtaggggagaggagagagcgatcgagattcgagggagacgcgtgcgctggatgcgtaggaagagaaaggcgatctgagccgttcgattaggcgatccgactttctatatttcgcgtatctgtcaaggttggagtcaccgtcaccactacggaacttttaagtagcagagatatatcatcttgataaatggatctagacttgttgacgcgaaaaacatacactggcctgggagatctgcttagctccagtgcagaaccaaaggttagtgagatgcgggcgtgccaatcagtttgaccctgcaactgacaagatatacaaataatagatcaatgagccgatcggctgacaagccgatggagtagttccagccgatgccgataatagccaataacgattggatttaagcaatcggctatatgtccaatatagataatgatataaaggcaatcggctgatgatgatgtaataaaataacaatataatctagtataaaccaatcggctagcaatacaatatgatagaataagcattgatccgaaggttaaagcatacatcggctggaggtccgatgtcatagaatccaaacgattagataaacagtgaaacctttgttgtaatcggctaaatccaacttgtatgtaatccttataagccgatgcaacgtccagataacttatcggctagcaccccgataaaacactagcgtgaacctatcggctcaacaagatttatattatcaacaacaatctagtaggtcgaacctaaccgatacagcacgagattgtatatgataatctaatg

SEQ ID NO: 30550 - DNA, 916 bp, Oryza sativa
cgtagtcgtgataccaaacatcaacgatacggctatagcacttcacctttgggtgcccacaaaaggatgggttttttggggaaaaaaaaaaactttttttaccaaagggggggggggaaaaaccggtaatgtaatctacctaaggctaagactgttcaaggacaacaactatcggtaggatagctaggctagaaaggattttctatatgttttcactatctaagctaagtaaatgtaattttctaactgctgcttcgggcaccgatccctgctggtctgccagcgtggttccggctatagctgtatgatgtatccgaacatggaggattactaggacgggattctgggatatcatcacctgtcgtctacctctaacaaatccgtgggatacacaaaaaacaaatataatctctaacctagacaccacgtctaagttattaattactactctaatacttgcgcaggaatttcctcctttatctagagccctagtactagagcacttagtacaaatactaaacaataaacccgcaaagatgaaaatttatctcacttagactaagtaattaaataacaaaagaaaggatcctgaatgcttacttgatagaagaagtttctctgaaaccggagtagagtgcaccgacagctccggtactcctcaagaattcctcctagaaatctacactcgccgaggtagaagtcgaagagagcgccaaacttccgggcactcctccagagattccctaactctctacctattttctaatgtacaaaagatacaatagaatctcttataattcagctcaaagttgtgtgtattggaatgagagcctctcatcttttataggctccaaatgacggttatgaccatgggaaatgaccaaaataccctccaaccatcattggggagtaatca

SEQ ID NO: 30551 - DNA, 1501 bp, Oryza sativa
cacgcacaccagcacacagccttttcttctcctcttcctcctcctccagttaacggttaaggcgttggtgttggtgcctcctctccaccaccgtccatcccactcccacgcgcacacagcaaagcaaaccaaagcaaagcttcgtttccgctgccccccacaggccactggacgaggaagagcacgcagcttcgcctctaccggcggcgcatggcataggcatccccaagaatgagagcttgggcctccactacaagagagagaggcagacccaccaccatcaacaacatcaggaggagtagatagatgggcaactgcgggacgcgagaggagaatgccgtcgtcgcggcgcacgcccaaggtattcttcgcttcctcggattgatttcttgggggatttcccggtgattgttttcttaaggatgctggttgttgggatgggatctcgggttggatgatctgaatttcatcaaaaaatttgatcttggtggttatttctaggtttcccctgatctcttggttggtgggttcagtggggaattgacaaaagcactgtctttcctttttgctatatatgatggcctatggcttattgggacctttggatgggtgttttggttgcaaatgttgattcttgttaggtctattccaaatcggcattttggtactttcggtttaggtttgattaaaatctaatatcaacatttgctccaaatgttcaacattgtctttctgttagttgcatatggggattctgggattttggtttacagtctacatttgctcaacatccatctttctttctttctttttctcttttttttttgttttttttgggggggggggagcctaatctccttaagctttctggtgtgattgctctatgatttcttttctgctgcatatcccggccaagttacgatcttactgtctttccttatcttcttggttgctgtatcagaaattctgcttcattgtgttcatcgggacaatttacaggcacttcccccaatagtgctgcaatttctgtgctctctgcttcactgaggcactgttgactttcagtttaacagaaatagagttatgatcctgcaagttggaaaaacataatcacttcttgcagtttgctgcattctttaagcaatttggagccctttttttattgcatgcaactctgcagtagatctggtctcctgatcctgtttacctcttgctgtaatcaacttgcccatgtatgtacttttttacagtatttttaggtagaataccattttataattgctaggaatcgccaacgctcgtttccagtagttctcttgttagtttgtgattatagcttccctaaatgtatttcagcaggattagctctctttcatccaaccatctctgtgaatgctgaaaattcaatatgaaaaaaaagttttatttttatcttatatgtatgagaatttatggtaaccttaattcgtttttaccttgactattttttctttcttgttgt

SEQ ID NO: 30552 - DNA, 1280 bp, Oryza sativa
cactgctacctcgcgctaagggaggaccttgcgtgccgagaggggctggttggctaggggagcaccaccaccgtccctcgtgagctgcaatgagagaggctggataatgcctctaccatgcatcaccaaacggattctatctatgagtattagatgataaaatatcttggattcattgtcaatctttcattttaaccctttcattttgttaatattatgaaaagttattcattcaattattttttaatgcatgccttgagtttatatgtattttcacataaacttctctgtactgttaaaattgagtatcaaagtctcacaggcttattctttaacctgactggcgtgtttcatacgaatacataaatgacggaacaaaggtatcacaggtgtgtttcatatggagagatgaatggcaaaacaaggtatgtaaagttataattttcttcactggtcatgaaacacaggtattttgcttgcaatagataaattccattaaaccaggaaaacataaaattaactgtctcttaatcattatgatcttcgataacccgcaaactagcctcaacatagtatacacatgaaacccactcatttaatgattatttgcacctatagatttctaaataatcacgaccattattattttattattttttcctaagaaaaaactccttaggcagtgggaaactttcatttttcaccaaaatgatgatatgtataggcacgcctatttcgcgggaaggatatgctaaattgctacacgcgcgccaaggttgcccgcccaaattagttttccctccttttggtgcattttactctccaacccactgattctttatttttcacatatattcctcagtggtccagcagagctgccttgctcctcgctagttgttgtacaaaggaataaaattagcaaatgagacattctatggggtgttttgtgaaatctttgttttattttaatagaggggattgttttggcggcgggaggcctcatcccaatcccggttggtgccacccaaaccaatctcgtgccccaatccagagccgccgcgaggtatttcctttcttccattttcttaaccatttctacttctcaatctttctctcacgcagatccaaaatgctcctcttctttctatggatttttttatggttttcacatgttagggttctagtgagctttatctctttttttcatgtgatttttcggcttttctcacttcttaaagccctaaatctacttcttttaccatgtgattctaatttctagg

SEQ ID NO: 30553 - DNA, 1501 bp, Oryza sativa
aaaatgtggaatgattggcctgagttggcttgggatgagctgggacccaggtcgggttgccagttcggtctgaatcatcgtaggccttgggttaaggcaggttcgtgtgggttcacggccttgattaataatattgtgtagctctaggatcgtgtttgcaaaatagctttgggcaactaagtgacttttaaatgttgtttactgcaaaacctaacccctattattagccccttgtaccccttgcattaatcatgcatctcccggtgtggcttgctgagtactgtggttgtactcattcttgctctatctctccccccttcagtaagagaagctttagagaagaagtcctaggtggagtcctggcttatgccccagttgagcgcctgtgaagatggaaccgtaggcccgctagtccgctgctgtttacttttgtttgtcaggcctgaagtgtctttgtaataatggaaatattattgatataataaagatgtgtcttttatatcatgtttgtgtggtgtaccctggcttttcctgggacggggattaatacactagcgttcgggaaaatgtaaattttctcggtcgcgacacgttggatcctaatcgaacagtcttgttaacgccagaatttggtaagcccaaagtcatcatcggcctagagtcagtatcggctttagagtcttggaatcagccgatgggagtcgtcaaatcgccagcagttgtattcttggtggagtgggatcaattagaggaaatttatccagaagagtccgagttcaaggaggatgcggcatggcaaatatatctattaatttggagtagtttgttagtttccttttatcttaaggaaagtgtgtttagtgtcctataaggactttatgttttccttttatctttaggacagtttctttcttgtcctacaaagactagtatctacccatgggtataaatatgtgcacccggggtcattgtaaattatctctcttgatcaatacaactactctcggcgcatcgccaccctctttaccgaggttttttacttatcttccggtggaatttggcacctgacatgaggctgcattggttcagttcgatctctggcgaaggagtaagtcctacgttccaccggccctggtgaatctattggctatattggtgttgttcaaggctgcattgcttcgatctcttggatcgctctggtttggttgatatatttgcctacctgatatctcaattctatctctaattgcattgtgtttagagacgcatcggtttagttgggactgtctcggttaggtctgatcttctgtcttagccgatatatctctgcaatcacaatgttgttctaaatagatttgttatatccatcacattagacagatctagctcatcaagcattagattatcatatacaatctcgtgctgtatcggttaggttcgacctactagattgttgttgataatataaatcttgttgagccgataggttcacgctagtgtt

SEQ ID NO: 30554 - DNA, 1501 bp, Oryza sativa
aactggttgtaagaaatccaaagtaaagtttcctttgatgctgatttcacaggaaaagtacaggaaaaatccatccaccttgagctcattttttgcttcctgcatgcaaatcctaggcaatcaatttcctgtgatccgaatgctatcaacttttgtattcctttgttattcattcctctgttttacacttagggcctctttgaatcgcatgattgagaaaacgtaggaataggaaaaacgtaggattttgataggaatgtaagtgtaaaacagaggattgtaaaacacaggaaaaacacaggaattggatgagagatatagactcaaaggaaaattagcaagaggttgaagctcttgttaaatttcctccaaaatctctataggattgtccattctataggaatttcaaaggattagataggattcaatcctttgattcaaagggcttcataggaaattttcctataggattgaaatcctctaaaattcgtatgtttttcctccaaatcaaaggggcccttagattcctttcatattcctatacttttcctatctatgtttttcctatcctataatccgaacaagcccttaatgtctatacatacaaaatgagtatatatgttgcaccgatcaagcatgtaaggcatatattgtaaaatcaaaggtgttttttattattattttgtgatgaacaattggcattggagattatcagtttagatatttggaatttatttgcgaagtggttttggagatgattggatttcataggtgatatacaggtactgtgctggattgggtacggtcacaccgggcacgggttgccggtcagaccggcgtgtatctcgcggtcagaccggcgtagcccacggtatgaccggccgactctgtgtcagtttcggtttcgggttgtttgtttggatatccgtgattgtttcatgattatgacttctagacggatattatgtgtatgaatattatcgtttgctactaatgagtcaagttggggatagcttggtctcggaatatggtttctttctttgttctatgtgtaggtgactcgagatgtcgggagagtatttgcggtgatggaccgggagtcggcttggggataagacgacgtccgtagtggtcagagatcatgcgggatactaaggctagagttcaatacacgtggttggtgaagattccatatggcatacgatggaggtattgtgtgtgaatgggatgcagagtcgaatttggaaggagtccaaatttggtatgattggttatgtaaagtttgtttcttgtactagagggtttcctagggtgattaggacttctagtatgagtttggttcgtggctttaggctgcctatctcgggtataaatagagggggagtgtgaggcttcccagtatcgcttttgagagcaattgagttgatagttgagttagggtttcgagtttagtcgaaatttttataaggagtgttgttggtgcactttgtaaacccagaga

SEQ ID NO: 30555 - DNA, 1501 bp, Oryza sativa
tagagatctacatcaatacaatattatgtgtgtgcaactggtagcagctttgtagccaaacaaaacacaataattcgtgagttcttgtcggctatgaagcatatatagttctggggctagagaaaattataacacgactatttgtacaaactagctactacaatgattattaattatatgaatttggactagagctaactgttcaatttattattatacttttgatatggtcctattgatgtaacatcaccaattcaatattactgaggaagttccctcatacggatagaaaatatatagtttcttgattgtttctatgctaataaaaacaatgtgatctagctcaagcctaaattgggcctaaatatttgcaatttgagcaaaaaatttatttggttccttgctaaaaataaacggtaccaaattttagtataaccaaatttcggtaagccaaaaatatagagataattggagtaagccttgtcaaatctcttcttgttttaagagaagtttttagagttaccaaaattcgataggatactagtggtagacggatagctgaccgttgccattctccaaaattgcaaagccaaaatttgagccataaaccaaagagagcttttcttagacccattttttgcactctttaaagatccagggatataatatggtgtgcatctagcaaaatataccccataattcataggatgtggttgcgaattagccgatgaaaaagaagacaaaaagaaaaaaaaataaaacgaagtatccagaggccacgagtccaggcgcttctcccccccgaagctcgcgcgcacgcacgcacgctgggcgcttcttcttcccccgcgcatcgtccgaaatcctccggattttctgaggaatccccccgaatttccttgcgtcccatcatggcctcctcaggtaattcctccgtgccaattcgtggtattcatcaaaggggggggggggatttctttctcttttttttttcaagcaatggatggtgaatcgagggctaggcgaaattactaattaccctcgccattttcgtgcgtatcctgcccttagcccaccgccaccgcctccggcgatccccatccatcccgcgatccgatacccgcgcactttttttttctcgaatttgcgttaaccctagcttcagttctagaaatttgtttgccttttaaccttgatactaataacaatttgatggttcccaaaaagttcccatgttagaaccgccactgtctattgcaccgtaaaagtatgcagcaaccgaggcgcttgatataatctattgagcatctaatgaagcagggctagatagaaaaaaaaagagaagttcagattgtcacagctgcaactgcaattgcttctagagttttgcatgagaaaatattatcgcagtcttaggacttcttatttctgttgtgaaatcctgggtatgttatcagttctcactttaacactcgcttgtatggtatgattatgcattttt

SEQ ID NO: 30556 - DNA, 1501 bp, Oryza sativa
aggatgcggcatggcaaatatatctattaatttggagtagtttgttagtttccttttatcttaaggaaagtgtgtttagtgtcctataaggactttatgttttccttttatctttaggacagtttctttcttgtcctacaaagactagtatctacccatgggtataaatatgtgcacccggggtcattgtaaattatctctcttgatcaatacaactactctcggcgcatcgccaccctctttaccgaggttttttacttatcttccggtggaatttggcacctgacatgaggctgcattggttcagttcgatctctggcgaaggagtaagtcctacgttccaccggccctggtgaatctattggctatattggtgttgttcaaggctgcattgcttcgatctcttggatcgctctggtttggttgatatatttgcctacctgatatctcaattctatctctaattgcattgtgtttagagacgcatcggtttagttgggactgtctcggttaggtctgatcttctgtcttagccgatatatctctgcaatcacaatgttgttctaaatagatttgttatatccatcacattagacagatctagctcatcaagcattagattatcatatacaatctcgtgctgtatcggttaggttcgacctactagattgttgttgataatataaatcttgttgagccgataggttcacgctagtgttttatcggggtgctagccgataagttatctggacgttgcatcggcttataaggattacatacaagttggatttagccgattacaacaaaggtttcactgtttatctaatcgtttggattctatgacatcggacctccagccgatgtatgctttaaccttcggatcaatgcttattctatcatattgtattgctagccgattggtttatactagattatattgttattttattacatcatcatcagccgattgcctttatatcattatctatattggacatatagccgattgcttaaatccaatcgttattggctattatcggcatcggctggaactactccatcggcttgtcagccgatcggctcattgatctattatttgtatatcttgtcagttgcagggtcaaactgattggcacgcccgcatctcactaacctttggttctgcactggagctaagcagatctcccaggccagtgtatgtttttcgcgtcaacaagtctagatccatttatcaagatgatatatctctgctacttaaaagttccgtagtggtgacggtgactccaaccttgacagatacgcgaaatatagaaagtcggatcgcctaatcgaacggctcagatcgcctttctcttcctacgcatccagcgcacgcgtctccctcgaatctcgatcgctctctcctctcccctaccctcaaccccctgatccacgccaccgcaaccccctcaaccgcccgcatgcccgatccgttctctccccctttcctccttccccaccg

SEQ ID NO: 30557 - DNA, 1501 bp, Oryza sativa
tgacatttgttagttagtttacacgtgaaactaatatacacatgatgtgtttccggtttaaatatggtcatttgtacaaataaaggtagatcttaatcggcaacgagaatgaagattagaaggtctaaatataaattagtacaaattatgtgcttagcgaatagcaattaattaagagaaatcaacatgttatcagaatatagcaatatatttgtaaaggcttaaaagattatatttaattagagatgtcgaattgagtacgtagtatgtgggagatgtagtttgacaagccggtgctttggtatttttggcagtaggtcattcaattattatagctttacatgctctttaacaccttagaagactgtgggggaataactttgagttgattgtagaagtaaaagtggattaagtcggtgtgtggctaagtcttagctaggcatgcaaagaatatgttcgtccaccgccgcctatgacgcatatatccatcctgatcttgccgctgccccatgcgtccaaccgagaaaaccggctccttaaaccttaaacaaaagattaaaaaccggtagagatatgcaaataaaatcatcagtcagagaaaaaaatttgtgctagtcaagtgtggtgatgaggttagtttgtcgtgaccgcaagacttctatcgtgacttcgatacattttgatcttgtttctgggagatagaatatacgtgtaaaactgctaaaaaattagtgtacgtttccgggtaaaaagttttaaatataaatataatatactgtaatgtaattacaatataactacattgtaatctctaatgaataaaattatatatttttcagtacttacatacaaacaagttacttcgtatattataagttaattatatactatagaattatcattccgatccctaattaccacgatccattcagatcctacgtggcgctcgcgcgttgcatgccacatggaaacaacagtttatatataaacttcaaacaatatgtttttatttgatattgttaaaaatagattattacaaattttaaaaatagattgattgatattttaaattaactttatatacaagctaaaatctgcatctgatgtacacgcagatgaagatgcgccggcacccaatcccaccacagcgaattaagcggatccaaagctaataatactcgatccgctgttagtgttagccgcgggcgcagcatttgtctgcatcgttcgatcggtttcggcttcattcattcatgtgctcccccctccccgcccacgcactagcggctgccgtccacgcacaaaccacgtaagcacgcaccacctcgcgcggtataaattccccgcgccctccactcattccattccccaaccccaaccattcctatttctaaacaacacacctcctctgcacttgctccttctcttcttctgtccatcgaatcgacaagaagaaatttacaagcaagaatggccgccaaggtgcatcctaacgtcgccg

SEQ ID NO: 30558 - DNA, 1501 bp, Oryza sativa
gtaattttgttcaagtttaatccatccaaaatttttataatacttcatccatcggatttggaaggattcgtgtattttttttttcttgatacattataatttggcttaagtttgacatttagttcacatttattgaaattctgagatagctggcttttgagggtgttttccttaaaccatttattagtttgcaaaccctttggtggagttgtttctgggttagtgtttgacaaaaatttatattaaaatttatcgaataaatatttcaaataacaaacatcaatgtgtattaataaaaaaaatattttggcacatgcagcgagattgtatgatatatgggcccaaaattatcaaataataaacgtgtccgaatatacccaataattggactcgttcttttcgaatagaaaatgttggtgaaaacagattttaaatttgatgcgtagtttaaacagttttcaggcgttcaaataagagagtttgactagtattagttgctcggttggaaccgatcacgtgtattacgctgattatctccagcgagaagaaattaaaaaaatcaaatgcagggcccactgtcattagcagtaatacgtgactttctttagcaatcgggtggatatgctcctccttgcgtgttatgcagataatcaacggatttcgctggcttgtgctagaatctcggaagggattaggccagggcgccatcgcctcgcctctgcctgtttaaaaggtgcagtagacggagagacggagacttgagaaaatacacagcgacgagaaaaacagagagactcgctcctgagaaatcacagccaatccatgcgcgcgcgcagtggagatcaatgttcaaacatcccttgtcatcaagctgatgtcgcaggcggagatgatcatgtgctagagtaaattccctatatgcaccttaaaactgactcaatcccttccatgtcctccaattttgtgtgcccttgagatttcgctgtgatccctcccatgtctctaccgttatttctcacagcattgactggttaatttacctggagatgtccattatacccttaagagtcacaatatgactaagcattttaaccaaggttgtcattacgctaattttctcatgatataggggaaaggtacacactaagtacatgtcaccacgggaggaacgacagcgacagccacgaaagaagagcggcggcgctgtgcgccgcccgcgtcgaggggagacgagagattggagattatttggggatttcccgctgttgctggcttgctggttgctacctagggtttcgctaggcattttggtctttttaaaaattactgacaatgtaatggatgtatacactgatagatctaacagatacctaatggtagggacatgggagagaacacaataaaatctcgagggtacacaggggattggttaaactggagggcatggaagggattgagtcagttttgatgtgcatacagggaatttatcaacgtgtgaggt

SEQ ID NO: 30559 - DNA, 1501 bp, Oryza sativa
gtttcacaatgtaagttattttagcattttccatatttatattgatgttaatgaatctagacatgtgagaaatgctaaaatgacttacattgtaaaatagaggaagtagatgctacgtacgaagtactcctaagtaaaaatcatcatgctagagaaatacgtgatgtcggtaatcctggtggtgatattctcaaaccagacatgtacagtaaactcaatagtcaatactatgggtaaggtatggattgagatccggtaaggtatgcatattctcgaacatgatcagtcactgcatattcgatcgatctcctaatcaagatgcattaacaagataggttcgaagaccatttgctgaaaacctaagctagattggtccttcttgcatgatgatatcttgagaaatactccctctgtttcgaaatgtttgacaccgttgactttttagcacatgtttgaccattcgtcttattcaaaaacttttgtgagatatgtaaaattatatgcctacataaaaatatatttaacaacgaatcaaatgataggaaaagaattaataattaattaaattttttaaataagacaaatggtaaaacatgtgataaaaagtcaacggcggtcaaacatttcaaaacggagggagtactaataatcgtaaccatccttttcccttgtgttttttgctgactggttgtgctctttaattatcactttatgcgcacttttctttgacgccttccacaattaacatgcgcgcgcgatgggtggttttgtttatatagtactccacactattgtacccgtatgatggcaatactagtctgactagtgtttgctcttcatctagaattgttgtgtttctgtacagtagtatgcatggaaagcaaagaagttgtggaaatgcggtcatatgcttggctaggaactgaagagatagcaattgggatggttggtttggcgtctaaataaaccacagcgtcctggaattgtgagtcatgcgtgatgcgtgattcctccagtacagaggagagagctgatcaaggaagataactcgagacaagccagtcagctaggatacctaatattccctcttggggctcctacaacgtatggaggaggagaaaaacgtgtcttgtgatcttaattgcgcagaggaagaacaaattcacctccgcctccgccgccgcgccgtgtcgagggatcccgatttatggatgcaaatcgctttttcggatcgtgattaatggtacggtggcccaaagcattccaggccctactagatagtggactcaacatgggccgaaatatcgggggggcctccgaaagcccatatacaattgccttacctgtccccacctgtcacatgcctcacgcagcagagctcaactcaagtcaaggcggcatttcgaaattcgaaaacaccaacggtttcaaatcctcctcacatcttctcttcccccaaatccctcctccccatcgcggctcctcctccggcagccagcca

SEQ ID NO: 30560 - DNA, 1501 bp, Oryza sativa
ccggggttcgcaccccgcggcggcggcggctgaccagtgggcccagagacgcggtggggcccactcgtcagcggaggggattcggcgagggcgactccggttcgacggggtcaggtgtaactcggggagggagggaagggaagcgaggtggcgagttggagccggagtccacggtgtgggccagggctgtcagggaaacctggtcgcaggtgggccccccggatcctatgatcttctgtggcgtggtccccgctggggaaagaagtactggtgccgtttattcgacacgttggtttgagggtgagtaggaggagccgtacggtaggccaaacagcctggaaaagttttgggagtagctatacaacaaagttttttttggatgaaaaacttttaggtgctgccgcaaccagcacaaacaatcaaagcttttgaaatgtaactattattatataattatagtacgtgttcgatcagtaactctcataaaaatgcaacggagcaactaattaatggaacaagtgtgtatactgcagggttcggttcgatccccatggcacgcttgcaaattttttccatcttcctccgccagcatgaatcttggtgaatcttagagccaaatcgaacgggttttgggttcgatccccatggtgtgcttgtaaactttttccatcttcctccaccggcacgaatcttggcaaatcttagagccggatcttcctccaccaatacgaatcttggcgaatctagagccagatcgaacagccaacaaattgaaagctgaaaattgtcgacaattaactagcaaaacccaaagtttttgttctcaattctcaaaacaagagaaaaaaggtttctcaattctcaaaacgagagaaaaaaatgttacacggtacaaacgcagacgtccatagtacatgtacacttatttttatgaacacacgcacaatttatccttatgaacatctacgaaaaactggaccaacatatcttgagattgatgaagttacctaacacattcttccgagaaatattaatcacaatgcaagaataaattccaattccttctaaatcgcaattaccttacaaccataagcatcattactacaaggttttaacaatgtggaactcagctacaagtctatttgtcagtaattttcttccaaagtttatctcactagatactagtgctgctaatacatactccctccgttttaaaatgtttgacaccgttgactttttagcacatgtttgaccgttcgtcttattcaaaaacttttgtaaaatatgtaaaattatatgcctacataaaaatatatttaacaatgaatcaaatgataagaaaagaattaataattacttaaatttttttaataaaacgaatggtcaaacatgtgcttaaaaaatcaacggcgtcaaacatttcgaaacagagggagtaattcataatctgcacaatgcagatagttcgtagatataatgtactcaacatgtgagcagtatg

SEQ ID NO: 30561 - DNA, 1501 bp, Oryza sativa
tcgatacgttattattacatcggtgtatgaaacaggtgtcggaatgaggggatgacttttgcctcgttggtgcctagcaacggtgcatctgttcctgtttgtttggacgtataaataatatagcaacctagcattgctagcgctcggtcataattttgtcgataatagaaaaatgtggtggccatagctttgtcagctttagccaatgcatcgtctggtctcatcggtctcggacatagagtcaattatgtatttttaatctccacttctccttgcatcttgcttattttgtacggaggatgtttctcttcaggaatttgggactcgctcctctagaatttaggatatgtggtcctacttaaaaatcttttctaaacatcgtaaatgtaacaatgttaataaataccatacaagtatagataatataatagatcaaacatataccttgacgtcttgctcttcagtgtgtttcctttaccacaatcgaggaagaagacaatttaaaagtattcttctttgttgtgtatttttttaaaatggatgcaatatctccatctttcttcatgtctccacagttagcaatctacaatatagtagtacaatttaatctcacaacgcataagaattaaaatttaaaactgaaaattgaaaaggctacacaagtagaagaactaaaacagaagtcgtccagcggcctccgattccgatacacaatgccatgccatccaacgcgccgagtcaccgatcgttgattcgatggtcagaagcagggtcgacgactcgacggtcgagtgtcgatggcggtcgtcgctcggccgttgaggctgagacgctatcgctcgacgctcgtgacagcatgactcatttgttgatgatgacgatcgacgagaggagtaatgggcgcggtcgccggctcgccggccgccgaggacgctgagacggagggagagtcagagaagtgggcacgcgacgcgggcgcatggcggacaacgaactcatcgtcttatctcaggcggcggcggcgaccagcggtgggcgtgggcgaaggcaggcgcgggcggcgctcgcggagtcgaggtgcctcgtggacttgcttcgctctcctgttgcgggcagcgggcagcagggcgcggcgaaaaaagaggagttgcgggggaggtgaaaaacgagtagtcaagttgaacatgcaatggcgcgtgtcagtctcttcagtctccaaattgcagttacgtgtgatgatttgggaccaggttttttcgttttctttttaatcccgatatatacacatatctgccagtggactcgctcccgacatgtgcaccataaaaacacgaggatagtccgatccgccgattagacatacctaagtttgcaattcaagaaggaaggaatgatctgatttctagatcgctcaagttgatgaagaaaagaggtactttgatcatccagtaaaatgacaaatttaccaaaatctttgaaggaatttattcaccacctcaca

SEQ ID NO: 30562 - DNA, 1501 bp, Oryza sativa
acatgcatgtccaattcctagtcagtctctctagatgttttttttatttgaactcacgtattttcctgcttgatctagaccatcaaaatctagacaaatacgatccaacgacacatatatttttctttttctccgaataacatgggaatttctaatccccacagcgaacgtgatgcctcctttcaaagttgttttaataatatgatagatagatagatagatagatagatagatagatagatatgcgttaagatttacatgcatgggttatatttgaattataacctgtgaaacaatataccttattatatttaagtagaaaaatgatttttttaataatagtatcaacgatgggtttaatagattcatgccggccggtttgcgcaaaccttttgcgagttggactaaaaaattggcttacaacttttaccccacctggcccacatccagcacacatacctttaaaattttctatatataaagtttttatagagaatctaagtttctactaaaatgtcatagctaaatcagaattggatgtgtccgcatacatgcatttcgaaaatgtttctcgaggaaaactttgtgtataataaagtttctatgtgaaaaaaagttttggtgtataataagaaatgtaaatacgtgcttatgataaattcacttaagtgacgcgcacacgctgtaaaatcaaaggtgtttttattattattctgtgatgaacaattggcattggagattatggttttgttatttggaattaattcacgaagtggttttggagatgattggattttacaggtgaatcgcatgttctgttatttcatgtgaccggtcagaccgggctctggtagccagtcagaccgacgatatgcgcgcggtcagaccggccagcccgcggtctgaccggccgactttgtgtcggtttcggtttcgggttgtttgtttggatatccgtgattatttcatgattatggcttctagatggatactatacgtatataatactgttgtttgctactaatgagtcaagttgtgatagcttagtctcggaatatggtttctttgtttatttcatgtgtaggtgactcgatgcctcgggagagtatttgcggtgatggaccgggagtcggcttggcgataatacgacgttcgtggtggtcagagatcatgcgggatacttaggctagagttgatgcacgtggttgatagagattccatatggcatacgatggagttattgtgtgcgtatgggatgcggagtcgaatttggaaggagtctaaatttggtatgattggttatgtaaagtttgtttcttgtactagagggtttcctaaggtgtttaggactcctagtatgagtttggttcgtggctttaggctgcctacctcgggtataaatagagggggagcgtgaggcttcccggtatcgcttttggagagcaattgagttgagttttgagttagggtttcgagtttagtcgaaatttttgtaaggagt

SEQ ID NO: 30563 - DNA, 1501 bp, Oryza sativa
gccctgcatttgatttttttaatttcttctcgctggagataatcagcgtaatacacgtgatcggttccaaccgagcaactaatactagtcaaactctcttatttgaacgcctgaaaactgtttaaactacgcatcaaatttaaaatctgttttcaccaacattttctattcgaaaagaacgagtccaattattgggtatattcggacacgtttattatttgataattttgggcccatatatcatacaatctcgctgcatgtgccaaaatattttttttattaatacacattgatgtttgttatttgaaatatttattcgataaattttaatataaatttttgtcaaacactaacccagaaacaactccaccaaagggtttgcaaactaataaatggtttaaggaaaacaccctcaaaagccagctatctcagaatttcaataaatgtgaactaaatgtcaaacttaagccaaattataatgtatcaagaaaaaaaaaatacacgaatccttccaaatccgatggatgaagtattataaaaattttggatggattaaacttgaacaaaattactgcaaaacgaagaatcacaagttaataccaagactggacataaacgcaaaacttaatacacactggtggagaaaccttctttcgtcggtcggccgatttccacaatagtcccggatgcaataaaaactggggctaaagatgatctttagtcccggttcaaaagggtaacgggcatatttgatctttagtcccggtttgtgttaccaacctcatctttagtcccggttcgaatgctgtcaggtcatatcaggcccccccgggatctttagtcccggttggtaaagatcgtaactttagtcccggttggtaataccaaccggggctaaagatcccggtgatctttagccccagttggtgctaccaaccgggactaaagtcccacccctatatatatgtcttcttcctccttcagctgcccgagcaagtttcaaaatttcttcaaaaaagaggggaggtcatgccaaaatttctattgaatttattttggtgattacatacaaatcggaggtgcctaaaaggtttgcaactttatcctccaatgttttttttgtcatactacatttgcacctatgttttgcacactttttttgtctccaaaatttagttgtaagttgatgagagagaaaatgtgtgtggggaataaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcaggtaga

SEQ ID NO: 30564 - DNA, 1501 bp, Oryza sativa
gcgacgatagagcgataaaatctttttccgtaaaacgaaaaattctaaaaaaacaaacacgcatacatgcataaaacacgggattattatgccctaactgtgaacctactgcagatcagccaacgcgtcatgcatgcatgaaccctctttcttttcttctccctacgaagaactttgatggagcgacgcacaaagcaatcatgcagccagcagcaaagtccatttggccatgcgacgacatgcatgcacgggtttagcttggagatcgatcgatcgatctgaaagccaaaattaagctgtgcacggcgaaaaggacgcagaggattacatgctacacgtgcagcagcagcagcggatgccgtgggggccggacgatctgccgatcgatctcctgtcctgcccatgggctccatggatggccaaaggcctagttccaaagtttttttttctaaattttcaacttttcatcacattaaacatttcatacgcacataaatttttttatcacattataccaatttcaaccaaactttcatacttcagtgtgaactaaacacagcccttttaagtccagggccaccacctgatgagatgagatgagagatgagatgacattgctgccaatctagcttagaccggtcaagctagagccaacagtgagatgcaatctgtgtgtacatggcccaccacccagccacacccaataatttccctgcagggactacgtactgtgtgaggtttaagtttgtgtgattcataagcacacgctctggttctggccggtgtgtgtagcatacacattctctgaacgtagtgctgacctttctgtgcagcgaagaaaatgtgcggtgcaaattaacaccaagtggaaaggagaaaggaataattattgtgtaatatgcacatatggaatttaaggttgtccgtatatgtcatcgtttttttaaaaaaattgtgtgatacatattttgttgtgaattataagactaattcttgatgtataaatttataagccgctagttggtcatgacatcgggttaaaatgtaagttgtgatcttaaaaaatatatataaagtcataagagcggttttactgtgcatccttggaagctagcatctttgtgtatacatccctcgtccaagaaaaaaaatcgattactatatataaatgaatatggatagatgtttatccaaattcatttttagaagttgttctttttatatggggggagtaggtgctacaggtattctctattaaaatccaactcttgattggctatgggcacgatggtcattgggaggaaaagcaaagccagcaaggtcaagggcaaccctacgtagatctggacgatggttcttccatgtggatgaagaggtggtgttgtacaacgccttgagaagaaaaaaaatcgtgcaggccaaaggagatgtttagcgacaggatgatcctcagcgcaaatactaggcttatccactcaaggccatgccttagacaccgcga

SEQ ID NO: 30565 - DNA, 1501 bp, Oryza sativa
ccgatcatgaccaaaggacttctatgcctctcttttcagtggtcgcgggccaaccaactagtggccacgggaccaccctactggaggaccaccgcgccacgtcgcatggtgccgcatgcctgtcctactcagtggtcgttcaccatgatgtcacctagctgctacacgcataccctgctcaggggtcaccgtgccatcgtctcctggtggtcatgggcccaccctgtataggggttgccgcactctgttgactggtaggagcaggcccaccatgtcaagggctgttgcaccacgtgacgtgctctgtctattttaggactaacccctgtctatttcgaataattataagtgtggatgggaacatgtaattgtaatactgacaacatgcttttattttttaaaaaataagagaagttgtgactctttaacataaacgaggaatgcacacaaccattacatcacttaacaggctaacaatagactaaaaaagagactaaaaaggcaaaaaataatatgaaaaataaactatcatgttagggttaatatagaaaggcttcgtcccgcaactcagaccactgtaagatcatcttcgtgaactctatggttgcaggaaaatatgttctgggatttttagttttcatggaaatgccgtagaaaaacaggtatgactcgtcgatatcgctagattcaatcgcggtcaatgttacatagagggattaatttacaccccggatctcaaaataccaattctcgatggtgatacttcaagatgggaacacggctgatcgatcacttgatcagatcaatagagtcactttcttgaggcaaatttaaataagattaatttacttgctcacttttcttactgtgagagcagctaagctagcgaagttgacacatggagattccagattcttgcacttgatcgctcctttaatttggaatcttcgctaaaaaaacaccacctttttcttacatccatcagaagaagatcaattcgtttatgttgtgtccaatcctatgcttaattatatgcttttcaaaagttaaacgtactccacatatgtatcctgtatatatacttatatagttcatccccactaaatatagttaatattatttctctcttctcttattaagtcacattaccttaattatttctagtcttttaatgatagatatatagttcaaattgtcttttctttcttctctcttaaaaacatgcaatctcaattacttttagctcaaaattatatcaaattgttttaattttgtacgtattatgtaacttaattttctacagcaacgcgaccagatgttcatatagtatcttataaaagtatgagcagtactagaatactaaaactggagaataccgaatgtacttacttataaactgtaggggaaattaaagcacttaaaaaatgtcctgaatttaatcatattaaacatttatataagcatctacgtctagttcataaaaaacgcgttcgcgaaaata

SEQ ID NO: 30566 - DNA, 1501 bp, Oryza sativa
ctaccgtgaaatatgtttaggtagtcacatactaaatagctccatctctaaaacttaatttttatctcatatttgtctctctacctttagcaactcttctgccgcttcagcctaatcacctcctttctctcctctatccctttgcaccaccgcggctttctttaatggggtgagcctaacaaacactctgacacaagaaagcaccaaccgtggcagaccaaataccagtcaagaccacctccacctcctccctccttactcggtgcttgcttcttctcctcactttgctcgttttcctagagaggccaaatgttattctatctattactttgcaggtggacatagttgcattgacaaaagtcatagcaacaaatatgacaaataacaattaagttttagagatggagctatttagtatgtgaccaccgaaaagacgtcacggtaacgagttgggttcagcgattcagtcactctatcttcgagtcaaagatttgatcacttcatctctaacaattaaaacttacatcaccggcaaaatcatcatcccattacaccccctctttgccttctctaccactctaccaccgtgactttttttaaacgggtgagcctaacaaacgctttgacacgggaaagcaccacccgatgactagaccagagaccagccaaagaccacctccacctcatccctcctcacttggccctcgcttcttctcctcacgaataggccaaccgtcacacggtgttctcacttaggcgtgctaacactatgtttcccctatctatctctatctaaggcaaagactcagccatttcacataaaaaaatttcagccataccaagagcatccaatttatagaatatacgggggctctctatagaaaatgtgtagccatacacagagaaaatgtataggagacacacacaaccactcttctagcaagtgatgagaaagtgtaccaaacacaaagtatgacctccaattcatagaatatacagggggctcctctgcaaaaaaaaaaggagcaccaaagaaggggaggacaaaaatgtgaaataggaagaaaggcaagggggtgaggcaaagagtgtttaaagccataaagcgcagccctgtaattgtaacgccgccgttatgcttcctccctccctcctcttctgccttcgctctctcttgctctccaccaccgcggctttctttaatgggggtgacacgagagagagcctaaccaacgccccctaacctgacacgagagagagcagagcagcaccacccggtgaccacaccaaaccaccccaaacaccaccacccccacctccctccctcctcactcttgccgcctctcttcttcttcttcttctctcctcacttcgctcgctccctcggtcgctcggccgccatgtcgtcgcaaggtgacgcgctgcctctggttcttgttttgttcttgttcttgtttttgttttgttttgtttgccgggaggtttgatggggggggggggg

SEQ ID NO: 30567 - DNA, 736 bp, Oryza sativa
tgcatcatcatcgtcctactagcaaaactaacaaataccttattcatatatcaatacacaattatacaacaccgtagatgctgtaataaaaaactttttttttgctgttaccacatacgtatttcagaaagatgtaccatcaaggacacccaccaaatcggaggcgaagaaaaacccctacctatgcgcgcccaactcacgcatctggtacactcaccgggtacaaccaacaatcccatttccaaaaacaaatcgaactgaaaaaaaaataaaagatgaaacaataaacaaaaccagacacagaaaaaaggaaagggaataggacgaggagcactgggagtgaagtatacctacctaccaaatccagccccgtgggggggagggcctttgcaaatggcagccactcaaccaacctccgctcctcctctcgtctcatcgcaccaactcggtcaaatggcccagagggatccgggtcaatggggccctcccctcctctccctctccctcgtataaaaccaaccaaccaccaccctcctctctctccttgctcacgaaaaagctcccacaaagcatcacctgcaaccagcccccgctcatctccatcttcctcctccctccctcgctcctgtgcttcttctcttcatcaacaagagagctttccctcgatctgtgtgtgtatatatatagagagagagggactgatctgggtgtagcgagctaggtagcctagctagca

SEQ ID NO: 30568 - DNA, 1501 bp, Oryza sativa; identical to SEQ ID NO: 22121

SEQ ID NO: 30569 - DNA, 1501 bp, Oryza sativa
tttatttagtgtaaaaaaaattatgctaataggtctatatttcaaagtatatctaataaaaaaattttatgatgaatcaatagcaaagtataattgaaaaaaaaggtataatcttaaatattttttaaaaaattgccatatataaatatttgaaggaagtataatgcaagtgattactatgatggtttacttatattacatatcttaaaataatactcacgcagcgttattcaatattaattacaaattaatagcgaaaatgcctgtagcctaatggttataagagcctcagtagcaccataggtcctgggtttgactcctcatgggagcgaattttccaggatttaacggctttgtgcttttagtggtaggcaacgtatcgtcaatctctaggatggttgtgcttttagtggtaggcaatgtatcgcaatctctaggatggtgcttattgtaacttcgtcaatctacaggatggatttgctggcctagtctttgaagatgctcatagtggtaaggtttgtgcgtaaaattacaaattaatagtttattttcatattaatacttagaatagatatatctcgtaacttcctttcatatgaccaggctcataaaacttctaaaattttgaaggaaagtttaattctacagaactggtgagtatactagtttaattctatggtatactataccattgtatgaaccttcccaaaaacttatgtacagtattttttttaaagcctcaaggatgcttgccctcttaaaaaaacaataaatatcactgcttaaagcctcaaacctcacacctaatgtcagaaaaaaaaaagaatacaaatgtaggcggcggcgaatctagaacgaaaaatacaaaaataccgggtgtcatatacctatcaaatatatacttcctccgtttcacaatgtaagttgcatttctcacattcattgacatcaatataaatgtgagaaatgctaaaatgacttacatagtgaaacggagggagtagtatattacactctttacgtgctaacatgagctaacaccaatgggattataaagtttagaacagtgttataccctgtggattcgcccctgaatgtaggggtacaatcgtcatcggatgacatagtcacactcacatagctaatagtttagaacaagacatattcagtcttgcctaaaggaacaaccgaacaagtttagaacaagacatatactaatagtatacttaggacaagcaaaattttcagtgacatattcagtctagcctaaaaccgatgccattgctttcatggtttcgtacttccattgcgtcgcatccctccagctccagtccaccaaactctgcgcactgcgctccttccaatgtcgccgccgacttcaggttcaggtcgctaccttcacttctccttcagcttctgatctccactggtaagttcttcactgaactcccacagcttctttgctagctctgcatctcttgcaacagccgtcggcgtagct

SEQ ID NO: 30570 - DNA, 1501 bp, Oryza sativa
ttggttgggaaaaaaattgctgtgatggaaactaaactgctggagcatgctaaatttctttttacctttattaggtactcgatgagattaggccatacctttctggcacaggaggtggtgagcttgaattcgttgcgatcgaggaacctatcgtcaaggttaggcttacgggcccagctgctggtgtgatgacagttcgcgttgccctaactcagaagctcagagaaaagatacctaaaatcgcagctgtccagctattgtcgtaagcctgaaaacatttagaaaacaacccctgcaatgtaaatgtgccgctacaataatcgccaggaaagattgtaatgggcttaaagctttgtaacctgttactctattctacttgaactacgaatagtgatcatcaatatgaaatgttgtaagggtgttcctactggatttatttacaaaaggttttgggcttctatgattttgtctgtacaatttgtgaatatcactcttttatttggaagttcgttgaaatagaaaagggcactacaattttaatttcacttgatctcttattgagtatgaggccttcaagtatgggattagtggtagctggtgaggattgtattatcttctgtcaattcataattttggtttactagtgaacaagcacatgcatgaccaatcggaatgaaattcaacatggtagtagctgtaatgaggcatattaatgactgataatttcttctttattgtcacataagcagcacatagaagtcgtccttaccgtatgctgaacagtgacaccatttcagttaggctctgtttagttcgtgaaaagaaaattttttgtgttatatcggacgtttcaccggatgccgaaaggggttttcggacacgaatgaaaaaactaatttcataactcacttggaaaccgcgagacgaatcttttgagcctaattaagccatcattagcacatgtgggttactgtagcactttatagctaatcatggactaattaggtttaaaatattcgtctcgtgatttccatgcaaactgtgcaaatagtttttgtttttatctatatttagtgttttatgcatgtgtcaaaagattcgatataacgttttgggaaaaaaattttgaactaaaccggccttaagtctgacggtgagtttactgggtgtcaatcaccttattaaactaatacatatatcgatagtaaattccgaaattacatgaggcgcctgtggcctaatggataaggcgtctgacttctaatcagacgattgtgggttcgagtcccaccaggcgtgttttgttttttcttcttcttttttttctctacaagatcggagacagatggacggtcagggacaacgagcctattcaatatcagccgtccacgtgtctgatcgttggtcaccaagcacccactggccactcgtctctctatagtgaatagtctatcctcgcatcgcatactcgtgcaacacggcttgcgagcggcggcgcgga

SEQ ID NO: 30571 - DNA, 169 bp, Oryza sativa
gcggttgtgatagcatgttggcattgtcctttatgaggtgatgtcgttgaggaggtcaaaacaagtggtgataggccttggtgacagcagcaattaacaagctagtgtgtcataagacatttcatttttatctcttgttggatatgctgatccttattttcttggcagg

SEQ ID NO: 30572 - DNA, 1501 bp, Oryza sativa
attttttactaatacttaattaattatagattaataaactaccacgtttttcgtgatagtactctctaagaaaacgaaaatggctaatctctatctctacttatatacttcaaaaaattgaaaatgtttccatcttccgtctaaaataaaaaaaagaacgaaaaaatttcgatttctatttggtttcatcgtttatacgttatctacctctaatctaacattctatatacctatacctaatcttccagtgaaatttttgcccgtcctcacctatttttgtccgcaacatccgcagtccaacacacaacaaatcatacagagtccgcatcaaatagcacttcaacttcggttacccagaagagaacgaacgggaaatttcaattcgcaggctgaagaattgaaactatggacaaagaagactcccatctatagcaattcacttaaactatggacaaagacttacaatggttaattcagttctcatcacttccaacctattacatgtgcactctgaaattgccaaaaaaggttatccaacacatcgatcgagccagaagacattgtttatggagaaaaaattctaatatggaaacaaaaactcactccctggcagcttgggatctagtctgtaggccaaaaaagaaagggggtatgggagtaatcaatctggagtttcagtacatagctcttcttctcaagcatttggacaaatttttttaacaaaaagaacctgccttgggtacagttaatttggaacaaacattattctaattcagacaaaccacctcaggctcacaaggaaaaaggatctttttggtggaaagatatcttcagattgattcccttctttagagcgttcgctcaatgcaccctggggcaaggggatactgctctgttttggaaagataaatggactgacagttatctggaatccgaatttcccattctattttcctttgcaaggaacgaagattccacgattcaaagtttcttacaagcatcagagctcagtcaaaactttcacatacctctttcaagccaagcaacgcaggaatgggaaactctcacagacagactgcagaacttatacaatggcagtaatatggataaatggacttaccctggaattctgatcgatttcatgccaacaaagtttataaaatgttctttgtccatctgcaacatgaacgacctcttactttgatatggaaaagcaagtgtgtaatgaaattaaaggtgttcctctggcttttgcttatgaacagacttaacactaaggagatgctccagaagaaaaattttaacattcaggggggatacagtgcgtcatgtgtaatgccagcctcactgaagatatgatacacttatttttcaaatgcccgactgctcaacaatgttggcaaaaaattggaatccattggaacttgcagtcagacatcatgaacatgatcacctcagcacacaaccagtttcctcatagctttttctttgaagttctagc

SEQ ID NO: 30573 - DNA, 270 bp, Oryza sativa
cttttttctcccttctctaggggaactcgtcgaggagggcgaggccatggcggcagtcacctcctccccttctcctgcatcgccgccgccaccgccgcggtcgggtcgcctgtcgttggccgccgacgccctcctctgcacctgcggcccctgcaactgccgtctccccttctcctgcgtcgctgccaccgccgcgtcgcacgtcgccggccgccaacgccctcctgctctcccgcctcacccgcggcctcctctccactcgccgtccgc

SEQ ID NO: 30574 - DNA, 1006 bp, Oryza sativa
tatatatatatatatatatatatatatgttacttcgcatttatcctaatacatctttttgtatcttgcagaaaagacgtgttgtcggagtcgtccgtcaagcctgagtggaagagctagccctagaaggaattggagtaggcaagtgacataataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacatgactattttagtcttagcatgtaatattatttaagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgagttttaatacaagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtatggttctaatgtacgacatttacacttagcatacatgacttagattgttaaaacataaatgtctcgtgacttagcagatgtttcttgtatcaacaga

SEQ ID NO: 30575 - DNA, 1501 bp, Oryza sativa
gctatgaaaagcatgtcctgagtcctgacaatgcacaatttggccatggaaggatcctcctaagtcctatatattcctagccatgaatttgatttcatcataccccacacactcccttgcgatgctcaacaaaggattaatttattcgacaaccaccggcctatgctagtaagttacagacatttctatatctaggttacagaatccgaaacttggaatgttatcttcctcgtgatgatttatgtcaagatctgttgcttgcacacacaaaagttggcactgccacttggcattgataatttgatatgcaaatgatcctagtgacacaattctgtattccatctctcaataacagaaatatctaatgagatgcacttgatagcgcagtagcaaggggtatgtgatttcaacactacggtcccgtgttgaatccacaatacgctcaaaatttctttttttttaaaaaaatgtttggaggaatgtccctccctccaaatctttttttttaatctaaagtaatgaaagtactaaactttcttgcaaagttactatggccacgtcattgaataaacatgagccgtcggatattcactccagacaatacaaaccgttggattgttgaatcggttcacgaaacttctttttacaaggagatccttccacatccctacggtaaaaagaaagagatcttgattccaccgcatcgtcacgcccctacgctcccgaagcccacgccgcgctcctccgcctcattgccgcctgctcaccggctcttctcccgtaaaaaagaaagagatcttcttttttttttttgtaatatctagtgaaaagagaatacaggtttaccaccaaattaaggtttgcgaacaatttgtcgactgatcatacgtactactttcgtcagttgatgactgagatgaacatgccctgccgccctggcatccatgagctatggaagagacagagactcgtgaacagagcataagtgagaattgaaccatttggtgaatcttatgacaaattaacacagcaaaaacccaaatgcacgtctgtgtttaattctgactctggccaatgacaacgagacaagattcgttaagttgcagctctcgcacattacacgcatgattaatcacgctagacaacacaaactccaaaccaaaataatgacaaaaggttaggttgaacaggttaattagagttctaataagtaatcgctttattggatccttttacaacttgatcataatctccttagtttagtaattaccagtgcactagccaaatggttagttagcgcttaattacaattagtgaactagctacttaaatggcggaattcgttaaagatgtggtaattgttatttgcaaattgcagttttaattaatcacatcatctgtcgtatgtaacgagtcggacataataatgatcaattgtcgatgatgcaataacgtgtcgtagggtttattattttgttggtacgattgatcatccatttta

SEQ ID NO: 30576 - DNA, 1501 bp, Oryza sativa
ttcggttgtgaaacattaaccgtgccaaccacaagccagcatgggcaacggctttatcttttgtatagcatgtttcattgcggggcaccagactgagaagtggcggagataagcccaccggggtcgctggggagtccatgccttgtttataagggggtgattatgatccaggaaggtgcgctgcggtggattgtgttatgcaaggggtattgtcacaactcctttccgaggtaccgtggtggtattgaggcacatggtgacatgatgaggggttgtgtcttgtgggtacagtggtacacctctgatcagagtaaaactattcgaatagccgtgcccgcggttatgggcggtcaaacaatgtctttcgtgattagtctcacacttctcaccataatagaagatgctataactggtaataatttgattagctcctggtttggaatggtatattcctggtttggagatagaactgtgcagccgggatggttgttcagaatggttgggcctatacaacagggtatgttgtatagcgttggattaatattgtttaattacttaactgttttattaaattctcaaatgtttgctaaatgttgcttttgcaaatgaaaccctactatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttattttatttttccgctgcttagatctttattgattgagatgaactatctacctctgtaatgacattttattcgtttattaattagagtaataattgtactctattatcaatttgttattgtgtacctcggctgattcctggacgagggttcacacacatgtaagcgtttggaattttggatagaaattccgggcgtgacaagttggtatcagagcccccttgaccctaggttatgccaaatggttacccatagaagccctctaaaaatattggaaaagtagaactgttctcctccctttctcttttaattaaaccaaactaatggcacatgcacttcataatctcttttaatggttctcattcaaaatttattccagtgttattagtactgtacatctattactatattaatggctcattttccagcaaaagttttacaatgttgttttatttaatcttgctgcaacaaaataaatttagcaagttgattttataattttcttttatttcttttgaaacctgatgttcaaaagtacaaaatttgtaaccttgtttccaactgtttcaacttatcttgcaaagcttggtttactttatttacttacctttttactttgattttctaaactttattcaaatcaatccaaaaacttgtgctattaattggataaatgtcttaactccctcctttcacttgtctttaga

SEQ ID NO: 30577 - DNA, 1501 bp, Oryza sativa
tccgaatttcaactatttctaaattgtatttctatatagactctagtctcctcttctaatatttcttattttttaattccgaatttcagctattttaaattgtatttctatatggactctgtctttttctttttctccgattaatgtgagaatttctagaccatgagagcgaacgtggaggcttctttttctatttctttaattatataatagattagagatgtcgaattgagtacgtagtatgtgcgagatgtagtttgacaagccggtgctttggtatttttggcagtaggccattcaattattatagctttacatgctctttaacactttagaagactgtgggggaataactttgagttgattgtagaagtaaaagtggattaagtcggtgtgtggctaagtcttatctaggcatgcaaagaatatgttcgtccaccgccgcctatgacgcatatatccatcctgatcttgccgctgccccatgcgtccaaccgagaaaaccggctccttaaaccttaaacaaaagattaaaaaccggtagagatatgcaaataaaatcatcaatcagagaaaaaaatttgtgctagtcaagtgtggtgatgaggttagtttatcgtgaccgcaagacttctgtcgtgactttgatacattttgatcttgtttctaagagatagaatatacgtgtaaaactgctaaaaaattagtgtacgttttcgggtaaaaacttttaaatataaatataatatactgtaatgtaattataatataactacattgtaatctctaatgaataaaattatatatttttcagtacttacatacaaacaagttactccgtatattataagttaattacatactatagaattatcattccgatccctaattaccacgctccattcggatcctacgtgccgctcgcgcgttgcatgccacatggaaacaacagtttatatataaactttaaaaaatatgtttttatttgatattattaaaaatagattattacaaattttaaaaatagattaattgatattttaaattaactttatatacaagcttttacaagaaacaaaaatcaaagctaaaatctgcatctgatgtacacgcagatgaagatgcgccggcacccaatcccaccacagcgaattaagcggatccaaagctaataatactcgatccgctgttagtgttagccgcgggcgcagcatttgtctgcatcgttcgatcggtttcggcttcattcattcatgtgctcccccctccccgcccacgcactagcggctgccgtccacgcacaaaccacgtaagcacgcaccacctcgcgcggtataaattccccgcgccctccactcattccattccccaaccccaaccattcctatttctaaacaacacacctcctctgcacttgctccttctcttcttctgtccatcgaatcgacaagaagaaatttacaagcaagaatggccgccaaggtgcatcctaacgtcgccg

SEQ ID NO: 30578 - DNA, 1501 bp, Oryza sativa
cacccctttcctcccctcgtggtggtaatggtgtcagcagctcctgcgggccagattcggcgttcctcagccccctcccgcagatccatcggtggcggtggcatatccgatgggtggatccagtgaaggcagtggcagtggcgtcggtagctcccgctagcggatcttgcggagttggcggcggtggcgtttccgacgggcagatccggcggaggcgatagtggtggcgttttcggcgactgaatctggcggttctctaccccctcctcctcatcctccgcgcccaagcttctaccgtagcagcggcggttgcatcggtgctcccatgggcatatcctgcggaggaggcggcgacggcgtttccggcgagcagatctagtgatctcccccttcgccccaaccttctcccgcagatctggcgatggcgatgacttctccgtcggatctaacggccgcggcggcgacccgcggacggatccggtagatttcttgtttgtgttgtttgtattgttctgtttatgcgatgatgatgtcgttgctgtgattgattttgggggcgaagcgggggaactcgcgcttgatgaatcggctagattccaaacagtccatcaccaatcatctaatggacaatggtccaaaacgttgaacaaacctgaataatagcacaagagccagaatatatacatatactgcagataattataaagtgcaagtcgtttttttccagaaataagtggtattaattcgttttggttcagtatcaatcccttcggcctcgcttcatcttcatggttgatcttccccccggccacgtatcgatctagtgaaatgctcctagtgtttccctggcctaattagcatgatgctagccaagccaaattaaatgaaaaaagcattatatttgcatactagatgtcggctcgcagtgccatttttctgacagattagcctgttgtggtatttatccatcgaccaaatctcaagctatctgctttaataaaataaattgactacaaggtttgatttaagaatggaaattctggtatatacgaaatcccccagcacgcttggaattctagttttttggaaatcaccaaagagtctgatggatatgagaactttgcctaggagttgcaaaatttctgtgtaaacaatactttgtagatgcatgccaaaccacttactctggcaactctgatatacacatcaatatgaatgaatgtttgttgtttttaataggaatggtccagcgtgaatcctgaaacaacaccaaactcactgcgaacaagtgaagaatgcaacttacgtaatgcactatgtgggagtagctacacccggattcccaatgcctcttaagcctaaactagttaagttaatcatgtgtacgtatctgaagatgtttatacacaaggcagcacatgcatgttggaagggttttcaatatgataaatattagaatacgagttaaagtatcttcagcttttggctgagcactagcctt

SEQ ID NO: 30579 - DNA, 1501 bp, Oryza sativa
atatccatttagaatgatatgtaggaattgcaggtagatcagaccaaaatgggacatgtaagttagcccagacaaaatagaagctgtatatttctccaaaaggttattctgatactgctgcaaaccaaaacagtaacacattatctgaattatagtgatttcagaagttgaatctgggcagctacttgggtattgaaatcattcaaactaagcacaagagctcaacagaggattttgagcagttcaaagacatcattcttttgagttttaaattgtctcaaattgaaatatgtgccacagtagtacatgtgtagtttctgaaatatacctacttccaggaacaccaatgagcatactttgttttgccattgctttctgaagttgtcgtatttttatgaaaatctccttgccttcactaaagctgcttcaaaaacaagcccttgatatgacatcagctgaaaaggttctcaagaactcatcaaccacaatctctgcactgcctcctctgtcctcaacttcatttttccatgagttcaacattgacattgcagcctccatcatcaaattcaccattccctgtggatgtcattttaacaataaattgagttttagtatatgctacatgtagtgtactagaaagttgctccaagaaaaatattgttttttgacagagagatccatggcccaatacaagtgcctgcagataattaccttaaccctttccatgaatagttcaggtgcaatcacttttctctggtgtacccatagatcaccatttgatgtcagaattcccataccaagaagagctccacgctctttttgcaagtagcaaggttttccaagatccaaagatttgcagttggctagctccttcaccatgtttggatcagtaacatttaaaacttgtatgcttccagtggaatacaggtagatggaacctaacacaacatcaatgtttcaggaacttatcagctttaattttaaatatgaaatgcacaaggcatccgtcgatgttctaaaaataaatctattaggacatggttacagaacatacaacaaaagaatttacagtaatttaaatagcttatatgtattagaattagattagatttgtatagtctaagtatgtctcgtatttgtatatatctcttatttaagagtttgttgtaatctctattgtatttggctatataaatataatcgccccccacgttgggaagtgtggcgtctcataattttctacatggtatcagataccggtttccctctcctctcctaattcgccggcttctctccacgcgttgccgcgatttttctccgcgccctaccgacgcgtttctgccgctcccgcgccgcgccctgctcgccgcgccttccgcgtcgcgcgctctgccccacgccgcgtcgcgccctgccccacttcgcgccgcgacccagccgcaccctcgctcgcgccacgccccagccgcgccctagccgcgctgcttcctcctctgcgcca

SEQ ID NO: 30580 - DNA, 1501 bp, Oryza sativa
agacccttgtcaccatgctcatcaactctgacatgtcaaggatgacaccggcaagcctcttggggaagatcaacaccaatgacatgtataagttgaagaagaaggaaatggaggaagcctcaccttccaagaagtgcattgctctccaagctgaagttgaagacaagggcaaggtgaatgacgtcaataagaacttggaagaagagattgcacttcttgctagaaggttcaatgatttcttgggaaggagaaaggagagaggaaagggctccaactcaaataggagaagaaataaaagacccaataagactctctccaacttgaggtgctttgagtgtggtgagaagggacactttgcttccaagtgcccttccaaggatgatgatggagacaagtcatcaaaaaaaaagagtggaggctacaagcttatgaagaagctcaagaaggaaggcaagaagattgaggccttcatcggggaatgggactcaaatgaggagagctccgcctcttccgggtccaaggaagaagatggtgatgatgcaagctccaagaagaagaagatggccgttgttgccatcaaggaggccccatcactcttcgctccactttgtctcatggcaaagggctcctctaaggtaacatctcttagtgatagtgagagtgatgatgattgtgatgatatttcctatgatgagcttgtgagtatgtttgaggagctccatgcttatagtgagaaggagattgtcaagttcaaggccctaaagaaggatcatgcttctttggaggttttgtatgaggagctaaagacttctcatgagagactcaccatttctcatgagaagcttaaggaagctcatgacaacctcctttccactactcaacatggagctctcattgatgttggcatatcttgtgatttgcttgatgatagtgctacttgacatattgctcatgttgcatcatctagcatttctacctcttgtgatgatcttgtggatatatctagctctagctctagctcttgtgtatctatttgtgatgcctcacttgttgttgagaacaatgagcttaagtagcaagtggctaagctcaacaagagcttggagaggtgcttcaagggtaagaacactcttgacaagattttgagggagcaacggtgcatccttaacaatgagggacttggattcattccaaagaagggtaagaaaccttctcaccgtgccactcgttttgtcaagagcaatggtaagtattgctccaagtgtcgtgaggttgggcatttggtgaatgattgccccggtggtaagcctcctaagacatgcatatttgattctcattatatgcttaggaagattcatgatggtagcattgttgctagatatgtgggttcccctatactcggtggtaaaaagaatgccatttgggtgcccaaagctttggtctctaacctccaaggacccaaacaagtttgggtacctaaaagagcttgatcttcttttgt

SEQ ID NO: 30581 - DNA, 340 bp, Oryza sativa
gactaaagatcccgggggggcctgacaggcccagacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagattgtttctccaccagtgctactatcgcaactgatacgctcgcgtcagcaactggaacgcgtgcgtcagttagacttagacttagacctgaaggcaacgagtagcttccctttcatgccgcggtgaatccggaagc

SEQ ID NO: 30582 - DNA, 1492 bp, Oryza sativa
gggggggggagggaatgggatacagatgtagcaagcatatacaaagtggagtagtaaaaaataattgtgggtattgtgctaccaactttctgaatttgtttttgtttctgttgtatctaacctgatttaaggattttcgaatatgacatgataacactagctagattgctctaacaagtgcatatatattacaggccagacactagcttaatggaaaattacaaacctttgaacatgcaaggtcttaaaaatagtcctatatttccactgctgttgactgaacactatcttgcactagttcattagtattatctgatcaaagtcaaacagcgattgatcccgtgcaagtaggtagtgagagagagagagagagagagagagagagagagagagagagagagagagagagagagtacattagatatagaataataatcaggcgatcattgcaaaacctacgcagaatgcactagcatgaacaagtgatcaagataaacaaacagacacaattgcagattgatttatctcgtcaagattgatgagcatgcagcaacttgtttaatgtcaagtcaccaaacaatgccaatatatgcctgcaaagtgaaggtagcttttcggtcacaggtgcatgcatcatgttcatatgaacgacaaactactttagaaagtacgcacatgatcgatcatcacttcactttgaagtggatttgcatgacaactcctattcgatcaggcagtggacactatgctccctatatgtatactctagtttaattagtttgttgagagcaaaagtcaaaatgattatttagtttatccactatcatcaccctatccacttcactttttcagtaagtcaaccggacatgattgcattttcatcgcggtgtaagttttttttttgtgagccgatctgaagtaggagtattaggttatgttctttactctgtgttcccaacttcacacccaatcgtcttccacggacatgtttctcagactgtatatatttttttcataaattttcaacaggaaattttctttaaaaaatcacattaatctattttttaaataatatttaatatttaattaattatgtgctaataaatcgttccattttattgtgtgggagatgagttccaacccattaagaagaacacagcattcgttacatgcaccactcagctttgggccggtccagacaacaatatgggcttcagatgggccgtaaaaatgcaggcccaccttaattttaggcccataacaactctacattgctttcctcctccgtcgattcgtccgccgacgagacggcagctgatgcttccggtgctctccgccgacctccgccgcgcgcccactcccttctcccttctccctctcgctctcgctccgccgccgccgccgcctcctacccttcttcggcgccggccactgcttctgccgcgagccatctcctcctctacctcgccgccgccgggccaggagatggagg

SEQ ID NO: 30583 - DNA, 249 bp, Oryza sativa
agaccgtttcaatgcaccttgctgacatcttctgcagttcttggatcctatttaggaacattagtcaggaagccacatctagctccactgaatattctaaaatggaatgacaaattttttataagaatatatcatcaaaaaatgattactgaagttaaggtatttatgtttagtttaccatgtttttaaaatcatactgttatggtgatcccagtataattccattggctcttttttttatgcactaga

SEQ ID NO: 30584 - DNA, 202 bp, Oryza sativa
tcattattcggcatattttaatccaagaaattgaaacaatgatcatggcataagcagtgtagggtgatcttaacgtaaccagtagcatactatgcgcatcatgaatgtcagaaacatgaacataccagtaacgcgataacatgctagaggcatcatgtagaacaggaacaagaacatagcgcacatagtatagcgctaacaa

SEQ ID NO: 30585 - DNA, 742 bp, Oryza sativa
gtcttctggctcgatcgatgtgttggataaccttttttggcaatttcagagtgcacatgtaataggttggaagtgatgagaactgaattaaccattgtaagtctttgtccatagtttaagtgaattgctatagatgggagtcttctttgtccatagtttcaattcttcagcctgcgaattgaaatttcccgttcgttctcttctgggtaaccgaagttgaagtgctatttgatgcggactctgtatgatttgttgtgtgttggactgcggatgttgcggacaaaaataggtgaggacgggcaaaaatttcactggaagattaggtataggtatatagaatgttagattagaggtagataacgtataaacgatgaaaccaaatagaaatcgaaattttttcgttcttttttttattttagacggaagatggaaacattttcaattttttgaagtatataagtagagatagagattagccattttcgttttcttagagagtactatcacgaaaaacgtggtagtttattaatctataattaattaagtattagtaaaaaatagattaatatgttttctaaaacaactttcgtatagataatttttgcgaaaaatgcgccttttagtagtcttagaaggaaacaacagccttaagggacctaaactgaacttattccgtgtggagcatacacgcggcccaagaggcggcatgggaatcgcggcccgacgcaggagcagccacagc

SEQ ID NO: 30586 - DNA, 1501 bp, Oryza sativa
gcgggcgcctgatttggggcatttcccatatgttttgcggtaaaaaacagagtaaaacattcaccagaaatgcggaacgatgtcgtgttccttgccattaaaacctttcgaaaataaatatcgtgccgtgttcgttggtctctcgttcctcaacctatccaatccgagccgaaccgacctcttgcaatataatgctggtggttcgaacttcgaattctaacgggccggtcgagttgggttgctaacattatagtgatctaattaacatatggtgagctttagccgcacaaattagaataggcctacaagtagtaacctggaaaaagttaggaacgttaatacgatagatgaacaccacatcctttttatgtagtaggggtagaatttgctgacccagtcttcaaagacgctcataggagtagggtttatatgtgtgttcatgaagatgagtgtgtgtgtgcatgttgtgagtatctgcgttgtaccgtgtaattctaaaaaaatatatactttatttgtctcaaaatataatcattttaaattttatcttaagtcacattatccaaaattaaactaggtttatagagaaaataatgatatttataatattaaatgagcatcatcataattgttataaaatgacaaaattttgaaactatcctcataaaaatactgagttataatatactatttcatatgagaactagattgatacgtcaatgatatatatgatggttttttttttaactacgtgatctttgagatgtatcaaattaatagattgtcttggctggagttggagtctctatgttgtgtaagcgcttactccctccgtcccgaattaaacaagcataggacccttggcatattggattgttgtagaagatacaagaaaatgagcgcaacaagttggatgtagttgatcacttcaacacttgattgaagcattgagttaattaacctaaagaatttactacatgaattcacgttaaattaagaaagatactaacaaaatatgtgcgtcaatctgattatctttggcattagatacatggcgtgcttgctcttctcaagaaccaattaacattttgcctttttccccattaatttcgttcggaagcatgttctattatgggactgaatttccaattacgttgggcctagaccaaattaatccaggaatagaactacgtactaatgtggatcttgacgtcctttctttaatttgctttagtaccacatcgcttacccaagtcggggtctacacggtcataagcgtaacaagaactccctgtggcaccgcgtggtagacgtggttagcaatcatcttgattgatatgaaacatggttatctctggtcgcaggaatctcagcacacgacatgttgtgctcagccattttgctattcaatatccacgtttgccttatagattattacacggatttcacctcttttttttcttctgttggtgctctcagttttataatccgatgtttaaaa

SEQ ID NO: 30587 - DNA, 1501 bp, Oryza sativa
tttctccttctaccctcggtctcatccgtggggaggagccggagtagacggcacggtggtgaagctccgagccggcggtgcggtggggaggagttggagacggcagggtggtggagctccatggaacgagtcggcgacgtggtggggagatctagcttgtgtcgtggacggcgacgggcggtgggagagagaagtggcgacgagctggggacgacgcagcccactagatccagcttccagcatgatggacaacaatgggcagtgggagagagaggcggtggcgacctggggacggcgctggcccactagatctggctgccggcgtgctagatctaggagagagaggcggtgaagaggagcttcgtcaacaacgacaagggagagagagaggagcggaaggaggggcaggcggagacgggtgaaggggcgggtggtgacaattgggtcaacgacgaacggagagagagataagcaggaggaggaaccggaggcgacgggtggaggggcgacgatggggtcggagcagcaaacaaaaagggatgatgagggagaagctgggcagtcggtgggctaggggtagggaaggaaaaacatacatgtggcttcgtgggctagagcacgaccgttgtggactagaatacctccactgttaccttagatttggtagggctggttagggctggttggagtaccctccattgaaagatgcgtgtctaatgaggcccagtttagtttccaaaaagtttttcccaaaaacatcacatcgaatctttggatacatgcatgaagtattaaatatagataaaataaaaactatttgcgcagttagggggaaaaagcgagacgaatcttttgagcctaatcagttcatgattaatcataagtgctacagtaacccacatgtgctaatgatagattaattagactcaaaagattcatctcgcggtttctaggcgagttatgaaattagtttttttattcgtgtcaaaaatctcttctgacattcggtcaaacgttcgatatatataacacctaaaaattttcttttcgcgaactaaacagggcctgagtacctaagtccacctatagttcacttgatgatactactatgtgcgtttttcagtggatgccctcatagagaccaaagagataagggcagattttgtcgtaagcaatgattggatttcacgtggcctgcctgcggagtaggtgtcaaagatctgcatgcaagggctgaaccactgaatcagcccactgaatgctgacatctcaaatgacgtatgcatttcccgttgggtatagggaccaccaatacatttatcgataaattttctcctaaaaatttaacagatataagatactttataatacaacgaatctgaaaaaaaacatgtctggattcgttgtactataaagtgtctcgttcggtgctagattgctatattatgggacggagggagtactatctataaagacgatgagtagtagtagtagttcagtt

SEQ ID NO: 30588 - DNA, 436 bp, Oryza sativa
tcctgcagccctaataaccatttcagctggtataatttcgtcttgtttatcaatgcatgtctgcacctcatgaagttgtttccccttgaatgttttacatagttttaaagtcaaatgagattgtgctgaggtttagaatcttccttctaaaggtgtatctaatttgatatttatatgggcctctatggatgcagaaaagttgagaagcaacacttatttggatacaattgatctttgagaatgacatagtgtacatatttaagaaatttttgaaggattaataattacaaatgcagaaaaaaagagacaattttgcccctgtgatgtacagttctgcattctatattagtatgtcctgcagctgatgcctatttaactgtgttatacaggcttcactcttctcccttgacatgcttgacaataacagatgaccagc

SEQ ID NO: 30589 - DNA, 1501 bp, Oryza sativa
taatatatatatatatatatatatatatatatatatatatatatatatatatatatatatatatatatatatatattctttactattaaaaaattgaagatatttttgtctagtactttggtacatcattcgtgtttaagtcgatctttaattttaattttatgttatctccactacttcaatttccattgtctgttaaaaaaaataagtccgactcaaagaggtaaaaaaaagtccgactcaaaagccataaaaaaatatctgtcgtcactcgtcagtatcgtccgacttaaaaggaaaaaaaaaaggtctggccagttaaaaaagaaaaaaattccgtttggatttttggcacgggttttttttcccatctttttgcacgtgaaagagttttttacgtgcacgcgtttaggctcttgttttttcgtccgtttttttaatccgatcgcgcctctgggtgcttttgttttttttcgtcaattttttttatcgccgttttttttttctcctgtgtggttttggtttttctgtttttaatccgattgttcgctgcacgccttctgagttgaaccctgacgctgcgccgccaccgtaccgattgtgcgttttctcctccaatttgattaaaaaaacttccccactactctctcatcattttcttcattattttccttttcgattcggctttaattcgtcaaatttaatctacgtttaacaattgccgatgatgacggcgatcttccccggttgtttttatcccgagctgattttggaaaaaaacggaaatagaagattgagaaccaattttgggtgatcgagaaagattcggctggatttgatggggaacaaagagttttacactctgattttggaaaaaacagaaagagaagatcgagtggataaaaactctcaaccaattttgggtgaacgagaaagattcgaccagatttgatggtgagatttgctcctctggggagatttacttcgacaacggtacggccacgggactatcttcgggaggttgaagatagtagtagactctgcgagctgtgcttacggctctacttgtggctgggtcgaagggaagcaggccaaacggagggagacaacagtctgaccgaagatggtagtagactgtgtgaactgcggttatggctcaacttgtggctgggttgaagtgaagcaggccaaacggagggaggtagctggcctagggctaaaaaggaaggaggctatcgaccctaaacccaggaaagattttcattaacttttttaattataatctatagcgatccctgtcgacgtttgatgtcgcgattccggtatttgcatagtatggggatcgttggtactaggatatatgcgagattgtaataaaagaaatggggacgaggatttttatacaggttcgggcccctgaattgtctggtaataaccctactcctattggccgaagccggtcgttgctcttattcaccataatcacaccagtacaatattt

SEQ ID NO: 30590 - DNA, 768 bp, Oryza sativa
aacctttaggaactccccatcatcctcacacatttgtagctgtacccaaaaccagagtcagtgcgttgctcggcgcattaacatgggagagcgttgaggggaaccggcaggaatgagcgagtcaacggatcaattcatggaggttcttcacctcctcatccaactcgtcgtttaatttgctgcaccggcgaaggaaaggagaaccctgcggccacgttacagaggctacaccgcagtgattgctataggtcgtggcagatgcgccactgctctaccttcaactgtctttctcttgccactgcaatggcctcaaccttctcctctctcttgtgaccgctgctccctttcccatgccgacgttgccaaagaagaagagatgaggatcgcgagagagacaaaggaggcagatgaggaataaggggtgatgccattgacatgtggatcacactgttcttttattaattattataaatgctatgcacatgccacgttaatgatgacaaagtcaaaataccatctggatgtcacttagaatgaaaccatcgtctaaaactgccaagagattcatatgtcacttattttaaaagttaggggacacgctataccaggttttgtgattgagggctacgaattataatctgtaaagtgcacttttccctacaaaattcgggtggttatgttcgatagctgacatggtacatattcaaaattaagttgggccgagttgggttactaccatggagcgatccaaaatttgatgggcctaaa

SEQ ID NO: 30591 - DNA, 1501 bp, Oryza sativa
tcatacatactagtatatccatccttgaaatctggaatcctaacatagctccacacaaaatgttaatagccagctatgaacatatgcagtaaaacttggggtagcagctaggaatgccattgagatagaggtgaaaagttcaaagagatgtgacaactggatgagccttccctcgtgcagtaggctctctatataagttctaataaaagtacagagaaaaaggttacataaattgcgagtaaaccaataaaataaagtatgatgatatggataaagtagaagtacactggccacctatcttacacctctattacagttctctaagccatcacataattattgtttaactcttgttcgggcattgtgccatctgcagagtggatatgcccaagtttctgggtttctaaattgtcaagcaagatattttcatacaactgtagataaattaagctgtgagtaccagttgtacatttgttaacattcaatatcagctatatttctccttcgagtgtcatatattatcattcgaaacggagaattatgaaaatcgaaaataatggcaaagttaatcactaaaagtttgtacaggcaagtaatttgaaaatgatggcaatagaaaatggtggccccagaactcgtcgtccggcaaaaaaaaattaacttgtggagctatcatgctctcggttggtctcagtaggacaaggtgactttactttctatggcaatttacttttttttttacagtgatccatgacacttttgttgagatgttacttggctctttggcatcttttaagctattggactaggagtgtgtaccggccgataattcacacaaaggttacaagatgcttccacaatgaaaaataataataactgcgtgtctatattgctagctgaaaattgctgcaaagacaatgcgagaaaacattagcatttttatgtgttacgcacattacttcagtagtcacaacaattatactttggaggcactcggagtacttaaaaaggaactgaaggatggataaatagtcagtcatatttgctgttgggcgtgttagagtatatagctgctgctgccaaatggcaatcgtgagcaaggccatccccagttgtagcctgggaatgacactgatcttaccagtctctgagaatctgacaacccagtctaagagtggaaggtgttccgaatttcaccatgtttttacccttacgatctgtgttttgttcttttgctggccttgctatccatgtaccatgtagaagactgatttgtcttggatgtttgatgtcacgcccagaaattcacgaaccagaatttctaagctgaatgtgcattaaatccctgtccaggaccagccagggtatacaaacaacaattgttgacatacagatccacgacttataaaaatataaaagattacaaatgcagcggaaaagataaaagcgagctaaaccgggatagcttgacttcagcagcggggcgactccactccacagg

SEQ ID NO: 30592 - DNA, 236 bp, Oryza sativa
ctcctctccgtgctcctctccgcgctcttcggtgctagccgtgtcgacgacgtcgagtccaccctcgcctccgcggagtcctccttcggcgtcgtccccggccgcgtctcctacaacgtgctcggacgagtgagaacagcaagagagacggaagaaagaagggagaggagaggggaaagaaaggtgacatggacaccctgacatgtggggcccacatgggtccacgctgactcagc

SEQ ID NO: 30593 - DNA, 1501 bp, Oryza sativa
ttttcccttcgaaaccaaaattccaaatttcaagaattctccaaacgatctctgtgaaaatcattccatcaattcatgtctataaactcatatggaagttctattcaaaatcacataaaaattgaatgaccactatatctctccctgggccaaaatcaaccacaatccaacccgtcaccctctgtgtcacttcctccaccatctccctagctctgtcctgcacctttccagcccactgccactgcaccccaacaaaggcagctgccccaaccgagtttattacgtgtgccacacaatgcccctaggtgccttgccatcgctcctcccgaccattcgctcgaccacccctctatcttccactagcatatccccccggcccctaatttgtttgtgtatgggtccatatcctcaatgaacggaacatgaggaggtgactaattctcataattattaataagttaaaaaattacgtggagaagagatgggaccgcatagatgtcgtacgctagcgaaacaaccaggaccgtcaaacttgcatctacttaaagcaatagtatgagtccctcgatgaaaatgcctaccaaagatctccatgctgcaccgcacatccatgctaggttttcataccggtccataaacactcctttagggagatgcttgagcaataggcccaagcagaactaggctttccccaagtccttcatctcaagctcaatattaagataagccattgcttgtttaatgtcctgtgtggtgccaaggatatttagataattgacatagaccgagatgatacaaaatgcattcagggatttctttataaacacagggggacaatcataattgtttgggaaacctctctttaggagatatctatttaattgattgaatcacatccttccggattgttttgatccgtacattgatcgctgcaggcgaacaatatagatgttgcaatttcctttcggatttgggatcttgagtccttcagggactctcagataaagttccaaatctaatgccccatacaagtatgcggtcaatagatccatcaaccgcatgtgtcggttcacatgctccatgaacagatcatgaggaggtgattaattatcattattctaagttttaaaaaaaataagtagagaagaaatgggaccacatagctgatttttgggaggcctgcatgccctaggctagcgaaacaaccgggaccacccaactagcatctgtttatagcaattgtataagaacccctcaatgaaaaagtctaccaacgatctccacgctgcaccgtgcatctatgcctagtttgcttaccctccctccaccataaatacgcacccaactgtaacatgtatcaccaaacatatcgatccatccctctaccagtcaagaaacaaggaagattacaccaacaaataaactagctagccaatggcctcgttgtcctctttccggcttgccgtggcggtggcagcactgttggttgttggctcatgtg

SEQ ID NO: 30594 - DNA, 1501 bp, Oryza sativa
aacatactcacaagctcatcataggaaatatcatcacaatcatcatcactctcactatcactaagagatgttaccttagaggagccctttgccatgagacaaagtggagcgaagagtgatggggcctccttgatggcaacaacggccatcttcttcttcttggagcttgcatcatcaccatcttcttccttggacccggaagaggcggagctctcctcatttgagtcccattccccgatgaaggcctcaatcttcttgccttccttcttgagcttcttcataagcttgtagcctccactctttttttttgatgacttgtctccatcatcatccttggaagggcacttggaagcaaagtgtcccttctcaccacactcaaagcacctcaagttggagagagtcttattgggtcttttatttcttctcctatttgagttggagccctttcctctctcctttctccttcccaagaaatcattgaaccttctagcaagaagtgcaatctcttcttccaagttcttattgacgtcattcaccttgcccttgtcttcaacttcagcttggagagcaatgcacttcttggaaggtgaggcttcctccatttccttcttcttcaacttatacatgtcattggtgttgatcttccccaagaggcttgccggtgtcatccttgacatgtcagagttgatgagcatggtgacaagggtctcatacttctccggtagagccctaagcatctttttggcaacctcaagatcggtgtagtttgccccaagccccttgagatcattcacaatgacattgagcctcccatacatgtcattcacactctcatgaggcaacatggagaatgtctcatattggatcttgaggaagtgaagcttggcatccttgtactcacttgtgccctcatggatcttcgccaacttgttccaaatctcatatgcggtctcaaggttgctcactctatcaaactcttcttggctcaaagagttgaacaaagcattcatggcttgggcattgagttggaggttgcggtgatcaatctccgtcaagggcgtgccggtgattgcaaagcctacatccacaatactccaaatatggaagctcatagctttgaggtgagtagacattttaattttccaagtggaatagtttgtgccattaaacatgggagccttccctacgtggttcacctcgttcgacatcttctctctaggcggtgaagcccaatcaagagagaccaagctctgataccacttgtaagatcgagatgtcgactagagagggggtgaatgggcgatttaaaactaaatgacacctaatcaaaactaacctaagttgctaggcttggtgagggtcaactctaactaagcaactaagttatgttttgcaaacctagggtgatagtggctcaaatatatctctagaaaagtaaatcacactcctatgtcaatgtttagcaatcctagggtgatatgatctcaagtttgtctctaga

SEQ ID NO: 30595 - DNA, 1501 bp, Oryza sativa
gcaaaggcactagtagtatggccacatgagatgaagactgaattcttgaagcatccacaagctgacagtagaccagcctttgtcccctagtcagccaactgttcctccatcagtgtcactttctcagctaatccaacacacagaccctctttgctaatttacaccttgaaagatgcaattcttcctatctgcagacatgcagtcatgcagctgagtggcctgtagaagaaagggaaagcagagacagccagacaggggggcctattggcaaatttggcaaatgtgcaatgtgcaagaagaaaagtagacgaaagaattaaagaatggatttttggaagaatgtctgtcattgaattgaattattagtatcttaatgatttgtttaaaatattactagtatcttaatgatggcaggccacacatccgttattcttttgtttcgtcctcactcatcgccgctccgccattgcccagagcttttcttttctacacaaagggaagggaaagaagaagcaggagggtttggtatctgaggctgagcaatggggctggccagcgacagccctgcgtcgttccccttctccgccgccaagctcgccgcctcgccgcgcttctgcaaccccatcagcaggaggtaacttgtaccaatgctgttcctttcccttccatttctgagctcgggtgtggttttgccgcggtttattcttttgcacaaaatgcaatggcgagtgcatgctggtgttcctatagtttgctagttttggcaaaaacttgtcctttgtcagttcagatcagttgcaactagtttttgttcattttgctgcgcaagtttggattgttcatgttacatttctctgggactctgaaagaagcagagaaaggcatagaccctgctggctgctgcagtgcaggtgcaggtgcaggtgcagccactccatgaggagaggagattggagagggtcacttgccttgtgtaatggtggtaggagaatctcagccccgccacgccggaggtgttcgagctcggccaagtggggtcggagtttaattctccgaatcccttgaaaaataacagggggttggagtcgaattctccgaacccctgaaatactggaatcgggaggtgggggtcggagttcatttctccgaacccgctgaaatactggtttctcgcaaatgctaccttcagagttcagattatcagatgacatctgaagttatcccctgtattactgaagaaagcagtggcaagccttaaaaatgttcatcggaatatcggatggtcccgggcatcacaaaacgtctgcacttttttttttatctcgtcccgtcacttgtctagattcaggtccctacctcagcattctcttttcttatgctgcatctggttctcaacctctgaacaagtcaatgaaggttttttcccccccttctctgtctctctttcctaaaagaaaatgcagtcaattttgggagaaaaaaattgcaaacgttagcaatt

SEQ ID NO: 30596 - DNA, 1501 bp, Oryza sativa
gggccaacttatatagtacacattcttagatagcacagctacgataaaacacaattaatacagcctacccaccttatggagaacaaggcataaaaaatatcaaaatatacctatgaccgccataaccaattattgtcatgtgatgagttcatcagagatttacatgaaaagaaaataaatatatttacacaaaacccataaccggcatcaacgccaatttctaaaccagcagaggccagccgacactagtgatctcggctatcaataccggtggctgaaccgacagcgatgctcaggctatcatagtgaattcatatagatttggtaaatgcccaacccggctggcatgaaatggcattaatagtcaataattgttggaactatgcatggcaacccgtagtgatgggtgatagtgattagctcatgtgtgctagtgcaataaaataccattcatttgaaaaagaactagtgtgttgtgtgatgcaacatccaatggtagccccccacaggaccattcatatgaaaaagaactagtgtgttgtgtggtgcaacatccaatggtagccccccacaggagcattaacttatgccatgtctcttctgctccttctctggattatagccatggatttgctcaacgcctctaaaattgaacattcctctattgcatgtatacttattggtccacttgttctaagctatctgttgaatatatttctcaaaatatttagtctatccctataatcaaagtagataatccataaaaaaatacagtcaataatcaatttcaagcagggcctaagtgggcaaacttatatagtacgacttcttgaaaagaatatctacaataaaagacaatcaatacagcatacccaccttacagacaatagtgaacagaaaatatatgtatggtttaattattgccatgtgatgctgtaaaataatgcttcagatttaataagacaatacaactacagaaactccaatcaccatcggttcgtagttgatgcatcactatcagtttttgaactagaagaggtcatccagcagtggtggcctcacctaccactaccggttgatgaaccgacagtgatgctaggtctatcatagcccatacacatgggttggtagggaaaaaatatccaagccagcatgaaccggcattatatatagttaatcactgctagtctatagtaaccgttagaccggcagtgtttgcctactgtgtactagtgcaatgaaatgtcttttgtatgaaaaggaatattgtaagtgccatcaatatgaaagtgctcgactctataaaatgccatcaacatgcaaccactcgactctatgaaatgccatcaacaaatatgagtcaaatttggaaggagtccaaatttgaaaagattggagtttgatttgtaaagggataagttgtatacttgttcgggtaggttttctatgagattagaattacttatccatgttgaattcgtggctttgtgcagccacttca

SEQ ID NO: 30597 - DNA, 887 bp, Oryza sativa
tgcaaatccaacactcgctcacgatggcctccacctcgctgctctccagtttggtggggtcgtcgcagccggcgacgtagttgtgcagccccgccgcggcgatcccgggcacggcggagcgcaccacccccaccctcctcctcctcctctcctcccccacagcgacggggcagaggacgcgggcgacgatgccgctgcagcgacgaagcggagtacgcgaacgacgatgccgtcgcagccgccgccaccgcggcgcgaggcgagggcttcgcggaggcaagcgagagctccctaatgactcctttgctccgccggtgccggccacacgcctcgcggagctcgaggaggaccacgcccgggacgcgctcgaggccgaggcggcgaaggcggttttccagcggcgccgtgctgctggaagaagagagagagggatagagaagatggaggagtgaggatgatatgtggccccaccattttgtatttcttgtgtagatgatatgtcggtctcatagttttaattatttttttcaacatcaaataagtgtcacgtcaatgcacgtggaacgaagacctcgttaaatgagccacgtatacgccacgttagctaaaaccagacacaatactgccgagggacgttatttacacggttttataagttgagggataagttgtacctggttttatgctttcgaactcggcgataaattgagagacctcaagtgaacttattcctttcaattatttagctaggcttataccgttgctaacaggagtagttcaagtcctattttgttatatgtgatttataatatttcgaattttggtgttattaaattttggaggactgctacagtacggaatagcattataatgatacactttaatga

SEQ ID NO: 30598 - DNA, 1501 bp, Oryza sativa
tgatagtggtgctaggctcatctccgtccacgcaaacgatcaatgcagtactcttccaagaaattagtgggaataagaaaagtggacgtggcttgggacttgccacgtcggaggatatggtttgggtcccacaaaattccgtacaccagttgaacgaggacacgtgaggaaatggtggggacgggtatcctgtgatccatcgggataagtccaaaagatacggacatctacgaacgaattcaggtatacagagaatgagaaagttgaagagatgctggagctttctcctttaaacgaaagttgaaagatgctgtttgcttgcactgatgatctaagctgcatcatgttcatgtcaaagaatcttgttttgcttttcattcaactttgcacaatgaaatttggtttttaatcctagcttacgaacaagatctaattcaatttcgttcaattcgtccattgcctggtgtacgttgcctgcacgtacgagatcgaagataaagaagaagcaactcgaatcgtgtccgacgttggcctatggtgcaaatagtatgaccccacatgtcagagaaacaacaaataacaagccggctgctctactacttgggctctgggaaggatttaggcccacggccacggcgattggaaatcgcaggagcgcatgttgctgctttgtttttgctgggagagagtttagtaccacctcggctattcagctgggagaggcggtcgcgagagctataaaaggagccggagggctccgtttcaactcatacctttctcggccttttggctaagatcaagtgtagtatctgttcttatcagtttaatatctgatatgtgggccatgtgtccactttgatattaaatttattttttgtgggggagggtccaccacagtggcttgccactggggccctcgcgtgtcgcccaggcgttgcactacagcccgggcctggcgcaccccaaccaaatcaatcttaaatttgaacgacaataatgtataatgtctttaaatcggtttcaaatctacttctctgattaagtttaaaattttaatttaaaaaattagtctaaagaggtgctctgcaaaatattcatgatttggatttgtagtgttcttttgcaaaatttgcctccttccattagcgcaggaggccgcaatgaccaagaaaaagccacacccaaaatgaaaatgttactacttgtacaatagaactagattagcttatctaataaaggagtgttaacactttaatctcttcacctagctgtagaattttacattttccctgcccatcttttccttgtaaaatgcattcatgcagtaacaagagcaagcatgcagtttgatgatgattcaggaggcagcagcgtaggtgacagatgacgccttgtgcctccgcctgctgctcatcatcatcgtcttcccgccaccatccgacgaccactgagactgcgagtgagagctcttcttcgtcttcgtcttcctcctcctctccgc

SEQ ID NO: 30599 - DNA, 201 bp, Oryza sativa
ctctccaagggggcaaaacccaccccccacctcggtcaaaggtcccctacctcggtcaaaccagcctggtgctttccccgccacctccactcttatcagctctcgtctcagaacaacgtagtaacgtgatgttcatcgtgcagtaacaccatgtcttacttgaagtaacgatactccaacccacctcccctctctccaagg

SEQ ID NO: 30600 - DNA, 1501 bp, Oryza sativa
agcccttgctaccgacgttgtaaccatgggtggagagccccgattaaaagctcgcactaattttttttcatacatagagagggctataattttgtatagtttgttcaacacctccaattaaatattcctagatccacctcgcactagacaaagacaaagatgaaaccaaagacacgagcaagatggaaggaagagatgatgacaagttgattgcgtcacatataagacatcatctcatcgccatgataatgcactaatgctagcttcactcttgagcaaaaacaaatcctcaaagtgccaaagaaacaaagaagagcagtgccaatcacacaatcttttccgagtgctgatcaagaaccaaccgcacaagaagatgatgagcttctttgccacgtggaaccacttttattttttttgtttgttttggttttggaaaagcccctgagctcgacagttaacgttggaaaagagattattgttctggttcggtatcattctcactggtcgttggaaaagctcttgctttgctggacgccttgaagttgcaggtgggccctacaggtcagcctctgaggactttttacatcaagcaccctctcaccttgcagaatagggactagggagttgcacaaaagcccctcggaagaatcgaaacgttagaaaagaggacacgtcgccaaaagcgcacacagaccaactgacagcctggacccacaactcagccgtccaggccaggggcaaagcagtaaattctggtgggcggtgtgccaactgtaatcccgtgtcttttacccggaaacacaacataaacatttccatataaccccctcataaaaatgtgcaattcacatagaagccctcaccatcatctccatttctaaagcctctctctctctccattgcttcactctcgccatcaaatccccaaacccctcctccttctctccaagtcctcgtcttggttgtcgcaatcattcgtggggcgcgttaatccctccccaaattctgtggcagccagcttccccgcttgcttggattggatttctccaagattgattcgttccctcccaattcttcacttcctctatccatttccaatccaatcttggttttttgcattgtttcctcccgatttgtcttcctctcgctctccctctcccaccatatcttggactcggtcctatctgtccgtgcctcgcttccatcgccattgctcttttgctgctaaagtcttctctttggagggagagactgggactgggagctagctcgcccttgtgttgttcagggagtaaatgcgcgtccttggtggtgcttggtcccagcattttccgccccaaatctcgtccttgctgccccgacttaagtggtggagattccgtcaccggcggtcgtagatgaggaggaggagatcctcctcctgatctactcttcttcttcttcttcttcttcagctcctggctgctgctgctccactccccctgatccccctgcaggagca

SEQ ID NO: 30601 - DNA, 399 bp, Oryza sativa
gcgtcaaatattttgggatggagggagtataaaatagttcctactgaacgttgtcggctacttgttgattctttttaggtggtgtttgttcctgtgcacaaataggtctgcacatgcacatgcgatttctcttacagttattttggtgctttaaaatgctttacgtattggtaatattagagcctagaggtcaaaaactattttgtatagagaaaattatcccacatagccatctgttgtttattcaagaaaatattctatgtatcttctgggaaccatatgtgatacacaaattgaattttatgtccattgttagagaatccatttgcttgaatcaaaattagagaatcatatatctgatggaaaattgtctttttaccaatatgtttgccttgcaga

SEQ ID NO: 30602 - DNA, 1501 bp, Oryza sativa
tccaacgaggaacaaggcgatcagtgtctccactcaccactagcactgcaatggtaaacacacacaaaccatccagaaagtaacatcatttatcagccacatgcaagataattccaaccatttgtccaaaataatgatagttcactggtaaacctgaatgcaaattcaaacatggataacaaatagtttttttttttgcttatttgtatatcattgaaggatcccaaaagtagagtgtatatgaaaacctgggcacgagatctcagaaagcctttctgagacaggcactttcgatgatgatatagaatccatgatcatggatatagtgtactccaaaagagccatctcccaacctctggatcttaatggctgaagaaaagacatagttttcagtctttgcataaggatccgatagttgcagaattttcagagacatataagtcaccttagtgtaaccttgaatgacatgatccgtcactttgcttgggtcataccatgcattgcggacagccaatataccaaacttatccatgatcaatcttacctatgtcaccaaagtccaatcaagaaaagaattcaacctgactattttcaattcataaagaaatgtttgtgaactggaaaagtctgctattcagttagtcagtgagagttgataattcaagtttagctaatttttacttacttttgttgacacatttactaaagtatccattgaagaggctatcagctaaaacactagagattaaaaaaaacttaccagcatcacgccaactgatgatcgaagaacagcaacaacagatttataatacaaagatcgaacaacaccacctattgccctaatcatattcataagaaaccctgcaatccacaagcatagctcgaggaattttccccaaatcctattgagtggatttgtaggcaaatttgaatcattggaatccttcttattctgccattcttgttcacctacaccattctccttcacacctttcctcctgaaaactggcacaaaaatggctggtgcaaccagcacaagtgcagctaccctttctggtgcctcaaagtatgcctccactgccacaaggcaaccagctgagtgcctgaatccaaaccatcacacacatgtaattcatcaagtaatgcacacagattaaagtatagaacaacacatgttgtgttacatccgtacccgacaaggacggccttcttggcaccgagttggtcaatgaatgccaaagttgccatgactgagaaggccatggagtaggggttgataggcttggtgtcatcaccagaccagatggttcgggatgtcagaccaaaggcaggccgatcaaaggctagaaccttggcaccagcaatgcgggctagagggcgcatgatgtgggtccaagagaagaccgacgagccaaacccatgtaatagcactatgggcaaaccaatttggttttggtccgcgtttgtgatggcagagtctggagattggtcactggaatcc

SEQ ID NO: 30603 - DNA, 315 bp, Oryza sativa
tcgtctgtacttgctgcatttggttgtgtgatttttgtttttactcatttacttctgaaactcccatttgctgttggaatgctagtaaaacttttgttctagcttgtttgcgcaaattgccatgcctataaaattaaaattataaatcacatattgaatgtgtctctcttactccgtcaaataattccttttactgtcaattattcttagatacggcgttagcacacaggatgccctctgcccggcccgccactgttccgccttcttcttgcagagttgcagtgcaggggtagagagaagaggtaggtgtgagaa

SEQ ID NO: 30604 - DNA, 1501 bp, Oryza sativa
ttcccctggccgactcgccatgccgcgtctcgacggcgtccatcttgctgcaccaggagcacatacggcagcgcaggaaccgtgccgcatcacctgccacacgaaacatcaatttggcataaaaagatcaaccacacgaaagtacgaaactgctgctaatgataagattagtgtcactgtagcatacgcacattattctgcagcctatcttctccttacacaatacagtttcaggtgcaggttggttatctgaagacaaagtcggtgctgataaggtaggttgcagtgagcaaggcctcatccgaaaagcgaacgagaagagttagccaagtctctacaatgttgcaatgtgcatgtgggaacacaaacgatgtgcaatgccaagtttcagaatgaatttttgcaaccttcaagtcaacatcaaaccaatcagtctgattgagcagattttattatttggatatcgttgaacatatgattgaaactgaatgaacaaatgctccagtcttcaagagaacgatatacccatgtgaatctgttaaaatcatcaataacaatatgtttgcccctttctgttttattgtccactgaagtaaacagtcagtcaattacgcctgtgtcccggtagcacaacagtgtcttgtttgaaaatactgtaagcaactcatcagagatccaggaattagcatcagagaaggtatgctgcagatgtgtacggagaaaatgctcttaacatctactactaaatactaatacctcaaggcatgctgcagtcagccttgacatcttgacaaagttactagcagccttgcaaaacttcagtgagtgaacagattctgaaaaaaaaaaatcagcaaaaggtggagttattgggacaagttcaaggaatggatgatcttcattctgtacatttgcaatttgaagatcaattcctttcttttccacaagtttctgcattttcacctccctgtttcatttcttcagtcccaattcaaattgatgcagcagctggcattcggtcagagactgcaattcaagacattggcacttattgataaatagattactctatttatcttagtaacatccaaattcagaaaacaaaaaagacactgctccttcagtttgattgccttccaaaattaacaatactttgcccatcattttcttcttcttacaaaaaaattccttcaaaaataagaatgagtaggacaagcaacagtttaaatttctgatcgaattataaaactgatcaaaacaagttccaaatcaagctcgaaacactagttatctgaaaaaactatcacaaaaaagaagccccgctgctcgcgcgggagcacgcgtgagacatacgctgtctcacgctgacgtcggcgcgtccaataaattcaaatcccaccttactggaaatatcccacgcgcgcatcctccactcatctcctctcgaccaagatttcccccaaaaccctagaaatccccaggcggcggcgcggcgcgcgat

SEQ ID NO: 30605 - DNA, 1501 bp, Oryza sativa
aattaatgtgccacgccatcaaagaaataaggaccgttcgattctcgctctagacgttggtggtcgttggatcctctaattggcatagtatattctagacccttgatgaaactcctatctatttctagtccttacacatccttatacctcttttgtttttcgggcctgttcactttgatattattttcaaccttaccaaattttggcattgccaaaattttagcacatgcaacttgccaaaattttggtaggatttcttatatagttactaaaatttggcagcaaactaaatgtagccacttttttagtaactttatctaaatttaatatggttgaaaatgacatcaaagtgaactgagccattcattttcacccttccccctcccacaccgtgagacacccaccataacgctctgtcttctcgcactcgccgcgccgtctcgcactcatcgtcgaccttggagccgcccgccgccgccgctgcctcatcgactcctctccaagactccatcgccaccgctggccccctctccatctgcactgctgcacagtacgtatcctcccatccaaaacctccttctgtccagcggcaggcgcggcagccacacctccttatgtccttcagtccttcccatccaaaacgccaccacgtcgattcattccctcctggccgctctctagctcctcctccatggtgatgtctcctggtggcttggagctggcaacaccggaggaaggtagtgatgaagccggctcaagaaggcccaaaacgccggtgtgacgaacaatgcgtcaaatccgatagcggacaaagacgattgtagattaccattaagtaacttgagtacagttgaggaactatcaagtagtagtatttggatttgtaatatggatgcttatgttcagctgaagcatcaacaattgcaacttgctacttctgaatatcactatgagtttgtcctgattagtgtcggtttcggatgaaggtgtctgaacctttgtgtagacaatagaagggaaattcgatgaaaaataggaaaatgtgcggtttaattttggtttcatatagtcatcctgatttttaataggattattcttacatcagagtgagttagtgtcacaatgttaacccctacttatgtaattcgtgagtttctctgcaaagcttgagcatgggtcaaaatgattgcaatctatttgatgtatataatttttttatcaaggattggggcctcactaccttaaaaataatttcattaggaagcagcgaattcatggttgccagtaatggctatcatttgtagatcttttgaacaaagctgaagccatatccagaattaaccaatggatacagtgcattaggagaagggttttttttttggtggatcatggatagttgaagcctctatgttgagagtatgtcattatttatacttaacaggagagcttgctactttgcttgatatgccattattctttatttcctatgccccttcccttc

SEQ ID NO: 30606 - DNA, 1501 bp, Oryza sativa
accaggtcatcatcctcttcagttttgctccctttctgctttgcttctcgcaagaacttgttctcctcttctagctgagcacatcgctgcttcgcaaaagctagatcagcttttactgtttttagttcacggagcacaagttttgctttagcagccattgcattagcaacctgaaacattttggggggatatgagaaaggcatcactaatctgaaaatgtttgtccaaatacatgggaagaaaaaaaaaggtcttatttcaagccatattaaccataaaaactgataaccaagaacttagcaaaaggaaaataagtattaatactttttaagtacaagcatagcaaaggttttgccatattaaaaaggtccaagtttctgtacgttaaacttccactactagacccagcatgtggcaccttacatcgcgagaagcttttaattgggtttcctgggctgcagtttcagcttgatcatgtgaaagattaggaggtcttaatgtatcaaatgctgggttcggcatataagaattcgaattggcttgcttccttctaatttgtatcttctttgtctcctcaatgatattggatgtcttattgtccacaattgtgagtccttcctgttaaagaaagaagagaagaagaggttattgaaaccaatgtgatactaaacgagagaaaatggaaatcccagaaaatccagaacaacagcaaagagagatgtagagttgagaaatcaatcagatgggttgtgccattagttatactaaatataaagagctgaattaagctaaaaataggacattacttccaacgcatctctgattcttccaccaagttggttgacagaagcagcaagagcttccgaccttgtccgggatccagtatctcctgtcctgctgtggttttcaaatgaccagcgagatcgagattcctaataaatatcacaaattttgagaacaatgtgaacataaatacaacttggaacatcaagatatcctacttattctgctttgtttttctaatacttgccacctcacctgagctccagtggatgaatcaaacttgcgaggggtcttttgttttgtgtactcgtcagacttatgtgctgtgccatcctcatcaagaattcccttggcttttcttgccaaagtttcccatagcccaagcttgggctcgttcatacttttgattgatgtgtaactgtacgatgaagaagagccctattcagagaaattgacatgcttaggatacatcatttgtgacttgtgagacacacacagacatctgaaaggacggtgcaaagtgatcattagagaccaacatcagttagtgatttcttttatccttttggaacaaaatgttttgtttatctgtaggtgataaacaaatgggatgatttaaggagtttgtacattaaggaacaaaatgatcaacgaaccagcgaggagccgaaggtggtcgaatcagcacatggtggtttcttaaggaactgtgatgatc

SEQ ID NO: 30607 - DNA, 1501 bp, Oryza sativa
gtactcctgccactaatctcctctgcactcgattcaactcattcccaactgatagctggtgttcgtaactatgtactcctatgtgtttacgcctttacggtagcaggtccaatcgctatagtaaaaatactaccgtgtggaatttgctcagatggtcaaactccaaacactctggctaccatttccattcatttctcattagaggggaccggccagtgatggtctggtactgttaagacataatttttcaaagctatgagtgtagttggcatttgtttcatttgatggtatatatggcaaaactgttgtatgtgcacgagagataatggttgtctcacatcttatacaagctctcttaggtttactagaaccaaacttttctactttgatatcatcttttttttccctctgtgctcttgcattgttcacatgctattaactcacttactcacagatgttttacttgcttcaatattggatattttcaagggagattaagactggatattttgttgcccaacgattacaacagcgtacaatttaggaagcagactgtttttctgaaggattttttttttaataaaaggaaccatactgttaatctgtagtgatttggttacacttgtagttttcttgtctttgcagttcattagatcaaatccatgtttctacatagaatgactgaataacttattttaaacatgttttgctaaagatagagaaatacataatgctttctagttatacgcttcctctgcaaagtactaaaattatttccatttcccattctacgctactagcaggatttacacagccactcattcatttagtacttgacatgtttttgagtagttcgtttctgctttggtcatcttttcctccttctcttcgttaatctagttactttcatggagtataagctgggcatggttttgtttgataacgattcaaatttgcagtgtgtggatgcagattgatttttcagtttgcttcttccgttgggaccccacacaattgttcagtccagaaaatgtgagtttcctgccttgcagttgatcaggtcaatgccgatgcatctcccacgctccctccaatacccaccctcgactccacaccctctacattccaccgccttctcccacagcctccgccctcgccgtcccaatggtcctcccccagccttcgcctctgccgagttcccaggtaaccatcttctccattgtggaagacttgcagcatttggataggaggttcttaaaatgggaggttttgaagttgatgtgctctttgcaagtagaatgcatgttttcccccatttaaaatggcttattattgcgcccttcttttcatctgggtagcagaactagcaccaacagctaaaatgtccccaaaactagcagaacagctttggcactactaaaccctacaactaatgcaggttcagttccagacagtgcccagatgccaccacgacgccgccgccgccggagtgtggctggca

SEQ ID NO: 30608 - DNA, 1501 bp, Oryza sativa
cccgttagcaaaagtgtattaaaactcaccagttttcaccggaccaatgacagttagagttttaagcagatatttaacaattagcatcattggtaagactaaagctataataatagcccacaaaccaattccttacaaaccagtttgaaactttgagttgttaaaattgtttatataagaagtgataatttgttattagaaaccatccagatatatgcatcatggttttgagtttttgcagtattttaattaagttgctatcataattttcacttttgtagtcactttaaagctgattttattggccttagcacaagatttgagatgtgcccgcgacttacgttgattcaatggttataaagtctgttctacttaccaaatcaagatgtgaacatcactacagcttgatgagtacatgagaaaattcatgaggttcatggtttatctgtcattttttttattaaactccaaataaaaaaaaacggaattgctgtatatctgtcgacagattttttgttaaaaatctgtcgatttcttcaccgtatgatttactttgagatttgtgcgtgtgccttcgagtgaaaaaaaaatgacgctagagcagggaatcgaccacatgatgtcgggatgccatgacgtgcatcgtaccaactgagcaagaagcgactgattattttgctgctatacctaacgtttttaaaactttcaccgcagtttcatagttaattacagtgtaatttttaatagatgcaggtgtaatttttgttttacatggatggtaatttttttactcatggttgttttgttatactgtagttaacctaattgtttgaggtgtgatttgatattttcggactatatatgccgtcatatttttcataaaaaaataatcggcacgtatttacatcgtaaatcttcaaatttacatatgtaattttaatatatttacgctataagttttaaaattacatatgtaattttaatatatttatagcgtaagtttcaaaattacatatgtaacccctaaaattacatgcgtaagttgatgtaagttgcttgtttttccttttctttttagcagcatcactgacgtgattaatgtccagtgactgacgtacattgatacgttttcatttgagcagcacatggtggtggcttgaaaattcgactgattttctaaagaaaatctgtcgaatgattgttagacagtcccaaaaaaaaatcctacctagcacataatgtctgacatcgctacatcactacagcttgatgatctaagcaaattcggcaaggccttttacatcttttttttggggtcaaagtagcaaattattatggtccatttagtactttccaacttgcaaattgcagaagtttcttgtcatgattgaaatagcctctcaaaaaaaaaaaacaatggtctatatctactactcctttgtgtacatccttaaatttaaatggtgatactgtatttacttggctaactttctagattgcc

SEQ ID NO: 30609 - DNA, 1501 bp, Oryza sativa
ttcggatgaggatgattgacgagcagaatataaacgattgctggttgaatgtatgaagaattgatgatcgatcgacgatcgttcatgaatgctaatagctaactcaatatatcgaccgaaaccgtacgtaaatattatactgattgtcaggtgttaggtaatactagtatacaatcacaaagacaaagatgcatgaatatagcctataggaggtaattaattaattaattaattaatctgagatgcaaatgcaagatttttgcagtggatgaatcatgaatgactagaagatcagagacaagtgtacctgtggggtgagggcgaggagaggcgagccatgtccatccatgagcagcaggtcgccggagaagagcttgcggcggcgcgagtagttgtcaacacggaaggcgaggctgccggcgtcgtcgtagacggagaagccgtcggtgccctggaaccccatgctggacctcttccacaccgtgtacaccgccgctcgcggcgctgccgttgaggcggcggcggcggcggcatcttggcgttgatacgaagggtgtatccgactcatcgatcttcctcgccgcgatcggatctacctatctatctgcagagagagagagagagagagagagagagtttggcgttggacgagagatgtagtgctcgactcgtcagtgctgaccacgtcattgccggcctcacctgcttatatatactcctctggtctctgaataaccgatgatatgatatgatgcagcaacgactgatgattccttttcagacttcgactgatgaatggatgtgcctctttgaaccgtgtgtgtgagtcgatcgtgcgtgtacatctatctatctatctattgatgtgtctgcatgaatgcgtggcatcgatctcacctttctgaatgtgccatatattcctctgcctgcctgcaaaggaagaacaaccttacctagctagcttcagattaaggaatgagccgcggaacacggtttaatttggtccactgttaattagtcattactacttgtgattgtcacaatgtgacaatacttgggtaaattgcaactactcagtcaatgcacacgctgttatactgacaattaatttcttttttactccaacatgcctgcatgcatatgaccacactgacttgatttggtcagtacaaactattaggaatactttgccatatatgtacagattgtattgtattgtttctttccttgtattctcctctaattgaggatcctgtacatgtccttcctatattaatacatggtcacccctcccattgggtgtgtggtgttctccccattccattctacatggtatcagattctaagttttcttctcctcttccgctgctctagtgctgcttcctctctggtcgctgcgtccaccgagcatcgccgcctccctggctgccgcgccccacttccctcaccatatccacttcctcggctacttccgctgccaccgactccgctacggtgtcat

SEQ ID NO: 30610 - DNA, 1501 bp, Oryza sativa
gccatggtcgccggcgaggcggagcgcgagcaccagcgggtggcctgggcccgttcggccacctgggcgctcctccagttcgtcgccgcctacgccatcgccggcaacctggaggtgaaggagatgatggtgttcaaaaccgtcggcgacagggacggcggcgccgagctgatcaagagccttggcctgcctgacagggctactggtaaaaataatctatagctttaattacagttcattccattttctcaattaatttatccgcgtaaccattgtctatcgaatcgcaaatgtttgtgaatttttacttaatttccacagaaaaaaaactgttacgtactgtgatcattacatgctagtactgcagtgcatggtgatgtttttggttatgttttcctttgtttgttagagttagtatctccttttggagtcttccattttttccttcggcagttgttgctctaagattagagattctgatagtatcccagtaaagcgtagagttgatacacaagctgagtatattcttagttcaatcttttgtccttttgaagctttctggcaaaaaaaaaaaatcccatttgaatccttctggaaataaggtcctttgagctctgccaatttggacactttagtgaagtttaatttgggaatttgctgaaattatcatgggaatttaacacattttttagatatattagttttataatttctatcaataatttatttctttcattcattcaaataatagtcataacttggcttccaaggggcaaatggagttagtgacacgcaagtaaactgaaaatatattttctatttatctgcaattggtgcatgtattagttgcatcttactcttttaagtctcaattaggtttgcactcattgttcttgtcatatatgcataattctattttttttcctatcaaatgttatgttttcaatgatcaaactgagtcttggtcaactcatgggcttgtctattacattgggttttcttttgtggtatgcaacccaatatctgctactagatttatttttgctaattaagtatgtactcccttgggtttataatgtatgacgctattgactttcggatatacgtttgatcatttgtattattaaaaaaattatgcaaatataaaaaatgcaagtcatgcttaaaatacatctaatagtaaaacaaatcacaagaaattaaaaaaataattatgcaatttttttaataagatatgtcaaacttatgtgcaaaaagtgaacggcatcatatgttaaagaaccgagatatattgagatgcatcattgttcctagccattgtttgccaactctcccatgttagcattatcttttccattttttcccttggatgaaggcagttatgttgtgctgctgggtatgcattagtgccatgatgatttgggtatgatcaagattaaactgatgcaaaatcatgttatgattatcttctagtggatgaacacatttgctatattgttta

SEQ ID NO: 30611 - DNA, 1501 bp, Oryza sativa
gaacaactctcacttcatctgatactccatcaaataaatctgaataatctctctgttcataacagatgaatgcaaaaaacgagacattagacctggatattgaaagaaaagatagaacgatggaagaaatggcccaagaagccaaagaatatcgtgctcttttctcctagaaaatgtctatgtatactacttaactttgtgtggatttcactattcctctagcattcagctagcttcacagctgcattttacatattacactgatttgttgtgtttttatatcagatgatcatactaatcgtattgtgcatactacctgatattctgttgtaatatatgtgtagccgttacttagtaatattgaactccttattttcatctcatttattttgcattgtgtacatattttactgccagataatatgtttattcctttgtagatgctcaatgtattaggtacaaagaacacttctgtaaatgataaaccaagtagtacggatcacaccagccctattcgaagggcattcttttgaaatctgaaatatatcatgtcagaatataatgcatatgagtaaaagctgtgtcagtactgtttatgtagcttttgggggtataatacgaggtattatggattttttttttgttgagatgaccactgcaacatgggactttatttcctgatccatgcgggaaatgaattgcttcatgtaaagttcctgaatagtttctgtcttccaaaggaacccttaaatggtggagaatgtatcctgtgcacccatgaaagttcacctaatcccttctatacccctgaattttgctcaatcccttacatacccctgaattttagtttggatcccttccatgccctttccgctagttgaccgttagttgaccgttaaattcttttgaaaaagtccattttgccctttgctatgaagaaacataataaattaatgaagtatattgttggaatgtaaaaatttattggatgggactattatatttatgagtatgtgatgcaccatattatttgtgacaaatttacttttacatatgatataaaaagttgatacttatttattattagttattaaaagttcttttatgtagcatatgtgttttcatagtaatacaacagatttgtttattacttcaaaacacatgctaaaaaaaatcttttaataactaataaataagtattaattttttatgtcatatctaaaagtatatttatcgcaaataatatggtgcataactatctcataaacataatagtctcatataacaaatttctatgctccaacaatatactctattaatttatatgcttctttataccaaagggcaaaatggactttttcataagaatttaacggtcaactaacggtcaactagtggaaagggtatggaagagatccaaactaaaattcaggggtatgtaagggattgagcaaaattcaggggtacagaagggattaggtgaactttcaagggtacacag

SEQ ID NO: 30612 - DNA, 1501 bp, Oryza sativa
agtaccaaagatacagaagatctcatcaacagaaaactccgatacaatgttgtaagaaatgagaaaatacaggaggccccaggaggacaggttcaaaacgtccctgctgcttccagtgctgtcaatcatctccttccaatccttcgccagctgcttggcctgcttcattgtgtctgaggacagcgaggcattcactgcaggtaagcaccgaatcagcccaacacagttaccccaaaccttggtggtcttcatcttcttgctgagaaggaaaccctggacgacttggaggacaagggcagcagcatctggggcatggcgcatcaccacggggtactcatgccagaggcaaatgctctggttcttacacaccaatttcaacagccccctgacgtccatgccagcacacactcccctaagatgatcgctgcaacttggaagagctcgattgccttgttctcgagacgctttctcgtcgccctcctcgatgtcatgctccatagatgtcaccttagcctcattttgctcctccgatttggcctccattgtctcaccgtcagccacctgctgaaccccttgggcatccacatccccattctccccaatgtcgtgttcttgagaggccagcttgtccccatgttgctcctcatctttggcctcaattatctccttctctgcctcatcctcttcctgtttctgcactggaatcgcactcttggaagactcatcagcatcttctttggacttctgcatctcctcgttggctccctgctgctcctcgtcgacctcctccccggcctcctgaacctcttctctgacttcctcttcctcctcctcaatctcctcttcttcctcctcaatctcctcctcgacctcttcctcctcaatctcctcctcttcctcaacttcttcctcctcaacctcttcctcctcctcctctttctcctcctcgtcgctgtcctcttcctgcttcccgcccttctcgccgtcgcttgtggaggcggcggcgggacctgcaagcgcggggcgggccgcctcgaggacccggagctggccgaaccgccggtcgatcgacgactggagcgaggagatgtaggagtcgaggtcgccccaggcgaaggggagcgggaagggcgagcaggcggcgaggacgtcgaaggcctcgcgcagcgcctccttcttcgcggggagggcggcgatggcggcctccatctcccccgtcgtcatctccaccggcaggccgtgcagcgccggtgcggaaggggccgcatcagattttggaccggcgccgccgccggcggcggcagcggcggcggggtccatcgcgacgccgtcacgccgcgccgacggcgagacgagaacggcgtgagggattccttcctctctcgtgttgcggcaaagcggatcgagccaaaccgaaaagactcggaggaggagagattagaacgtggtttagttgggctcggactcggactgcgcagtgatttacttgggcttttctctt

SEQ ID NO: 30613 - DNA, 1501 bp, Oryza sativa
ttctcctaattcagaagcaaagactttaaatagtcaacagcccttagatgatagttaggtaccttcaagcgataaactacaccttgcccaagagcagcagatccagcatctgccttatttggcttcagagcaaccacatcgtgtgttccaaactagagaagaaaaacataagtgggcattagcaatggtgaagtaaaatacaaatttctttgaatcagtgtccggtaaattaagaaacatgcatgagcttttcatgtatcaactcctgccaatctcaacaaaatcaataatacacgtgatgcaattcataatgaactttacaaacgaatctaatatttcactgaaactatcagttaacaacaacattacttgttcacaattactaaacaaatggcagaaatactgcaagtgtgagtttcgacggcaatacctgaagcgacaattgttctgaaacaaaccgctctcacataccacaaataaattcctaaccagaattttatcacagcgagcaataacaacaatacgacaggagggcaaaggtaacctcaccttgtgaggtggaagcacgtcgcccttgttgggttggaactccaggagcgtcttccccatcagccccgtctactctacgcaccaagcaggtccaacaaggccagaacaagattagcaccacgcctcgatgacacattggcaccgatgggcaagcaagcaagcagcaaaatggaagcaaatcaacctgggcgtcggtgcacttgaggttggccatgacgcaacccctcctctcgagggtcttcgagctcgtcgccgactccgccgatatctccgccgcctgcgcaaccacaccacagacgcgtcaccacccaccaccactaccatccgttccaccttccgaaccaaacagcgaaagaaaagcgatgggggatcggagtacggaaccttctccaggtctatgagaggcgccatggacgagacgaactcctgcagcgacaccatcctccccgtcccgctcttcccggagctcccgccgccgccgccgccactccgccccgccatggccgctctcctcctctcactcgtctcgtccacggcgtaatcgccttgcgattcgcccaagcaaagcgcatttcatgggccaggcccgcgtagtctaatccaggcccatttaaagcaggtttcgtgggcctagtccatgtgagaaagtgagaatccagggctttttattccgtgacgtcgcggcggcggcggcggcagcgtcgcctaaccctagctaaaccccccttctcccttgcgcctccgcttcgcgagcctcatctcctcgatctctttcgattcagtggaaaacctaggagaccggcgcggcatggcggagtcgggctcgtcgggcctggaggagaagctggcgggtctctccgcgggctgcggcgaggagccgcagcagctctcgaagaagtgcgctttctcatcgcgcacgcagccggcatttcttcttattgtttttttttcc

SEQ ID NO: 30614 - DNA, 1501 bp, Oryza sativa
catggaagagccagaaatgaggacaacttttgtcgggaatccagatgactatgttgatgcaaggcagtttgagatgctccttgagcaatttgctgaggacaacgattccagaagaggagctccaccagcagcgacatcctttattgaaaatctcccctccgtgattatctctgcaagccatcagacaaatggtgatgttatttgtccagtctgcaaagacccaattcctaccagagctagagcaaaacagctaccatgcatgcatctttatcattcatcgtgcatcttgccatggcttagttctagaaatacatgtcctgtctgccgatatgagcttcctacagatgatgcagagtatgaaaggtccaagcaagccacaaccaatgtaagagacattcaggttgtggaagaaatttctgatgaacaagaggtccaggtaactcgtcagatggctgctggtgtgatcgaagagactaatacaagtgaacacaatgttcgtgttgatgagcaaccaaacagtgcacgcaggcgcagtggatggctttttattgctgctgctccagttgtaagcctcatcggtttcgctctagttttatgctttacaaatcccgctaggagtggtagaaggcaactgtactgtagatccccaagtgccactgaagtacatgtggacaccaaaaagagttggtggtctatgttctagaatgttccgttggtacatctgataacaaaatgactatatggtggtgtgtgattgtttctttagaatagttttattttaaaattttcaaacgttgtagttgctgcagttaccggtcggagtgttgtaaaagaattcacatgccaccggttgtaaaagaattcacatgcctactttcttctgctactttgctcagtcaagcaaagtgtgtattgatacttgctatttgtttaacatatatgtgtcattggatgtcctatgcttccttctgttgttgccacatttaaaaatcaccatggaagagaagactccatttgcgttcagtgcttctgtcagaattctacccagtgtccagtggagaggtaattcgtctcttgtttgaagctcacgtctaggcttcattggtttgtgcctctcaatttttttctatatgttaattcttggtatattgtttctctcatgaaatgcttctggtagctaaagtaggttgtgcataatgcagtatgctagcacagaacttaaggctggttcttagatcgtcatcaggtaaaacaggggatcaaaatgattttcttgcagtaatttagtctgttgaattcacctcatcatgaactggaaggtctaactgattgtaagttgatcccaagatgtgaaagcaacctacaaaacaatcagttgttgaagaaaaggtcaaacaaaagaattcacatgcttgaggtgttaaacaaatatataaagctagcgcacgaaagacctaatgtactgaagatttgacagaaatactttgcttctctggttccc

SEQ ID NO: 30615 - DNA, 1501 bp, Oryza sativa
tagcttgaagtcagcattatgtgaaaaaatgttggaagttatttacagctatttacatgattgtttcgttaagatccaaaacattttgcttagctggtgctaacttatgggcactggtcaagttgttccgaaaatcatctttattcttttatggcacggagttatccaataaaaccaacccaagaaattgcttctactatacttcaaatcagtgggacaattttgatctatgttgcttcacatcagcagcagaaagaaattgtccattctattttgcttttaaaattagggtttctttgcttttcatttcacctctgcatagatgagtatcacaaccaggacttctgcttgagcttgtttagatcgcatatattagtacttgtatcatgctcactcaaaactatttgtttcatgttgtacttctaacaactgaaccccactaccttctcctccagaattattgattgcttgtctgagcttgcttttctttacagggcctttcaaacagaaaagttggtactacgagtatgaacttgaagagttcacgttctcatgtgatattcagttgtgtcattgaagcatggagcaaggtaaattaaacctctcttatttcttctgttatttggagacctcatagccagctatatttaacttctattattgcaataataatgtcagtattatagcatttagaaaatcagtctgctctttggtctattctattctgttttttaagttcactaattgatcagcaaatatacatgttgtcattatattgggaatttactttgttcaaccaaattacagggtttctcaaatggcttcagcagctcacggaccagcagaattaccttcgttgatcttgctggtcctgataatgatgaacttgatggtggcaacaagcactgtacaagagaagaaagatatgttaagaagtccttgtcaaagcttgggtatgtaaatttataagatggcttgtttggcaggaattttgatgtctcatgaaaattcatcagtaaaatttcttcaatgtttctttttcatgttcaccgatttctccctcataatctgtttgcatatagtgataattgctttctttggagaaatatattataaacatatagtgataagaataaaaacatgtagtaaagcagaagactgacttacattgttacttcaggaaactcgtcaatattctatcagaagcaccagagacccagaaagatgactctccccacaagcaatcctgtttgacgcatgtgctgaaggatacactaggtggaaattcaagggttacattcttgtgttccatttcttcagaacacaggtattttctgttcattaccttatgtacttcactatgccatttacattctcttaagttgacatagagtcctgtgactggcaaatgcaggtgcagaactacaactttaagcacgctacggttcggtgagagagcgaagctcatgtcaaacaaggctgtagtaaatgagatatcaga

SEQ ID NO: 30616 - DNA, 1501 bp, Oryza sativa
tgctattattcccccttttcagaagtgtagtgcttctgagctgaagacgaagttagaggaccaaggctcagaccccagttgagttttgcctgtggagtggagctgaagccccgctaggatcgtcttttccgctgccgctgcttttgtttcggtgtgaggactaagtgcctctcctgtaagtattttacgctttatttacgtttggaactgtttattacttgtcattttgtgtaccctggctggtcctggacagagatttaatacacaaaatagtctgaaaatttaggctaaatttctgggcgtgacactagcccataaaaggatggtctttgttgtactgcttcaacaggtcgctgcagctctcattatcacggccgcaacggtcgccttcgcggacatccatcccgtggctcctacggccattgtcggagcgatcctccttgttgcggtcgtctttcgctctatcttccttgtcgtggccactctcgttttcatgattagagaggaactaatagaagcgtggcgacgacaggtgatgagggaactcattgaaccaccgatctggcgctggctcgccatccgccacaccaaggtgccatggcgggagttggagcttagcggggcaatagttgctttgtcgtcgagggtcgttgtgacggatgtgtggtcgtgaatctcctccaagtaaaacttatttatatatatatatatatatatatatatatatatatatatatatatatatatatatatatatctgtgtgtgtgtgtgtgtgtgtgtgtgtgtgtgtgtgtgtgtgtgtgtgtgtgttttagcaactttaacggcaatatttaaattttggatttagctttggcttacgagggctctaaattcaccgtgtgcactgactggtgggccacacttggcagaggcagccggctttccctttccccttccctctcgtcgtcttcttcgtctccctacctcctttacctcaacctccaataatccccatcttcaaacccccctcaaaatccatatttggtgttgctccactgattgattccactcaagattgtcgtcaatcggtctctgcatatggcagttggttcctcctgcccaccaccaccagccctagtttaggcctcccccatcaaatctactgccatccccgactagtatacctcaactcttcaatttctcttgattcaaattcaaatgagggggatgcttcctctgctctgctgcagtagcgcttaattgacaaggcgggggtcccgttgtttcgcgctgcgatctctcatcacttcttctccgcaatctctagctggtaatggtattcgtcttgttgagcatatatcctataagcattttgctactacttcactgcagaactggcgctaatcacattctttctttctttttttatgttttgttccgcaggtctactttgtccaatagcgaactgctgaccaaattcagtgtgccctgttcagttcatcaggatatccatgtctg

SEQ ID NO: 30617 - DNA, 1501 bp, Oryza sativa
taaaaacaagatcagatgatacaccagtttggaagacaatctgtggggtggtggaatcagtgagtgcttcaacaaaggtctcagtgggtaatggccagtcagttcaattctggagagatcactggactgaagcaggttgctttcatacatctttccgaatgctcgccacctttcccacaaacatcaattgcccagtatcttcccagttcataaacaatatgtgggccattgatttacgcacagtccaattcagtatccagacaagctcagcttgaacttcaattccttatggacaccttagctgatcaccaacttcaacatgagagaccagatgagagggccttcatccttacctccgcaggaaccacaacagccgcggcttataatctgcacacatatcagtatcacggcacactatagaaactggcagtctttatctttctttttttttatcaagggctgcatggcccccatttccattaccagaaatgacaatcagagttcttacaaataaaaggaagaagaggttaaaaaaaaaaagagacagcaagagagagggctaggcatagagggtctgggacagacagagtgaacaggcaattactgaaacagaccacaccctcaaaatctattctatgaaccctgagccagccaaaacaaaactacccaagttgacagattacatttttgtgcccagattgaaacaaaagcaaccagcgtctggtatgatcttcagtcctccagtcttctgattcccgtcccccagccaaacttgggacaaaccaatcccaaatacttgcataattttcatgtggctagtctttagtgacagactaaacactaatggaaacagagtccacaaacaacggtcatcggaccctcactgcagtttctgcctgggcaactgaacctgcagatctatacaagcaagcaacaatcagcaaaaatatccgacaatatgttgacaccttcaacctggcagaaacatctcaggatcaccttcaacctggcttgtctgtatgctttgccgcctgctcccacaatctgtggaaggtgcacaataatatggcttttcgacacgcaaatctcaacatattgaaccttcttcatataaaaaaaactcagcacaagtgctgctggtaagatacatgagaccaagtggagcatatccctgtacaatgtaaaaccactgctggtactagatgtggtaagaggataggatccaccagaatttttctcattctgtttcaagaaccagcacttccacaggacctcagtttgcagttcagttttgaaggaatcattatctcttgcattggggccaacaaagttgttgtagattcttgaatatgctacatgttttccttttgtgcagtctttagtaaatgtaaatataatgtaagatgaacttgcattgtcaatatacatcctggtatctgacataatttaagggaactgcagctctgttctgcagctagcatgttggttctgtaattcgatg

SEQ ID NO: 30618 - DNA, 167 bp, Oryza sativa
ccaccatcgccctatcggtatcatcattcatctccaccctttgcaggttcactgacatatataagtgctatccgctctattagcctcatgatctacgacatagcatctacgcacattcttgctcatctgacccattatgttagccatcaacttataaaataaaaaga

SEQ ID NO: 30619 - DNA, 1501 bp, Oryza sativa
aacagtggtagtcattttcagtcactaaaatacatacactcttattgtactgtaattcatggttcccttgagccatggtcatcgtcaccatcatcactcgcacttgcgtcgaaggagtgattaggagatggttatcgtgtgtgacgtggatcaagccagataagcatttcaatgtttttatttttgagagagagcagggataagcatttcaattagcaaatgaaaggtgtctgctatagctttttctgcaaggacaataattaatgaatctgaaagtgtgtcgtccttggaaggaagatggaaaggaagaaccactcattaatcaaacaagtgtcacaaattggatcactgactgcctgactggacaggaatgttggtgcattatcatgttataactaaaagatgcgtgaaaatcagtgagcaatcatagaaaaatcatcaagtgcactgttccattgttgacaagaaaggtttttcctcacaaaataattaaaaccgtatccttccaagttccaacatacaggacaatctctgtgggatgtgacttggttaattatccagttacatctagagagttagcgaaaatcggctgtgcatgacaagatcacaaattaatttggagaacaaagaatgaattaaactaagttcataaaaagaaaaataatcgtgcatatcaaaatattcagaagagcgaaaaatacaaggatcagatgcgaaaagggccaaggttgcattgcaaaccatattagtttgctggtgtcctggtgatatatgcaactttagagagccagcaaatgacgtatctctacctaaagaaagatattcccctttggtattgacacaaaggaacatcaatcgctctcatttaactggcacgcacaacggttgcttcatcttcaactgctaattaactttctgaaacgctgatgctttttaatcctcttcttccccggcccatgcatattctctctgctttaatggtgtgaaatttcagaacaagaatctagtttccgcatacagagttccagaaatttccgactgttcatctcatcgatcatccgcgattctttttttagtttttgatggtgatcagccacaccgctagctagttgacacatgtatgcagtagcaatatttgttagctgaaaaggaagcaaggaggaaagcagcaaatcagctttgttgccaagctgcttggcaggtcacatttttcatttccgagttgattaatttgcaaccatcatgcatcaatacaattactatttaagcatattagtaaaattgtgtgaagttttttttttcaattaagccatgtcatgtgtgggggcgttaccttgcagactatataaatatgagtgaaattgacttgaggcgtcgagttgccttattgccaaacaatagtactattcattagtagtatatctgacccaaaacccaaccatttttccccctttgcgttgcatctcagtgttcttccattctttccagagagacaaagtaa

SEQ ID NO: 30620 - DNA, 1501 bp, Oryza sativa
tgaaaatgcagaaacttgtggaaaagaaaggaattgatcttcaaattgcaaatgtacagaatgaagatcatccattccttgaacttgtcccaataactccaccttttgctgatttttttttttcagaatctgttcactcactgaagttttgcaaggctgctagtaactttgtcaagatgtcaaggctgactgcagcatgccttgaggtattagtatttagtagtagatgttaagagcattttctccgtacacatctgcagcataccttctctgatgctaattcctggatctctgatgagttgcttacagtattttcaaacaagacactgttgtgctaccgggacacaggcgtaattgactgactgtttacttcagtggacaataaaacagaaaggggcaaacatattgttattgatgattttaacagattcacatgggtatatcgttctcttgaagactggagcatttgttcattcagtttcaatcatatgttcaacgatatccaaataataaaatctgctcaatcagactgattggtttgatgttgacttgaaggttgcaaaaattcattctgaaacttggcattgcacatcgtttgtgttcccacatgcacattgcaacattgtagagacttggctaactcttctcgttcgcttttcggatgaggccttgctcactgcaacctaccttatcagcaccgactttgtcttcagataaccaacctgcacctgaaactgtattgtgtaaggagaagataggctgcagaataatgtgcgtatgctacagtgacactaatcttatcattagcagcagtttcgtactttcgtgtggttgatctttttatgccaaattgatgtttcgtgtggcaggtgatgcggcacggttcctgcgctgccgtatgtgctcctggtgcagcaagatggacgccgtcgagacgcggcatggcgagtcggccaggggaaaaggtggagggacggtcatctaccgttcgcaagggcgcgtggcggcggtggcgaggtacaacgggttgggtagattccgtcggcagcggcaccccggactccggcagcgcgacagcggcggaaggacgacggtggctggccgggttggctcatctcgcagctcgccaggctggcttggtaggctgggccgagacagagcaggcccaccggtaggttgggctgctagatgggccggcctaaatggaggaagaagataagggtgctcggctagactagagataggctaagggtttggacaaggtgtggtttagactttgaaactagttttgtttttatctgtataatatttccctaaaggattttaatttaaataacgggtgctttaataaatgacgtttgaatttaatatttgaacttaaaatttggatttaatttcttttgaatttatttattttaatttttggcactagcacaataggaagagaaaaaggaaaatccagtgaatatcagcattattcaaattttgaaaaaggttttta

SEQ ID NO: 30621 - DNA, 1501 bp, Oryza sativa
tcgcgatgttgtcggccgtgctggtgaagcgcgagttgacgccgcggaggaggttgaggacgagctgggactcggtgacggggtggccgacgtcgtggagggcatcagccaccgtcttcatgcgctgacaatagtcggcgacggagagatcgccttgggtcatggagtggaactcgtgatgcagatagatcgcgcgaggctccttgttggcttgaaagaggttgtcgatggtgatccacaagtcctgggccgattgattaggctccatggcgaggtcgaggacatcgtcggcgacggagccgaagagctagctgcagaggcagcaatcggcctgttcccaggcggcgtcggggttggtgggaggagcagcgtcaagatgatcgaggagaccgaatttcccacgcatcgagcggaagaaggccttccacttgttgtagttggggttacgaagctcgagggagatcggaacatgggacttgacggcgatggtcacatacgggttgacgaaaaccggggcgacggtagaggtggaagatgacaccgtagcggagtcggtggcagcggaagtagccgaggaagtggatatggtgagggaagtggggcgcggcagccagggaggcggcgatgctcggtggacgcagcgaccagagaggaagcagcactagagcagcggaagaggagaagaaaacttagaatctgataccatgtagaatggaatggggagaacaccacacacccaatgggaggggtgaccatgtattaatataggaaggacatgtacaggatcctcaattagaggagaatacaaggaaagaaacaatacaatacaatctgtacatatatggcaaagtattcctaatagtttgtactgaccaaatcaagtcagtgtggtcatatgcatgcaggcatgttggagtaaaaaagaaattaattgtcagtataacagcgtgtgcattgactgagtagttgcaatttacccaagtattgtcacattgtgacaatcacaagtagtaatgactaattaacagtggaccaaattaaaccgtgttccgcggctcattccttaatctgaagctagctaggtaaggttgttcttcctttgcaggcaggcagaggaatatatggcacattcagaaaggtgagatcgatgccacgcattcatgcagacacatcaatagatagatagatagatgtacacgcacgatcgactcacacacacggttcaaagaggcacatccattcatcagtcgaagtctgaaaaggaatcatcagtcgttgctgcatcatatcatatcatcggttattcagagaccagaggagtatatataagcaggtgaggccggcaatgacgtggtcagcactgacgagtcgagcactacatctctcgtccaacgccaaactctctctctctctctctctctctctctgcagatagataggtagatccgatcgcggcgaggaagatcgatgagtcggatacacccttcgtatcaacgccaag

SEQ ID NO: 30622 - DNA, 1501 bp, Oryza sativa; identical to SEQ ID NO: 30554

SEQ ID NO: 30623 - DNA, 1501 bp, Oryza sativa
caggcatatctgcacatagtgagattttagtgaaatgctgaaagtgtctgggaacaaaccagctaaatggcataaaaggtaagcaatacagttgaacagacaaagttttacctggcatcagcaaaaacttgaactttctcaccaccaccataaagatcataaaataagagcttggaagattgcgctctcttggtcatgatcctccctttaataaaaaataataataaatacaaatcccacccaaatgtatctctaatcaactacactatcatatctagtcaaagagaacgaaaaatacctgctaggcactcggtgacgtcaacaagcttatccccaacattcatgctcttgtatttctcaatataatcggctacggtaatattagccaggaacttatggggataggggtttacacccgtggccttgagtgaatcaagtgccttgaggcgattctcataatattgctgcagcaagaaacacatgtctgaattttcctaaacaaaagaattcaatacaacaaatagcacagcagcaccaaaggggcatcaatatcacatacagtgggatccatttcctcatcgtcggcggcagattccttcgggggctctccactagcagctgctgttgcagcggcctacaaaattttttttaaaaaagggtgtatatatatttagagcttagcaatcatgatatggaaaactctttctcacaccctagctgcagaggtatatccgtatctaacaagagcaaagagtgttgcttgtcacattggcatcatctacaaatgaacgcatccaaaactcgctccataaaaacaacactggaaaaaaatcggcaaaggttaagaagttcaaactgcttcaccttcttcttcttctcttcctccttcaaccggcgctcctcctcctgcttcttccttttctcctccctcttcttggcactgcacccgccacaaaactcatattaaacaaaagccacactacggaggaaaaaaaaacaataagaagaaatgccggctgcgtgcgcgatgagaaagcgcacttcttcgagagctgctgcggctcctcgccgcagcccgcggagagacccgccagcttctcctccaggcccgacgagcccgactccgccatgccgcgccggtctcctaggttttccactgaatcgaaagagatcgaggagatgaggctcgcgaagcggaggcgcaagggagaaggggggtttagctagggttaggcgacgctgccgccgccgccgccgcgacgtcacggaataaaaagccctggattctcactttctcacatggactaggcccacgaaacctgctttaaatgggcctggattagactacgcgggcctggcccatgaaatgcgctttgcttgggcgaatcgcaaggcgattacgccgtggacgagacgagtgagaggaggagagcggccatggcggggcggagtggcggcggcggcggcgggagctccgggaagagcgggacggggaggatgg

SEQ ID NO: 30624 - DNA, 1501 bp, Oryza sativa; identical to SEQ ID NO: 30557

SEQ ID NO: 30625 - DNA, 1501 bp, Oryza sativa
acaagagaatatgcctagtgtcaggtgtgtagaaggattcctgctttgagggaagattcgcaagaagatacctatgcaaagcacaatccgtgaaataaagcgcagcgccaaaccttttctccttttcttttttctttctttttggcagttttagtttccagaaatgttttagatggtgaactccaggaattaccggtttggtaccaaaataaaaactttttttggtgtaccaaaaatctctaacttaagataaaatttaagataaacgatgatggtgagtctcgagcctacacatgactaaaattacccatatatgctatcgtagtctacacatcactaatgttgtgttcgtttcgtatagttgggaacacatgtcctccgcacggaaaacggagcagtccattaacgcgtaattaatataagtattagctttttttaaaaaaaaatggatcaatatgattttctttaagcaactttcatatagaaattttttttcaaaaaaaacgcatcatttagcagtttgaaaagcatgcgtgcggaaaatgagggagatgggttgggaacactgataaacgaactcagcataaattgaccactcttattctcgacattgtcatcatcaccagctctatcaccgatatttcgaatgtaaaagaatttatgtttttaactcgagacaccacatagttcacatcaatcatgggcgtataacttgtttttatcatgcgactgctattttctattatttaatgaaaatccagaaaggaatagaggccattatatccttcatcgtctgttgccactgcctgcagtagagctttcttaattgcgactctttcaaccttggcttcatgccctatatgggcaagcaatgagactacgctaaaccgacgatgcagcaagaatggattagtgcacacatcaatacaatcaaggaacttctaagttatcggtgtaggcacggaatagagactcattgaaaaaggtgtgggccaccattggttggcatatgctgttgcatatcagcacaaccaggctgatgcttatcagcataagcttttctatcatctcatgctacagtccaaggagccaaccgatgaggtcagtcgtgacaatgggaaggtggcgagagagagaggaagcggggaacaatatttataattttgatgaaattcggtctggattacactggattgaaaacataaaccgtttggtttataaaccgtttggtttatcggtcaaataaaaaaatcaaactaaaattttagataagattttgttcaaattttatcggtttttgttggaactatgatgagggcataatcgtctattcctttccagattttgattccaagagaactgaaaaataggctggaaagagctttctcttccagaaataccccaagctcaattttcttctctacacaaccgaaaggtggagcgttggcgaaggaccaaccaatttcctctctctaatcgccgcggcgggggatagattggg

SEQ ID NO: 30626 - DNA, 1501 bp, Oryza sativa; identical to SEQ ID NO: 30559

SEQ ID NO: 30627 - DNA, 1501 bp, Oryza sativa
agcataatctattctaagattgaaatcatttgtcaaacttgcatttttcggagcaaaggaaatgataaatatgattgttattgtattagaattctcactaccaaagtagatcagatcctgcttaatctacaagtagttgggaaatttttagttattcaacacaaaactcgagataacatataaaatgggtgtatgaaaattttaattgatggtcaactactgagtcctttatatgactgtcaagagttgaatggctattatattaagctgtaaaagggtcccacagtctaaataaactattcatcaataattatgatcctgacaaacttgtttaataatactcagtactagcatctgagcttgtttagagtctgaaacagaaacttcgtaggatggtaaatagcatccaaaatggacaaaataaaattacaaaacaaaggattagatatatatttaaaaatgtgtgatggcaccatttcgctgaaaagtgtctgatctgtttatataatttgatatcctactaaaagttgaaaaacagtaaaaagaggagagattaaaaaaattatgattgccctccaactccctactaaatgatcaattcaggcttataaactagattttaatagcaaggatactttgggatcctgcttctccatggtaattcattaattcacttcaacagttgtaggtgactaattttctccaagacatgtcattaataaacttcaggatcctatcatcaatctgatctactcatgagccatgaacatatgagtgcaagagccaatcatggacaaagtcacaacactagcatatgcataccataagtttcccgacagaggagaaagtgtgggaagagggtggagatgaagttgttggtgccttgcttctgtgaaaatttgagttcttgtcggattcttttgatctcctttgtgttgccgtacagaaaagtaggcttgggaccccttatgccttgcctcctcaacttcttccttatcttcacagccctcagccataggatgttgcacaagtagaacagagctaagctaagaagtatgacaagaacaacaatgagtgcaagcaatttctccatgaagcatagggaaccagagaagcaaagtatttctgtcaaatcttcagtacattaggtctttcgtgcgctagctttatatatttgtttaacacctcaagcatgtgaattcttttgtttgaccttttcttcaacaactgattgttttgtaggttgctttcacatcttgggatcaacttacaatcagttagaccttccagttcatgatgaggtgaattcaacagactaaattactgcaagaaaatcattttgatcccctgttttacctgatgacgatctaagaaccagccttaagttctgtgctagcatactgcattatgcacaacctactttagctaccagaagcatttcatgagagaaacaatataccaagaattaacatatagaaaaaaattgagaggcacaaaccaa

SEQ ID NO: 30628 - DNA, 1501 bp, Oryza sativa
tacaggagaggcacttagtcctcacaccgaaacaaaagcagcggcagcggaaaagacgatcctagcggggcttcagctccactccacaggcaaaactcaactggggtctgagccttggtcctctaacttcgtcttcagctcagaagcactacacttctgaaaagggggaataatagcaagactgagtacaaccaccatactcagcaagccacaccaacgatgcagacgtgcaatgggacacaaggacggtttgtggctatttgcataaaggctgttgtaaaacattttattgagcaaaacaataaaactgttgagtaattaaagtaacattaaatctccactgatcaatgctacaccacgttgaacaggcccaaccaacccacctgaactacagtgcattgagtcgatttattaaggtgggactaatcacggtgaataaccacgggcacggctattcgaatagttttactctgatcagaggtgtacaactgtacccacaagacacagccccacgacacgtttccgtgcgccgacatgccaccacgacataccggaaagaggccgtgacaggacccttcgcataactccctctagccaagcacaccacacctcaggtttcacccccactcctcgcaaggcagcgggcagtcccctctcgtgcctaggtgaatccggaagctgcataggccgtcgcagggcccatccaaactccatcacgcccacccttgcctggatgcgtcagctagaggaaagctacactacaagcccagccgttgcccacgctggcttgtggtaagcacgataaattcttccagggtttcccgcgaaccggtccttaattgccatgggcacgactagcaaaaccatgcacccacagcccaccatgaagtcacattttagttggataattacgacgatgaagcatggccagatgtctcgagcacgcagctcattctgatactaaaaaggtctaatattgtaattatcccatcaactaagctagtggtaattaagaatggctaagcatatagctctagctaggtcacataagtaacatgacctagtcgatttattacccaaggttgacaaaggacatatatcaagtaaatatggcacaagcaagcagataggtaatacccggatcccatgtaattagcaaaacatgcatatttatttgcaaacggtaaaaacatttataaattgggatcaacatgctaaaggggaatgcgtgacttgccttgcgcgaccgcggacttccgaaacgacggattctacacgctggcacgcaaaatgaggaaaaactctaataaaaaccaagaaaacagtacataaaaagtaaacaaacatgtagatctcaattttagatgaattttgcaagttaaatggctcaattcggagttctaatgaattagatatgaattttagaagttttgagccatttaaatgaatttctagaattattaacgaattattgcgcaattattaaatatttttccaaagg

SEQ ID NO: 30629 - DNA, 1501 bp, Oryza sativa
gtggcgcggcagtggtccacggcggcggcctcgcagggcgcggcgaggaggtccacgacggcagtggcgacggcgcggcagtatcatagggtgcagcgaggaggtccacggcggcagcctcgtagggcacggcgaggaggtcgacggcggcggtggcggcgtcgcagggcgcggcgaggagttccgcggcggcgacggcgcgttctctctctctctctctctcgggagctgcctatttgccattggggagtgactagggatgaaaacagaaggaaactatcaaatgatgttggtaaatttgtaagctaacataaatataatttgttgtgagcaaacaatgcaaaaatgatgttgcgtgagcaaatggttgcctagcggtaagattgtcttttcatgcaacttaacggaaagatgctaacagcaatttgacggcgatggcatttttgggagaaagaggcttgtgcaatgacatttttgggaagttgcctttgtcgatggcatttctaggattatggtgtttgtctatcgatggcatttgatggattttctcttttccaaagctacgagtgtagttcacatttatttcgtttcatggtatatatggcaaactgttgtagtaactgtctttcggtatcgtctatagtgcacgagagactatagttgtctcagatcttatacatgctcttaagcttactataaccaaacttttctattttgatatcatctttttttttcctctgcttgcgttgttcacatgcttttaactcacagatgttttacttgcttcaagattggatatatttttttagggagattaagacttgatattttgttgcccaatgaatcaatgatgagaaaaatccaagaaatgcgattgccgagcatggtagtgtgcattcatctaatatagattgatagttatttggagcaccgttttgtttgatgacgatacaaatttgcagtgtgtggatgcagattgatttttcggtttgcttcttccgttgagaccccacacaattgttcagtccagcgaacgtgagtttcctgctctgcagttgatcaggtcaattcagatgcctctcccacgctacctccaatccccaccctcggctccacaccctcgacattctgccgccttctcccgcggcctccggccctcgccgtcccaatggttctcccccagcctttgcctctgccgagttcccaggtaacttctctgtggtgaaagacttgcagcatttggataggaggttattaagatgggatattttgaggttgatgtgctctctgcaagtagaatgtgtgatttcccctatttaaaatggcgcattattgagccttttttttcatctggggggcaaagctagcaccaaaagcttaaacgtccccaaaactagcagaacagctttggcactactaaaccctacaactaatgcaggttcaattccagacagtgcccagatgccaccacgacgccgccgccgccggagtgtggctggca

SEQ ID NO: 30630 - DNA, 188 bp, Oryza sativa
ctggaaggtctaactgattgtaagttgatcccaagatgtgaaagcaacctacaaaacaatcagttgttgaagaaaaggtcaaacaaaagaattcacatgcttgaggtgttaaacaaatatataaagctagcgcacgaaagacctaatgtactgaagatttgacagaaatactttgcttctctggttcc

SEQ ID NO: 30631 - DNA, 1501 bp, Oryza sativa
aagtctattttagctccctcgagtatacctccaatctaattcgtgcccctaaacacaatatcgtatatcttgcggtttgaagagtggtttgacaaactatcgaaaccgttgtggtttgactccctcagcagtttgaagagtggttttcattgacgtgacttattgactaggtctaattgattgagtcagcatgtgaggcccacatgttagtgtcaccggctctttcttctcctctcatccttttatgttcctttgtcctcttttcctttccccacatgggcacatagcgatgacgccgacgagctcgattggggaatggtggttgacggctttggcgggccaggagcgaaggagaaggcatggtagaaggaaggggagcggcccctagcatagccttccgaccacgtcggggttccgtcgccgccatcgctctctccccatgagcctctatgctgccttctcctccagcattggtagtatcatctgtggctacagccgtgacctgctggctgccaccctatgcgacgatgatgcagtctcatgctcgcgggggcccatcccttctccaatggattttgcaatcaagctcgcagaaaagcatcttcctctttgcgctgccccaccgctttacctccccttcgacaataccggccctgttgcaaccactagcctcgggtccctcccttgctcgatccatctccgactcatgggccttatcacttaccatagcagagagaggaagaggaggaagaaagagatgtgggcggcttctgagaggaggctgctgggctacaggctagtgactgcagtggaaaccgacgtgaagggaggtcaatcagcctcggcccccatcgccggcccctcctagatatgggatacggtgggcccctccatcctgcacacttatatcagaaagatgttgcatgggcttgccaagctctggatgcgtgactgaccacaaaatttatcacaggttcgttagttaccgctgcttttgtggagtccagctatcgtagtagagatgacgacatgccaaagtggtgtgggcgcattaggcgggactgggccatcaccgattccccatccacctctttgccatcaacaactaccttcgtaaaaggagaagagagagatgggggagagaggaaggaggaagacagaggagaatagtgaggatgacatgtgggctccatatagtattctcaattttcttgttgactcggtgtttttgactgtggtcaatatgccatgtcaaccaatattattctcaatattgtcgtaggagtaattttctactggttttaatagttgaaatagctgttacactcgattttacaattgatgatacatgaattagattcgatctttatttgagagagttaaaagtggacttttccctttcacgatatcatgcgaaggtattcgtttggtcggttggaaatcctttgggacgtaaaccaaactaaaatttagaaaggtatatcatgttgtcaagtaagat

SEQ ID NO: 30632 - DNA, 1501 bp, Oryza sativa
ccgcgtcggcagcggtggtggaggcgcggctggcgggaggaggcaggccacgggcggcggcgggcggaggctggccgccagcgtcgtcggcggcaggtggaggtgcggcggcaagtggaggtgtggcggcatgaggaggcaggtcggcagcgtcggcgggaggaggcgcgtcgcgggcgtcagcgggaggaggcgcgtcgtgggcgttagcgggaggaggcgcgtcactggcaggccacaggcagcgagccgcacgcgattcggtagtgggtggtggcgatatgatctatgaggtttttgtgaatttgtgaggggctgcgaaccgggagtgaagatggtttctccagcagtgacaacaataaacaagaggtggaaaataaacgaaacaactagaaatgatgattttatggtacaacttttatatttatattcttaatctgttaaaaataagactaaaaatattaatttaaaatttaaatttcgctttggtttataagccgaccatcgaacatccacacagagaaagaaatagatagtgggtcgggcatggtcaagtatgggtcactctccgtcgggccacaggtcggtttcagggtatggatggtcgcatgcgccgggataatggagcacacaacgcagctcgatccggctccccccctccatacacacacacactcacccaacatcagaaagcaaaaggacaccacttaatcacctagagcctagtgtgcaatgcaccactaagctgtggcggctatctcagacaagattatcgtgttgttcttgtcgtctttctccgcaacaaaatactaatactcgctctctactttttcctttccagaatatgtttcacgccatcttgcttgcaggttaattttatatcggtttgcccgtaccagctttgtgctacagtggagtggaaaaataagtctgttgagaggtatactggcagattagtgaaaagttagttccgttctagagataaaattaagaaatgctacccagtccgcttcatatattataagtcattttaatttgtcctgaatcaaacttttaaattttcttaaaagaaaattactgtagaagaggctcctaaccttatcaaatttaaccaagtttataaaaaatgtatttacaataccaaattagttttattaaatccaacattaaatatatttaggcatttgtcgaaacatgaattcggcaataatgaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcaggttgtcttatatatgccccctagagggcctcctgcccaccttatataggatggggggcaggattacaagatagaaaccttaaccaatacggtatcggtttcctagatcaggactttaggccgttccgtaatatacaaggaaacgt

SEQ ID NO: 30633 - DNA, 1501 bp, Oryza sativa
tgctcaggggcttactagctcaaatacaagtattatatcttcaatttggacttgctccggatacatgcaacatgaattcatgatcatgggtctattttctatgctcaaagactggactatttattattccccgtaagggttatcaaccgaatacttgcgccagtcgggattcaatttttatatctattttggagtatcccataagggataatcactcagatcagaagctattcatatgagctacgcttggtctatattacccggaagatttattactcgggagcatgttacatgtgtcatcctttaaagggtgtcgagggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcatcgcttttcgccacgtaagtgtgcatttttattgaccaatattatgacttaggctaattatatattgtggccattttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttgaaaatttctttattcacaatatacaagcttctttatagctattttgctatatcactcatcatattttacaaagcagttggtatatcactcggatcatgttatttggaggattcacaccgcatatgctatatattgatatcaagtcacttggttgagtacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggagattatgggtaccccatacccacacggcatggttatccgactagttataggggataacttatatatatgtaatatgtaacagatcatgacttgggtgttacgtttccttgtatattacggaacggcctaaagtcctgatctaggaaaccgataccgtattggttaaggtttctatcttgtaatcctgccccccatcctatataaggtgggcaggaggccctctagggggcatata

SEQ ID NO: 30634 - DNA, 1501 bp, Oryza sativa
tatccctttcggcttaattaattacacgcgtcgcattaaccactcagatgatgaccaggttaaccatctgttattagttaatttaccggacaaacactacttagaaaaaacattttttacagacggccaaaagtaatttttccaggtagggaaaggaccgcctgcagatcaacgactacgaaaatcattcatttttataggcggcccaatggcccgtatgtaaaaatcctctagacgaaaaaaaaattgcgcccagccagccccgcacctcgccgccgccgctctcccccggccttcctccggccagatttgtaaggagaggggaggggagccgcaccggagccaccgtcgccgccccacgcggcatcgtcttcgccccgcgcctcgttgacgctgccctccccgggcctccctccggccggatctgggaggggaggggaggggagccccgccgttgccgccgtcgccgccgccgccccgcgcgtcatcgtcgccaccccgtgccccgcgcctcgccgccgccgccctcctccggccggatctgggaggggaggggaggggagccgcaccggagccgccgccgccggcgccctgcgtcgtggccggccccgcgcctcgcctcgccaccactacccttccccgacctccctccggccggatttgggaggggaggggagccgcgctgagagccaccatcccgcgcgtcgtcgttgccgccctgtgcctcgcctcgccgccgctgccctccccggcctccctctggccagacctgggaggggaggggagggaggaggaggggcccggtggggagaggagaagaagtgttgagggaggagagagagttacgagggaaatgagtggtggaggggtggcaggagaagataagagttaagtggtccgtctgcgaaaatcattttcgcaagcgccgcttaagtgatccgcagcgaacttcaccccaatttaaatttttataggtggttatttggctaaagggttatgtccgcctgcgaaaaaaagatcctatgtcaggaaaagtgatttttttagtagtgaaaccaaatggcaaaaatatacctgttcgggagggttttaaatcattaaatctaactctaaaaacggagtatggaacggacatatgaagcagcctaaattaaccgtgttgaatcggttccactctttcatatcactttagcccttcgttttctgggtgaagtttaaatcatttgattggactttaagaagagatgaatctagagctagcggccggagcctgtcaaacatgccttaattataactctcataatctaatattgcgctggttaattaagctggtgttactttctcacttgttacacgggacccatccgtggatgtgattagctgtagagccatgctgtgggctgtggcatggtaatgatggtacgaaagccaaggcggtgccaagtcaactactagctgcttctagtgtagctttggcacgtacatacaacggcaaagtcag

SEQ ID NO: 30635 - DNA, 1501 bp, Oryza sativa
gaattttagtgccatccaaacaaccccttagtttgcatgttccaagatatactttgatgatcatcgacatgcatgtgggtgtaaattggatttggatttgtcttattgatgctctaccatatcaggaaagtagtcttagacattataaatagacgtgacatttttcataaaatagggggatacactgtgatacgggtacaaattaaactatacaaatacaacaagacactagcttatttccatccaaagtcatgtatataaagcttgtttcggttagaggaaaattgtttttttactgtttaatctgcagattgaatattgcaatcagaaggatgaaaaaaaattaaaattggtgcgtcacacgaagttgctaaaattacagacatggcatgttctagatcaaaattgttgtaagattcccattggcccaatttgccttacccacaaactgaattccctttccggcatctttgtctagcaggggtaccgagtgccgagtacaacctaaacgaccaaaccgttgcaagccctgctctgaatcgatcatctccatgactcctttctggtgttttggaaagcaaagtcttgcaccttacctctttctgtcttcagtccacccggggtcaaattgtagatgcctctctgcttccgtttcttgggtaactgttcagcactcccaagttccaactccaagtgatcatgatagcaaaagaaaaggggtaaataataaggaaaagaaaaaaacaagacgcacaacaacgcaaacgtatacagatcacatgtacactttctgcatttcttaaacaaaaacagtacaaagaacattccattattccatataccttcgagcatgcttgccatataaaggtgccatgtctgagtcatcctaccaaagtagtcccaaggcaaacccaatcaacccgacctaactaacgccctccgtcttatcatagccgtccattgccacgatcgggcggccgcgcgcgtagtcaccgaccttttcgtaacaattcagttacaatgtagtactagtacaagtctattgtagcacagcttcacgttgccgaagcagaggttgcggtgcggtgccgccggtgcggctgtcacgtatatgcgcgcagcgcgcagacgatcgattcgtctgcgcatacgagctgacgcccactactaaaaacccacggaaacaacgccacgcgcggcgtgagatagatcgattcgttcgatcgaggcgcgggactcgcccggtggatcgcgttgcgtacgagcgtacgagggagaccgacgctgcagcgcacgtacacacgggacgcgacgagacgctgcagcgcagcgcagcctcgcgcgcgcacggcgaggggaagaaacacgcacgcgggggctggatcgcgcgctggctggctggggggaagcggcggttggcgagcagagcagagtgagttcccgtttctttctttgtgttcccgggcttttctcccattcatccacgcgccaccacgcggat

SEQ ID NO: 30636 - DNA, 1501 bp, Oryza sativa
atccctctccatgaggggcactactcttggctcctctcccaacagcgatacccctccttgcatgacctacccccaactgctaggccagtccgatccatggacggagagacaaggttgagaacatgtgacaatgcaatcgtggctgtcgcgctgtggccggtcgacaatgaaatcaaggggtgcaaacgatgcgctcacgcacaacctaaatggtggagggagaaggccacgcaagtggcacatccggcgacggctacatcgtttggatggagcaataagcacagtgacattgtcctgcatacggtcgtcctcgtcaacaatgcccacagggagagaagagagaggagaggttaaagtgagaggcaggagcagatctacatacaagtacaatccatatgatacataggacacattttagcacaaaaataaagcattatacttatgattgataggttcaggacatccgataattttcattgtagattttccctggagagagggggagggaggaagaaggtgaaccgaccgccacttacatgtgggtccctatgtatttttattttctttttactaactatgatgccacatcaacccaaactactctaaatattgtcgagagatttgatttgcattggttttgatagttgaaggatgttttatacccagttttatagttgatgggcataaatgaaagttgactcaaacagccaaacttgtgagacgtaaagtggattttttttccgaacatgtatgagcatccagccatgggctgaattaagtccaacaaactctaccttctcggccaggtaaactcaagagagaacatgagttttcaggagctcatcaaatatcttcttacatgacgaacgaatcttccacatcgttttttcttcggtggctggctttctaaccaaataagatgcatctctcgtttctgccataagcagcaccagatgccttccttgagcaaatgctctcgcatcaaggtcgcaatattcaaccgcatcaaccgccagcaatgctgatgaccaacctccctaagattctccctactttgttctttctcccaacaaggagagaaattgaatggttttgtcatacaaaactgccagcaaaagtcacttttttgaacaaaacaaatgacatgaggggaatcctcttccaggccaagctcttgtgtcagcatttggtgtactttcttcctggcaatggagttgcaatgcatccaaaatgctcgtttggttctttgtgaggtcatgtgatggaggcatcagaacgcctgggcaaagaacgattaatttatgcaatggtatcccttcatttccccaaagagcaactccttgctgttgtatctattgccaaaagaggtgaggaactgtagagctgcatatcgcactctcactattgggcatccctgctcactacacagtgtacagtagaagtatccgttgttatttagtgcaacaaaatgatacaaacaggcataaaaattatcactctt

SEQ ID NO: 30637 - DNA, 183 bp, Oryza sativa
ttcttatatttttcatagaggttttagttactccttttcattacttgtctatgttactagttgaatttcagatatgtttcaattttgtcttgcttatttgcttggactactttgtttttgttttgcacattcaaattcgtgctgaaggcagatcaactattaacaacagaataggccaagcga

SEQ ID NO: 30638 - DNA, 1501 bp, Oryza sativa
tttgataacccataacgtcatcgtttcacccatgtcgggtatagggtacggtcattggtgcttagtgaagttgccctgcgctcatgccattcggcattccagcttagcttgacacaagtgatccctgaaagagtgatgaaagggttccaattcgtaccgctaagttcctgccttttcactcgaaaaaaatattcggataggagtatactatttcttcttaataccattgatacttccactaccgttctcatctaaaatattccctccggtcctaaatatttgacgccattgattttttttaaataggtttgaccgttcatctcatttaaaaaatttaagtaattattaattctttttctatcatttgattctttgttaaatatacctttacgtatacatgtaattttacatatttcacaaaagtttttgaataagtcgaacggtcaaacatatataaaaaaaattaatggcgtcaaatatttagggacagagagagtacatcctcaacttgaaaatacaaccgattaattttcacatgaatagaaaatatatcatgatgagttctttatatatatatatatatatatatatatatatttatcaagagattacggggtaactcatgcttcattaagtttacaaattcaaactgattggaatgtggctccatcgaatcacccaaaactacttgaaatcaactgtttccgctcgaattttgctgagctttaccaaattctaccgatttgagctagcttgcataggttgacaaacttgtagtggtgttttgaatgcattcgtgaacctgcttcatagaattaattattagagcatcacgagtagatgcgcaatatacttttcacttctaaaattttaagcttatcgatggaaagtttgctccaacagttttcctaattagtatcctaaaattttaaatcccctttcccttctggctctcaactagtgggagagagcatcggctccgagtccgcagcgatcagatcgtgcaggaggaagtgaaatcgacaacttcagttgatagtttgaattatctcttatagagaagtatcttttaattcttaaatcctcatttacgcgcgttttgtgcttcacatattaagacgctttggatttaaatagattcatatatgtatttcatatatatgtttaagtttatacttatgttaacataggccgtgtttagttgtaaaatttttcttcaaactttcaacgtttccatcacatcaaaacttttctacacacacaaactttcaacttttccatcacatcgttccaatttcaaccaaattttcaattttggtgtgaactaaacgagaaaattgcttatctaccatcgcataagatgggattcgctcaaataccatcactaaaatgggcttcactataataccattctcaaccaagatgtctttgctcaaataccatcccggacaaaaatgcccctagttcatcttcttcctctctccctcccaccctccagtgg

SEQ ID NO: 30639 - DNA, 1501 bp, Oryza sativa; identical to SEQ ID NO: 30631

SEQ ID NO: 30640 - DNA, 1501 bp, Oryza sativa
cgcgtcggcagcggtgggtggaggcgcggctggcgggaggaggcaggccacgggcggcggcgggcggaggctggccgccagcgtcgtcggcggcaggtggaggtgcggcggcaagtggaggtgtggcggcatgaggaggcaggtcggcagcgtcggcgggaggaggcgcgtcgcgggcgtcagcgggaggaggcgcgtcgtgggcgttagcgggaggaggcgcgtcactggcaggccacaggcagcgagccgcacgcgattcggtagtgggtggtggcgatatgatctatgaggtttttgtgaatttgtgaggggctgcgaaccgggagtgaagatggtttctccagcagtgacaacaataaacaagaggtggaaaataaacgaaacaactagaaatgatgattttatggtacaacttttatatttatattcttaatctgttaaaaataagactaaaaatattaatttaaaatttaaatttcgctttggtttataagccgaccatcgaacatccacacagagaaagaaatagatagtgggtcgggcatggtcaagtatgggtcactctccgtcgggccacaggtcggtttcagggtatggatggtcgcatgcgccgggataatggagcacacaacgcagctcgatccggctccccccctccatacacacacacactcacccaacatcagaaagcaaaaggacaccacttaatcacctagagcctagtgtgcaatgcaccactaagctgtggcggctatctcagacaagattatcgtgttgttcttgtcgtctttctccgcaacaaaatactaatactcgctctctactttttcctttccagaatatgtttcacgccatcttgcttgcaggttaattttatatcggtttgcccgtaccagctttgtgctacagtggagtggaaaaataagtctgttgagaggtatactggcagattagtgaaaagttagttccgttctagagataaaattaagaaatgctacccagtccgcttcatatattataagtcattttaatttgtcctgaatcaaacttttaaattttcttaaaagaaaattactgtagaagaggctcctaaccttatcaaatttaaccaagtttataaaaaatgtatttacaataccaaattagttttattaaatccaacattaaatatatttaggcatttgtcgaaacatgaattcggcaataatgaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcaggttgtcttatatatgccccctagagggcctcctgcccaccttatataggatggggggcaggattacaagatagaaaccttaaccaatacggtatcggtttcctagatcaggactttaggccgttccgtaatatacaaggaaacgt

SEQ ID NO: 30641 - DNA, 517 bp, Oryza sativa
ccaaaccaacgccactgctccacccttcgtgcaaatacgcagccgcacaaaacagcaagcgagagcacggcaaatttctgctcgcctgcatgtatgtgatcatcagcccggccagaagcttgtcgactatagcaaattaatctccacttgcaaccagctgcatgagtcttcacctctctgatctctatctgcatgctaatgcaaatagtacttattaacgcaaaaaccttccttgactatggttaagatcagctaatccataatatttccattccatgataaatgctaaccctccctagccagccgcgcgcacacatttaatcggctctcaaaccaaccactccaaatcatgacagctaaactaaataatctggcttacccaaataaaacaaactattagccaaattatgctacaaacacatgcccccctgttttcggtataagtagaacgtgtaacttttgctttaccgaaaacaccataaaactaaccaacctaaaccacaaccgtcatctcaga

SEQ ID NO: 30642 - DNA, 260 bp, Oryza sativa
atgcgatgttttagaccggaatgaaaaagttcaaaaagcaacaaaacatgatttcggacatattggagtgtattggctgtgttcgtggcaaaaaatcactacgtgattcgcgcggcgaacttctgtcaattaatgctaatatttgcatatattggcacacgtgggtgcgatgttttacaccggaatgaaaaagttcaaaaagcaccaaaacatgatttttggacatatttgagtgttttgggtgcattcgtgggaaaaga

SEQ ID NO: 30643 - DNA, 849 bp, Oryza sativa
cgcgagttaatttcggattttgacatgatgggttagcaattaatacatgtgagaaaacacactgaaatcttaagagtgatagctacatttcaactaatgtttgtgcctagtgcatcactattggatttatctaattatcttgcagtagtaaggagctgacctgatcaaaaaaaaatgaagggaaaagatatgtaggtgtggagatcaggaatggttcaaatcaataaagtggattaaatgcagtgcaaattggaattctgtcacgccgaatccgtccaaaattttcggtattttgtgtggtaaagttaacactttggttgaatgcatcctcacgtgaatgacatcagtgagtggtgaagtgtgtggtgctggtttggccaaatccaagtttgaatgcatcactgtctcactcatcaaagcaacaaattgaccacgtaagcagtaggaaattaaggatcatataaagaaattacaaaagcaattgactgtttcatccaactgcttggttataatcaaagataactgaactggataggagggagaaggatcatcagaatgctgacttcatttgtttaaactgaattgaacaggaccaaggtttgtgaaatgttcagataacagatcatacaccaaaataaatggtccaggtggccattgaacatggaatcatccatcaagacaaacaaacaaacatacctattttgaattcgactaaggtgtgctgaaaaagagaattgcatatcattgtttactgaatcctgttatttgcatgaacaaatctctaaaaagacaaactttgtttttccaaaatccactgctgctccaagtcatctgaattgagagttgaca

SEQ ID NO: 30644 - DNA, 311 bp, Oryza sativa
tacggatgttatacaatttatttatttattcagtggtttcttttgttttatcacccctattttcctacaaattgtttttctcatgacatttcccctcagacttgcattaggtgtgatctgataaggttatcagcacattaatgggcatcattttcattctgttttggcctgttgatgaatggtactactctttagcgtgttgcatctaaccttgatttggtccctttgtaccttttgtgtcactgttcagtttagttcattccactcctgcgtgatcgaactggactaatattttttccatgttgtatagg

SEQ ID NO: 30645 - DNA, 278 bp, Oryza sativa
tatatatttttaagatatatagttagattttgtattgatgtatattaagatagccactatataatacccaagcatggtcatggatgccatcttgtttgtaacatagattttagcgttgtttggttgtcaattgcagttttccatgcatgtatattaagactgaccaattcattatgtcttcttttgaaatgattaatcacatcatatataatatattgcagtatataactatagaacacatagagatctacaactaaccaagttgtaaaacgtacaca

SEQ ID NO: 30646 - DNA, 418 bp, Oryza sativa
tcaatttacttatagtttatttataagtaccaaacaaactatcatgtaagttaaagcgaccaacaaaactattaacttgaagaaaaattaggtaatttaatttttaaacaacaaggctatatggatatcagctgcctaattatttttttctcttatattttttttctttgggacataggaaggttgggagagaaggttcatttactgttttattacaaattacaatttacaaggtgagttccaccctcatgacccgttagaacactgaaccggttacgttggcgccttttccgtcgcggcttgctgagcccaagctaaccagccataagtgggcctacaaccgattttttttattttaaattttatttattaaaatatttacagaaataattttcgatttaaaaattttacaaatagt

SEQ ID NO: 30647 - DNA, 421 bp, Oryza sativa
ttcatttatcacaaaactacatatttattgtctaattttgtgagaatggagacactaaatctgtagttttgtgataaatgaagatattaaacctatagttttgtgaaacaagttcttacatctgtagttttgtgatatactattcaaaatacctgtagttttgtgataaatgaatacattgaatatatagttttgtgatagattatgcaaagtatatgtagttttatgaaatttactaaaaaaaattcaatatagtactggataatgaatctggacatcctaatacccttgtattttttactgtgcagggggctgcctataaaaatgctacccctcgcatacagtagaaaatagcactcctagaggactaaagggggctaccaggcagccctcccagcccttttgcaggtggccccctaga

SEQ ID NO: 30648 - DNA, 266 bp, Oryza sativa
agccccatgcaccgacctgtagttgcattagtaaggccctgtttagttcataaaattttttcccaaaaacatcacattgaatatttggatacatacatgaaacatcaaatatagataaatgaaaaaaattgcacagttatggagaaaatcgcaagacgaatcttttgagtttaattaatccatgattagccataagtgctaaagtaacccatatgtgctaatgaggggttaattaggctcaaaagatccatctcgcggtttccagg

SEQ ID NO: 30649 - DNA, 253 bp, Oryza sativa
  unsure (1)..(253): unsure at all n locations
gtccaatgattctttcttcttccgctacatcgatctcttgggtcttggctggcctgcctataaattcgcaggcccccatgcctcttcccaatccaatccatccatctcccttgcttgccgtacactcgatctactctctcacacactcgtgtgatctctctctctctctctcgctagtcgattggcttgcctagctctctcaaactgctctagtgcagttcagcanaatctaagtgtctgaaactaatttaca

SEQ ID NO: 30650 - DNA, 382 bp, Oryza sativa
tttacttatatatgtagagtcctagttcttttgcaaggtttcctaggactttgaagttgtcagtgacgtggttccctgtgaaacttttagtcttaattagacatccacaacttcacattgatgctatattcttacaaaaaggaaaattattactaaagctttactagacctatcgctttccatgtcctacggtgagctagttgatgcaatgttcttgcatccagtatatgtcagtgcacaaccgcgtgggtccttattccccaaagtggtcctcatgtctttccttgtaaccacagacagcgacaacttttttgtttttagactctacattgttttgcttgatatgtagcaggagtagactatgctaaaatgtttttatctt

SEQ ID NO: 30651 - DNA, 186 bp, Oryza sativa
cccatcccgtcaggacgagggcttctaggcgctcgtccccagctggagctagcgtgttacctcctagagatggcacgttagtcctggtcagatatatgccaggcttcatcctaaccattacaggcaagatgttgtgtgaagaagggcgagcatgtagattgctaagctgacacgtggtggcaagaa

SEQ ID NO: 30652 - DNA, 746 bp, Oryza sativa
gtgagttcttaggaattttttttaaagcccccatcggtagacctataataagttaaagtaaaagttaaattttaaatttttaaattaattttaagatattttcaatataaatttctttttagcgttagcttttaagttgcttttgatttattaggaaatgtgggcaaccgatgagcctcttagcttcttttgctcacaagtgacatcagtggcggtgtatgtgagatttttttttgggtcattatagtagtacttgggccctgtttagttcgcgaaaagaaaattttttagatgttacatcgaatgtttgaccggatgttagaaggggttttcagacacgaatgaaaaaactattttcataactcgtctggaaaccgcgagacgaatcttttgaggataattaatcagtcattagtacgtgtgtgttattgtagcacttatggctaatcatgaactaattaggctcgaatgattcgtctcacgatctccttcttaactgtgcaattagtttttatttttatcaatatttaatgcatgtgtccaaagatttgaagtggtatttttgtgaaaaaaatttgggaactaaaccgggcttggtaacctgtaaaactggcgtgaagagggccaaatttattaacatatagttatatttatttacctctatttccgttattaattccaggatgatataaacagtcctaccaccgttcataatactaattattctccatcaatcactttacagt

SEQ ID NO: 30653 - DNA, 1501 bp, Oryza sativa
tcgagagatctcgttcgtactggttttgtaagttagaggatacgttgtatccggttttacatttcaaggacgatcttggcattcggtgacaagatgcggatcccctatgtaggtttttttttggttaattggatccatgccacttcaactttgcgaaattaaaaaaatgccactactattcgtcatatcggctacatgccactagaattttctaaaattaaaaccatatcacttccgtcactttttccgtctcctctctcacgccgtttcgttccccccggtttaaccgtttccatctccctcctctttcttccccatcttttcctccatccttgcgatggcaaagaggacaatggcgacgacggtggcagcggctcctgtgcactcccgccacagatggtgtcgaggacagcggcggcggcatctgtcgagacctcccgttgcggatcgaggacagcggtgacggctcccgagctccagatggcatcgaggacggcagcgacggccacagattggatcgaggacaacgacggcggcggcggctcccgagctcctacgccgcctccgctgcctcctcccctagctccggaccccaacttcctcctctgccgccgtcttctcgtcagcgcccttccggggctactcgctccacgccacgctagcccgccgctgcgcccccgcggccgcctccctcgccctctactcccacatccggaggcctcgccgcccaccccgttcatcttctccctcctcgccgcccttgcatgtcgtcttccccgccctcttacccatccgcaggcttcgcgtgcctcgcagccgtgtgcgttgcccacgcgcaggcgttcaagtgtaacgtgctcgcgcaccccatcatcaccccgccggatggagccatggagatcgccgcagtctacgatgactgtgcttgtgcgcgtgcggtggaagttcaccggcaagaggaatatgtagtggcgggaaggaggagatcgtgttgacgacggagagggaaagggaaggcgcaatccctcctcaagctctaccgctcgccggagagggtgatgaagtcgggaacggagatgaggaaggagggaggggatgaggacgggaacggagatggaaaaagggatgggagtgcatggtttcaattttagaaatttccagtggcatgtagccgatatgacaaatagtagtggtattttttttatttcgcaaaagttgcagtggcatggatcccattaacttttttttttccttttgcctttggtctcatatcggtcagacgggacccatgaacacacgcgaaacgcggcccatccgcctctgctcggctcgaaagcgtggccctgcccagcccatgagtggaatttccaacggcccacagggtactcagcgaggtgcaggtatgaaaggcaccaccgcgtcggagatagggtttcctctcgcgccgccggaacagcggcaaacccagcctagggcgaagggaagaaggagaagaagatgg

SEQ ID NO: 30654 - DNA, 193 bp, Oryza sativa
atggttcaatcagtgataaaatgaggaaacaaaattgctacagattgtgaaaaaaattgatgcagcactggatgtgaggttggtggatttgatttaggtctttgtcttggtggcttctgaacagaggcgaggtggctgctgcctggacaagcttctgatgatttcttccccttgctgtggttcttggactcca

SEQ ID NO: 30655 - DNA, 1501 bp, Oryza sativa
ctgggcagggccacgctttcgagccgagcagaggcggatgggccgcgtttcgcgtgtgttcatgggtcccgtctgaccgatatgagaccaaaggcaaaaggaaaaaaaaaagttaatgggatccatgccactgcaacttttgcgaaataaaaaaaataccactactatttgtcatatcggctacatgccactggaaatttctaaaattgaaaccatgcactcccatccctttttccatctccgttcccgtcctcatcccctccctccttcctcatctccgttcccgacttcatcaccctctccggcgagcggtagagcttgaggagggattgcgccttccctttccctctccgtcgtcaacacgatctcctccttcccgccactacatattcctcttgccggtgaacttccaccgcacgcgcacaagcacagtcatcgtagactgcggcgatctccatggctccatccggcggggtgatgatggggtgcgcgagcacgttacacttgaacgcctgcgcgtgggcaacgcacacggctgcgaggcacgcgaagcctgcggatgggtaagagggcggggaagacgacatgcaagggcggcgaggagggagaagatgaacggggtgggcggcgaggcctccggatgtgggagtagagggcgagggaggcggccgcgggggcgcagcggcgggctagcgtggcgtggagcgagtagccccggaagggcgctgacgagaagacggcggcagaggaggaagttggggtccggagctaggggaggaggcagcggaggcggcgtaggagctcgggagccgccgccgccgtcgttgtcctcgatccaatctgtggccgtcgctgccgtcctcgatgccatctggagctcgggagccgtcaccgctgtcctcgatccgcaacgggaggtctcgacagatgccgccgccgctgtcctcgacaccatctgtggcgggagtgcacaggagccgctgccaccgtcgtcgccattgtcctctttgccatcgcaaggatggaggaaaagatggggaagaaagaggagggagatggaaacggttaaaccggggggaacgaaacggcgtgagagaggagacggaaaaagtgacggaagtgatatggttttaattttagaaaattctagtggcatgtagccgatatgacgaatagtagtggcatttttttaatttcgcaaagttgaagtggcatggatccaattaaccaaaaaaaaacctacataggggatccgcatcttgtcaccgaatgccaagatcgtccttgaaatgtaaaaccggatacaacgtatcctctaacttacaaaaccagtacgaacgagatctctcgacaacggttttggttgacgtggcttctacgcctcctccaccgccgtgaggagcccatctgccgtcgttacacctcctccgccactctgcctccgccaccgcattgaggagctcatccgccgccgctatgcctccttcatcagcgatgccgc

SEQ ID NO: 30656 - DNA, 1501 bp, Oryza sativa
atggatcatggatgcacctgagtccacaaaccgaaaaggaacttcgcaaagctccaagaggaaccatgttccatgaaatggcctactggccctatgcctcatgtggccacatgattaaagaaaatgtatttgtaaagccagttaccttctcctttgctatctgctttagcaaaggacactgtcacaaaaccatctctaacttggtagaaaaaaaattctaaggcttacgcctatgaatcccttttcgatgggattgaaggagattgaagtaataaaagttcatataactgttaaccctttttccgttgggattgaaggagatatgaagaaaaataattccatatctattgagacgtggaactaatcggtttagattctttagtattaaccgaacgagctctaacaagacattacaaaaatgctaaaattcgtgcgctgatcaggctgaaataacagtagacgagtcaaatgcatgcatgtcagcatgtgatctgatacatgaaccctatactgaactaaaactacttgtagagctatagggcattgatacggatgaatgcacatcacgagtcaggacagggacgtgcctatggttcacatcgtttggcttatttcctaataagtcaaaacagcttattagaaaataaaaatgaatttgtagatgaaacttttataaatatgttttttgatgacttaaaagccaatgttgtaaaagaaactacgttaaaaatatctcaaaatcaattttaaaattaagtttgaaaatttaaaatttggctttttctttggctgattaggccatccgatgggagcatatgatcagtggcattcagcactctgtctgcgtggatttggttattagattatccccaatcgatcaatgtaatgctccatcagtttaggctaattattaggtgccgacccttaactccgggcccgcgcaacgcgcagatcacaagagccatgagtgccaggtgggcccaccggtccagacagctgtgctgtggtgctgcagcccggttccccatcacccacccctgtctacgatctgacctggtccaccgccgcattcacgtcgttggctcgttgcatgtggcgtggtcaatcactggtcaattattatcaccattttatctactagtcccggtcaattatgagtactcccaccatactataatacaaggatattttattaaaaaaaccttttagaattattatttattttatttgtgacttactttattatctgaagtattttaaacataaattttcgttttttatatttgcacaaatattttaaataggacgagtggtcaaacagtataagaaaaagttaaaatcctttatattgaagagagtatttgggcagtcaatctccttctcactcctcgagaggaaaaaacaaattgtgctgaaataacatgtgcagagatgagaaacaacaacttgtagatgaatatttttctcacaccagtcaaatacggatgaagatcctctaact

SEQ ID NO: 30657 - DNA, 1501 bp, Oryza sativa
tcttgttttccgttagtacctttttcaaaatgttaataatatattttttaaaaaaatttaaataaatctatttttaaatttataatagttaatatttagtttaatcgtgtattaacgagattttttgtgtcgcgtacgtgaaatgtttctctccaatttgaacaaacgaacgaggaaacaagattgttagctgcacgcttcttaaaaatacattcttcccaaaagaattcctatggcgactaattgtttcaaattatttgttaaattcatttccaaacatttaaattattcatcatataatgagtacatagtctgcgataataatctgatggataatatgtttcaaacagaactgactaatagtgcatatactgtatacttgaagaagcagattttttatgtcagcctattttaagccaccaagtatttctatttctttacaaattcgtcctatcaaatccctctcaaggcttttgtgctaaattactgtgtttcaacaagcagtagcttaagatcggcgagaagcttctctggtcccggccggccttcccctagatcttcagattggaacgctttaagatagaacaagaaagatgctgctgctgatgtataacttagatccatacacacgtggacgacgggtgatcgtgcaatcggagaatccaacggctcgcatggcaccgtgcattgaatggggttcggtccgaagcagatcgcgcccatcatttgcactgccaacaacaccagtgacgaaaccctgtctggcgcacgcaatatggtgcgcgacgagattaaaggcgccacaccggcacggcacgtgccctgcagacgctcgtgcccccacctcatcaaatgactcttctacccctccattgcccggtctagctctagccaatcaccccatcgtctgatttaactaaggtcctatttagttcctacaaaatggtaaaagtttaactattttagtgtaggttttgtcaaaatggatctaagtagtaaaagttaacaatttgttatttgtcatttagaagtttagagtagcaaattttgctaaaaagtacggtgagaaccatattgtctctctctctactagtaaaataacaaaactttaccatgtatctaaacaccaattaataaaacttcaatgccaaaccttttatcactaaattttttttaaaaaaattgccacagtaaatttatctaaatatgccctaaaagcctacttattatgctgttgttagcccaagggtaagatgggtattttggccactgtgaatgaatgctccatcagctatagattctctggttttgattgcttcgtaggctaaagctaaaaaaactgaagaatgcttaacgaacgcgcttggtggagggtaatacggtcatttcaacactctgccaccctctactaataaagcttagctctgcgagctcaccactctcactctgcagtgcagtgcccacgcgagccgagacgagacgatggcatcatctcccgctc

SEQ ID NO: 30658 - DNA, 1501 bp, Oryza sativa
tcctctagttacactctcgtacagtaggagtgaagcatcgactaagccgttagtaaccacaaatgtactaccttcggcatgggaatatcacaaagagcaataaaaagaagacaaacagactgcatatctatgagaaaaccatgcaagattgctagttatttccataaacagagaaggattcaaaggtatggatctgtatcacacttaagatagtatgcgaatttggaaatttaataaaaggaacgccattttggataaggatacatggacgaaggataaaaggaatatggatttgttggatttcagctccgggttgcttcaaaattccaaggacaagtcaaactgatatggcttaattcccccgagaactttgttttggggattgtctttaaaaaatatttgcaaaacagaattaatttttgcatttttaaataaagttttgcaaagataatttctccaaagagaaaagagtgtttgtttccaacaatgtaattgcaaaattgtctccaaaaccactttgagattatatttaaattctggtaatggtcaaaattagtttcaaaataaatatctctttgtaaaatatatgtgaatttcagttctaaatagtttattgcaaaattttccaaaaattaaaattccgtgcaaaatcaaattttgaacgcatgtgttcgtaaacatcctttccaaaaggtttgcaaagctgaacttctagaactattgcctaaagctttccttgcaaaggaaattattgtgaaagatttccaaaacctttgtgaaaactgttttccaagcgattgtttccatttgaaaatattgcaatttctgaaaaaggtccaaaaaaaattactttcaggagatttattttgggatattcaaaagtattgttgtttcaactatgaaccgtgcatgcaaactatatggcattttgccctgttggcaagagttttcttttgcaaaataaaatcaaaggttgctttggttgcagaagtttctagttgccgtattgattttgctaaatgtatgattatacaaaatcttccttgaaaaatctgttatcaaattatattgggtgagaaaatacctctcttgaaaactttaaatggtttgcatacatcaatttcaaaggatacttgtacaaaaccttttttttatgttgttacctttttaaattattttcaaacattcttattttaaggggggtagcctattatgggaagacctcaagagaatcaataatttgtgagaacaatatggataaggaatactatatatcaaggtttattcacccttggacaaggaaattgagcagattcggtaccattggacagtaatactgcacaagatacaaccacggctctcaccaacacgatttatagcataatattaagaaatggagtgaacagatgaagaagaaagacaacaattcagcattgtcatgctactattgggccccgagaattttagtttactaaccttcaacctactaacttctaacaga

SEQ ID NO: 30659 - DNA, 1501 bp, Oryza sativa
accatgaccagcctcatgcttaccttctccatgcaaattaggtcacacgagattatctgtagcaagctgtctttgtttgtcatacacgattggtggggtgccttttatagcagatagtttgcctgcaatatcagtggtggggatggaacttagagaattagagattgtaagatggatctatttttagtgtgagcttgcaaataggtcatgcggctatcaagaaggctagagatgtagggcaattgacaaaaaatgtggttttgcaacctacctaaatggtttgcgaaggcgggttaatggaaaacatgaaacaaggaggctagcaaatcgatatccgaatagaaatcaatccctcaaggcaggctctcatacaaagcatcacctaaaactagacaccacgagcgtgtaacatcctgaaaattcccgacaataaaaatcactaaaattttgaactttttaaaacttttgcatcatgctggatgttatggttgctattacttgccaaactataaattgtcacaatagaatatttaattagtttttaagaaatatcaaagcctagaagttatattggataatttttggataatctaatggaaagcaaattcatttgggaattaatgaataaccaaataaatattcaaatcaaataattgaattctcaaatgcaaaatatatagagctacatctcaactccaaatcaaatctcagctatttgcagtttagtcctccctctttctcttttccttttcttcctttttcttttctttttctgtcggtcactgtttatgggctatcacctattcgatccggtcccatgtccgcgccggcgtcctgcccgtgtgccgcatgccgcgcctccctctcctcgcgccgcatccattcgctcccaggtcatgcgccgcttctaggccatgcgccgcatccctccgcatccgcgctcgtgcccggacgccgcgcacgcgatcgaccacaccaccttcgcatctcgtgtcgcccccgtgcaccgcatcgtgtctgtgccggtgcgccatcccctctgtgccgcgccgcgccacgcgacgcctaaccacgctctctcgctccggtttccttccgggaaacacggcgccgcacgtctcgtcgcgccgtcacgatcccatcacccgtcgcctcgccatcgacggataacggccaccacgtcgcccctttgtcatcattgtcctctcacccatctcctcgtgtcacatcgtcccacgtcgtgcccatcagataaacggcttctcctctagccgtctagctgcgacgcctacaatcctagtggcaccattactccatggatccccaaatccccgagtcagtgagagaggaggaaacttacccacgtcaacctccctaacttaggccgtataggcagccatcgagtgtaccagctaccgatcttatcctccacgccatcctggcttatctccaagccaagcccccatacaaaccccaaccctctctgcctttttccctcgaa

SEQ ID NO: 30660 - DNA, 1501 bp, Oryza sativa
taacacctggctagatattgtataggctattaagcactataacgcgaaatattcagttagattaggtctcaaatacaaataataaattcaaaactaaaattactatgaacttagtgtgttttgtagtagttatgcaaatatttctcgagattttacctgacaccatttattttcatagtttttatcttactagaaaaaatacccgtgcgttgcaacggttaaatactatcttatatcttattattattatacggtttacctaaagtgaaattcgctgtagaaatttgcttggatattatttttacaagatcatgagctataattaggactccaatcgtctcaaactagcatgcaagttttttaaagagatttcttatatgactccttctatatttccaaaagcaaatgaatttaaaaacctactcaaatacaaatctgtaattccaaaagcaaatgaacttaaaaaccgactcaaacaaagatgacgtaccaaagtaccggcaaaaacatcttcaattttataatagtagagaaattagatatcttgatgcatatgaggccgattaagaaatgccaataaagatataaaaacaaacacaaagtttgtcaacatacgacttgagataaaaaaaaatgttacgtacaaaagagcacaattgagtagtggcatcattagtgccatttttcaaggaccggtacatatgaaagtacatatatgctggtttctgttgagaactgacacatagacaaacatctgtaagcgtcggttctcagcaaaataaatcggtgcaagggatatatttgccggttcctaattttggcctcctgcacaggtcggggaagatgggaaatgcctcacacacaccgattttgtgtggactggtacatttggtggcatcagtcatcaattagtagtggttcatcgcggcaaccctcgcttgcgtggcaaacaccgcgaggccgagagaagattgccgtgagcttctcaagttttttcctttcttcagcaagttcaggggaatctgttgccacgcacgtggatgcatcgacgacctcctggctcgccgccagcacgatgcccactaacaccaaggccaccatgaccagcctcatgcttaccttctccatgcaaattaggtcacacgagattatctgtagcaagctgtctttgtttgtcatacacgattggtggggtgccttttatagcagatagtttgcctgcaatatcagtggtggggatggaacttagagaattagagattgtaagatggatctatttttagtgtgagcttgcaaataggtcatgcggctatcaagaaggctagagatgtagggcaattgacaaaaaatgtggttttgcaacctacctaaatggtttgcgaaggcgggttaatggaaaacatgaaacaaggaggctagcaaatcgatatccgaatagaaatcaatccctcaaggcaggctctcatacaaagcatcacctaaaactagacaccacgagcgt

SEQ ID NO: 30661 - DNA, 1501 bp, Oryza sativa
agataaaatttgaattttttttatcttaaatttaaagttgattttggggttttttttattgaagtttattttttaagcctttgctactaaatcactaaaaacacgtgtataaaattttattcatagattattttttgtttgtaaatatatcgtttcgtttattccccgaagtcatgagtgcggtgtctgttagaggaaagaatattagaagaagacaaatccaaagaccattttgtttaggatagcatttctacgtggagtgtgataagacggttcgcggtggatggcagctgggagcaatgcatgattaactgtaaacttggggacgtttttgtaaaatgtttgctaacgtggcgctctaactctcaagcattcccatgacgtttagatagattaattaatatatacagcgtggtatttgtgcaaaatctatattcaatagtaacataatcgcaagattcccatgtaataatagaatagaacatatgacgttgtcatagttgaattggacgatcgcgctaatgatacacgacgacacgggagacgacacctgactgatggacacaccacaagcgccgggtcaacccgcggtggaacagttggacaccatcgagagagcaccgcaaggatgggagcatccgagtatgcatagagcaggtgcaatagctataagagcatagtatatcacactattagctctaaatcatctatagccaaagtaataactcatacaatagttgtttactatactattaatatctggccccacctatcatacacacattacgtcttggagtccgtactatctgtagcccactgctcttctctcccttcatttatctctttaaaatatgtttatagctggtttatagcctgctattgtacctgctctaagccagctataaccatatatcgagaagaaatataagaaagcgggctacagatttgtagccagctgctacacggactttaagacattattatatatgtatgagaggtgggatcggatattaatgatgtagtatatttttatagataactattttatgaatgtactatcagattacctaaagatgatttggaaccatcagttggctatactattaaacttgctcttagggtgtgtttagtacacgctaaaattggaagtttggttcaaattgaaatggtgtgacgaaaaaagttaaaagtttatgtgtgtaggaaagtttggatgtgatgaaaaaattggaagtttgaaggaaaagtttggaactaaactccgcgttagtatgacatgtaagccccacagtacagaaaacaaaagtaatcttccttttggtctgattctcctgaaacgcatcgctatccctatgaccctatccacccgcatgtgcttctgcttcgtagttaagcttttctagttttattttcaaccaccgcgcactcacacacactctccgacgatattttccttctctgttttttttttccttcgccatcaagccggattcgaggacgg

SEQ ID NO: 30662 - DNA, 1501 bp, Oryza sativa
tgacgaaggaagtcgacgaggcaaccgccgttgcacaaggcacatgcgccgggagccgatgttgctcctcgtcattgtgccgaggggtccaccatggagacacggagggcgcgcaggggtttggctatggcgacatcacgataggctaatgacgtttgtgaagggcaccggtgggttggggttcggcgataggcgacgtgacgctctcgcacaacatcgtgatgcaccactcctcctcatcccgccgccaccgctcattcttgctccccaccatgttcatcgccgaccaggcccgccagaagcccaggttgaagccttcctcctccacgtgcaatctacacatcgtcattggcggacacgttcttcaagccctcgtcatgcaggatcttgcgccgcgtcaccatctccggctcctctctcgtcggctactgcccctagtcttgagcgggatctcgctccgccgccacctttgacgaggaggtggctgaagcagggtggagcagctggcgagcaggatggcaccgctgctctcgactcttcttcttgcaccccctcctccttgccgctcgccgccaccggggatggggagaagccaaaaaaatctaattgttgtattatgttgttttctgatctattagatcgaccctctcatagagtatatacactggtggagaaaccatctttcgtcagtcgggctaattccacaatagtcccggttgcaacaaaaactgggactaaagatgatctttagtcctggttaaaaagggtaacaggcatatttgatctttaatcccggttggtaataccaaccggttcagatgttgtcagggcttgtcaggcccccccgggatctttagccccggttcataacaccaaccgggactaaagtcccacccctatatatatgtcttcttcctcctccagcccgagcaagcttcaaaatttcttcaaaaaagaggggaggccatgctaaaatttctagtgaatttattttggtgattatatacaaatcggaggtgcctaaaaggttagcaacttcatcctccaatgttttttttttcatattacatttggaactatgttttgcccactttttgtctccaaaattttgttgttagttgatgagagagaaaatttgtgtggagaagaaagaatatatagaaatttagtttatttgctaaagaaggttttataaaatagttgagaaggaaaatatagtgaaagttaatcttgaataatagaaaccaaagtaaaatgaaaaattaaaataagtacagcacattaatattaatattagtttaaaactttataaatagtaaatatataattattcggtgtaatatttcataatttttgtatgaataatgatatgtcattattgtgtgactgttgaaagagttcgtaattattttataattattgtatgactgtcattattgtacgaataattatgtgtgtacgatttttttcatgtcatgtagatggatcggcaatggatgta

SEQ ID NO: 30663 - DNA, 520 bp, Oryza sativa
gtcatactatattacagaacaagcataaacaaatttcctagcagctttggttgtatcaccagatcgaatccaatggtcaagtcctttttatttggaaatcagagtttatacacatgtgcacccccccccccccccctttacttgcaacttgagcacgtaggatgcataaattaaacatatagatcgatgtcacttcacctaaataatgttgctcttgcggcgcgatattttagagaatatgcaggagaactgcatatcattctattgatgaagaagtgaggagggatcagtacatagaacacatccaagctacacatggaacataaatcagtttgttcatacaacaaattgagttcgataagctacatgtttcatgcctaaatgccattattatgctacactgaagcagttcatagaatcttgtttgatggcaagagttatggaatttgaagttggttctgtatggcttaattgtttgtattaactcatctcttactttgtcatgaataattatgcaaaa

SEQ ID NO: 30664 - DNA, 539 bp, Oryza sativa
ggctcgccgccagcataatgcccactaacactaaggccaccatgaccagcctcatgcttacctgctccatgcaaattaggtcacacgagattatctgtagcaagcagtctttgtttgtcatacacgattagtgtggtgccttttatagcagatagtttgcctgcaatatcagtggtggggatggaacttagagaattagaggttgtaagatggatctatttttagtgtgagcttgcaaataggttaggcggctgtcaagaaggctagagatgtagggcaattgacaaaaaatgtggttttgcaacctacctaaatggtttacgaaggcgggttaatggaagcatgaaacaaggaggctagcaaatcgatgtctgagtagaaatcaatgcctcaaggcatgctctcatacaaagcatgagctaaaactagacaccacgagcgccacacttgaaaagcgagcaatcttgatcctggacacacgcagagtaaatcgaaactgcaattaaactttcaaatggcacaaacatgcttggagaaca

SEQ ID NO: 30665 - DNA, 345 bp, Oryza sativa
ccattctgacccctatactcaggagtgttgtgctcatgcaataactcaacaagaatcttctctagggctgggttccaagaggctcttgttttttctacacaagataagaattgatgtataatctacatttaataatttcaaacatgaatttcacatgttctataattgcatacctattggagaacctccatgcttttttgtaggacgacctttcggagagttcttcttttgtgcagctttcgctaaaagcatggtcaaccttggagaacctcttccaagcatattaactgagaaaggatgcataacacaatattcataacaaaagcattgtagcaaatgtatgtc

SEQ ID NO: 30666 - DNA, 251 bp, Oryza sativa
tctcgaactacaatcgatatactctgataccagctctgtcgaccacccgattttggaaatcggaaatctcttgtgtttatcagtaccaatccctggatcagtagttggtacacacatacatagccgaatcacaacatatcacgaatgaattcaggctaaaagagttaaatgcttacattagggccaggcaggccaacaactatcagagaaacaacagcggaagacaaaataatacaagggcccggttgaca

SEQ ID NO: 30667 - DNA, 1501 bp, Oryza sativa
cagcaaagctcttcctccactccctccaacctccagctccggccggggagcctcgcaatggtgatctctagcggtggtgagagagtgatcgcatgatgttcgatgaaatgcattcgagggaaaaaggcagagagggttggggtttgtatgggggcttggcttggagataagccaggatggcgtggaggataagatcggtagctggtacactcgatggctgcctatacggcctaagttagggaggttgacgtgggtaagtttcctcctctctcactgactcggggatttggggatccatggagtaatggtgccactaggattgtaggcgtcgcagctagacggctagaggagaagccgtttatctgatgggcacgacgtgggacgatgtgacacgaggagatgggtgagaggacaatgatgacaaaggggcgacgtggtggccgttatccgtcgatggcgaggcgacgggtgatgggatcgtgacggcgcgacgagacgtgcggcgccgtgtttcccggaaggaaaccggagcgagagagcgtggttaggcgtcgcgtggcgcggcgcggcacagaggggatggcgcaccggcacagacacgatgcggtgcacgggggcgacacgagatgcgaaggtggtgtggtcgatcgcgtgcgcggcgtccgggcacgagcgcggatgcggagggatgcggcgcatggcctagaagcggcgcatgacctgggagcgaatggatgcggcgcgaggagagggaggcgcggcatgcggcacacgggcaggacgccggcgcggacatgggaccggatcgaataggtgatagcccataaacagtgaccgacagaaaaagaaaagaaaaaggaagaaaaggaaaagagaaagagggaggactaaactgcaaatagctgagatttgatttggagttgagatgtagctctatatattttgcatttgagaattcaattatttgatttgaatatttatttggttattcattaattcccaaatgaatttgctttccattagattatccaaaaattatccaatataacttctaggctttgatatttcttaaaaactaattaaatattctattgtgacaatttatagtttggcaagtaatagcaaccataacatccagcatgatgcaaaagttttaaaaagttcaaaattttagtgatttttattgtcgggaattttcaggatgttacacgctcgtggtgtctagttttaggtgatgctttgtatgagagcctgccttgagggattgatttctattcggatatcgatttgctagcctccttgtttcatgttttccattaacccgccttcgcaaaccatttaggtaggttgcaaaaccacattttttgtcaattgccctacatctctagccttcttgatagccgcatgacctatttgcaagctcacactaaaaatagatccatcttacaatctctaattctctaagttccatccccaccactgatattgcaggcaaactatc

SEQ ID NO: 30668 - DNA, 1501 bp, Oryza sativa
tccagacggctcaatgcagtacgcaaacgacaacgcgttgcagatggccaaggtaacaaagcatcataaacacctgaagattgtgtagtaagttccatgtgatttctgcatcctgctaacccctgctatgctcttccatccaatgcagtcactcaaggtctcactgcttgttcttggctacacatctactgccctctctgttttcacatcaatcgggctgctgttgctggcgcagcagatcaactctgatgacaaaacggagtagctgcctaccagttgtctgaaactgtcgatgtgccattgtgtgtgctctaatcagtggatcatgatttcatgacacattcatagcgttctgttgtaccagtgtaattagcaacgcaactggataatctgtgtataaattacggaatgtttctgtacaagaattttaagttcacattgttcgtcagtgacttctcaagatcttgaattgaaaggttgaagcagctcaggactgactgactacagacttacagttacaacttcagaggatgtgaattattcatttctcttgcgcactaacagttagttcttcagtggttttgggatgagatcctaaaaatatcacatcaactagattattaagaacaaattgattaatatttatacatgctgaaaagcttaaatttgttactactgcgggcttgtttggcacagctcacctctcctggagctgaagctcagccaaacagtttcaactccacctaaaatgagagcgaagttgggtggaactctcttacaaaatgaactagagaggtggagctggatttaggctgcttcacaactacattctagacccgactcctagaactaaatttaggagttggagctctgccaaacagccctgctactactacatggttaaggggggtgtttaaatctaggggtgtaaagtttttttgtttcacatcgggtattatatagggtgtcgtatggggtgttcaggcactaataaaaaaaaataattacagaatttgtcagtaaactacgagacattttttaagcctaattaatccgtcattagcaaatgtttactgtagcaccacattatcaaatcatggagcaattaggcttaaaagattcgtctcgcaaattagtcgcaatctgtgcaattagttatttttttaccctatatttaatattccatacagatattcaaacatggtgaaaaattttagggtgggatctaaacagggcctaggaacaaaacgagcatcacatgctgatctgccaagctggctagccctaataatttggaaatgcaatattccaatatccaaagtggacccggcccaattaacccaaccaaaacccacgcccacctcctctccccttctcggctgctcttctccccctccctatcctctcctctcacctcgcaatcacatcctcttcccttctcttctccatcgcatctaccaccgagcgtgcaaagaggggggggggggggggggggtgaaaa

SEQ ID NO: 30669 - DNA, 1501 bp, Oryza sativa
atccttcggaactatatagagttcataggagcctccatccacatcagagcaaatcaggacggcattttcagttggactatacgacagtgtcctgggtgactgattcaagctgaccgatccaggtcttcttattggagccaactgaacctccttctgtgtggagtattcaaagaaccgaagaaaacggtccttcacatagaagacagtatcaccactcacagagaaagctggacgttccctctctaatttaaacacaatcataccattgtcatgaccagcggcaagaagattcatctcagggtgggcagcaagaatccagaaacgatcatgttcccgcctgaatgtttgaataccagttcgcttggtggcatcccagacacgaatgcttttgtcctctgagttggacacaatgatgtcttgctttgcatggaacatcacgcaggacacattattcatgtgcccccgcaaagtatcaacttcccaagccttggtgtctgtccaaaaatagcacacttagattgcatcatttcaaatacctcaatagtggtatgcatataatagcgtttggccagtctaccaatgtgcagtagaataaagtgctacgcaacaagagtgaccacctttagtcccagctaaagtgatatactctaggtcgggagctagttactaattgagtaattgtgaaacatgtttcttgcattcagcttgtttggtgacaagttagttacttcttctgtatgataaattgaacaaaacaaatgaatttatcatttaaccaaatccattgttttgtagtactgttatatggaaggatgaatggataaaaacataaatatgtaagtgtttatcgatggaaaatgataatcaaaaagttcagggcgtagtagcagtattaccattcattctccatagcttcacttgccggtcatctgccccagaaacaatgagcggcaatgtggggtgaaatgacgcccagttcaccccacggtcatgcccttccaacacatattttacaactgcatcaacacctccaaacagatcagtgttcatctgggtgaggcgcaggatgtcatccgcaggtgacaccgtcttcttcctcaaagcaccaatatcccatacacggacagtctgatccagtgatgcggacacaaccagatcctccttgggatggaatgatgcgcacatgacatagtggttatgtccagtcagcacagccacacatgtgcgtgactgccagttccatatccggattgtctggtcatcactagcacttactatccatgggtactcgtggtggaattgcacggtgcgaatgtagtcaaggtgcccatgaagtgtgaagaggcagcggtgtgtcttgtaattccacaccttaatcttgtaatcatcacctgcaatgcatcacagaaatcttagaatctacgattcaacaattccatatcccaatcgtattagcccacagctatcccagaaatacaaccaggcggaacaccagtgtgac

SEQ ID NO: 30670 - DNA, 163 bp, Oryza sativa
tcgatcgtgggatttctcgaagattcgtgaagcttcgtgaagaccttgagcaaggcaagtcaccgtttgatcatttgctcctataattggaaactcattattgttttgttttcaacttgcattagtagaatcacacacttaacttgcttggcctcggtttgcg

SEQ ID NO: 30671 - DNA, 1501 bp, Oryza sativa
ggaggcggtgctggcagcaaggaaggccaagagttggggagttatactaggcacccttgggcggcagggaagcgtaaaagttctcgacagggtggtggagcatttggaggagaaagggctggaacacacagtagtgctcatgtcggagctgtccccggcaaggatggagctgtttggggattcggtggatgcgtgggtgcagattgcatgcccacgtttgtcgattgactggggtgaaggattcaagaagccaatgctgacgacattcgagtttgatgttgcactgggctatgttcctggatggtgggagaaggggagtagggaatgtggcagtggagatgccaccggttgttgttcaggatcaggaacttccacagattgtggttgcagcaatggtggttgtgctgacaaggactttgggggggagtacccaatggattactactctcaggatggaggtgattggaacagctgctacatgaagaagaagccctctactggagagagaaagctgcgagttcggattggtaattactcaaattcatagtagtttacatgtggcctttttgtctgtcctttttcccctgtatactggggcgaaatgcttgtgtaactcttacattctgaatttttcaatattaccggcatatctatatgttttgtcaatcattttaaatcaacaaggaaatccttgttatgttagtgggtgttataattctctgcttaattgcaacatggtgattttttttttcaatgtgaaatgtccttagcataaaggcagaatcaattcttttttttttcagaactattatagaacttcaggatatattctttgatgaccaagattggagtgattttttttttatgatagagcataccttaatgcaagaaagttatctattgaatttgttaatttattgcacttggtaatttactatagactagagagataagaaaggactattagttaagctctgaataatacacctgaactatgtggatttggacatagtgagcatctttcttgtgacaatcggtagtgcaagagttatccactggtggctatctactgtgtttgtaaactcctgccatcatggtcaatgtgtatggtttggtcaaaatcgcactcgtcagttaatttgattgatactccatagcaactattgcatgttaatgtgctattcaccttttttttttgctgccatttgttagattttgacgtgatttatgcttaccattatgtgagcaggcagcaaagttcaagttgaggataagcaacaaagctaatatcgttgaaacgagatatcaagagcagcttcatgtttcttcagaagttttgacaccagagttgaatagtatttttgatcttagcactgccgttacgagtgctgtgatatctgtatctgtacacagatgtaaactactcgatcctgcgccacactgtaatgctgtgatgttgtcttcccataaaggtgaaatgattctaagtttatggagcaca

SEQ ID NO: 30672 - DNA, 1501 bp, Oryza sativa
ccacataaaagcattacattgggactacctgtgtcattttttatgtcagtacatgttggacttggacataattgattgtatccaagacaaagatgcactggttcacattatccaacagtatgttgaaaaaggatttgttatcttctaaaaaaactggttgctagatacctccatcagctaaaccatccttggacaaagcattccgaattctcgagagaacagtcaaggtgcgttggaaacctttctgcattgcctacaccaaggacacacaacattctgtacaagaaatgctacagaatccaccaggacgtataagctgaatgaaacaaagttacctcccatcgatcaaccatcacaaaagatgagctttcacatgctagttcgcataagcgaattcggtgggctgcagataaaaggccctaatccgttccaaatcttaaactcaatcaagagaacagtggtgatattttttagataatggattaagaatccggcctctacaccacaaggagaacagtggtgatgccacacattaccttcttcttgtaagcatcgttcaccggagacatgtaaccacccaagacagaataccctcgctgctgcaattcatcctttgccagttctaaatgaaacatatcagacgggaaaaaataattaaaaaaaactttcttgctgtaattatcaagctgttcatgggacaacacaagcttataggcataaaaaatcaaacaaaatttagaggcttaccaaacatgcgcaggtgcatgtaggtgggaggattgaagctcccggtggccacgagcacagccacacctcgctttcctccctccctaccacatcaagatcgaatcaagagatacatggaaggatgagaccacccatcaagcaaccaacaacaagccaagatcggatctcgctacctgcccggatccacggcgagcttctccgtggggagaggcaactccagctcctccatggccgccctccagtacctgcgaagattctcaactgctacgaaatttcgactccgccctaaggaggtccggccctcacttccactgatcctctcagtattccgtggcctccttggtcgccggagcacgccgccgagctttgctggagccgcgccgccggcgatagggcggaagaggaaagagcgagctcgtcgcttcatgggcctaagttgggaatagcctaggtgggccttgtctgcttaataggcctcatctacttagtgggccaaaaggcctacatgctttttcattcgaaggcctatatgttagttgggcttgacctccttactaaacctaacctcgagcagttgcgctctctccttcttcctcatctccctcggcggcggcggcggcggcaagcgaaggagaaggcgaaaatggtgaggagaatcgcggcgagcggcgatcgatgcatcttgtagcgcctctcctcgcgtggatctgacagggattgatctggttgctttgtgttttgttcttctttgcgc

SEQ ID NO: 30673 - DNA, 1501 bp, Oryza sativa
ttgggctgcctcccattggagggatgcccttgccatgcatgttggattttgttccaacacctgattaatatgaaaatttctaaagtccataccaccattttattatttaaaattttaatgatttttcagttaatcattgggggatttattttatatttattcggatggtaattaatctcatgtggggttctatgataaaatggcatttaaatattttttattttaaataaattttctatgcatgcatgtcgccgttaaggacatcaccctgatctagtgatcttccacccccgtgcgtgctttgagtcatagctcggtctgccgctcgatcctattgcggagctcgatctggcaccatcgaagtttgattcgctgccgtcggcaccccttccttgccactggagctccatggtccgtcctcaccactacagctctcctgtcattgtcaagctcagtctacacatcggagctcatctaccatcagtcgggaggggatgggagggtacacgaggaggtggcaccggcgaagatgggagggggaagaggaccaaaagcagttgaatgcgcgatgggggagaaagagaatgggacgagggggttccgtcgataagcaagggtactctatatgtaattttttttatcttgataaagagtctaaatataaaagttgagttgatttgttaatatacaatatgaaaatgactaacatacaaggaatcgaggcctgagacgaaatagaggcacaagttccgctccgccgttcgccatcgttgatggtcgggttaatttctgtcgggctcggcacaccgtacgtgacgcgtggtcgcgcgcgcgcttcacccgcacctgcgggggcgcccggcgcaacgctcgaggaggatacacggttggatgaagacttggtgagttggcatgcgacagtaaccgtgacgctagctatctcttgctacctgatcacttcttgtccatttgcacttaggtgcagcgtgcaacgttggtttcctctgcatagtagcacgcacgatcgacgtggggagtggggactactttttattattttttaagttgcttttgttctttcctccctattgctgcaatggacgtcagtttcgaatgggtgcaaagtttttaaagtatacgggcgtatatttgaagtattaaatgtagactaataacgaaacaaattatagattctgtctgtaaaccgcgagacgaatttattaagtctaattaatccatcattaacaaatatttactgtagcatcatattatcaaatcatagtgtaactagactcgaaagattcgtctcgcaatttacatgcaaaccgtgtaattgatttttttccatatttaatgcaccacgcatgtgtccaaacatttgatatgatgtttttggctaaaatttttaagaatctaaacaaggcctaaggtaaaaaatatttttccgggaaccatagttatagtagctggtagttgcctacatgaaataggggtggagata

SEQ ID NO: 30674 - DNA, 1501 bp, Oryza sativa
cgtgctgaccacgatccgcgtgacgccgaggacggcgtcaccgccgaacctccgcggcgcgcgcacctcgacggtgacggcggccgtgtcggaccggaggaaggcttcttcgacgcggaacaggaaccggtcgttccacgtcgggtcggcgccgccggcgaggtcgacgccggtgcggagcttgtgggcggcgtcggcccaggccacggcgtaggcggcgcgcacgcggcggccgaggcggcggtgcaggtcctgcgcggagatgacggtgacctcgagcaactggaggagcgtggagggcggcggcgacggcgacggcggcggcgacgcggagcagtcgtcgcggtgccggccgcccgccgacattgtgcagatcgaacgaagcaacgacacgagggagagcaggttgagacgccgcgtggcttttaaaaggagaggcaaatttggagggaaccaagtatggcgcgtacgagttggctctacagctcgatcttgcagatgctgcctgcctatttggagcggtttcaattcaggtacgattcgttattgtttgaaatctatgtttgtgagctgtgacaatgatccgatttatacacccgtagcaattgtcaatttcatttatttccttttattttgcactctttttctaaatctcagacaggagtattttggtgtgctttgaattattggaattaaacgatagaagaaacgggaggagttcaaaccatgctgtttggcagtactaagtgctatctgtgtatggtaaacatattactgtagcgcaaatttagccttgcacgtgatacacaagaaacatgagcacatgagcaatagaacacaagaatgtgcgatacatgttggactagggaaaaatgtcatgaaggcgagcaaacagctaagctctgtgcctgtgcagagacagggagtagccaactagcctgatggaccatgcacaatccccacttctgaatactgattctagtatttcacgcatcaccaaaattgcaaaccgatgcagcgagttgcacatagacaacagcaacgataaatgcgtatgagagcgatgataacggataaaacgatctaacattcaaaactcaaggattaacatccaggatgcaaaataacagaaaaccagacatcgtttgcctcatttaggaacatagagttacgataaattaagcaacaaaaagacactggtctcccagcttagcgcaacaagtgcagtctagttgctagcagcagcccccttcttccttggtgcagcctcagtccctggacaacatttgcaataatcaattaacaagtgctacagcatttgcaatatacttcctccgtttcacaatataagtcattctagcatttcccacatttatattgatgttaatgaatctagatagatatatgtctagattcattaacatcaatatgaatgtgagaaatgctagaatgacttacattgtgaaaaagatggagtagtaaataatcagtgaacaagtga

SEQ ID NO: 30675 - DNA, 1501 bp, Oryza sativa
attcatcttagctccgatttagttggttcaagtctctaaatttttctaaaattgagatctacatgttaaaaatatccacatgtactgttcatgcttgtttatgtgcttttttggtgattttgctcttttttgcttagattccgtcgtttccggagagcccgttttcgcaggagaagagtttgaagagttccaaggccagcaaggcaagtcacacagatcccaaacaaccctttgagcatgttgatcccgtttaaagctactgtttctattcaaatattgcatttattttcgaatgtcattgggtggaattaacctattgtttgttatagcccttttgttcttgattactttattccttgataccttgggttattataacttgactagttgagctttacatattggttcagctagatattagatgtgattgcttagccatgcttagaaacattagcacactattgggataacttatgactcactattatttaatgatggcttaatgatagttcacgatggccaatcgtgattggttaattaatgaatgtgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgggggtcgctggggagtccatgccttgtttttaagggggtgattatgatccaggaaaggtgcgctgtagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgcgcccgcagttatgggcaggtctaacaatgtcttttgtgattagtttcacacttctcaccataataaaagatgctataactggtaataatttgtttagctcctggtttggaatggtatattcctggtttggagatagatctgtacagccgggtatggttgttcaggatggttgggcctgagcagcatgggtgtgctgtttagtgttgattaaaattgatgattaattactctactgttttataattctcaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaagagttctacaatgatgctgatggtgtggaggattaggtgtagccttggtcaagctgcttgtggagtggagccgtccgcgccgtttattttattttccgctgcttagatctttattgattgtgaggaactatctacctctgtaatgacattttat

SEQ ID NO: 30676 - DNA, 811 bp, Oryza sativa
gttagtatagtaagttaagtaaaaataatagtgtgtcaagggggtaaagtgaataataccagcaaagccctagaaaccccgactatataagaaagagaagccgtccccctcggccgccgccgccgccgccgcttgtcaccccttccgtttccaagatgtcgaagcgaggtaaaatctcttgctccctcccgatgatttcttctcccacatgatcctcgattctggtctcgtatgctagtttagtttgcgcggcgtgatgcttcgatttggatgcgcagacatctgctgtggattaccgtttctaagatgcagaagcggttgttcgatgcgtcaattgctgtgtcgctaggatcttgtgcaagtgttcgagtagcatgatttagtctgcttgtcgcttcaagggtggtgacccgttgtatattttgaaggcagtgatgcgttgtataatttggagatgtgttgcttttagtgttacaaggaatgatttagtctggttatctgtagttagatgtggagaagatttttgtttagctgtttgttgacttaggtttgttagatccctgtatgtgttaaattcttttaaggaccttcggaaatgaacatccttcaagtttagcacgaattcttttagatgtttgtgaagctgcatctttatagatctttactagttcagttgctattgattcttctacttcctattcaaatagtgtggctagtcacatttctcaagctaaaccattttaaattttccctgtgttgttattatcaaatgagaatgaggcgaagcatataccctttgaatgaccactat

SEQ ID NO: 30677 - DNA, 1501 bp, Oryza sativa
ttgcatttcatgaataatttaaattgaaaaaggttttaaaaagtcttcttttggctttgggccgaaagtcggcccaaaaccgctctctctctcctcggcccatgtcggcccagtccgccgccgcgcgcgcgcgcgtccgcccgctgacaggtggggcccacctgtcagggtcgtcgtcaacctccggccgccgccgcccgaaaccctagtttcgcgccgccgccgttcctttccaaaatccggccgttcgttttcgtttccggtgaaattgattgaggggaaacaatctttgggatctcttctaccttttctcctttggaaacatcggctaaatcggtttggaatgtgtttgattcgagttcgaatcggatcggtctctttccttcaaaccccgatctttccttctcgtcgccagccgccgtgggccttcgccgtcacctcctagcccctttaaaaggacccccgagctcttctctacccgccgccaccttcgccttcgcctctcgtcgtccgtagcgccctagcgccgtgtgccctagcgccgccgtcgctccagccgtgcgccgccgccgttccagacgtcgccgtcgctcgggaagaccgccgtcgtggtcgccgtcccgtcgccgtcctcgtccgccccttcgccgtcgccgaagatcgccggagcaccatcgccgccgtcgacccgaagaccgccgtcgtttcttcgtcgtcgccgttgccgtccgttggtcttccgccgctcctttggtcaccggtgagttcgccgcgtcgcgctctacccgttggtgctctccgttcgtgccgaagcgccgccgttcgccggcgagcatgcaagcccgagccgctgagccgccgccgccggtggtgacgtcatcgctgacgtcatcgtcgccctcttccgtgagccggtcgtagaccgatcgatctcggccgtccgttttggatggatcgatctcggccgtccgttcgcgtgaaccgtcgcccgtgcgcccggtccaccgaaaccctagcccgctgacgcaataatcctccttttccttttcaaaaataattcattattgcgtcataattcaattaaaatcaatttaagtgttttaatccgatttaatcttcaaaaattcataactaattcatcttagctccgatttagttggttcaagtctctaaatttttctaaaattgagatctacatgttaaaaatatccacatgtactgttcatgcttgtttatgtgcttttttggtgattttgctcttttttgcttagattccgtcgtttccggagagcccgttttcgcaggagaagagtttgaagagttccaaggccagcaaggcaagtcacacagatcccaaacaaccctttgagcatgttgatcccgtttaaagctactgtttctattcaaatattgcatttattttcgaatgtcattgggtggaattaacctattgtttgttatagcccttttgttcttgattactttattccttgataccttg

SEQ ID NO: 30678 - DNA, 307 bp, Oryza sativa
aattgaaacgatgacggaaaagttgaaagtttgtgtgtagaaaagttttaatgtgatggaaaagttgaaagtttgaagaaaaaatctacaactaaacacggccaaaggtgtaaagcataaaaagatttcttgtacagtatatatgtcctaaaattttagccgatcacttctatatggccctactattttctcacttcctttatattactactgaatttcggtttaatcccttacatgccaattccgttacttgacagttgatcatttaatgcttatgatttatgaaaatgtctattttacccttaga

SEQ ID NO: 30679 - DNA, 520 bp, Oryza sativa
aaggttgaggagaaaagactttggtgcccctcaataaaggagggatagtggttgagggtagaacggaaagaaatttgaacggaaagtgattgatgggacaagtagtgtaaatggtggtagacatgcttgtgttgtggtacaggatatgaatcctagaaatgcttatattttggaatggtggtagtacacttgaactgtcagtactatcaaagcgtcattatgtcaattattgagggcactactctgatgttgcaataattgtgaaaaactacttttagaagttagcaattgcctattggttttgttggttacgatcaagcagcctttctgagatacctgaggaaacaaaaaaaatatttagcgggcataatgttggccagatcaagtcctttcatgtgtggtcattatttacctcttattttttcagtgggcaagaattgtttaagttctttatttctcaaagctgttaatcgctgttctttaaagaaagtaatattttaactgaacctttgaactccaa

SEQ ID NO: 30680 - DNA, 1501 bp, Oryza sativa
acggtggaccgattcccttgacccgctgacgtgtggggcccgcctgtcggcgccggcctctttgatgacgtcagcgcttaagctttttcctttgagaaaataaataataattgcacaataaatcgagtttaattctagaaattcatttaaatggctcaaaacttctaaaattcatacctaattcattcgaactccgaattgagccattcaacttgcaaaattcatctaaaattgagctctacatgtttgtttagtttttatgtactgttttcttggtttttattatagtttttcctcgttttgcatgccagcgtgtagaatccgtcgtttcggaagtccgcggtcgcgaggaaaagagttcggaaaatcaaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatatgtcctttgtcaaccatgggtaataaatcgcctagcttatgttactttgatgacctagctagaactatatgcttagccatgcttaattaccactagctcagtcgatgggataattgcagtattagacattctagtatcttgttgagctgcgtgctcgagacatctggccatgcttcatggtcgtaattatccaactaaaatgcgactgaatggtgggctgtgggtgcatggttttgctagtcgcacccatggcaattaaggaccggttcgcgggatgcccaggaagaacttatcgtacttaccacaagccagcgtgggcaacggttgggcttgtagtgtagctttcctctagctgacgcatccaggcaagggtgggcgtgatggagcggggcgggccctgcgacggcctctgtcacttccggattcacctaggcacgagaggggactacccgtcgcccgctggggacgggggtgaaacctgaggtgtggtgtgcttggctagagggggttatgcgaagggtcctgtcacggcctctttccggtatgtcgtggtggcatgtcggcgcacggtaacgtgtcatggggctgtgtcttgtgggtacagttgtacacctctgatcagagtaaaactattcgaataaccgtgcccgcggttatgggcggtcgaccagattcaccgtgattagtctcacacttaataaatcgacccaatacactgtagtttatgtgggttggttgggcctgttcaacgtggtgtagcgttgatcagtggagatttaatgttactctaattactcaacagttttactgttttgctcaataaaatgttttacaaccgcctttatgcaaatagccacaaaccatccttgtatccccttgcatgtctgcatcgttggtgtggcttgctgagtacggtggttgtactcagccttgctattattcccccttttcagaagtgtagtgcttctgagctga

SEQ ID NO: 30681 - DNA, 1501 bp, Oryza sativa
tctatgcacatattagaataatatagcatatgctgattggtaaaagaaaacttaaatgttttgtggacttggaaagctccacacatagttgtgaagcacaagacacagttgatgtacatagattctacgttgtatatacatgttgtgatgtcaccttgtcaacatatgtccattctgtcaattcgttgataagtggtaatcagcatagatccatattgcaaagctatttgaatttatagctaacaccaaaataaggatataaagtagattggattgacagggtagtttaaataaatagattacatgtgtataataaaatatggatagtgatctcaccatgtaaggtgcagcttaacctaactgttcataatgggataacctaatatgttgtttggttcttttgccttgaagcaatattcctgcatagtgcatgtcaagaatgaacaattataattgcactgtcacatatgctctaaaactacagtagatattcgaaaaaaatacaggtaatgtgagtaatatggtacatgaagatcatcgctcatgggggctaagcgcatatggagcaagcaaagatagcattttattttgagatcaagcattccctcctcagcatttgcattgaaattaagtttcatttcatttttaacagaacaaacttaagctgacatatgaaagactgaaaatcgatctccatttgcatcttgaaattaacattcaatcttcctaatcaaagcaacaaaaggtacattttccctacagttcatatctctgttgacttcagccttcatcttcatttagtgaactggaagctaaggtgtgaatgacaaaatgaaatataattgtagttcctattgatctttagctggtgaaaaaaagcaccgacaaaacataaaacatttttgtactcaaagcaagcattggacctgttacaattgaacttcaaacattagtcaatgctgggacagtattatctatcatgtacatacaacagataaatttggaaaataagtgcaaaagaaagtatataaaagggaagttatatggcccaaaccttgtagattattccctaatggtgtgttgtatgcctgttaaaagcattctacagagcatggttggtgcaggcaaacatgattccagcttgatttatggcagtaaaactgcataatgaatggttcaggaaaagagaataataagccagataaaaaaaagcaattactatataatatatatgccgtggttaatcagcagcggaccatgtaaagtagacaccaaaaaaattcttaaagctaggaagtgccacaacttgacaaacatattgaattggatggtcgattttttttagcaagacatgtagggaatagccatagacaggttgtaaattcccgaacttttcattagtaaccatgtttggttatctcgggaatatttttcaatgtgtatatgtaatactataccttaacatgttataataaagttatcaggtcaaagcagagatttt

SEQ ID NO: 30682 - DNA, 1501 bp, Oryza sativa
gcccagttaaggatgagatattatctagtccaaccaatctgagtaaacaactattcagatttatgggactaggtgatatctcaactagattgggtttttttttttaaatggagggagtataccgaactatgtcctcttgtactacctccgtcccaaaataagtgcagccatgagtttccgcgctcaattttgatcgtccgttttatttgaaatttttttataattagcatttttgttgttataagatgataaaacatgaataatactttactcgtgacttatgtttttaatttttttcaaaaaaatttcaaataagacgaacggtaaaagttagacgcggaaaatcatggctgcacttattttggggcggaggaagtactatctacggagagatggacatggagccctgtcatctgatcccatcccaagtgacacatcatcaaatcagtggctactcaccaacaactattccattccccaatgattgatcaccgatgcagtagggaagaaagccaccactacaactccacggagaaacaacccatctgctcgcaagcatggccaattggatcgccccatcatccatcgccgacgttcgtcgcaaatcgcaaagtgccatatgatgctcccaaagtcccaattgggggccatggcttctccgccccctgccagcgacgacacgacgacaagcagctgcagaccacaccaccacatctcggcaacacatctcctcgatcagcgacgtgaccatcgcggtcatgtgttgtatgtactcctgctacgctcatagtcttctaaccatgcaaattatgagaaatacctgggggtctttcgactaactccacaagacggtgggctagacgacctgcgtttgaacctcacatattctaattatttaatattaggtccttccctaatattcgtatttttaccatgcaaattatcagtggcggatctatgaggacggtagctagggaccgaagccccgtcatgatcagcgttgatcgtggaagccctcattattatttttacttagttatacatgagatatgttggtctagtttgtttagccatcatatatatatggcatcactaatttttttttcatagatcgtacatcttctttggaagatcaataatccatgctacaatgaacttgtgaatgtcatgcgaggctatgaattaattaatgaattaggccgagagcttgataggaatataagatgcccacgtgttggctcggctaaagaggacttttctccatcacatactaatttttagaataaggtggtgtcgaattatggtataataggctattatgggtaataggtggtgttgatttttcttattgtctttgcaggcgagaacttctttagcttatgccagctaaagaatttaagaatttcgaaagattgggtcaagagccactgggtagatttagaaaggaaaaaatatgaattaccccataaactatcgcagtcgaccgaattaccccctgaac

SEQ ID NO: 30683 - DNA, 1501 bp, Oryza sativa
aagggcattcatctgagtaatgggtgtattcaccacagcggcatgtggggaggcataaactagcagtgtgtccgactaccccacatctagtacatgctttgaacttcaactctctttccctgaaactgtcaagggtcgcgtcatcatcgtcatcattatcatcatcatcgtcatcagcagaaaaccactatcctgattcatcatcttcgggtctgggcggaccgtactttatgagatgtcgggttagctgacgtgctccacggaagttatttcttcctctctgacgcttgggtatccttgctgcgtcttcaggtgtaaattctgaaccggtgatgatcatggtcctgccattatccatcttccatatcactgtcctgttcgctccagagttgggctgcaaagtaccatccttcttgtcggtagactgacttggagcttggttacttccggggtgctgcttctcgtcttcttcaggtgacctggcgaacaccttccatggacagttccttacataatgaccttgctcaccacagtcataacaggtagcacttactttcctttggtctgacgatgacttggctgtcgttatcttcagggatctggacagcattttgacaggggtcttcggtgccgatattgggaactcctgactctgactctgattcgggtttcgggctggcatctggactcgcacctgcggttggtgacattgacgcgactcctgacattgccgttgcatctgttgcatctggtatatttggtaccgacgtcgcatctgttgtaataactcttccactgtcttagtttgattagccatgacttggggttgaggctgatcttcaagaggctgatgtggaatactattagaattgcactgagttgccccatgaaactgacagggtcctgattcgatgaaattgtccctcatgctgaccatctgctgcaggcaccagagagagggggaaatgggaggggttactagagatgaggtactaaaccacttgcctagtgatatgttgtgagtagatttttatggtttaagttgcttaagcaaacaacctagtatggtcgcatccccaccaatgatgcaagccatacccctacacacaagcaaacaacacacgatctagaagctaacgaaactactcttcatggaaagattgggtttaggtcatctccgggaaaactcctattgatcttcgcggaacgacgagtctggacagatcttctcgctctttgcacgaagcttgaggcttagcttgacttgacttccaaacatgcacaaagctgatggcttgtccttcaggtttgacagctgtcacgcccggaatttctatccaaaattccaaacgcttacatgtgtgtgaaccctcgtccaggaatcagccgaggcacacaataacaaattgataatagagtacaattattactccaattaataggcgaataaaatgtcattacagaggtagatagttcctcacaatcaataaagatctaagca

SEQ ID NO: 30684 - DNA, 1501 bp, Oryza sativa
aagaaaacaaatcatagcacacacatatagttacgacctccattttaccgaaataacatgtgacggagagatttttgaaagttacatacaagttacactatagttacagtgtaattacatgcaagttacagtgtaattacattacgattgtactataattacatctgtcaaatttttgggggaaaatttatcgacaaatatatagcaaaatcgttttttttttgcatgcttcattgggctgtatatttgggcctcaatttcatgggtattgggctgggcatgtaggacaactccaggatgggaaggaactggggcccacccaaacgagggctcccgtgttttaaggcatggaataagtctataatttgtccttcaactcttgctcctgattaaatcgtctccctcaaccgcaatactgggtataacacatcgattctcttaaccgcaataccagatataacacctccctaacatttgaaaaccagaaggaatcgagtccctcagctttcataacgctcatggcccacgcatgtcagtagaaaaaaaagaataaaaaaaataacagcccacctgtcagccatctctttcttttctctttatcttttctctcccctctctggttcttggtgactccgggcgagacggccgtcagctcttgtccggcggggtgcgagggccgggtggaggagtatatcgctggtctcaatatccgcatgcacgtcgtgctcgtggcgcagggtgcgcgtaataatccatatggcgatcaacgctcgactggacgccggagatgacgaggatgacaatcggaaaaagccggcggtgctcatcgccggctgcgccaaaggcgacatcagctacgagtactgcaaggccttctcctccctcggctgcggcgtcgtcgccaccgacatccccgaccgcatgccctgctagctctttgttgagaatactactatcagaatgcagcatgaaaccaacacacacatgaaaaggattcatgaaccagcaacacaatgcaattgtgcaagcaagacaacgttatacgtcgccgtggtgaatgtgggcagcgtggagggcacggtcgcgaagccgtgggctggaccctactgtgcgccgaaggcggcagtacactcggctcggcgagagctgctgcgtatgggtgaaaatattacgaaaactttccgggaatctgtcggtctgaaatttttcggagtttttttggaaatggaaatgaattcagaaatattttctcagaaacggaatcgaaaatgataagggtagtttccgtcggaactaggaatcggtcggaaactttccggaaattttctcggaatttccagatattttgtgactgaactaccctgtattccttttttatgacactaatgaatcgattttctagattcgccactggctgcagcctgcttcgccttgcgttgctgggctttcgccacctggtgcttcagtagttcagtccgttgtttcacctagcttcacgtcg

SEQ ID NO: 30685 - DNA, 1501 bp, Oryza sativa
agaggcacttagtcctcgcaccgaaacgaaagcagtagcagcggaaaaaggcgatcctagcggggcttcagctccactccacaggcaaaactcaactgtggtctgagccttggtcctctaacttcatcttcagctcagaagcactacacttctgaaaagggggaataatagcaaggctgagtacaaccaccgtactcagcaagccacaccaacgatgcagacatgcaaggggatacaaggatggtttgtggctatttgcataaaggcggttgtaaaacattttattgagcaaaacagtaaaactgttgagtaattagagtaacattaaatctccactgatcaacgctacaccacgttgaacaggcccaaccaacccacataaactacagtgtattgggtcgatttattaagtgtgagactaatcacggtgaatctggtcgaccgcccataaccgcgggcacggttattcgaatagttttactctgatcagaggtgtacaactgtacccacaagacacagccccatgacacgttaccgtgcgccgacatgccaccacgacataccggaaagaggccgtgacaggacccttcgcataaccccctctagccaagcacaccacacctcaggtttcacccccgtccccagcgggcgacgggtagtcccctctcgtgcctaggtgaatccggaagtgacagaggccgtcgcagggcccgccccgctccatcacgcccacccttgcctggatgcgtcagctagaggaaagctacactacaagcccaaccgttgcccacgctggcttgtggtaagtacgataagttcttcctgggcatcccgcgaaccggtccttaattgccatgggtgcgactagcaaaaccatgcacccacagcccaccattcagtcgcattttagttggataattacgaccatgaagcatggccagatgtctcgagcacgcagctcaacaagatactagaatgtctaatactgcaattatcccatcgactgagctagtggtaattaagcatggctaagcatatagttctagctaggtcatcaaagtaacataagctaggcgatttattacccatggttgacaaaggacatatatcaagtaaacatggcacaagcgagcagataggtaaaaccctgaccccatgtaattagcaaaacatgcatatttatttgcaaacagtaaaacatttgtaaattgggatcaacatgctcaaggggaatgtgtgacttgccttgcttcttcactttgattttccgaactcttttcctcgcgaccgcggacttccgaaacgacggattctacacgctggcatgcaaaacgaggaaaaactataataaaaaccaagaaaacagtacataaaaactaaacaaacatgtagagctcaattttagatgaattttgcaagttgaatggctcaattcggagttcgaatgaattaggtatgaattttagaagttttgagccatttaaatgaatttctagaatta

SEQ ID NO: 30686 - DNA, 978 bp, Oryza sativa
aatccacatattttaaaggttaaatcatcctatagttatcctagtaaaacttctaaaatatacgttgtttggcaaataaaattagtgctaaatttgccgctttgttatattatggctaaatatgtagttctatgctaactccgttataaattatgggagtgtctagattttaagcacatggaaaattttcaaaaactttaatcacaattctcacctcttagatataatccactggttgttatcaatacctacttatgcaaacaaaatctgtttctactaaaagattgacaaaattacataaaccaccccataacctattttgtcgcaaaagcccacccatcaaatattgtgaggccaaaattacccaaatgcttaagtcggactcaccacaaaccacactacctagcttggcttagttgatatggtccgccgggattcaagtaaaaaatggaccgaatcagttactcatgtgtcagggagagggcgagggtagagtggtttttccaacacaatgggttatgcgatggaatctcaaaacagggtgacaattataatgatttatgcaatttctcctaaaagattaaacaataaactattctaacctataaaaagaattacaaaactgcatgagataaacttataactaataaaaacttactaaattacatgaaaaaaaatgtttgaacttagataaaaataaaactctaccaaataccttacatgacagtttcatagtattgtagcctaaggctgctttcatttgaagcaccgtgagaaaaaatagtgcatcgtttttcgcgtgcgcagatattgaacggttaaaaggtatttttttaaaaaaatatataggaaagtggatttaaatatggtattatccatttttcacttttgaaataattaatactcaattaattatactctaatgactcatattgttttacgtattttcttaatcttctacttttcccttcctttagt

SEQ ID NO: 30687 - DNA, 237 bp, Oryza sativa
aaaaaattcagatatttgcgtcggcaaaagacgcttgtaacatgtagagtagggaggaaaattatttgaagtgtacgtagtgcagtccttttgagcaaaattaatcccaaatttgcttcggtcccgaacaattcaacgaaatcagacaaactccccaaactttctgtacacttcactgtctcacttgaggtgaagtatcaagagtgaactgaaattcaacgaggagagacgctgaca

SEQ ID NO: 30688 - DNA, 1501 bp, Oryza sativa
gcttttaacaggcatacaacacaccattagggaataatctacaaggtttgggccatataacttcccttttatatactttcttttgcacttattttccaaatttatctgttgtatgtacatgatagataatactgtcccagcattgactaatgtttgaagttcaattgtaacaggtccaatgcttgctttgagtacaaaaatgttttatgttttgtcggtgctttttttcaccagctaaagatcaataggaactacaattatatttcattttgtcattcacaccttagcttccagttcactaaatgaagatgaaggctgaagtcaacagagatatgaactgtagggaaaatgtaccttttgttgctttgattaggaagattgaatgttaatttcaagatgcaaatggagatcgattttcagtctttcatatgtcagcttaagtttgttctgttaaaaatgaaatgaaacttaatttcaatgcaaatgctgaggagggaatgcttgatctcaaaataaaatgctatctttgcttgctccatatgcgcttagcccccatgagcgatgatcttcatgtaccatattactcacattacctgtatttttttcgaatatctactgtagttttagagcatatgtgacagtgcaattataattgttcattcttgacatgcactatgcaggaatattgcttcaaggcaaaagaaccaaacaacatattaggttatcccattatgaacagttaggttaagctgcaccttacatggtgagatcactatccatattttattatacacatgtaatctatttatttaaactaccctgtcaatccaatctactttatatccttattttggtgttagctataaattcaaatagctttgcaatatggatctatgctgattaccacttatcaacgaattgacagaatggacatatgttgacaaggtgacatcacaacatgtatatacaacgtagaatctatgtacatcaactgtgtcttgtgcttcacaactatgtgtggagctttccaagtccacaaaacatttaagttttcttttaccaatcagcatatgctatattattctaatatgtgcatagatatatcttactccgttacaatgtctctttgaaatttcaaatttatttttgtatagttcaaataactaatatggttacaagcattatacccgcagcaacgcgcggggccactgactagttatatagaactatcgagtggccgtgtacattgcagagaacgttggacggcaatgcacaggcctataaaaagttttgtggttccgttgtaactcagacctaccataaaacccacacatctgcctcatacctcgtgaaggtctcacagcccccgcgcacgtataagaaccatagccacatccgcgcgtgggtcggttcgcgacacacgaagccacatccgtaggaggctgacacccgtgggatcggactgacggacggacgaaccaaaaaatcatcgtgcaatgct

SEQ ID NO: 30689 - DNA, 641 bp, Oryza sativa
atgtttttctgctatcctttagtcttgtgcatacctaccaggatttttctttcctgggccactactaggatgttagtataaaggctcagtttttttttggttcatgttctatgctcgatcttctactgccagcagttatgcagaaagaaacaaacctcacttaggagctcgtatggttcatagttgactaggtagtgtcatgagccatcaatttcacatttatttttatctaacttgatctgttcatgttgctttccagatcacagatgttttcctgaaaggccactcaaattcgctggttacaattgttgggatagaagggaatatactgaagcaaacggggagtctttagttcccatgataacctacattaaactagccattcagcttagtcatgatgtcgaagcccctgaaggtggctgtagcttctggcagggaatatttttgcaagcctaccctgctctctgctgatatcaattagatgatcctatagaggattagcattcgagtgtttaacattcgttcatgttatgaaaaatccaacgttacattaccaaagtaccaaactattgaaagaaagtgaactgtatcattttggtcacattgcttttcaaattctacatgctcttgcaagaggttga

SEQ ID NO: 30690 - DNA, 1501 bp, Oryza sativa
tagtactacatactccctccatcccaaaatgtttaacaccgttgactttttcaaacatgttttaccattcgtcttatttaaaaaatttaagcaattattaattctttttctatcatttgtttcattgttacatatatatacttttatgtatacgtatagttttacatatttcacaaaagtttttgaataagacgaacggtaaaacatatttaaaaaagttaacggcgtcagacatttagggaaggagggagtatatatctatggctgtttagattatggtgaaaaattttggtgtgtcatgttaaatatatggacttatatttaaagtattaaatatagactaataacaaaacaaattacagattccacctctaaactgcgagatgaatttatcaagtctaattaattcgtcattagcaaatgtttacaatagcaccatattatcaaatcatgaagcaattaggcttaaaagattcatctcacaatttacacgcaatatgtgtaattagttattttttttatttatatttaataatccatgcatgtgtccaaacatttgatgtaatagagtgaaaaattttgtcaggggatctaaataggccctatatgcaaaactaatttattttttaagtaaaattcacacattacaaataattgagctaaactattggaaaactacattcttaagatgatatattacaaaactatacatttaacgataaatttatcacaaaactacagatttaaggctaaatatcacagaactacaaatttaataaaaaaattatcacaaaactatatattttgggtttctctaatattatgctttgagttataatggttgaaattttatgattaaattgatctaaaacttgtaatttgtgatagttatgtgataaattactttaaatatgtaattttataatatattatattgaatctatagttctgtgatagtttgactaaagtacatgtagttttataaaatttacacttattcttctcgaccagttatcaatatatttttgaaattggatgtaaaataatacgtttaattggaaaatcacaagataatcccaagcttttagaaatgcaggagcagaatgtttctcactgattttcttagcgaaaaatagtctccaaggaaaaacattaaaagtcgcggaagaagagaggaggaagcggcgagcgtggaccgggcccccgccgccctgcacgtggttgaccgcccaccgaggtgggcccacccgggccgccgccgcgcagcccgtttccactcgccttcctcgattcccccgcctcccgcggcacccgccaccgcctgccacgtgtcccgatcgagtcctcgtctcctctcgcctcgttttgtcgcagagcggagcgcgtcaaccagcttgtgtcagtagcctactttcgcagacttgtcttcagtaaaaaatgtatacggatgggcccacatgtcagcgtctctcctcgttgaatttcagttcactcttgatac

SEQ ID NO: 30691 - DNA, 1367 bp, Oryza sativa
gtttaaggaccggccatgtatttcacttatttatttgacatgtttgtctcttcttttcatgtgctgttatttttcttttgttacggtttgactataattaacaagtgggctatatttagagcagtgatgttatcaatgtgactgggtttcaggcaattgagtcaagcatgcccattggagaatcttcggcatgtaaaacgggtgcgtcggtgctgtgaatatggtggtaaatgttcttttttcttttctcaatcgattccatgatatgtccatctactttataagttggtccagcttcaccattcatccatacactgtaatactggccacacatccaacacccaaacaaaatagatggtttgtagcagctttgggtctactgttgtaaaaacttgtgcatgcatgtgcacggcagtttatatgaagccaaatcatcaattcaacatgcaaagctccaccttttcagattgagcttaatttggtctgtcattgtgaataccagggggttgggggtggtattgcccccagaattatagtatatgagtgtaagtgtaacaaaactatcttaaatgtggatttccaaccctataaatgattataaccttggtggaatttatcagcaggctttctcttcaacaagttaaatatataatttgattcctcattcaacgatactcttcaatctttaatgctgatattgtcatgtgagatgctgaaccttattttcaagaaacttagtcttacctaaaaaagcagcagaactgggaactaaaatctagaagctcatagtgttttccgttgattctgcttaagaagaagtgcaagagtaggctagtacatgctgatccattgctagaatatggacataaaactgaccagcctacaaatgttttaagttagttcctgggtaattatgttgaacacttttctgtttacttttataatttgattatcttttccttgacagaaaaatctgagttatcaatcatcttatgccttgcaactgggcctgaacattgtagcgaaatgtttcctcaagatgtaaaaaagattgtaggtacctacgaattgaatactttcattgcaaaagtaagtacttttgttaaccttgggagttcggaaatttgagttctctgttgtttttgtaggcatattggacttatttactaacttaatcatgtcatacattcattaagatcaaaattattggtctctagttttacttatatggaaattatccaccaagatagtgattgttccgtgttaaatccttacatgtttctttgtgtgacctacaggcaatgtgaagtgatatttaatcctcctgaatccatcaacatctaaggaatgtatggatcatagtagta

SEQ ID NO: 30692 - DNA, 1501 bp, Oryza sativa
atgagtttctagtagagttgaaaaggggaagaattaagaggttagacactgatccagctaagttattattggcaagtgcatgctcactgacaagcaagggtccaaaaggtggtactccttccgttttgaaatatttgacgccgttgactttttagcacatgtttaaccgttcgtcttattcaaaaaatttaaataattattaattcttttcctatcatttgattcattgttaaatatatttttatataggcatataactttacatattttacagaagtttttaaataagacaaatggtcaaacatatgctaaaaaatcaatggtgttaaatattttgaaacgggggagtatttagtagtagggggtcaagaagtcttgcatgtccccttcttcctccaacttcttctttgccaattgcaaggcatgcagatagggatctttattaatagcaggcatgtgtggtgtattttcttgactttggaccctgccccactatccagcccaaagaccatgcatcatgctgctggccgacatcctgactagtctcccacccactcgttattacatcccctaattaattaatcatttctattttgacaagataaaccatacctttctctaaaatatagagatttctaatatttatactttggactatttggtagagtttcaactcctaaatttagcttcagaagtaattaagtctaaattagaattgtgaagcaacctaaacctagttccaactcttaattttattttgtgagagagctccacccaactctatttctattttaggtggagctgaaattgtttggttgagctggagctgtgccaaacaggctctttatctaaaatatagctatttcttcttgtgctatgtcatatcaaacaattataacaatgttttatttaatttatctctatatattttatttcaaataatcataaccatcttttgttaaattataaaacgtcttatccactcaaaaaccctagtaatattttaaaacgagtattatgaaatgacgagatgacaaacacaagaactagagggatgtggtttttatttttgttttaaaaaataataattcagttggcgccgctagctgttccggtcaccctccagtctccttccgattcttccgccacatccgcatgctcgaattccccctccctccatttctttactcatttcccttcccctccgcttcctaatcctgcgtgaccccagacgacgacgacgacgagtacacatgcgtttgagcgcgacatccccgcgcgcgccttcttcttcctcttcctccctcctcccatgactagaccatcctcgccatattcccgcctctctatatatattagggctcagctcctcctctcacctcgtctcctcctctcctctcttctctccttggctcagcttgacatcgtcggagcagcagaaaagtttgctcgatcgagctagctaactaggtcgtcggatcagtgataaatcgttcgccga

SEQ ID NO: 30693 - DNA, 168 bp, Oryza sativa
gtttaaggaccggccatgtatttcacttatttatttgacatgtttgtctcttcttttcatgtgctgttatttttcttttgttacggtttgactataattaacaagtgggctatatttagagcagtgatgttatcaatgtgactgggtttcaggcaattgagtcaagca

SEQ ID NO: 30694 - DNA, 1501 bp, Oryza sativa
tcgccggcgtcttccttccccatcgccgtcgccgtcttcctccccctgtccgcccgtcgcagcccgccccagtgcgctcgccacccgccgccggcgagcatgagcgtcgtccgggtcaaccttccgctcctccctcttcctctctatccacagccagcggtattttggtcttaaaatccctcaaagtggcaaaatatcctgaaagtaatatattgagtggcattttatcatttgcaatgtattgggtggcattttatctaaacccaccgaatggagtggcatattgtcctttttctcagctctgtactgcctaaatccaggatggttactttggttagaaacattttgggttaggaattgttcacagttgaatctaggatggttcatttgatttaggatttaggattagtttatttgaatccaggaatcaggaatggttcatggttgaacattttttttatttaggatttgaatccagccatccagggatggttcatggttcatggttgaacaattgaactttgaaacttgtgattcactgatttctgaagctttgtagcagagttagtatttatcagtgcacatatttagcagagttagcatggtcagtacttaaattggaagaccatattgtagtatttatcagtgcacatattttcaaaatatcaagaagcggaatgttcttttctgaattgtaagatttcttatcatttttccattttctatgctctataaatttgatatgttctgtcaattaatagtttagtactgtactttaatatgcttaacacattcaatttttggtcgattctatgaacactttataccgttataaatatacaactattagactttgtgggttggaaaaaaatattttatcccttctaatttcgaatacccaagttgaaaatcctgggcccgcccctggaggccagcagccgcccaacgccctcactgactctgtctgtttgtctatctatcttagcgtttgactgtttcaagtcctcactatcttgtctcaggtttgttccacggctccaattctgtatgtgctgcgactttacattttgtaagtttgcatgcatcaatagaactagagtcattaagggattttcttcaatgaactatataaaaacaatttaagaagcaagggcaaaaaaacttgaatggttgcttggttacatttattgaaagggatttcttctcaagttaaggatgaggacagcatcattcattttttttttaaaaaaaagcattggcaaattgtcctctaaattgtaagatttatttattatcatttgccatgttctagatattgatatgttgaaaaattgtaaattaaatgttgtaattctatatgtggaggattttatatgaaaattctatgaatatacaaaattatgctcaagtttgtgttatatccgctatagaatatacacaactaatagtttagaattgtgtgatattatacatgccaaacattagtcttttgctctaaaaa

SEQ ID NO: 30695 - DNA, 1501 bp, Oryza sativa
caactgggcaaagtagctatagtactagagtatcttgtagagcagggtaggtgtgatgcacatagttagtacagtactatgttttcttggtgtctttcctggtttggtgagctccaaacttgaggggccctagattaacctcttaaattaaatcaaatcaaacatccggaaagagctttttgtactatacaatagcttaggtttttgccaaattttgactagaaatacttttggggaagactactctcgccgcacgagtcaatactgcatccaaaataaaaagtttgtttatgacaactaatagcatgattaatccactgttattgaccggcgggcgccgttgggtcgtttactaagcttaattatgcaaatgatcccaaattttccagttcttgtactactccaatgtagggttattaggattggaacgtctggtgttgacaaatctacaattcagatgtatcagagacttttcttttcgtgatgaagaaaaacggaaatgactctgtaattgttactgaaagatatgcaagattactgcagaagttgcagaagagacttgtcattgacaggaacaaagaaagaacgggttataaagtgtacttggcttgagccacgcacaacacaagacttggaccaagtggtttggttggttgccaagaacgagttggctatgttctctggcacacacacagcaacgggcaattcaagcaaccacatgacttgaggtcattgtgctgcaactagctactgtcgacttgcaattttgcaatttgtcctctcctgtttgctggacgaattgatggtgttaatttctttttctgagaatagtttggttgacaacttgacaaaggtatgtgtgaaaaaaaaaacaaaataacctcactgttgggcagataacagtaacacttattgggtttgcttttcaagatttttttttttgacttgtggcttataacttataagcggatgacaaattatcattaaaaacaattatttttaaagcaagagatttgcacttgtattattagcggtctaaaatccaaaatccaagaccgtagaccgggtaacaaaaataattataaaattaaaaattaactacgccggagttcaaacaagtagtaacactgtaacacgcaactgaaattctatatcgtgtaccagctagtatttttactattgtgttaatacggattatttgaatgtcgtctggctgaaaccaaaacgggacatctggtctttcagctaggttcgtttaaatcttccttgctgtacaccatatttctatttctgttcgtatcagaatcagctcaaattggccaggctgtggtggaacctcttcaccgaggttcgattcgatccgactcaccacgaatctcgcattttcagtgtattatgcagttatgctttaggcagatgatatatacatgaacaagggtacatctttatcaataataagatatactaattcagttctaagagctgcttagaaaaataagat

SEQ ID NO: 30696 - DNA, 318 bp, Oryza sativa
ttctttctgcttgaggaaattgaaggctgccttctaactgaaaatagtcggcgggggtattattggaaatacactcatccacgccaacggcaacgacgcctcacaccgtcacacggaacggaagccgcacacactcactagcgagcacgagagagagagagaaaaaggctttaaagaaagcgagctcgcagcagatcgaccgggagagatcacaagctgagagctctgagctcacctcacccaagctccaaatccttcctctcctctcgccgacacgcacgcccacccagcttcatcggatccggcacgcggcgacaa

SEQ ID NO: 30697 - DNA, 308 bp, Oryza sativa
caatccgttaaatgcgaatttctgtccagttaaccatcagacttgattttgctcgaaaacacaattcgaaaatcgtagaatctagtagccaatagaacgtaatgctgaggattatagccaggaaattgatcccacaaatcggttccctccacaaatttcccaactcgcgtaaaacaatctgcgcgccttgcaagagaaattgtcgaaacaaatgatcacagcgaaggtggccacgtttcgtgagcccagatcaacccctattcggggcctaaagcagcaggcgctatattagcagaggccgcaccgaa

SEQ ID NO: 30698 - DNA, 476 bp, Oryza sativa
gacgacgcggatgcatatgcatatgatgcatatgcattgcacacagatgatctattgtactagcaactatacttcatgttttccacatgaacctacataaaataatttgagaactttattactctctctgtctaaaaaaatataaaaagttttagttagatgtgacacattgtatatactgtctgtacatattcattgtattaagatgtgttctatacaactaaaacttcttatatttgatctaaaaaaacttcttatatttgggatggatggaacttcttatattttaggacgaatagagtagtaaggtgcgcatatacataaattaatacacattgcatgtgtgatcgatatagatggagctagcttgttaagtcaatttttcaaaaaaaggaaaacgaaaaaacttgttaagtcaatcatcatatcaatatgcgtagacgaccgcaaattaaaaggctggtcgtctttctagg

SEQ ID NO: 30699 - DNA, 587 bp, Oryza sativa
ttgtgtagggagtagggactagggaaagactcaggcagacaggatcatggccggctatgatgtgggaagaaaatatgataagcaatataagttgtatccaacttgctacctgtatctagttcttatcttttggaatttctttcaaatcttgtgtcctttagatgccatttccactacatgagccagttatcattgtgaatcaagcaaatcagtgaagtagtttctctgttttaaatatcaccccaccctagggtttctctcctaaagccctccaattcaggcctgatgtcattccttcctcaatatagttattacctgtgataatttaaggagctagtaataagacattcttgtagtattgcgtggcaacctatctgtgcgaacctaacaagtttaataaattgcgaggtacatatgcttgagagcaagtatttatcctctattggagaagatttaaatccttgttattaagcacgatgtccatatatgtgcttcctttaacacgaaactgctggacatgcatatgatgtctgtcatgctctgctgtttacttcagtgtagatcaaataattatgtttaattcaaca

SEQ ID NO: 30700 - DNA, 243 bp, Oryza sativa
tcaggccacccattttgtacgcctgattcaggcgagtacactcaggcaagatttatcaggctagaatcctcagggtaagcacccaaccagaggccaggcgagttacaggcatgaccttaggccaggcttatttgctcagggtagcaaccaaacaggcccttagtcgccgtgcccgaaggagatggttagtactcgaagaattgaaccgccggagatggacatggccctggtcgcctgcggcca

SEQ ID NO: 30701 - DNA, 1501 bp, Oryza sativa
catgaccagcatcaatcgcctcaatagtgccgcgtagttatatgcgaacaacaacaaaaaatagcaaaaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaaacgaagtcggcgactcatgaaattgattccatcgcgctcgttgataggaaactcgacgcaacccctacctggcgcgccaactgtcgaaacatgatttcggcaataataaaagggggtagcgtacgagacctaaaagtggatggatgcggagacaaaggatttagacaggttcaggccctctcaatgagaggtaataccctactcctgtttggggatttgaatccgccgagtgtgtattgatctgacgatcaggttgtctcatatgccccctagagggcctcctacccaccttatataggatggggggcaggattacaagatagaaaccttaaccaatacggtatcggtttcctaaatctactttacaatattatcaaaccaggactttaggccgttccgtaatatacaaggaaacgtaacacccaagtcatgatctgttacatattacaaaaatataagttatcccctataactagtcggataaccatgccgtgtgggtatggggtacccataatctccacaaatttcaacgaacagcaggagaccgtcaatgcttggacagagattgagaagcatctgacagctccgattgaagaaaacgttctgcaatccataaggataaacagcggggggcaacaacatctgcaggcgcggcatcctcttgaagtagaccaatccaggctgttacatatctagccaccgcaggtcctccagctcctctgccacaatgctcacaccctccagatcctcgaggaagcattccgttacagacaacacctcgagccctggaagcacggcgttgagccgacgcaaccgccgcacattgtacagagtcatctgggtcagaggcgccagcctgagcgtcagggaggccaagccactggaatggcgaatctctagccattccaaggacgggagcatggcatcttccatggtgagttcgccattgaactggacgtgcaccaggtgcagctccctgagcttggcgaagacacccgatggtggtagcgataggccgagaaaccccaggctcagcgttatcttggtgaccctcatgaagcagggcagctcgaaggcgcccgattcgtccaccaccaagtccccaagctcctcgaccagctgctccacgacgtccatctcctcgttgagaatttcggacggaaccgaggacctgttgcggaagaagagctcgccggtgaggcggggcgcggcgacgcggagccaggaggccgtggcgtccggcgtggcgctgttgagggaggtgacctcgagcaggcggatgtccgtgg

SEQ ID NO: 30702 - DNA, 208 bp, Oryza sativa
tgagcggccaccgtactgagcttgaaaggagagctggtgagagaaaaggactctctccctctatctctctctctccctccctctttgtttcttggtgtttgcttcttggagcagaggagatggatgggacgggtgatggtcgtacctcccagggctgaaggtttatgcatagtagtactagttatagaccctgctcctgccttgcagt

SEQ ID NO: 30703 - DNA, 1501 bp, Oryza sativa
gaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagacgcccaacagcggcggcataataggccagccgtgtaggcggaggcaccagtcggcggcgacggaggcaggccggcggtgaagatgacgatgcccatcaacggtggtgtgaccaaccgaccgtataggcggggacaccagtcggcggcgacggaggcaggccggtggtgaaagcgaagacgcccaacagcggcggcataataggccagccgtgtaggcggaggcaccagtcggcggcgacggaggcaggccggcggtgaagatgacgacgcccatcaacggtggtgtgaccaaccgaccgtataggcggggacaccagtcggcggcgacggaggcaggccggtggtgaagtcgtagacgcccaacagcggcggcataataggccagccgtgtaggcggaggcaccactcggcggcgacggaggcaggccggtggtgaagtcgtagacgcccaacagcggcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaaaaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaaacgaagtcggcgactcatgaaattgattccatcgcgctcgttgataggaaactcgacgcaacccctacctggcgcgccaactgtcgaaacatgatttcggcaataataaaagggggtagcgtacgagacctaaaagtggatggatgcggagacaaaggatttagacaggttcaggccctctcaatgagaggtaataccctactcctgtttggggatttgaatccgccgagtgtgtattgatctgacgatcaggttgtctcatatgccccctagagggcctcctacccaccttatataggatggggggcaggattacaagatagaaaccttaaccaatacggtatcggtttcctaaatctactttacaatattatcaaaccaggactttaggccgttccgtaatatacaaggaaacgt

SEQ ID NO: 30704 - DNA, 627 bp, Oryza sativa
tgcaaagatcctaaagttaaaatatctctcgaagtgaacagtattgaacagtaatttaaacagtaaactgaatagtgtttttgaatagtaatcagccgaataaacagtaaactgaatagtattcagccgaataaatagtgtttttgaacagtgttttttgtccgaagcataagtgtggtatcagagccagtcatcatagagaaatcaaattcagaagctaatattggaaaggtaattactaccaaagataatctgaatataaggtgtaggttaaatcacattgaagaccatagttggcactctaacaatagtcaattaaatttaattgttgatctgatatataatttttatataaattgggataaaaagcaggaagatttagagcgaaggattgaagatttgtttaaagaacgaaagcaatctgaagaacaatatttgcttgtcagtaataaattaaattcagtgctaaaagagctagaggaatataagacaaggcagaataagatattacaaaacagtgactatatcaaagaattattagaaataataaattctagtaaaggaaaagagatagttttggcttcaacaggcataattacctcatctcaagctattaattcagaaaaa

SEQ ID NO: 30705 - DNA, 1501 bp, Oryza sativa
ttagcagctggctagctttcacatgtgattaaagatgtttctggagctgaacatgatccatcgagatgcatgtatcactgttccagaacagtgctagctccagataaactaattaaaatgaaaacgatgttagttttttttcctgctacgatgtcagcttcaagacgtaggtcatctaatttagttgtaccgtagctcactggtgcattcatgtatctctgtttggaattgtagctgggtaccttcaattgatctggtttccaaatatgggcactattttatcttttgaaagtgagttaattgatacggagttacggatgaaacgatacttttccatttgggatggaagatgcattgacgaaatcccctatattttacgaatgaagtagtatatatttaaatgtccatatggtgaaaaaaaaattaactggtcgatcagacaggttttttgctaaaagtagcagattttatattggcttgctatatagtttgggtgcccactattattaatttgttgagttttatgctcagattgatctctctgcaattgtaatctgtgaggacgattgacatactatatataattttagaatatgttttctgaatggttattattggagtatgtctctctactcaagaaagtattgtttcgaaaaacaagaatacatgttattctaacttctggctggtttgctgatgtatttccatgagaaattagttttcatatgagaatttcgaagtctctaggtgttctaggatttttttagaatattgcacaatgcctacatcgcaatatttgttttgcatcttaatggaacgatgttgagcttttaaaagggcaggattaatgtagagtgaagaatcatgtaatgatcaatccaaactcaattcatccaaagtttaggaactcccaaattagtaattatattatttttaactaccattttttcttttgatttttccttgttgaatttatcatcaattgtttgttagttccctcctgatttggctcaagttaaatctaatatttcaatggctggcaggttaagataccgggttatttcctcagtctcttcggtatgaactcaaatttacttcattttgtccttcagttcatataatagccatgcttagttactttaccttcatttggaaaaatctttggaagttattactggcaattcaaactaacaatagattttctaaaatgttgtttacataatattacgtatctctagatgtttagctgcaaaacagggttactgaaattaagtactagttgaagaatgtgatggacatagtacatagcaacaccttctcttaatctggaaatgaaaagctgcagtgtaaattcaactgcaagcaaattaagcatataagagaaaactttcttaaaaaaaactgaaaagtaaaactttgtgggaaggaagctagtgacaacccaagaccagatagttctgctggatatgacaatctgtaagttttcctgtacttacgtagg

SEQ ID NO: 30706 - DNA, 1501 bp, Oryza sativa
tctgatgcaatgtttgcttaaaaatgaacttattttgggacacaaatgggatgagtcaaatatgggactgagggagtaacttcctgcctaaaccaacagagcgtttgtaattacacttaagaatttactgcaggtatagaaattagaattaaaaaacgcagttgttcggaattcataggaaacatgattacctggaaatcttcttctattctcaggcccagcactgctataccagtacacattgtcagaatatgcaacacactagctccataagcatgccctcgtgttagtaaattcaagcacaagatcttaatgtgagggagttgggtaatgccttccattaaaggcctaacgccatgcttgtcgccttgctcctatgaatttgtaggaagttaacagaggtaatctcagacaaaatgcaaaactaactgggaaagagcaaagaaatgtttgacagaaggccatacagttgaagaatcagtaatttgcttgcagacaagtaacgatctagtaatttgctgcagagtcaacattttcagtttggaactttggatgctgcttttcggccagatgtaatagaaattaatataatctgaattcaattgtagtgcaagtgaattagatgtatctgcaggcttatgtaatcatgttcaacaaccacataatggtgaaacaactgataatcaatgacgatctctttggtaacgacaactcagaaactgcagcatatcgagaaatgcaagcatggatgactcgcaattatgctagctcagtaaacatgaatgcagcaattgatcctttgtacagaaacaagtatcacttgaaaatgtgctgataaaattattttcctaaggtcaagtatacatttgaagttcagttcaagattgttctcctattctgcaactttctaactagtattcaagatattcaactctcaacaatgcaaaagataggccaacaaaaaactgcagctgaatcgagcattgagtgttgagcctaaacactcatgagcttagatgatctaaacttaacaattgcaagtttgcaatagaaaattgcatattctgaaggataatcatctgataatccacattgcagttcgagcaatacacaattgattacttgactgaaacagaggaagaagaggcactcactagttcaattttgtcgaaacatgatttcggcaataataaaagggggtagcgtacgagacctaaaagtggatggatgcggagacaaaggatttagacaggttcaggccctctcaatgagaggcaataccctactcctgtttggggatttgaatccgccgagtgtgtattgatctgacgatcaggttgtctcatatgccccctagagggcctcctacccaccttatataggatggggggcaggattacaagatagaaaccttaaccaatacggtatcggtttcctaaatctactttacaatattatcaaaccaggactttaggccgttccgtaatatacaaggaaacgt

SEQ ID NO: 30707 - DNA, 489 bp, Oryza sativa
atatcacactagcatctcctctgcctacatgttcaattgagacctaacaattttgaacttgctgtaacaggatttcggaggtctgccttatagagtgcatgtacaaaggcaagcgaggtctgaaacatggggcatcctattcatcctcacaatgtatgcttgtacaactagttggaaacttgtagcttcatccttttctggcactatataaatgaaacctgaggtgcgagtgcatgatttgtagcgagatttgctactgtagacttaaattagtacattccactccagcataacgtgttcttcactttttcgggcgtgttcttcacttttttgttaatctgatcttctgctttcaccttgaaaacttgaaattaatttgaactgggcattcagtcctcctatttggagtgcatgaactgttgtcaaactaatgtggaatttgtgacttgtcaacagggccagtgtttgctctattgcgttgatcataaa

SEQ ID NO: 30708 - DNA, 1501 bp, Oryza sativa
taaatataaaaaacaaaaggttgtgcttaaagtactttggataataaagtaagtcacaaataaaataaataataatttcaattttttttgaataagacgaatggtcaaacagtgtaagcaaaaagttaaaatcccttatattatggaacggagggagtatccgcctccctgaaggtctgccccatccggatctgtgagtacgacatggtgtacctgctgccccctttggtcctccctaaggattaaacgtgaaccacgatggtataacctgctgtccaacttctgtaacacttctcttttttttagaactcacgcatttatttaatataggatgtttatacacaacttgcatgagtggacgtcacatctctcaaagaaagagagattaggttgcctatagaaggacatgtagataaacatacaacatgatttgcaaaaagactcctcaaagataaacaagttacgcaggggtcctgaaaataagcaaatgactccaacagaaaacaaaaaggcaatcgagtccctgcttcactttgtcttccaatctaatcaccaagacaatgaaaccgacgatggcatctcataattggaggttgaagtgaacccgatgaacacaaaaagattcaatctaacattgaaaaagctccatcaaagacaagggcaccaaattgctagcagcaaactcgtcggagatgatttaaacggccgaccacaactcatcgttgtggaggaaggagacctcccaccatggggcaaatatgctgcacttgttgactaaaacattggtataaaatcccgtaacaacttttcaaatggcgcaaggcagatcaagctttggatttggaactcaaaccggccatgaaaggaggtagccaggacgaagaagatgggtattatggcatctccatcgagctatacaggaaagggaaggagcagagaacctagtactagataaactcgatttacaatagaatgaacccgactaagggataaaaccgatggctccccaaacccccctcccctggcaggcgaccaacggccaccagagatggaggggaaaggggatccggtagaggaaaagaggagactttgtttttttggctcaccgacatatagagtataagaacggagcaaggaatctacacagggaagcaatccgcaacatttcttcttggacaacagtttgcgcatagggcatggattggtaactagagagacgccagagggagagagacacacacatggagagaggccaacaagattggtggagtctaccaatttttaattttttatttgttgttgggtctattcatgtgtcacgtaagggaaaatcacaactttgtttggactcggaggtaagttaaataatagtaaatgttgagcggtgaacaatatacataataattacttccttcgtttcgtaatggaagactttctagcattgcccatatttatatagatgctaatgaatctaggcatatatgtgtgcctagatttatta

SEQ ID NO: 30709 - DNA, 499 bp, Oryza sativa
gatctttcaacttcggcaattcatccagaagaaaaagaactctttgcgccacggaatccgatcagtcaaaaatgttttcaaaccttgcactatttcttgtcttccatggctcataaataattgtagccatcagttgcatagtcgattccttttgaaagtctgtgcagtcaagcaaccatcgtgccagtgcggatggtatagctattgcatatttgcagtttcatcagaggaattgacgataggtaatttagaaaccgatagttagccatactattaaacttgctctaattcaatcactaacaaaaaaaaaaaaaaggactgcagcatctagtggagtccatcgtgtgtggcccagggtttgcaataccgccggtaactgcacggttaccgtgcttaccgcggggtacggtaaaagaaaaaccatggtaatcttcttaaatttaaaaaataatttaaaatattgataaattttacacggttttgtatggtttgccacagt

SEQ ID NO: 30710 - DNA, 1028 bp, Oryza sativa
ccgcatcgacgcgcagatcgccgcgcgcccgcctccctttgcagccgcctccgccgccgccgccgccggtggcccctccggtggcgaggagctcgacctcttcatggtacgcctctccgctcccaggcccctccttatgcccctttccgcgtgcagaattttctgctgcaggtcggggaaacggcgatgggaggaaaagaaatggacaattaagtttgtttggattatctgcaataagatttttcaattgctttgctattgtatggactttatatggtagtagtagtagtaagtttgcacgtttcccctatgcttatgattggttgtcatccaaattggacaaaaaatctcaggataaagttcaaacagtctcactataccttgaaaatcaccacaagggtgaacttgtactatggttattttgttgcaaagcccgttttgttgttgtagatgactttgatatgccactgatgtcttagtgacatccttatagtgagtggcacgtagtggagatagttgaaacttagtggcatattgtggatttgtcctagtgattatgaagttgttacaagaattgtttgcttgaaaggattctatcacccgttgataattattgctactcccgcatccattgataccttctaaacgggacacagtcatataaataagaaataaatccacaaattcaaaggctcataaatctagaccaaaagctatcaaagtggaaaaatagctgaggcccatttctctagtttctgagatgatgtaaaaccttgcatgaatgaaagttccctgccaagattattgatttgctattaatatctgtgctatgctaatctcatctaatgacaataccttgttctcatcatgctgttaactggaaaaataagctcatgtattgatgccattacctctctttctacgaaatttgctgtgacgttatgacccctgtgttactccttatcttggaaatgaacatgtcattgtgtttttcacatggcagcccttcttgtggactctaacatact

SEQ ID NO: 30711 - DNA, 438 bp, Oryza sativa
ctgatttgcgtcgggcgttctgcagttgcatatgtaactgatcttttcaagcgttggaagtatttttttttagataatggaataaataaatattccggcctttactcaaaagagctacagccaattattacatagaagcgtttgacaaacatagtgtagatctaattgaatagaacacaccgcaaggaacaataaagaatccagtctaacaaaggagattacaattattgaaatctatttgtaaatttccacccataattggcaaaaggttgcataaccatagtctccaacttccgacatgcaacttttagaaactcttcatcatctttacacctttgtagttgtgctcaaaactgaagccaatgggttgctctgaaaatgacctgcatataggaaaatgatggtgatttgtcaaaaactatattgttcctactcagc

SEQ ID NO: 30712 - DNA, 1501 bp, Oryza sativa
  unsure (1)..(1501): unsure at all n locations
cattcttgcggctgcgggagccggacgtacgacgtccccgcccttcagcgtgacggaaccgaaaatccaacgccagcggcggcggctcccaccgagccgcgttcacgaatcacgccgacgcgggcgaccagccgcccagtttcgcgtacgtgtgagctaacgagcnccgtacgtcccaccacgttattcgatcggggcctcggcctaatgcgtaccagggcggcccaatttgttatggctcataggctcgaagccaccgtttcgccttcctcgtgaaatgtaagcgcaacagggaaagcatgtaagagcatcagggaaatcacgtaagagcatctccgagagattctccgttccaactcttcaagttaaattttggccatccaagagaaaaattgctcaataaaaaactagccatccagtttgctaagccatcctactagctaaaagtgccctcggcctggccaaacttggccatcctatctcgcttgccattcatgagtcccactacttttttttctctatcttctctcattcccaccgaagtgcaatagggaggcggggggcacaggcgttgttggcagcggcatggtagagggggagactccggtggccggcgacagaagcttagggatagtgtcatctctggtgagcagacgaaagcacgtgacacggtgctgtcggcactgctccaggaggatttgggtcccgcaggcgtagtctccgtggcatcggctacggcaacggtggcggccgagcggtgggacttcagctccggccagatcgatggtgcgctcgtcacccctgtcggtgtgagcaagaggtcccacgccacctggccaaggtccaccattctgttcgcctcctgccgatgtcgatgccgttcgcctcccgcatcgctgtcgtccacccaaatttatgccgccatcgtcttcctggatctgtgtcaccgctgtcatctccccgaatccgcgctgctgtcgttgcccccacatcatctatgctatctacgggttgtttctaggggtagacaaaaaactcgaaactcatgagtagctgcctagctcaactcgtgtaaaactcggcttgactcgagtcgagtcgttaatgagtcgagttgagtttgaactttcactcgcttgcttaacgagacaactcgagctagctcgtgagttactcggttagctcattgagctcatgatgcattaagatggaagttaattgttcatgtaggtataaaagtcgtaaactcataattatacattgtagcacaatcttgtgagtcatgatatacatagcatgtcaattataatctttggtcatagaatcacaaattataccgcatgtgaattttaaaccatgtatttcggtgtaacgagtttaatgagtcaactcggactttttaacgagtcaaattgagttccatttttaactcgttatgttaatgagtcgagccaagctagctcgtctacttaacgagtttttacaagtcgagttggcttgt

SEQ ID NO: 30713 - DNA, 932 bp, Oryza sativa
catataagacggacagtcaaacgttggacacggaaacccaatgtttgtctttttttttttttttgggacgggagtatagtatatactgcgcggtttcttgaccgacgtactcctacgtctgcaacatctgcttgattggaagtgcatgcgcagtagaagaattgaagaacatttgatggaagtgagcagccccttgttgactttagatagtttttggttagagacgattttgtttcatattcttctctcatcagagaatctgatcgaaaccaatgaaatataagcagcactttgtgatgctaatttttcatgttcaagtaattaatttaattactgtactttcatcatacaaacgcaggcatatattttttttacatgggaatgtatcattccatatttccattagacttcagctccagacagggatatatgatcagcagaataggtaattattattttttagaacaggcacttaggtttcggacggtttcacacattattattttttggatgtagatgtctggtttgaatccattttcaaaaaaagaaaataaaaggatcgaccagtattataggaaataagctaggtttcggacggtttcacactcacacatacggtactcgtgcgatggacggctcggatgaaaccaacggtcacatgcatcagttgtctctctcccacacagccgctatgtaaagcctcggagcagaggcagcctcccgtactcctcctctcgctcgatcgacgcagcaacgccgccacgagacgaaacacgaaaccctagatttctcctccatttcttctccttcagagctagctcaaatccccatttccccaatggcttacaggtgcgccgcgcacaagaaggcttctctgtccggcggatccgtcggcgccggcgccggcggtggccgtggctactacggtggtc

SEQ ID NO: 30714 - DNA, 687 bp, Oryza sativa
ttaattggacccaattcaatctctttactttttagacaaaggagcaaagactagttctctagccttaggccgtgtttagtttcaaagtttttcttcaaactttcaactttttcatcacatcaaaacttttctacacacacaaacttctaatttttccatcacatcgttctaatttcaaccaaacttttaatttttacgttaactaaacacagcctaaataaatcaatgggccgtgcagacatgcatgatcacagcaactgcatgggaaacgatgatacatctttagagaaagaataaaaacgcaacagaattcgattccatgctttaatttgtaaaagagacgcgagctcggtgagaagcaaaggatccgatgacccaccagccaactcttctaataccaccaggcaatgcaacaagcaaggaatcgcgtgtcatgtcgtgtctttgatttggagacgaattagcagctaactagggctcttctttggacgacggatcgacgaattctcgtctaattccgagcgacgagcttccctgcaggtaggtgattgttccccttctgcttctgcaacaatgctgatccagagctccagaactactctcaccaacagttgtgatttgtgaagcgcagagggattatattaattagagctgacagttagagtgttaattctgtacccatgcagg

SEQ ID NO: 30715 - DNA, 226 bp, Oryza sativa
cgacgggagccctctcgtcgcgctcgagcttggccggtgagctgcttccgtcgcgagccatggggagagagatcgatctagggtttgcgcaagacggctgagcggcggaagcgcgcgctgctgcttcgaattcgagacgagaacgatggagttggggaatttttggcggcggctagggttttgggaaatgggccggactctggtctctatttatattacacacagg

SEQ ID NO: 30716 - DNA, 758 bp, Oryza sativa
gcctatatttgaacttaattatgttgcttgaaaaatattatgcattgataggatcgcacttagtctgcttgtcccgtctgaaggcagattggcggacctacctaatttgtcgcatttgatccttcctttgttaattgttataccatgttcccttgtaaccatctagttgcgcctcgatattcgtgcactctgtgcgagtatcgacggtcgccttcaaacttaaaatctgagtaacttcttgggtaaaacttgggttttacaaaagacttggaaaactcgacacctgggtcggtgctcgcgaactaaatgaatttccaaaaccgcggaccggggaacgtaccgggtgtacagtttcccgttcttgcacttaaggaccgtttccttggaatttcatccgaacataagacaagtacgaccacatgggtggaatgggacacccctggctgagtaattagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccgtgggcagggtgatccgggttagtaatgtcgtgtgggtaaagtgtaccccctctgcagaggttaacaaactgttcgaacagccgtgcccacggtca

SEQ ID NO: 30717 - DNA, 1501 bp, Oryza sativa
ttggttggtcaggattcgagaagttttcatatctatgaatttaactatttagtgacgactctaatatgatgttgacataatttagagaaaagtatttaaaaatcgatactcgatcagtcgagaattttctttccaccatttccatccctattttacacacactcaaaagtcaaaacgaagccctgtcctgaatttgtctgttcaacaaagcgggccgtggcccatgcctcgagattccagcccagtcatgaaaacgtgggctataacacgattacctaaatgggccagatttgtccaatgaagcctgatgagcccaaaaggtcccggcccattaacattaatctgcggcgattttgctatatatttgtcgacaaatttttccccagaaatttgacagatgtaattacactacaatcgtagtgtaattacactgtaactatagtgtaacttgtatgtaactttcaaaaatctctccgtaacatgttatttcggtaaaatggaggtcgtgggaaaaaattctttcacatatgtgtgtgctatgatgtgttttcttcctcaccaaaacaaatcttgtaatagatctaatgattcaaaattatgtgaaacttacatataagttacactgtagttacatgcaatttacagtgtaattacatataagttacagtgtaattacaccatgattgtactataattacatctgttaaatttttgggaaaaaatttgttgacaaatgtataggtagtcccatctgcggaggccgccaccgccgtcctccgtccaccaaacggattgggaatgcggattggatgcgtgttagagcaagtacaatagcagactattagccagctataaacatattttaatgagataaaagatgagagagaagagcagtgggctacaaatatgtagccagctacagcacggactccaagacgcaatgtgtgtatgacaagtgggaccatgtattaataatatagtaagcaactattgtatgaattggctataaaattggctatagatgaattggagcaagtagtaggctatgctattaaacttgctcttagggaattgagagagcgtttttgaacaacgtatgatctgttcgcacatgttttgagcaaattgaactgattgtagcttgggtgtgtttagttcacgccaaaattagaagtttggttgaaattgaaacgatgtgatagaaaagttggaagtttgtgtaattgtgtatgtagaaaagttttgatgtgatggaaaagttagaagtttgaagaaaaagtttggaactaagctcggcctttatgcataagagagagagagagagatttatgcatgagagagagagagagagagaaagagagagagagagagaagttcaaatggttccaaagcattcaatctgtagagtaacctttttgagcatggaccgctagcctgactctaggtttgcaatgagaaatggcatgagagcgtcaggcaggtgagaggcttatatatattg

SEQ ID NO: 30718 - DNA, 1501 bp, Oryza sativa
tagaaaaaaataataatatttttttacccaagataaacttattataaaaatatatttaattattaatttaataaaactaatttggtaatgtaaatattactatatttgtctataaacttagtcaaactttaagcagattgactttgaccaaagtcaaaacatcttgtaatctgaaacggagagagtgtacagtattatgattctacgataaattttagactcgagaacaaattgaaggacctaaagtaaacttattcctaccgactgtggtacagtggcaggagcgatccagcaaggatcgccagttcttttcttctctgtggccatctggcaggatggttgacagggcaaatagtagctagatactcttctttttccttttttttttcttcgggggttcggatcctctggaggtagacgagacgctgtcaaaatgtaaagcagagagagcagaccggcagaccatctgcctcgacactatttcaaggcagagtatgggcttcctttgttgaggccagggtatggtcaatgatctttttggagctaacaccatggataataacggttgttgtttcaaattgttaataatgtagcacgtgtgtgtcctcggtgttttgtgaagctttcgtgggcttttgtcagtgtttacaggcgtttcaggatcatcgtgtatcgatttttaagtgtctgggataagaaattgggatgtctagaaatcaaaggcggctgaaattttcaaaaaaaaaaagccacttttttcgtaccttggatggcaattcaatagttctcaatttctcgtcattatcattgttacttactgcaaacaaaacccattctttctaataaattactctaacataaacatgaaataaatttacagttcatatcatttttaaaatttccaaaaaaaaaaagaagtcacatggatgataaaaaagaaaaacacgggtattcgcgcacggcccagacgcgtaaacgttcacgcactagttatttcgtcaacatatcatcttgtgtacttacttaggacttgtttagttccaaacaaaatttttcacactgtcacatcgaatgtttggataaatacatggagtattaaatttagaaaaaaaaacaattacagagttcaccaggaaattgcgagatgaatcttttaagtctaattgcgccatgatttgacaatgttgtgctacagtaaatatttgctaatgatagattaactaggcttaataaattcttctcgcaattttctgacaaaatctgtaatttgttttgttattagactacgtttaatatttcaaatgtgtgcccgtatatacgatgtgatatgccagggcaaaatttgccaactaaacaggccctaatttttgctctctgtgtgcacttgaacattgcactatctttcatgaggaatagtagcctcagagagtcaaggaaagtcagagagtggagaaaaattggaaccgaggataaagtgtatgcaatatatattatagacatc

SEQ ID NO: 30719 - DNA, 1027 bp, Oryza sativa
attcaataaaattaacatcgacttatgctggttcataaaaaaaatggcattgatacgtgaattatgtcatcaatgacctgaacataaccgtccaaaaactactgaaaagtagtattaagggaggtcacctatgcatcatttctgacgtaagatttgacagcattttttattcttcttgttcaagtaattttgcaacaaaaatgcatgtcagccttttgtaatgctacgtaaactggcaacgcaacacgttcgagatactctctccgtctctatgatataaagatatataaaagattttgtaatgctcgattgtttgacaattcgtcttattaaaaaaaattaaaattattatttattttatttgtgacttactttattatctaaaagtattttaagcacaacgttttgttttttatatttgcactatttttttaatatgatgagtagtcaaacattacaataatactagtgaatattctttatattaagagaaataatactagtgaatattctttatattaagggacggagggagtagatgaactactggatgggagtggtcaatggagtccatgattttacttatctttttatctctcattctgacggtcatacttacctcatgctttcttttttgaaactatacctcatgctttcgccagggccatgcgatagagaactgtactggacgaccatacgaatctgaaaccagtttgaaattaagaatggcaatgcattatgtatgtgaaacttatggctaaagttcttccatcctcaagttattctgtgtgggacacgcatgtacggcttctcccctttcagattaagcagaattttatatgaatcagtatggctcattcttattctcggctggttttagcgttgttccatagcatggataacccattaagaattgtttgcttttgtttcagagttttgtgcaacttggtcaccaacaactacagaccctaaaaaatgatgtatacgaagcagtacactgaagtacacatctctttgttttttcaga

SEQ ID NO: 30720 - DNA, 1501 bp, Oryza sativa
agtcaccatgaacttgttagtcttaacgctcacaggtaacttgtaaatgaactgtgtatgtgccgtcaagtttctcccatatataaaaaaacaaatcaacagaactgcttgttatgtgtggacacattttctgaactgctaaacggtgttttgggagacgaaggagaactatatttcaggggacgaagggagtaacgttgaagagaaccagaattggaaaaagttaacttgagtttcctcatcttatcgttgagtttcaaaaaaattcttaaaccaaaataccaggtatatataacgcatcatattcttacagaactaggtcacattgagttccaaggcatcattgctcccggttttggccgacgtggcagctaagttagcgtgggactcacatgggccccatatgtcagcaacctgttaggtttaattgggtaattgatccatttaaatcaattaaatcaaataaattccaaggctcattatgctaggaattcatgtgaattcattcttttatgggatatcaatgggatgaagagttttgagaattaatccatttgattaaggaattggtaacttatatcaattagtcctaattgatggatggttgatggttgtgtagtggaggatggttcatggctagttgatgagaattagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgggaatggatttgatctcccgcgagataaagaagacacactttcatccattttcaaaagctgttgctgctacggtaatcccatcccgacgagtgtgtgcacacgcgttgggagagtaggcctccgaaaccacgcgttgctgcgacgtttgcacagacgggcgggcgatcaggtttttggggagcgcaaggcgcgactactcactgttcgtcaacatctacttcatcttcaccaacatgtcgaacactggagacaaggagaaggagactcccgtcaacaccaacggaggcaatactgcctcaaactccagcggaggaccattcttggggtataaccttattacattatttcaattagaagttttactgttaatgttcatcgcaatgtcaacattgtgtcattatgtgattgttgatgcttattcaacgttaagcatgctcatgttgattacattcaccactatcactggatcaaatcctattgtaaatatcatgtttattatcttgttattttggattaaaatatgccgaattatgaccaaatttccaacaatccaaaaacctgataggtcattttcggtagttggctttgctgctgcactgaaaccacatgcttttgatggttcaaactataagagatggaaagcacgtgcactattgtggttgacagcga

SEQ ID NO: 30721 - DNA, 259 bp, Oryza sativa
caatcccaatccccaatcaaacaacatcacagaaaaacaaacatgaaaaacataactaaaaatctttcactaacattgaatctttcacaaaaatcattcccaaacaacatacaagatggctcaatgcggcagcttcaatctttcactaacaacaaaaatcagaaaaaatcaaaggagggcgccaccactgctggtcaccactgccgccgccgggccaccaccacctcctgctgccggaccaccgccgcatgcaccccct

SEQ ID NO: 30722 - DNA, 1501 bp, Oryza sativa
aatcttaattgcatcactcgagctacttgcttaacatctctgatccttatctccatctggacaaatattaattatttccagctaattaattgatctgctattttttttctaattaagcacagagatgaagcctccacgatatctgcgttttgctcttggattttgcagcgtggttaagccgacgagaggagtacaatctaagcgattactccctccatcctataatataaaggattttgagtttttacttgtattgtttgaccattcgtcttattaaaaaaatttaaaaatattatttattttttttacttactttattatccaaaatactctaaatacaacttttcgttttttatatttgcacaaatcttttgaataaaacgagtagtcaaatagtgtaagaaaaaaactcaaaatcccttatattataagatggagggagtatttccttagaatcttagcctcctgcatgccttttgcacgtgcttccgtagtcccgtgtgcttgcattgccaaggcttaaactaatgcggtcaaagctcacaaatgactcaaccgagcttagtttgcttaggtgacaacacaacaaatgaacaaaatgtctttgaaacttaagtgcattgacttaaaaaaaaacacggtaattatgtccttgctccatggatttaaaaaaagaggaagagctgagaacgaacaaaactaaaggacatgttgctttgaactgcgtgctgatgaattagatttcaggcagggtacggtgcatggctagcaatatggaaatgatcatgagtgtgttttcttttttgcttagtaagatctggcccatgcaattaaaggaccattcacaaaccaaagatatataggtaggagtacatatagtagaatatatgggtccttagtggaaaaagcatgatgttgtcatcctcataatcccctttagcaatcatagagttttgatggtctcccatgtatggccagatggaagagaagctagctagctaaacctggtagccaaaggcaacatgcatttcgcccccaccaaaacgcaccttttattaaaaaaagggttttgatttggatgtgtgtatatgagtatatcatgttcctttttttttcccattgagctagctttatcctcctctgtaaagatccaaaatgagaaactaccgttaatatgttaccaaatgcaattgcatatatagttttggatgcgtctaccaatgcaatcacgtacaagagcaatgagcaataaagggcatcggcatcttttcaccatgatgctaattaatatgtgagaatttctacaaattacactatttagttgaatgcaccaactagttcatgtttaaaaaattaagctgatgaaaaaaaaaacaattgcattgacactacatcaggcctgtttagttcccaaacaaaaatttttcaccctgtcacatcgaatgtttggacacatgcataaagtattaaatatgaaaaaaaaaactaattacacagattg

SEQ ID NO: 30723 - DNA, 1217 bp, Oryza sativa
tattttgtgaagagaataatataccaattattatttttgaagtaagataatatatcaattttatagtctcttactctcttttgcctcatttatcatctaaatgtataagaacgcaaaatttctgttaaacatgcatgtaccaaccgtagactaaatatgatatacatagcagatgaagcaattcgattcggcagcatgcaaccttgtaaaattataatatgaaatataatcatgtttagtggatatatattaagatttgagatgaaagactgtagtatcccttgtgagtgggagggtggttgatgcgataagtagtactattttagtaatgcttataatgtgtataaattctgaatcctaaaaatgcttatatttgagctagctgtgcgattgtgcagcatgcaaacatgtactgttgtttaatttttgttccgtgcgcatgcactacatcggtcctagctacctcaaagtatgaaaactgaataggacataaattcaagcgtctgatctcagacataccaaatgaagcatccaaccgtatgttgcttacatactcctcgtttcaaaataactgacatagattaaagggtggttgggaagaaatttaaatgaggtgattgaagggaaaaatagtattctaggattgcttttttgagacaagatttaaatgttacaataattgttttgggacagagaggtagtccatgaatagatggccaagattttttttttctttttcctgatttaatctgagtatttctttctttttcgatcaatatgggaatttctagatttttttttccttcactagattaatgtgaggatttttaggagagccttagtatatataatgctattgaagagtccaatagttcctacattttcaaattagagttagtttggtcccataaaaacaaacgttgcatctattttcttattactaagcactgaaaagtgcaaattcttccttcaattcatatcaatgagttcattgaaaaccattcaagactcaagcatcaattgagatattaagttagtctagtataaatcaatgtgatcatctgcactgtaagtttgttaaccccaaaaatcaatgtaccttatccaaattactcatgttgtgtagattctacaggctgcactgaacttactggtttcgtagcggcccagagggtccatgttcctaaccaaaagagcaacaccataaagatacagtc

SEQ ID NO: 30724 - DNA, 333 bp, Oryza sativa
cacttggcctgttcaagcacctttttatgttttgttaaatgttgaggttacaagtatccatctggttgattgatctttgttaatatgaaataggtgcatttagattggaatattaatcttcgttgtttgcattcagtatgtacatttccacatgcatgtttgtgctgtgcgctattaagaatggcttgttattttgttttggattctaccttgttggaggactaaagcaatttgcagtattgtattattggaggtcatctttcttttttctttgttgacaattgcatgcagctcatatttaacaaaagggcataacacatgtttaacctatca

SEQ ID NO: 30725 - DNA, 1501 bp, Oryza sativa
gacgaattggctattgccacccccttctgatcttctagtagcaatctgggctcaaaatgagaaagaagagatacgcgtgtgcctggactttgtttgaccaagcgacccacatggagttttcaactttcctcgagatatctgcatgcatcggcgctgtttgacccggtatatatatctattcaattctagcagcatgggttagggagaaatgaaatggatgattcactcgattaattaacacggtaaattaatattttgaaaacaaactttaaaaatataaacagtaggagtagcaactaggaacagagtggtctaaatgcggcagaataatgttcgaagaaacttttttttacaagagtggagtaaacaatctggaccaataatctgccaacaagcaattatgaacaaggctgacctatgacaattgacaaacaaatccgatgttgggctgacctatgagcacgttaaggggaaaaaaatcatatgttacatgttataagacgttttgacgttgatcaaagtcaaactactctaagtttaactaactctatagaaaaaagtagtaatatagtagtttgattttgactaaatttaaaacgtcttataacgtaaaacggagagagtacattctatgccctataaagattataatccgttcttttctttaaaaaaaatacaatcctaaaacaatcaccttaccaatcaatcatcttacccttttatataaactttttcacaccttagggtgtgtttacgccccatttagttccccagaaatttttcccaaaaacatcacatcgaatctttggatatatgcatgaagcattagatgtagataaatgaaaaaactaattacacagttagggagaaaatcgcgagagtaaagttgggaaagtgtggatgcacagcctaaatgtccacagctagcctgagataccagattttgaaagaagttagtattttttcaactctaaaatcatgtttcagctgaaattgttacgggctgtttagttcgcgaaatgaaaatatttgggtgtcacatcggatgtttgaccagatgtcggaaggggttttcggacacgaatgaaaaaactaatttcataactcgcatagaaaccgcgagacgaatcttttgagcttaattaattcgtcattagcacttataggttactatagcacttatggctaatcatggactaattaggctcaaaagattcgtctggtgatttcccccttaactgtgtaattagtttttcttttaatatatatttaatgctacatgcatacgtccaaagatttaatgtgatgtttttggaaaaaaaaaattggggaagtaaacggggccttagttcaagatcatttcaaacttgttacagcagtactaggactagcaaaattctaatgactttcctttgctctaaacagtattccaagcagtacacattccgctgcacagccgtcttgcccgtccagactttgggagatatttaaccatttgcca

SEQ ID NO: 30726 - DNA, 178 bp, Oryza sativa
gtgacataactcaaaatcattttaccatttaaaattgtttaattcaaaagtcaaagcataatgctgaactagcactctgatgtaaattcccatcagaaacaatcatcaggacggaatgtttcaccttatctcactattgtttattgcacaatataatatatctgtccttccttgcagt

SEQ ID NO: 30727 - DNA, 778 bp, Oryza sativa
attcctgcagccctgcaaaatttgtgatatgccaccctgacccacatgttattgactcatgtgggtcctaaatgtcattgagatacgggtggcatgtctcaaattttgtaaatatagggtggcatggttacaacaaaccgaaaaaagagaccgggcgaaagataaaaaaagcgaaaaaaataaaaaaaaatccgacccctatccgattccctctcagaaacgaaaaaaaagtccgactatagatccggttcccccttaaaaacgaaaaataaaaggcgccactccttttgagtccgagatacgagcgactactcctctcagtttcaatctatatcgtgatatctcacacatcttggtgaaacaaaatgatgttccggattgaaaatctgtttaaaaaacggaacctacaggtcgagagcattccatttttatatgattttaatttttgggtttgtacttttacatttgagtccctataatcttgcaataagctacttgaggtcgtttttgttaaaaataataataaaagagagagaacaaaagcagaaaggtgcataaaaagagaaaagagtaaattgcatcttagaccatatttttttaccatggtttcactttgggatactcttaacataatgttttcactttaggcctgattttattaccaaaacctttcactttgggccattggcccataatcagtctctcaaagcctatctctcatcactatctacctggtcatcttcgactcttttcgtccatggctctatagatcacaaag

SEQ ID NO: 30728 - DNA, 1501 bp, Oryza sativa
actttatttgagagaaataaaaatgacaaatttcaggtgaatagtagcatattactattcacccaaaatttgtcttatttgttacccaaaataaagttgagtttaaacttgatatttggcaataatgtatttcataaccacacctatctttaatgtttttttcataaatttataaaaacttttaagtataattttcatgagttctcgttttcactgaatatgccctcatttttaatttgttcaaaagcaaatgcacactatgtaaaagcaccatagtcatttctctcaaaaatttcctgtgtacctctcttgacattctatccacgaataagagcaggggcgacgctacagcctaccatcggggtcagtagaccccgacgatttcatgcatacatctagtacccctcgcttttttaccagctagaccccagtcaagcaaactactagaccccggtgacaccgtttcgttaaagcccaatagcaattaggaacgagactagtaagtagaaaatagaaaattaatcagctcttaaacgcctgagacttgagcccacatggccggcagcccagaaagtccattcccctgttgcatcatattcttctggtagtttgaccgagcacttcgcattgcatcgccgcacatctcgatttctcgactttccgtgtcttctcgtcctcgagtagtacacgcgtgcatcgccggcttggcgtcacaaggacgagaagaatggcaagggtgaagggttatggttgagcgctcgagcgctcgagctgttgagggcggtaacctactaacattatcacaatttcttgattattaccatcacaatttagccctagggtggtttctcaagtccgaaagtttattaggaagttagggttctataattcagaagttctgaaatatgaacatttgatttgtctttgttttcaaacttcagttatatgatcatgagtaaggaggaggattaatgtataattttgttccatcttacgcatagttttagtcacactacaaaaaaatggtttttttttctgacagccacccctttcattttttgcaaatggctagcttaaacttaaaggctatatctgtgaagattcatttcaccatgtgattatcgtagcaccggtcacaagcgaaaagatctttagtcataagcgacacgattggccacctgtaaaaatgtgttttggccatttacgataaacctgttcatagtagtgcaagttcattagttagtagtgaccccggcgatgatttattctggcttcgcccctgaataagaggacaattacaacataaacagttctctttcttaaaaaaacactaaacatgatatagtcaatgtctagtgtggatataataaaaaaaaatcgtgcagcataagaattggagctacccttagccgcccatgttgtgatagttcaatatttttaacatattatccattatacatctcaatcgtactacgtacgcacacttaatatgtccttcatc

SEQ ID NO: 30729 - DNA, 1501 bp, Oryza sativa
gcacaaaattataaattcaaccagaaagacggtgcatgcatatatatatatatatatatatatatatatatatatatatatatatatatatatatatatatatatatatatatatacggttacatatagacaaggaagccgaaacgtgccgttcgtaccaatgttcatccaaacaaattagacaaaactaccctcaccccccctccacttcctatttacatatatcaaaaaaaatttagtgagagcttcgtggaggcttccgtgattctcgcgtcaataccgaagactcgagacctcgttgccttcatggtagatccatcccttcatccatcaatctcgtcgtaataagcaaccaaaatgttataattaactgtacgagatgagtatctcaaacgtattatgttgatccaactcgttaagaatgtctaggtctataatgttaaaagcgataatattaatttttatttcagattgtttacatactctttaaaaaaatatattttaaaaaataaaaatttaaattcttcgaacgatctttgatagagaaaatccttatacaaaagtcgcggaacacataagatcggtaactttgtagttaaggaccttttcatttgaagtcatctggagtgtgaaacatgatttggatatataagaacagtaaaacgaataatgatgaaggagttgataacgtgagttttataggtgagttggtaagggcgtgccttgtgaagagagggagatattatgtcttgaactccatagccgaatatatgtgaatattatctgaaaattatgtatcatgtatataggatggttagtaaaatttaaaatatatttttacattttctatgcatttaaaattgaaaaaaattatggatttacaagtagtgatgtgtgatcatgtataggataattatatagactcaaaatattctttctagttttttgtgcattttataaaattttaaaaaatgaaaaattgtggttttatgagtagtgatgtttcaataactagaaaaattcaaaatattctttatagttttttgttcattccaaatttaaaaatcatgacttgtcattagtgactcggatgataagttatatatgaccagtcaaaatgagtcatcaatagcaagtggtaacttaccacctgtcacaaataacacatttgtgaaggagggtaaattatatgacccatcatctacttagagcaggtacagtatagcagactattagcaagatataaatatattttaatgagatgaaaaattgaaaaagaagagtagcgggctactgtcacaccccaatctgataccgccgtacaacggcacctgacaggagcgtgtcgtagggaaaacggcgcgaaccgcttcctacgaaaccgcgatcacggtaccagtcccaggacatagtgctggtacccacggtgacaaatatgaatcatagcaatccttaaactaaatagaggacttatttaccttaacttaggttgcagctcaga

SEQ ID NO: 30730 - DNA, 671 bp, Oryza sativa
cggcgcagtggctcaggattggctcctcccaccagcgacggccctcctcccaccacgagctgcccctccccacgtcggtgcccctccgtgtgcctccccaccggcggcgcgactactgaagaagctgaagaaggaggtcaagatggatatgtaagaagggatttgtcgattgctttaggctgcaatgctaattttgttggggtggattggagttctcccatggatccctttgttgattttatttgggtgaatctttggttattgtgtttgtcttatggtgtttgtgcatccgatttggttgtgtcgaactatgaaagtctggttttggaaagtgcttccatgagattagattattggtaggattatctctcggtgtagttctaatactaactatgatgttcgattggtttgttaatccatatttgattttgtatcgaactcttttttttcttttttttgggctttggccgtcgtatggatgtaattgcgcgtgtgtatggaggatgccgcttctcagattgacggacgaaaaattactgtgacgaaaggaaaattacgaatattttaattagttaagaatagcaaaaatgtccgtgcgttgcaacgggtgaaaacattctaatgataatatgcgtttttcatgaataatcatgtcaatgacaatgtttgta

SEQ ID NO: 30731 - DNA, 1501 bp, Oryza sativa
tggtcccacctggcagtgacggtggacaggaggacctccaaagtctggggcttttaactatttgccacttttagatttggcaaataactatttgtcacccctatttcaatgacatatgtccacatgtgtctataacatgtgggtctagtgacaaaaggttaattgccacatttatatgtggcaaatggttaaatatctcccaaagtctggacgggcaagacggctgtgcagcggaatgtgtactgcttggaatactgtttagagcaaaggaaagtcattagaattttgctagtcctagtactgctgtaacaagtttgaaatgatcttgaactaaggccccgtttacttccccaattttttttttccaaaaacatcacattaaatctttggacgtatgcatgtagcattaaatatatattaaaagaaaaactaattacacagttaagggggaaatcaccagacgaatcttttgagcctaattagtccatgattagccataagtgctatagtaacctataagtgctaatgacgaattaattaagctcaaaagattcgtctcgcggtttctatgcgagttatgaaattagttttttcattcgtgtccgaaaaccccttccgacatctggtcaaacatccgatgtgacacccaaatattttcatttcgcgaactaaacagcccgtaacaatttcagctgaaacatgattttagagttgaaaaaatactaacttctttcaaaatctggtatctcaggctagctgtggacatttaggctgtgcatccacactttcccaactttactctcgcgattttctccctaactgtgtaattagttttttcatttatctacatctaatgcttcatgcatatatccaaagattcgatgtgatgtttttgggaaaaatttctggggaactaaatggggcgtaaacacaccctaaggtgtgaaaaagtttatataaaagggtaagatgattgattggtaaggtgattgttttaggattgtattttttttaaagaaaagaacggattataatctttatagggcatagaatgtactctctccgttttacgttataagacgttttaaatttagtcaaaatcaaactactatattactacttttttctatagagttagttaaacttagagtagtttgactttgatcaacgtcaaaacgtcttataacatgtaacatatgatttttttccccttaacgtgctcataggtcagcccaacatcggatttgtttgtcaattgtcataggtcagccttgttcataattgcttgttggcagattattggtccagattgtttactccactcttgtaaaaaaaagtttcttcgaacattattctgccgcatttagaccactctgttcctagttgctactcctactgtttatatttttaaagtttgttttcaaaatattaatttaccgtgttaattaatcgagtgaatcatccatttcatttctccctaacccatgctgctagaattgaa

SEQ ID NO: 30732 - DNA, 1296 bp, Oryza sativa
aaaccatggttaaaaaacatggaccaatatgcaatttactcgaaaagagtaaggaaagctgcacaaagaaaagaaaaacaacaacaaaagttctgttttccctaagtggtgaaaaaaacaccatagatccaaacggaaaaaaaatccgattcctataaaaggacaaaaaaaaagtggtgaaaaaaaatactagattcgattccttgaaaaacaggaaaaaaaagtctgattcctataaaggcaaaaaaaccgaaaaaacaccttaaaaaagttcatccgattccctaagaaagtggcgaaaaaatggttcgtaaaaaaataaaaagctggttcgtataaaataaataatgcacacgagaaaaaaaatagaaagggcgaaacaaagtctgatttctaatcaatatatatctcttctttatctctaatataatctaactatttaaaaagagaaaatacacgagaaaataaaaaaacatgctaaaaaggctttccatcttccataaaaaaatttaaaaaacatgcgacgaaaaaaatgtcagaaaaaacgcgcctttttaaaaaatggttttaaaaaaccatgcatgaaaaaaacatcgtctattaaaaaaatcgctctgagtcggataggatccatcgattttttgccacctattacacggcttttatttcgtcatatattctcctgtattgacaaaaagcaaaaaaaaaggaacatttgaaaaaaaaacaagcaaaaaaacgcgcgagataataattgtcaaaaaaggcaaaaaaacacacgagaaaagaaaagaaaagaaaaaaagggagaaaaatatggttttcattgtaaataaaaagcaaaaaaaaacatgctagaaaaaaacttttagaaagaaatgagccattgctgaatggtttgagaaaatcgcgcaagaaaaaaactgtttataaaaaaaaggttctcattaaagtacaaacattgtcattgacatgattattcatgaaaaacgcatattatcattagaatgttttcacccgttgcaacgcacggacatttttgctattcttaactaattaaaatattcgtaattttcctttcgtcacagtaatttttcgtccgtcaatctgagaagcggcatcctccatacacacgcgcaattacatccatacgacggccaaagcccaaaaaaaagaaaaaaaagagttcgatacaaaatcaaatatggattaacaaaccaatcgaacatcatagttagtattagaactacaccgagagataatcctaccaataatctaatctcatggaagcacttt

SEQ ID NO: 30733 - DNA, 1501 bp, Oryza sativa
caatgaatttgtatgccatgcgccgattctaaacccctcttcgatatcgtcatccgttcgttcaggcaattgcaaagaaatcctaagtttagtccttgatcgactaagcagccgaatcaaatctcatcctatttaacagtccaattacaaaggcaagataaatgtccaactatacaatccatttacaatctccagagcaaattctaatacaaattcctttcaaaattctaatccaaactcattggcaaaatacaaaaattcctagcaattatccaaaaggatcctattacacttgggccatcttttcctcttccagcacatggcaggcccagcactacaaccggcccagtactccccctcctccctgtggagtccatccatcccaaaagtctaactcaggtccctttacttattctttaccagaaaagatgcccgtgcgttgcaacgggtagagccaatttaatttgaacatatgtcagtagataaataatcaaagttcattatttcgtctattcatgtgcatacctgaatcacttattaccaaataaaaggctatttgtgtgtcaataagttctaaaatttaaattcggcttataggaataagcataagccaaacaatgaggcattcaaacacgagcccaatttgtcatccagctttatctcaagtcaggcaagaattgatgacggacggaatcaacaacttcgatcatctttttattttagttggcatgctcttttcgaaagtaaaattgattcttatgtattattgtaatggtatccctaatagtacatacgagcatgtgtggagactgacttgaaattatgctaacatgtcctaggaatcgtgttgtgtaatgcgaatagaatcggatgatctaagcaacgatgtacatgatatccatacggagtctgcgaatttcattcacttggtatctacatcacacggactctctttcgcagttcgtttgcgagtaatgactttgcaatgaatgttacgcgtgacgggaatcggatactgtcggtgacatgggaccgggagtatcatgactagaggcttgaggcagacacaatcacccacgtggcctggcaccctcgggagacgtcgggcccgagggtgatgtgtgcgcccacctcttggtctccccgaggggggggctcggaccactcctgcctcgccccagacgggccgaggcgccccgacccctcgcggtttctcctccgcgtgtatgggttgggtgagcccagcggggctcacctaaccgcatttattgcgcctcggctaaacgtgtcacaccgcacgaagtgcagtgcagtgcactcgtttatccggtctgtgaccggtcacagaccggtcagatcgcgggttaggtggcgacaggcggtctgacgcacgcttcgccccatcccgtcaagacgagagcttctaggcactcgtccccagctggagctagcgtgttacatcccagagatggcacgttagccccagtcgatatatgccagg

SEQ ID NO: 30734 - DNA, 220 bp, Oryza sativa
tgcaagaatcaaattatcgttacatggatccgctagttgttggtgtttgtcaccctgctcccagaagtagcatttgtcaccagccttcctcctctaataagtggttgttgaactgtcgataatgcaggtggaccttcattctggtgacgatttacttcggggtaggtcccttaatccctcctttttcacaacaaaatagtttgtctctgcactgaattca

SEQ ID NO: 30735 - DNA, 1273 bp, Oryza sativa
atgagtaataatatgaaacggagagaatatcgtatatttcgagacgaagagaatatatttttattttgaggaggggaaaatctgatgccaggccggcccaacagaggagaggttctgcttctccctttacttgatgccttgattcctccctttcttttcatcttctcctcctcctcctcttggctttcctttcttccgatccaagctactctctctctcctctcctcccctcccctcaccaagcgagccttctagagagagagagcttcccccggggggatcgagctcgccggaggactccacccgccgcgcctcggctgccgggagatccccccgcccgcccgccggtccgtccaacggtaagtctcgccttcttcgctcctccctgatttctcaccggcgatcgatcgatcgatcgatcccccgcgcgcgctcgagccgtcgccggagcctgggtgggtcgggaatcgcggcggcgtacggagtgagagatggtgtggtgtggtagggtagggtggatggagcacggctcgtcgttgaattaggggggaggagaaaaaaagggagggatttttatgcgtttttttggtgagggggaaatcggctgctgtctcgtgcgagatgtgctgctataagtggcaaatgtcaagtgccggattttcgttttgcgttttgccctggttggggttgggttactcatccctctactgaattggcatgtactactatttcaagctaatttgcttgttagaactatatatgttcagataccttttttgtggctgcacagtgtgtgtgagttttttttatcttaaaaactgtcattagaaggcatcatggcacaacagataagagaagtgcattgccaatgctgcaaacgggattgcggcaacgcaagcttgcagtgttgcctgtggctaatcttgatgatgctgatgatggtgatagtgtctaacataagttctgaacttttcttgtgtattgacaaaaccatcaccagcttgcatgtaattcatcttccatctgtgatagttttgtactccctagttttcttcaccatgctaatttcaatattcttgtttctgctatgctaggaattgaaaggaggtagccttcttgtcagctagtatggtaagttctctagcagaaaattgattttactacagcttcccagtttatctgccgcaccaagttaacttgtggattcggaggatctctttcttgcaatcctttgtttctacccaaagtttgatgttctaatatatctgtaata

SEQ ID NO: 30736 - DNA, 1501 bp, Oryza sativa
ggttgctgtcacgctatgaacaaatctgctaatgtacgtaggacacagaagataatatatcaattaatttcgcaagcttgtactttaccaaatccattttgtatcccgtggtcacgacaaaatctaaaatgcttcctcatttttggaaaataataaaagcatttttcgtcaacagtttaacaaactatttgaagaattttgcaggaattatttcgccaccgtttccggatgattgatatactctctgtccaatcacttagcttgcactgtaatataatgcgttgttgcaacattcaggggtaagcaataggacaggttaattatagtactgtggttagtactacccattaagagtaagtcttctatctgacagcaacaaatactctgcactctactactctaggactgttttgattgccaaattaaattgaccctggattatccagaagctaacacattacttagcttaataataattccacgggtacgagacacgtctcttgcactaaactgaagaaaagctcagtagtgctgagcgttgtgtagcacaaagtaagcagcaacaaccaccggccttacagctaaagcgaggaattcccttagctccaaatccaccgttctaacgccaaagcctttttattcagtgtcgatggatcaaagcttgacgaggaagagatctcgctccagaaagaaaattattggtaaggttgttgttaggtcgtagaggtgatcggtagttccctgtgatcatggcatgatccatcttgaatccttgcttgccatcaacaacagctactctacctgttatgtgttacttacatctgcagctagcttcatctggcaaagagagatacgagcacaaaaggaacaagctatatgtgcaacctaagaacgactaagaacgatctgcttacatctgcagactgcagctagcttcatctggtacagatatggcagaaaaggaaccagcataagaacaatctgctttatgcctgacaacacggtattctgagctctgatgaaatgtgggttcagaatcttcagctatatctgtctacaacctatggcaagccaggtcaaaatggaaaatgctggttcttcttccatgggtaacacaagaaacagagaggatcaatgcctcactggaagcgtccaaagcctagtccactttaagcagctacttgcaatgcagtgtcgggcagagggaaaatcatggggggaaaagcgtctgccccggcggccatgaaaatggcctgcctgcctgtactcaagttaaacgcaatcatcgtccttgctttcactggattgaataatggtccatgcttacttagcaacagtccagattagaaattttctactgaatcatgcactcgctaaccactttaggaatcctgccattttgtgattgctctcgtcttttccccgtacgccaacttggagagcaaataggaacaaaacatatggtcctgcgcctatcggtgcgttcttctcttcagcccaa

SEQ ID NO: 30737 - DNA, 401 bp, Oryza sativa
tgtcctatgcatcgtcttcgatctccggcgaagggataagtccaatgttccgccagtccaggcaattgtatcgtttacgtcggcgtcgttcaaggctgcatcagtacattcgacctcttggattgctctggtttggatgatatatttgcctacctatttatcatatatctctgttaatctagtgtcagcatatcaatttagctctatcggctgcttctcgttttagggtttctgccagtatcggctaaatcgccttgctagattagattagcttagacatctaccaccctgaaaactcagtcaacggcttgattgtctagatattatgtttcttttcatacttagtgctgcatcagttgagtttgatctactaagtcatgcttagaatcataatctctagc

SEQ ID NO: 30738 - DNA, 247 bp, Oryza sativa
ccgcgccatggatcgcctaatcgattgtacagagttcatcaggatctgtgtatgaaggagctacaaagtatcagccagcctctccctccttctgggttcccgatctgggaaggtccagtcccaacccaagcctgctctccctatgggcaaggtcctccttttatatttcaaggggataccacatgcacccctctctctttttgtgtggggacttatcctatcttttcataaatggacggagatttgt

SEQ ID NO: 30739 - DNA, 445 bp, Oryza sativa
atccgaaggttaaatcacacatcggctggaggtccgatgtcatgaaatccacaagattagattaaacaatgaaacatttgttgtcatcggctaaatccaacttatatgtacatgcaatccttatgagccgatgcaacatccagataactcaccggctgaaactccgatgaaacccttattggcaatcaagaagcaagctagagattatgattctaagcatgacttagtagatcaaactcaactgatgcagcactaagtatgaaaagaaacataatatctagacaatcaagccgttgactgagttttcagggtggtagatgtctaagctaatctaatctagcaaggcgatttagccgatactggcagaaaccctaaaacgagaagcagccgatagagctaaattgatatgctgacactagattaacagagatatatgataaatagg

SEQ ID NO: 30740 - DNA, 839 bp, Oryza sativa
cctgcaccccagcaaatgctccagataatttagtgattcataatctcatccagatctccacagattctgttggtttcggtgttaccctcatgagcaaaactcggtttcgtagcctgaattgcgggttttcccagcggcttctgtggatctgtcacatggaaatggaagagggctgaattgtgaacgatctgcatggcaactttgaggaaaacttcgaggaagggaaaacaccttgtttgcgtacgtttcccaaactactagacgatgtctttttttaataaaattttctataaaaaagttgctttaaaaaaatcatattaatccatttttaaaaattaaaattaatcatacgataatgacttacctcgttttacatatcttctcaatcttctcttctcctctcaatccctcccctaaaaagagcttagaagagagagttgatggcaagattcgttatgagagtttatctttagtccactgtattgtttctaatacctctctaaaatctcttattttagaatggaagcagtagtatttaagaggcgttttggtattttaaacacttacaattctaccctattaaaatattggtagtgccaaaacttatctagagtttaacactaccaacattttgatggtagggtactaaatcaaacaagccttaagttcacgacggacaaccaaatttagcttgctatgctatacttagtgaaaacagaaaaaaaaaagaaaaaagaacatcgagacatactagttaccttatgtgccgaaaggccagaagaggcggtgtgcttcaaaggatagcaaagcctctcactctactagataagatagcaaag

SEQ ID NO: 30741 - DNA, 441 bp, Oryza sativa
cgcggccgttaagatacggcttcgattgcaagtagttcatcaaatattttttatatagtatttctatacatttaaaatttatacacctatagtttatacatccaaaatttataagtcaaaagtttacatacccgattcaaatttgaatttgaattcgaatattagtttatagaatcaaagtttataagttgaaagtttacatacccgttttaaattgaatttgaattcaaatatttttttatatacagtatttccatacataaatttttctagctttgttttcttattttttaaaaaaattttatggtgtagtaggaatagaagaaatggaggaggaagggggagataagcgtacatggggatgggggggtgatcgctgtgggcgttcacccgcccattagccatggcccacaccatgtggtttgacgtgttctttttagc

SEQ ID NO: 30742 - DNA, 1501 bp, Oryza sativa; identical to SEQ ID NO: 24428

SEQ ID NO: 30743 - DNA, 1501 bp, Oryza sativa
gttcacaaagtacaaaacacagggtgtgtgagccaataatgtactgctgatcactcacgtacttggggcagtataatataagatgcaaggacaacgtatacgcatattaaacaaccccagctatttcatgtgcaaatttgtttatgggttttttggcggctgattggccattccctgcaggaatatgggaaggtcaatactcaataggagtaggtcattttgctttagttttcagttagcaaaatcatcaacagctatttcagttagaagattttcagtaaagtacatgcaaagattatgtagggtatgaaaagtgaaaaaggaaattttatccatagttaaatgattttttttcatgggaaaagaactctacccgtatgtcttggaattaggagttttgctatatggaaaactaacaaagggaaggatttggataggataaaattgagtgaaaaaaattgtacatctcacagtaatttagatgccttccttaattctagggccaaactgaagaaattagggatgattgcaacagctaattaaaatgtttttccttccttccaagctatgagagatagtatatatatgtgcgtgtctatatagatctgtgaatctttgatcctgtcgtgctgcctagcatgcaagaaatatgagaggaagaattaagtgggagaagacgggcatggatgtaacatctagctgtcaagcatcactaatcttatcaccaatatactttaatcaagttatatactccataaaccagccgcaaaggccagctcaagccacgtcagcaccaacaataggagaaaaagaggtgcctggatgatgactaattaattaaattgagaaatgccaaaactattgctttccaccctaaccagttgtgtaattgcgaggaacgaggatcactcacataccctcgggctcacatgcctatgcaatacagtagataatcgggattgaattacgagctactttatccgtttcaagtcataagactttctagcatgctaaaaagtcatataacccaaaacagagggagtacattttctctaacgccacaattacacaacaaatacatatacacaaatgttggaaaagaaacttgaaaccttacctatacaatgaaaaatcttaaaggcatcgtaattgtaaacaaatcatatgctaaccgattcgttttcaagcatgtatatatttttatcacatattttcatgcatatatatgataaatcatataggtaatacacataagacttatatctactataaaaatagatgaaaaataataaaattcaaaaggtgtcttgatattagatttaaagagagtacaaacacctacccacatctccgaataggtgtcgcgtaattgctagcgttattttaaagtcgtgattacataacaaaatatatatacatataaatgcttgttggaaaaaaatatttaaaccctacaccgaaatatagaatcttaagaggcattagagtgacgcacatcatc

SEQ ID NO: 30744 - DNA, 303 bp, Oryza sativa
  unsure (1)..(303): unsure at all n locations
cgcgcgacctgatntttgcacgtgcgcaagtagcncatcattattgcggtttgggtgagcacgtcacgccacacgtaatgcagtacagcgcgctcgttcatccggtctgtgatcagtcacaaaccggtcagatcgtgggttaggtggcgacaggcggtctgacgcacgcctcgccccatcccgtcaggacgagagcctccaagcactcgtccctagccggagccggcgtgttacctcctggagatggcacgttggttccggtcagatatatgccaggcttcatcctaaccattacaggcaaga

SEQ ID NO: 30745 - DNA, 1501 bp, Oryza sativa
ttatttcctattgagtcgcccccgattccccacagtgctaaatataaaaggggaggccggcccaacagtagatgacaatctctctcggtctcaatctaaacccaatcaacattggcgctggaggggaaacgtgtggcggttctaggatagtgtaggtggcaaccggaaggctgccgctaccccgcaaccggcgttctcactgctacgactacttcccttacgccgacgatcacggagcagttcgagggacttcatcctctacttccactccggttgatggtattggagagggaacaacaagaatcgcaacggtggtttcaaataacggtcagtaatcgtaaaattccgtattagggtgatcatgtttagactaagcactcatgttaatagatcagtagaatctacatatatgtgttcgtatcgggtttctagaaaattttacaacgaatagggtaatactccctccgtttctaaatatttgacgctgttgacttttttaaatatgtttaaccgttcgtcttatttaaaaaatttaagtaattattttttttcctatcatttgattaattgttaaatatacttatatgtatatatatagttttacatatttcacaaaagtttttgaataagacgaacggtcaaatatgtgataaaaagttaatggtgttaaatatttagaaatagagggagaggaagtactgatatacggagtaatcagcaaaaagatggaccatagccgtcgtgttggactcctccatgtaagacgacccggaacagcgaaaagaagaagcgcacgtaagaatcggcagggtcaaagctagtttctcaaaaaaaaaaagataataagaataatataataagaaaataaaaagaaaaaaaatccccatggagacgaaacgtggacaaaaatcgcagccgtcacgtccatctccgcaagaccgcggcgccaaacgggtcaaccacccacctctcttctcctcatccccatcccattcccatttctctcgcgcgcacggcgccgcgcgcgacgcgagacgcgacgcaagccatcaccaacacaaaaacatggcgtccaccacctcctcgcccacgcgcgcaccctcctcctacccgtaaacgacacccacaccgacccgcctccgcctgcgcggcgagaaaacccaagaaccccccacgtaggcaagacgaggagaaagaggattgcaagacgctgtccatcgaagcatgccatccatggcgcctcctcggctataaccaggcgagagagagagagacgagacgagacagccaagaacacgcgcgtgcgcgcgtgcgtgattcttagtttagcgccttcccccccgcggccgataataacacggtggtgggggaggtgttcgtccgtggcgcgttcttttgtcccaggcgtgcatggccgagacgccatgacgacgacgacggcgacgaacacggcgacgaacacggcggcagccatggaggtgaccaaggcggtcacgcagct

SEQ ID NO: 30746 - DNA, 485 bp, Oryza sativa
cccccttgccgccctgggggagggcgatttttgcctctccccctataaagcccagtccctcctctgtgaaatttcattatattcactaaaaatccaaaaaaaacaaaagagagagaggggagggcagcagaaggggagcggcgaagccctactggttcgctcaattcatcacaggtatgctcccatacatcttttgcatttgtactaatatgttatgtttgagtatatatgttgcgttttagttttagttccatatattttagcacatctgtagcacacagcacatatgtgtagatccaaagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaa

SEQ ID NO: 30747 - DNA, 636 bp, Oryza sativa
attttaaaagccaaggggggccccgggaccagccacacatttccactgacacgcgctaccatttgctactatttgcatgcaaaccacaaactctacaaacaaagccgcctcatttctccaacattaaaacctctacttcccccacaaaaaaaattaagaaaaatcgattttttttcctcctcctccacttttcttcgcttcctcactaccaccttctcgttgatcctcctccccgttcttggctcccctcgcattcgtcctcacttcccttcttccatgggggttcgccgccgtgagtgaggaggaggaggagtagtactaggaggaggtgaggccatggagagggtggaggatccggacctggaggacccgaacccggacgtgggggagctgttcagccactacgacgggctctacttccgcggcgcgctcgccggcgccggcttctccgtccagtggagctcgccgccgtcgcggatggccgggtagggtcccttgctcagctcactggccctctcaatctcttgctgagggtttcttggaggagctgcattcttttctggtctttttttcttcttttttaatatatccagaaaatttgcagttcatgggaggagttagtagcatctcggtgtg

SEQ ID NO: 30748 - DNA, 1501 bp, Oryza sativa
gcccactgtgaaaggccttagaagcacacatgcatattcgttgttgtagggcttgaatcgtaatggttcgaaatcatgcacactgcacctccggtgctctcttacaaactactaaacgatagggactgtctgtatggcgtttgactgaaaaaatgccattacaaatcttgcaaaatctaaaccattggattgttttaagatttgtgccatttaccactaaccctcctctctcttttcgtcattatcatcgcagcgttcccccccccctctcatctctaagttggcggcaacgagtgcccctgcggcgccttctttcctatcttcgacagctccccgttgctagaaacgccaccaccaaccgtcatctcctaactacaagctctattttccctcatcgccaacatcggccctctgcccctcctccatcttggcagctttggagccattgctacctcgccgtccgcctgtgtccaccgcggaccgttgggccgtcgtctcccacagccatctctctaaaccccgcgatctccttcctcttctcccttcccccaccccaaaatctgagaccctaaactctaactcgttaggacgtcaccagtcgttggagctagaggagaaagatctaggtggttagagcacgaacctagctaagattagccttaattttctgtcaacagccatatagaaatcctataaaaatatataagagattatcttagatatctctactaaatacatgaaccaatttaattcaaatttgtatgttagcatgtctatctgtaggtgtctttgcaagcatataaagcttaattggttaggttccttgtgttggaaccaacctatccaggttcaaattctatatttgacataggtactcgcatttgcgattaattattccttcaatgatatgcggcatacctattgacagcgagacacccgtggtgatttcgtcaaaatcaaaatatatcgggttagtccgtggtgactttgtcaatctcaagatatgtcccatggtgatttcgtcaaaatcaaaatatatcgggttagtccttggtgacttcgtcaatctcaagatatgtcgggtcagtctttcggatgtgctcatagggatatgatatttgtatgcccgtggtgacttcgtcaatcaggtcaatatttcaaacgtgctcatatggatatggtgtacgtgtgcccgtttactgggggtgaatgtgcgcgcattataaacgtccgtgtctgtactgcgttttcggaaaaaagaaacatctagttcggggcagattaaaaggagtaatttgcagtaaccgcatcttaaattcttcaccggataggacataataaatatagtacatatattgtgaaacggatagtcttatttatgacataatggcaacattgacacggagtacgtcactgtcacgttacgtgaacgtgaccagctgaccatgccctccgtctcgatcatttgcttgatcttcttgcatagactttggtactttgc

SEQ ID NO: 30749 - DNA, 1501 bp, Oryza sativa
  unsure (1)..(1501): unsure at all n locations
cggcggaggccggatctgccgccgcaacgacgggggagaccagatccgtcgccgcgatcgccgcagggccactagtctctaaagtctaaattatatatttaaaaaacattacgaatataactttatgaaagagagtttctcataaaaatataccaatataacttttcatattttaaatatttttacgtctattaaatttttaaggtttcaagatttgactgcacttataggagatactactatacaagaatcaacgagaagcgaatttttaagttgcgataaactggtagtagtaagattttgtgaacaaggataatgcatatctgtgtaaaaaaaatatatagtgcaaatcacatatacattgaaaatctagaaactattgtcacgagtaaaatttttaccaaccaaacggccacaatgtcgcgcagggcttatccggggcactactgcccatgggctgaaagtgcggccacaagcccacaatatcttgcggggcttagccggggcaccacggcccatgggctctatctccctcaccagtaaagccctagcctccaagaccgcacccgtataaagctgcagacctctctctccttctcctcccccgccaccgccgctcgcctccgaaaccctagccgccccctccccgcggccgcgaaaatggtacgcttctccctcctcctcctcctnctnctcctccccttcgccgcacgacgggaagatcgcacgcgtgcttgtcctcgtgccagtccacggctccgcgcgccgtctttctcatggtgtttcacaatttgtaggatgcgttctttattcatgttgatctgccgtagatggggggatcttgagccggaggagaggagtagctagtttctttgattatgcgttttggggtctagcggattttaacatgagatggtttctctttagcgacattttttttgttcatgttgatgtccacggggattgttctagttatgtcatttttatcttcaagacttaaatgctttgaatcgcgggtatagaccagattattgtcgtgaagatcgacgtattttccgagctgaccctctgcatgctgaaaattttgtagtgggttatatctagattatatgtgtattgttgtcattcaattagcacttaaacttctgtagcataaacattttcatcatcttcctgtgaggacatcggatgagttcctttttttttctcttcttgttctaaaattgttcggtaatcttgtctggctttgactgatgggctccaatgatggcatgaaatctttgagacctgacattcttgtgatgacaaacataagcatatttcctgaggacccaattgaggttttaaccattggtttgctgaatgtgtcttcagtgttgaaaaatttggacacatttgcttcaaattatgcacattcgactgttgtttataggcctgcgatgtccattccacattcagtatttgttaagctgactgcttttgtttcaaatttgttttgtat

SEQ ID NO: 30750 - DNA, 1501 bp, Oryza sativa
ggttgtttgatgtacttaaattgatactagtactagcatctaatgcagtcattagccttaaaagatgcagttttcagttgattgattgcttgatagaggctaggcgacggcgattgtttccagcactaatcacacattcacaccctcgctcttcgccgtaaagcaaatcacatcctccgcaaaagggtaagaaaagaaaaggtgaaacaaataacaaaatcgcaacgatcgacgatgccattttacccggtgaccgtggcgtgctttagactggatattttggctcaatttgctcggtaataatatacgtagtagaaaaggaattcctagttgtgcctcctattgcagcactcgtggtaccaattgtgtagttgacctctacaagtcacccggcccgctggtgtgaagaaaattactttttagtccttcctacgaaggagagagagagagagagagagagagagagagagagagacccacttgtcttttacaagtccggctagctttataaacctttgatacgtatttgaataaaaggtattttaaaaaaatatgataacctccctttattagtggattatggatttaaggttacacggcaaattatcaatgaaaatcttattccagaaatctggttgatatattcatgatagtttaatgaggatgaatggagaactttgtgccccttttgtttttttaaataatggaatagaatccatttgttcaaagagttacaaccaattattacaccaattcaaacaaaccaaaaacacatggcaaaaaagtcataaaaatacaggcctaaaaggacagaaacacacgctaagtactaaaaacaaaaacaagaaaagactacaaaattattgaattctatttgtgaatctccatccgaagttggcaaaaagttgtatcacatatttgcagttgtgcccaggaccagagccagtgtgttgccctgaaaagaacctgcatataagatatagacagtgatttatcaaaaaccatatcatctctactcaaccatagagcccaacatatagcggaagctcctaccagaataagtttactggttttttttatcaatccccagaagccaattctcaaaaatatgagatatactatgtggaatatttaaactagaagaaaattaaaatgctctccaaacaaattttgcataatgacattccataaataaatgttggatagttttattttttatacggaagcaacatttcagactaccataccaatttcttttaaccaatttatcctttactaagacaacccctttaaacaggtgccccttttgtaactgtcttagagattgtttgtatctttgttggcttcttttaggctttataaagaggaatattttatctactttttcatgtctaggatatcactattaacaaagtatttttgtttataggaagggatatttattcaacttttttcccctgatattcatgcaacatggtggagactgagtagtcaacctcat

SEQ ID NO: 30751 - DNA, 220 bp, Oryza sativa
tcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcatggtgaggactaagtgcctcataagtaagtatttattcgctttagttattgatgaatctgtatattgaat

SEQ ID NO: 30752 - DNA, 1501 bp, Oryza sativa
gtgttttttagtagtacattcatttctccaatctctctgttcatgttcttgcttatcaagcttgagaacattatcagtttaccatccaagaattgttaagtcttgaaatacactttaaaattttagagtagctttggattatactccctccatctaaaacatagctacttatactattcacattttattgcaaaatatacctatttctatagtatcaagggtggtctatatatagtcataaaatattcaaaatactccatatctccacaacctcagtgacttccaaccgactatttactttttatcttttctttaatttcgttgaaaaacaaaaaaaaactatattttgagataaaatggattggtcaattccaaagataaaataatctagtactacctatgtctcaaaataaaataagtttttttttctagaattagaactaaaacttattactcctatattttaggagtataaaatagttggtacaatcgtacaagcttcttgactggaagaggtactcaatgcatctgattcatttaatttcttcacgtgcatatgctggattatctcaagttaatctcacgtcgtactagtaatctagtactaagtataatgcgcctcaaatcgtccttgcatctgaggattgcaagcttcagttgcgtactagtactagtagcaaatatgttggaccatttgaaatgcaaataattttaaattgcagtagagtaaaagcaaagcaattaacatggcatgtccagttgagttagcacagaaaagctcaaatacagagaagaataatacatatgaattccagcatcatactaccattcgttttatttattctgttgtgagttgttttacaacaatttatatcttatgcatatatataaaatttctgaataaaataaatggttaaacgtgttctaaaagtcaatggggttatctattaaaaaacggagtgagtatgatatttcccacaaagtccatatggatgtttctccaataccactccatccaatggcaaaccaaatttcaggggatttgagcataattgcgtaatctctcttatctttttatttttctttaaaaatggcctgcaaaaaatgtaaacccttattatgggcagggcccacgagataatcttatgtttatacgggcctcacaaaactgggcctcttagcggcgtcaggcctatcagtaatgggctggattttgggcccatgtacgtatccgtatctggtacagttcacttctctatacatcacactcgccgcttgtttttttttctttaattattttttttctctcgctcgccggagaccaaccggaatcgccgcgcgccgccgccgccgcctcctcgccgtccgccgcagccgtcgagcccatcggcgccggtcatgtcggtgagtgccccccgcgatccccctcccccttctccgctcccacaaaaccctagcgtctgatccgcggcgatggcgggggatttggggttcgtgtcgc

SEQ ID NO: 30753 - DNA, 322 bp, Oryza sativa
  unsure (1)..(322): unsure at all n locations
atggttttcatcaaggtggacaaagagacnnnnnnnnnnannnnnnnnnnnngnnnnnnnnnnngctaccggacggataannnnnnnnnnggggtttagcaagcnnnnatncatttcaatctcgcgtgtaattcgagaggcagaaacactaccgccgcccatgtagagttcattggggggggtttgtgggggccttaaagcttgaccgggactagattaagtcctctccaatattgtactcgtgtgatattgatatataaaaggcaacaccggcttcagccgataggagtagggctattacccattagttacgtggtccgaa

SEQ ID NO: 30754 - DNA, 1501 bp, Oryza sativa
ttgttccggatacattccacatggattcatagtcatgagtctattttctatgcttaaagactggaccaattattattccccgtaagggctatcaaccgaatacttgcgccagtcgggattcaattattatatttattttggagtatcccataagggataatcattcagatcagaagctattcatatgagctacacttggtctatattacccagaagatttattactcgggagcatgttacatgcgtcatcctttaaagggtgtcgaaggcgtattttttggcctaggcctaatatgtctgcagcctatattttcaggtgtggcctgtcacgttcttttagggacttaggcacttttcgcttaggccaaagtgcgcgtgatcaagtgcccaataccttaaaatccttttataccgcagttactcgactttttaggagttggtacaatgcatcttaaaaggtgtcaaacagtaaagctttatatagctgccccgctgacttttttatatagtcaaggtgctgtttgggtttatcaagcaattgattggatacaatatcattgctttttgccacgtaagtgtgcatttttattgaccaatattatggcttaggctgattatatattatggtcatttttcaggcggttggtaaatcctttatgagtttacttactcggattttacaccacatatgccatatatttccaggtgtggtgaaaccatgtgtcttttagggacttaagcacatctgttaaagcattgtgcgcatggcgtatgcccaatactttggaaatttctttattcacagcattcaagcttctttatagttgttttgctatgtgaactttcaaagatgttgtcaactttaggttgtacgcatcatattttgccaagcagtcggtatatcacttggatcatattattcggggattcacaccgcatatactatatattggtatcaagtcacttggttgactataattatcaaaaaccacccggttaattggataacttattccttgactatatgtttggtttgttcagctaaccacatagtcgggggttacacctatcaggtgcatctattcgatgcatctgactttattttttcagccctccacagtcttctgatttggaaaaagtactcgggagatcatggcgaagatgattgaagcactcggctttggagtaatctagttcgagagaagattatctttccgactgtgaaggtctcaggggctactgtggagattatgggtatcccatacccacacggcatggttatccgactagttataggggataacttatatttatgtaatatgtaacagatcatgacttgggtgttacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggcaga

SEQ ID NO: 30755 - DNA, 1501 bp, Oryza sativa
catctatactgccataggacataaattgaacggttttgtatatttggggtgaagatttctggtattgaggataagggatggcaaacaaactcggtgtaaagttgagggacatcagatgaacttattccaactataaggcaacgcatcacggtgcatggcccatgggctgcgcattctggcccacaaagcagcacacgcaccagtaaaccctagcctccaggagctcacccgtataaagtcgcagaccttctccttcccctccccgccgccactcgccgcagcgtgtcgaccagacaaggcagcgcctccgaaaccctagctccccgccttcccctccgcggccgccaaaatggtacgcttcttcctcctccccgtccgcctctctccgccgcacgacggcaagatcatgcgctcgtgtgtcctcgtgccagtccacggcaccctgctctggtcgatttgtagggggattgcgttctttattcatgttgatctgctgtagatgggggcgatcttgagccggaggagtagctagtttcttattgatgcggtttcggggtttttagagatttaacacggtttcgcggtttctctttagcgatttcttttttcatgttgatataatgatatccacggtggttgttctagttatgtcatttttatcttgagtgctttgtgtgattgtttttcaattgtgggtagagaccagattattgtcgttaagatgcatgctctgaaacgcggaatttttttgtaatgggttatatctagattatgtgtattgctgtcattcaatagtcttttcttaatacaaggcgcaaccgtcttttcttcaagtaccagtatacaaggcggcaactgctcaactccgtacttggtgcatgcaagcattgaatggatggttgcatgagctcatgatattcggttcattagtttaaaggcaaaggatccaccactcggatgcttgcatgcacgcgcaaaaactgcaggacacgggtgcatgctgctttggcactagatgcgatgaactgatcaaagcgtcacgcattggaacgcgctggaataaatcggtacgatgggtagttataggttttcttgttctccgagtccaaacaagttatgccttgtattaaggaatggagggagtagcaattaacttctggagtaaacatttttcatcatcttccttgaggacgtgggatgaattcttttttttatcttgtgcgaaaattgtttggtaatcatgtctggttttgactgatgggctccgatgatggcatgaaatctttgagacctgacattcttgtgatgacaaacataagcatatttcctgaggacccaattgaggttttaaccattggtctgctgaatttgtctttgctgtcgaaaaatatcgattcacatgtgcttctgattatgcacatttgattgtgttgtttataggcctgctatgtgctttccaataaccagtatttgttaaatttgtttcatatttcttatgtat

SEQ ID NO: 30756 - DNA, 1501 bp, Oryza sativa
ggatagttttattttttatacggaagcaacatttcagactaccataccaatttcttttaaccaatttatcctttactaagacaacccctttaaacaggtgccccttttgtaactgtcttagagattgtttgtatctttgttggcttcttttaggctttataaagaggaatattttatctactttttcatgtctaggatatcactattaacaaagtatttttgtttataggaagggatatttattcaacttttttcccctgatattcatgcaacatggtggagactgagtagtcaacctcatacctttctaacctgatctttcacctttgctgaagaggaagaataaatattctgaccttttctaggctgtgttcttccccattttctcaacccacctctctcgtttttcacgcgcacgtttttcaaactgttaaacggtgtgatttatgcaaaaactttctataataaagttgtttaaaaaattcatattaatccacttttcaaaacaaaaatagtaaatacttaattaatcatgcaataaaacgaactttgttttgcgtgcagggaaggaggggttcccaatcccctcctctgaacacagccttaagaagtgtaagctgagtgctactgtgaatcatatatacatttttaggttttgtgagatatttagagcatcgaacaaatatgtagtgtgcaatatatggtaaaaacacaaatttgtagggccacatttattagtttgtggtaattaggacttatgagcagtttgtcatatagacagcgtcatgataaaaacaccctttaaaggaaatttgatgatttattattatcattaagatgatggatttgatgatctgtccaactggcccgcacgttattgatacaaacgattcgatatgttattgtcatatgatgataagcagcaatctacagagtgataaatcatcaaatttgaccctttaaaaatgagattttacttattcgctacgatagttgaattatcttcgtgaaattgacgtaaaattaaggataaaaaagattgtacatactccaattaaactaaggctgaaactagtcccttttttatttatctacatgcgtcctgtctctactctagaccggtcaataccaaaccttggagatcagttgtcatgataactcgattaacccgtgtattaaacatttggaggttgacaattacaaaaggatgacaaaaatgatggtacactgcaagactggagtccacccggcaaagacacatgatgcgaatccgcgtacaaccttccacaaaccgagcatcgcgtgtgctactcctgatttttttttacttttaaaacattttttattttttattttaaaagtaaaccattttaaaacatatttataaaatttgaaccttggatgctagctcgtctagcatgctaaaataatattgtcatgccacttctaacgagcgggacggtttaattctaccataacaacctagcaggacaatgctatc

SEQ ID NO: 30757 - DNA, 225 bp, Oryza sativa
aataccctactcctgtttggggatttgaatccgccgggtgtgtattgatctgacgatcaggttgtgtcatctgccccctagagggcctcctgcccaccttatataggatggggggcaggattacaagatagaaaccttaaccaatacggtatcggtttcctaaatctactttacaatattatcaaaccaggactttaggccgttccgtaatatacaaggaaacgt

SEQ ID NO: 30758 - DNA, 1393 bp, Oryza sativa
aaaaaaattaagtttgattgtgacaactgacaaatccactaattaatttgaatctttaatttcatctatatgcatgtatccctcacgaaaaagaaaccatccaacatatatcatcatcctccagagcacattggttttatgaggaaagagaaaaacacatccaaagttaatctcttatgtttccccttaaagatataatgaaagtacaacttcttgtctctgcattaacgagagaatgcacacaatcattacgctgccatgatctaataaagatgccaattgccaaaataaattagatcacatctaaagtttctctagttagcaaagtgttttttttccctggattgattattatttttgttcttccatgtatatatatatctcacttgtgtaggagagacatatattatatgccctaagattatatcctgagtacataatcacaaatgcttgctttgtccagaatatttgttggattgatgccctagaattgataggttttggcctatgttctatctaattaatttatgccacttttctcaccctaaaaaaatgttctaattaatttgatttgatatacaggatcgaagctaggtgatcttagctagtctatatagaaaacgcaaagttacacatttagaatctcatttatttaaagagtagtgttcctatatcatggtatatgtcattgtagcttggtagctaaattaattgcaatggtgtcatgaacttgacacaacataatccataattcaaggatgcatgcatgcctctaccatgcatgcatctagctaaaagctaacatggatcactaactagtggtaaacttgtaattaattaggccccattaatctccatctaggttaacacatttgctaggagagatgcaagctaatgataggacatggatgactgcagagagatgtgagagatagcattagctaggtcctacattattagataagcacaaagatatatattttatgccagggctagctttgcatgccatcatacacaagcgcacacacacacacttgttaatcctcctaatgatcaaatcaagctctcacacaagctattatacaaaaggccaccattgtttccttctgatgcttactttgcatatcacccattaaccaattacttaattacttaattgtttctcctcccatggcccccacatgtaatacacacaacctgccactctcatccctaacctgccaacctatgtgtataaattcccagctccttccctcccatctgagaagaaagcagcagcagcagagaattcatcacccagcaagatcagtcaggatcagctagctaataagctagctacaagcttgattagtcacaaaaccacaagacaattagctagaagtatatactgaga

SEQ ID NO: 30759 - DNA, 1466 bp, Oryza sativa
  unsure (1)..(1466): unsure at all n locations
agtctagatcggtcgccgcgaccgcngaaaggnccacaagtctctaaagattaaactatatattaaaaanaacattaccaatatacttttataaaagaaagtttctcataaaaaaaaatataccaatataacttttcatattttaaatatttttacgtctataaaatttttaaggttcaaagatttgactgcacttacagaagatcctactatacaagaatcaccgagaaacgaatttttaagttgcgataaactggtagtagtaagattttgtgaacaaggataatgcatatctgtgtaaaaaaaatatatagtgcaaatcacatatacattgaaaatctagaaactattgtcacgagtaaaatttttaccaaccaaacggccacaatgtcgcgcagggcttatccggggcactactgcccatgggctgaaagtgcggccacaagcccacaatatcttgcggggcttagccggggcaccacggcccatgggctctatctccctcaccagtaaagccctagcctccaagaccgcacccgtataaagctgcagacctctctctccttctcctcccccgccaccgccgctcgcctccgaaaccctagccgccccctccccgcggccgcgaaaatggtacgcttctccctcctcctcctcctcctcctcccctccgccgcacgacgggaagatcgcacgcgtgcttgtcctcgtgccagtccacggctccgcgcgccgtctttctcatggtgtttcacaatttgtaggatgcgttctttattcatgttgatctgccgtagatggggggatcttgagccggaggagaggagtagctagtttctttgattatgcgttttggggtctagcggattttaacatgagatggtttctctttagcgacattttttttgttcatgttgatgtccacggtgattgttctagttatgtcatttttatcttcaagacttcaatgctttgaatcgtgggtatagaccagattattgtcgtgaagatcgacgtattttccgagctgaccctctgcatgctgaaaattttgtagtgggttatatctagattatatgtgtattgttgtcatttaattagcacttaaacttctgtagtatgaacattttcatcattttcctgtgaggacatgggatgagttcctttttttttctcttgttctaaaattgttcggtaatcttgtctggctttgactgatgggctccgatgatggcatgaaatctttgagacctgacattcttgtgatgacaaacataagcatatttcctgagacccaattgaggttttaaccattggtttgctgaatgtgtcttcactgttgaaaaatttgtacacacatttgcttcaaattatgcacatttgattattgtttataggcctgcgatgtccattccacattcagtatttgttaagctgagtgcttttgtttcaaatttgttttgtat

SEQ ID NO: 30760 - DNA, 1501 bp, Oryza sativa
tacttatttttaattctgaatttcagttatttctaaattgtatttctatttggactctgcttttctttttctccgattaatatgagaatttctaacccccacagcgaatgtggtgcctcatttcaaaactatcttaataatacaatatatttaacaatatcacatttaatatatgctactaaaatttgataatgttgtcattttgccaaaattttggaaatgccaaattttggaatggttcaaaatggctataaagtgaacaagcccttagttatagacttgacacatgttctactatttacggatatttcaatggcagatggcataactgtcgacagctgtatgcatgtgatgacttcatcaatctcaagatatatcggtctagtacatagttttcaaaaaaaaaatcttagttgtagaatttcccatattttgaaattaagagaaggtacagtgcaatcgcactgaaaagatatatcggtctagtacgtattttttttaaaaaaaaatcttagttgtagaattcccatattttgaaattaagagaaggtatggtgcaatcacaccgaacagttagtccgatccctccacaagcccaacaccatatgtaggccagtctctcagttttgtaggtcgcccattttcacggtgacagagtcgagtcctctattttatcccgttgccgccgccatcaaacttcgctggagaaaccatatatcacgtgtttcgatcgcgccccacatgcaaaaagctacttcatcgctctaaaaaatataatcacttgtatagttttgttctaaatcaaaccatcctaagcttatatatttatgatagtgaacatccttattagatcaactgaattatatttacgatagtgaatacttggtttcaactaaaaattttaaacttatttgacgtgttagataaacttacttaaactaatactaaagctagaatgattatattttaggagggatggagtagtacagtatagcatgatgtcacaaactaacagattgcagttgcagaaaaatacaggaactgcatcaaccaatgttaaaacacaggaactgcagaactggatcagaaccaaataacatcacacatcaaatgtataggataggatctcgatggcattggacaaataatgctggcatctggcttctagcgagaatgctaggccaggacagcgtgacctgtcggcacgcccatgaatatgatcctaaccttcttatttatgaagaccacatcaacacatcatgctgaacctgaggggttttatgtccatcaccaagagcattccagcaacttgtgaggcgcaaatcaattcccagtttattactagtaataactggtggcttcagcttgtagagataacctttgcattacattggcaggtataagaacgttcaaatgcactagtattacccagtataacattgtcacttgaacttgcagtccttgaaatcatctcggccaaggggagcacattcagtatttg

SEQ ID NO: 30761 - DNA, 407 bp, Oryza sativa
aggcgcgttgggtgggtaaaattttacttggtgccaatagtttctagatttccaaggaatatgtgattggcacaatatattttttttacacagatatgcataatcctggttcacaaaatcttactactacaagttaatcgcaacttaaaaattcgtttctcgttgattcttgtatagtagtatctcctgtaagtgcagtcaaatcttgaacccttaaaaatttaatagacgtaaaaatatttaaaatatgaaaagttatattggtatatttttttttatgagaaactctctttcataaagttatattggtaatgtttttttaaatatatagtttagtctttagagactagtggccctgcggcggtcgcggcgacggatctagcctcccccgtcgtcgcggcggcaga

SEQ ID NO: 30762 - DNA, 1501 bp, Oryza sativa
aaataattcttcaaactttcaacttttccatcacatcaaaactttcctacacacaaacttctaacgtttccgtcacatcattttcaatttcaaccaaactttcaattttggtgtgaactaaacacaaccttagtaaactgaaggcgatactacaagtgttattatactactagtactatgttgctaacttgactctcgtgtcgctctgctccaaaatgacacgggaggtgacgtcgcagtcccgccactgccccaccttccttctctccgctgcccgagcaaccgtaggcaaagctgggcggcggcaaggatggcggtggcaggacgttctcccttcacgcaagacttggtggctggggcgctgacaaggttcgagtggaggggcggcaagcaacagcggctaggtccgacgctgtcggggccggttgcggcatatccgaccagagacggaatttgccccctcgtggccagattgggagggggcggcactgaccacgcatcaccgggcaggaggaggaggttgtggcgatggggagtaggaggaggatgtcgtcgatgacagaggagtcctgcggtgtgctcgcgcggaggaggcatggtgcctccgaggagggcgagactgcaagggtggaggacgagatgcaagcagcgaggctgagagcgtggaggcggcacgaggaggaaaggtgatagggtagagggagcgcaccatgaacggagccgctagatctgatgcccctctggccaatttcagcgcccctccgtcaagacttggcctctccaacaagggaggtagtcccccttccccatgtggcgaacctcagcgacagcgacagtgacgacagggagcatcggcattggagaagacggcgatggtgctgacgggcacatttgtgcatggacgatgacgatggtggagcccacgggagcccctacgacggatctggtcgagcggcacggtacatagacagtggtggcagggggcttgtcagagacgatgatggttgtggaagaccggcgtgggtggcgtcgggaggtcagtgtgggcgacggcgatggtaagacggccggtgtggcgacgatagggaggctgatgacagcgggtattccacaaaggcatgtagaggtttgccggcaggaggcgttggcacgacgatgtccatacactgacagagaatgaccggtggtggagaaatggagcgatagcttcagatcgataggagaaacaatggtgcttcgggcgttgttcttcctcttgggggcattaatgagtcgttcctctccctttagtggggctgctgggtgaaaaccatgtcctggactcctggttttcttgagacctcgacggatgacggcgttagtactcatcgtcgctcttcttcttggagatgtcgtctaggagacccctaccaaaacgtctctccaacaatttgtgcatgctctctctagatgtttatcctcttgtagcggtgccttagctttataagttggctatgttggt

SEQ ID NO: 30763 - DNA, 1058 bp, Oryza sativa
cggcaagggggccgcctgcaaattctttgacggccgtcgcccggaagcaaacggccgtctgccacgtcattttcgccgccctctgagagggcgatttttaaaaatcgccctcccagagggcggtaggcgactccttccgtcaattttcaaaatggaaaattatttttgtaaaacttttaataaaaaaaattataaataaaaaaaattcatgaaacaacacacaggcgtaactaacatcagtgatatttgggccgaaagagcccatgtaagggttagaggcccggtccatccaaacttgcggccgcatcgcggcatccaccaacgaggccgtcatctcggcccgcgcgcgggcattgggccacggtggcatctcgggcattccggcccacgtatcggtgtaacggcgaaatcactagccgcacacgcgagcggagccggaggaggagacggagccggcaggatccaccactgctccagctctctccactctcactccccgattcgccggcgagcaggcggcggcggcggagctcaaggcttcctctccgctccgcaggtaaacaccaggcaccatcccctcggctgtggctcccccgttcctcttgtcccactctctcttggccccgaccctcgggagtccggcgctaccgaatccgtcttccccccggagctgtcgaaggagcgccgcgtgcggccgtgctactcccaccgacgccgcgtcacctcgaaggcgaaggggctcttctcccctcccctccaatggactgaggcgtatcccgtctaggccgatttcttctgttgagacggaagccctaacatagctagattgctttttccaatgatttgtcgcttgctaccagcaatcaaatccttgtgttattttttgcttgtctgtggccactccaatccacacatatagtcgcatatttgatttgattttattactcgaatggcagcttgctttgcaaaattttcagaagcgcaactgaaccctcgcgcctgatatctaaatagctgctcacgaatccacctcccttattgtgtaccaggtaccaaga

SEQ ID NO: 30764 - DNA, 611 bp, Oryza sativa
gtttttttttctcaaatctcggctagtttttgcattttcgaacagagggtacgtttgacaaatggattataagatgtgggatcagaaaaaaaaaaagaaagtggatgaatggctaggattgaatgaggtgtgaagaatagatggctatgattttagatgagaatatcaggagatactattttcttatcccatttgccaaacaaacctaaacggagtatcgactttggatgagaatattaggagtctagagaaattaccggtggtaaaattgatatgagtttgatttttttttaagtcccatcctctagtttgactgaagtattggtaattattgagagttctatgtaatagatttcaagtaagaactgagatttgtaagatgtatcgagggcattccctctcacctctcacccattatctagatattaaaaagtgttccttccgagttgataatacttatcggtttagataagaagttggtcttcaaaaattattttgaccattttttattacaacatataaaaaataataaatatatgattttattgaattaattttaatactagtttttataattttaagataaatattttagatgttatttttttaaa

SEQ ID NO: 30765 - DNA, 1501 bp, Oryza sativa
tccttattttttaattccgaatttcagctatttctaaattgtatttctatatggactctgtttttttttctccgattaatgtgagaatttctaagccatgagagtaaacgtggaggctcctttttctattcctttaattatataatagatttaggagtgtaatatttaattcattactataaacaattgtcaataacctatccaaatcatgcatgaagaatggaacaagtactacaatgctacgaaaacagttcactaacatcacaagaccaaacattgctacgaaaacagtttcactaacgccacaagaccaaacattagtatcgaccttctaagataacaatcacaagaccaaggcctatcttacaattcacctccatccatggtattccataccttctatctcatgacgaagatattgaacaaaacatagtatagttaaccatatacgaaattcagtctgaaaaatggaagttcatcagactaacctctcagggattcatgtcacaggaattcgtttaagtgggtcgctctaggattgcaaacataggtaagataacgaaaaacagacaccgagtacttagggagataaaactgccataagacaaaattgcagtgcaacataaacacatgcatcacattggattcaatgagcattaagcaacaaaacttgattcagcagaaagccaatccttgctagagtacttgaatacatgatatggtctgcttaaattaagctcctaataacattgaagtatgaagcacagtagacccacaacttcagtatccagtaggtagtttagaaaagagacgttcccttgcccttcttgtctccaccaattttaaaatgcttgcacctctgcacagaataattatgtaagtgagcatccaacacatctaaaaagatactgattcatgagaattttcagcttgaatcttcacattgcaaaaataccttgatggggtgctgggagtaatgcttgcagctttggcattgcagcttcagcacaatcttcttggtggtttttgcctgaaaacaggaaccatgtatcataacatgaaaaatgcaccctgcttttggacctggccggaggagagcaacaatgccgtgcgcggtggcgcgatggggcgtggtggaggcggtgcggcggcgtgtgtcccggcgacggtgtgctgttcccggcgaaggagcggtcgtgctccttggccgcggagggcagtcgccagcggtgctgtctggcgacgtgtcgtccgtgagggcggtgatgggcctcggcttggctccttatagtcccccccccctcagccggcgatgaaggctaggcccggcgcccccgactggtggcgtgcagatctgcgctcctagcgtctggatctggtcgaatccgtggcaccggtggcaggctctggcctcggaccccccctcccccgcgggactggtgaccttgcccaacaccttcttccatccccatccctcctcctccctcctctttgaggcgcc

SEQ ID NO: 30766 - DNA, 1501 bp, Oryza sativa
acagggttggtgccctgctgcgaggggctcagttccgtctgcctgtcccgggggttccggccgtaggcggaattgggtcggtactcttgtctaaggctaggatgggttagaaactatgtcacgtcttccgtctgtataccgtggtggtatgtggcacgtggttacacgtgaggaagacgtgtcttgtgggtaaagatgtacacctctgatcagagtataatctattcgaatagccgagccctcggttatgggcaagccgagcaatgtacccaagtcagtgttataattcttaaaattttgctcaacaactaaaatgtggaatggttggcctgggttggcttaggacgagctgggacccagggtcgggttgccagttcggtctgaatcatcataggccttgggttaaggcaggttcgtgagggttcacggccttgtttaataatactgtgtagctctaggatcgtctttataaaatggctttgggcaactaagtgacttttaaatgctgcttttctgcaaaacttaacccctatattattactccttgtacccccttgcattaatcatgcatctgccggtgtggcttgctgagtactgtggttgtactcattcttgctcaatccttcccctcttcagtaagagaagctttggagaagaagtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtatggtgtaccccggcttttcctgggacggggattaatacactagcgttcgggaaaaggcaattttcccggtcgcgacattcgccgcgcgcacgcttctcgaactgctaaacggtgtgtttttcgcaagacaattcaacacaaaagttggttaaaaaatcctactaatccatttttaaggtataaaataattaacactcaactaatcatacgctgatgactcacccttttttgcgtatattctcttttcccctcctcacaaacacaccctaagtaacattggcgaagtttgatgcctaggaacctgaatgatatgtttatagcttcacatgctattggaactttagtgaccgttgcgtagactcgtataagaatcgctgatgaccttgtcgaatttgttgccaaagtggttcttacctttgtttttctttgacaacacccctcgaaacgtcgttcatgctcattcgcgtacctattgccaaccggacaatgtgttataagccattaacatcttgcgtacatataaatttcatatcggggttgtggaagtccagatttggatcctgcaggctcagtcaagacaagagatagcatgcactgcggaccgaacacttggcacacatgcatgcaaccaatcaattttggaccatgaagctttccggtcgatcggccacgagt

SEQ ID NO: 30767 - DNA, 1501 bp, Oryza sativa
ggtgcgtgtgctgctttgtgggccagaatgcgcagcccatgggccatgcaccgtgatgcgttgccttatagttggaataagttcatctgatgtccctcaactttacaccgagtttgtttgccatcccttatcctcaataccagaaatcttcaccccaaatatacaaaaccgttcaatttatgtcctatggcagtatagatgtcttggtttcactaacgtggcatcctagttagcaaaataggaataaaataatatgtgagtcccacatgtaagtgaaatagaaggaaaatgtgagacccacccatcggcaacgttgttattgggacgccgcagcctgaggacgcggtggaacgactctggtgagggcacgaagacggtgaaggcgaggtctcctggtgaaaccccaagcgcgtcggagtcatcctctcccggcctacttcgtcctcctcgccatcgtcccctacagcgtccgccatcacttccatatgtcgtcgtcctctgcaccccaccgccgccaccccgctccgcccgccacagcacagcgacgcccacaccacaccctctctgaggcgccgtcgctcgcccgccacccgttaccccttgcctgctccgcacaccgccgccaccgcctgccgtcgcctgctcgcccgcccgccggcctctcaggctaggagaagaagggaagaggagaagagagaagaaagaaaagacaagaagaaaaaaaagaaaaaagaaaagaggagaagacaggacgctgacatgtgggtcccaccgtatgccacgtcagcaaaaccggagaaaatggatcaatattgtcttgggatcttttttgcacggtttatgatagttgaggggtagagatttttgctatcgcggattagggacctcagacaaactcaacataaagttgagggccgtcaggtgaacttatattcccttatagttatgaagtgactttatccctcaaaatgagttcactttaggtcccttacttcatcgctccgtctgttttgtgatctttttcgcacggtttatgattagttgagaggtagagattttattgtggattaggaacctcagacgaactcgacttaaagttaagggacgtcaggtgaacttattcccttatagttaaggaagtccaagtggactttatccctcaaataagttcactttaggtctcttactttgtcgcttagtctgtttttcatccttatccgaaaaccatatacaatccatccttcaaagtgtgcaaacgaggtccctcggtaataatatttctggttttggctgacatgacgccttcttcaaactgtgcaaacgagctctctcggtagcaatgtctccggttttagctgacatgacgcctttgactaggggtcttcgtcccacgtgctattgacatgacgcttacgtggctatttgataaaaataataaggaggtgtttggaatggactaaaattttttagtcccttccaaattggatgtttggacactaat

SEQ ID NO: 30768 - DNA, 445 bp, Oryza sativa
cttgatcatattgaatcccattttataaacttatgttgatttaaattattgcattatcgctttatttaaattcccgcgttatcactgttttacttagccatgcctatttacctttgttatgaccatattattattgttattgttattattactaccttgttcactctaggcaaacaaaacctcaactagtggactctctactcatgacaccactagtttaattttaggtagatgcttcgcaatctaattaggtaaccttaggtggttttacaactatagactttgggaaattttcatatcacctggacactctggaattgttggtttatggtggaattggacatacacctctcttcccctttcaaaacccctaaaacctgttttcggtggggtttgggtgcatgccagttgtgggaagtagcaccccggccactataaggattaa

SEQ ID NO: 30769 - DNA, 1501 bp, Oryza sativa
cttagacttgggaggtgtaagctccgtcggtcgacttggacgaggagtcatcttcacaactatgtcttctttaggccattgtatgaacgtcttgtgcgcatcgcccaaagtcatgatttcatcattggggggcacgagcagcggatagcctgaccaggtgtcctttactgtatcgatggacaccttggcatacccagctagcaggtctgcaccgtggaccttgtctgtaaccgagggcttgaaagccatgccctcagcgacttcgggagcgaaagttgggtggaccctcgccagtaggacacactgtgctacgccctacatatgtgaaagtttgaatttaatattggaacgtgtaaaggcttttttattagatatggatcagataacatcaattacctctatgtggtccactgcagctagtggtgcgaccgggagaccaggggccagcacctctgtggatgcacaactactcctatgctgtgacggactcgcgtcgtgttgtgcacgaggagttggatgcacagcaggtgttgtgcctcggggtatattcatgtcggcgaggaccttgttaaccctttcttccaccctagcgttcatgctagcttctagttcttgaatgacctcaaccttaagttcggccttcaaacgagcgtccctctcttccttggagactttccgtttcttgtattgggaactgtactgcgggagtccatgcttccagggcacatcgctaccaattcccctagtccggccaggatgttctttggttccgagcgcctttgtgaggatgtcatcttcgcgcctcttcggcgcggactcaaccttgctttgtgaagcttgttcagcaaccaagcccaactagaaaaaaaagagtcatttatacgaacttctactttatacgaacggaaattagttaggttaagtagtgaactcaccagttcctgatagacgacggcatctcttttgttctcaaatgtgacagagccatccgggttgaccttaccccttgcccgcgcccagttgcgagctctttgttcagggatgtctgaaaacggggcatggacattcgctgctgcagcggctgcatcttcttgggcccatattgcctccttgccgatgtaccctgcggtgcccagccgatgcgggtgctcattccgctgttgcagtaggcgatgtgtctcgcttgattccctaaactcttaggtgttcttgagagagcatttgatattttgttgcatttgatattttgttgtataggaaattcttctggcaaaaaacacagcatgatttgatattttgttgtataggaaatgcttttttttcatgtaacaaatgttttaatttgcatagtatatatgtaattcttggaaagagaacttttcccttttttcacatattacccacttctagaacattgtattagaccaagaagaacgggtgatatagatatgagaatatatcgctttaacaagatcacggcttttcgtcaaactatcagcaa

SEQ ID NO: 30770 - DNA, 941 bp, Oryza sativa
  unsure (1)..(941): unsure at all n locations
caaattaacacgtaaagtttatccctgggatccaaacaccacttagcgaacaatataaaaaagtaaaaaaattcaattaccgcacgtgtctgtagtttgaactaacccgcactcatagtatatgagcactgtcatgagcaacaatgctaagttgtaattgttccatccggtatattgggtgggttggggncagcttatgcaagttccaaactttggaatatcctaaggttctaaaattatattttgtccccatcagcattgcgagtcttcatggaaaactatttattcggttcataataatatataattttaaattcataactacaacggagattgtgtagcttatcgtataatgcattaagtcaaaagcatgaactgatttgctccaataagaatgcgctcatatcgctaatccttccgggatactcagtcgcacaagctaatgtattatctcgctatacaagaacgtctagggaccgcattgcctttnaaacacatgtcaagnnngcggtgatggactttactctagtttttaatatccccaacaaagtgtcattattatgccacatctttcatgagctattcgtgtttgtgtcctcttatcctggttcagtggatgcttatgccttctggacttgtttgcatttggaatgattcaaaagcctttattccatagatcacaaccctaattgttactgaccatgtttttataagaaaatgagccattctgcttctgatgacactggtttctgtgtaatagtgccattgccattgatgcacatagtaacatttcaagctatgcgcattggatgtgaaccacaactcctcaatagaagccttaaattgttctcccactagttttacctaattatatgtgctcttgttatgcttgttcgtcattaaattaaggactacagttcattgttttaatttattaaatg

SEQ ID NO: 30771 - DNA, 1501 bp, Oryza sativa
acccaaattaattaacccttgattaaaagccaaagctattaattatattccaactccaagtaaattcaattcctccccatctagctaggcagctagcctttaaaaccatgcacaccttcaagatacccaagcaaggagatacccttgtcatccaatggaatggatgattcccttttggctccttttgttttgagataacagtacggcttataatatattctcctgtgctaattaaattagggttcatgctgagctagtactactcactagtactgatgtgagaggagaatgttgggtgacatgtataaagtcttctctgtgttgaactggacacgtttccagttttaagaggctgcttagatggctaggaaataaacaagagatggacacatggcaaacagctagcttaattagatgcctttctgtttttaatctgtattttcttcagatagtacatgtacgagtagctagcagaaaaaggtgttaagctttatttcatcattatttgggagttaaacctaatgaaagatgtactatgaataaaattaatattaattagcaatatattaagatatatacagatgagttagacttttgatgagaagcgtaaataaatatcttggggggcaccccgcatgctttcccaaataactcaacgtgatttttaatgggctaatgattcgccttatataagcatatgagagctaagctaccatatatatatatatatatatatatatatatatatatatatatatatatatatatatatatatatatatatatatatataaaattaactattgctgatagtttgacgaaaagccgtgatcttgttaaagcgatatattctcatatctatatcacccgttcttcttggtctaatacaatgttctagaagtgggtaatatgtgaaaaaagggaaaagttctctttccaagaattacatatatactatgcaaattaaaacatttgttacatgaaaaaaaagcatttcctatacaacaaaatatcaaatcatgctgtgttttttgccagaagaatttcctatacaacaaaatatcaaatgcaacaaaatatcaaatgctctctcaagaacacctaagagtttagggaatcaagcgagacacatcgcctactgcaacagcggaatgagcacccgcatcggctgggcaccgcagggtacatcggcaaggaggcaatatgggcccaagaagatgcagccgctgcagcagcgaatgtccatgccccgttttcagacatccctgaacaaagagctcgcaactgggcgcgggcaaggggtaaggtcaacccggatggctctgtcacatttgagaacaaaagagatgccgtcgtctatcaggaactggtgagttcactacttaacctaactaatttccgttcgtataaagtagaagttcgtataaatgactcttttttttctagttgggcttggttgctgaacaagcttcacaaagcaaggttgagtccgcgccgaaga

SEQ ID NO: 30772 - DNA, 501 bp, Oryza sativa
cctttttaactttgtttatttcttttcaattattatttgtgctctgaaaattccactaaaatttatttaagcattttaggcttttaggaaatatacaaaaatcctccaagcctcatttgacttttatctttgcacattttaattgttgggggctttcacatgaatttttacttattctttgcacaatttcgaggatagattttagagtcgatttgggacgcgacacgagatctttcggtttgcccaacacctccatgtcaaatatcccgcttcctaggcatcttgcatttagataggttgcaaaccgccttgaatcaaaagcacaactgcgctagcctccttgtttcagccgctggacctattcaaagagttagccaaagaaatatttatgtacgtagctccctattcggcgtgcccttcagtaaaacgggcatgaatttttcatccgaattctttttaggacttacgacaacccgccatgtctttttttccgccataagt

SEQ ID NO: 30773 - DNA, 185 bp, Oryza sativa
cacccgtacgacctctagcgcagccaaccaacatcccgcccaacctcgccagcgaccaatatcgccggtcagttgcaaccaatgcctttgctgtactaacacgattgaataaagcattgacgatctgaattgaccacccctctgcctgattccatcgcttgtcgtatgtacgccttctctatagc

SEQ ID NO: 30774 - DNA, 1501 bp, Oryza sativa
taccatcaattaactacactttcaaagcgaggttactaaactatattgatcttcttcttaatccataggaaattaaaaaggctcaagtttgtgtcaaaagatcaaaacagtggacataaatctatcactcctccccatacacacaacacgttttggtctgcacgttgtcgaccgtggcccgatcaagtactgatcagcaagcaaagattttttgagagctaattaatcatggtgtcttaactagtactgatatccatctttgaaaacctagttaggctgtgatcgaatgcaattaggctttaattaattaagctgtcatatggtacggaatttcccggactgtttcttcggcgcgagcacatacatatacaagtttgatatctcaatgattgctcattgctgcagcgtattgcaaggaatactatatacttatatggctctcacgacgtgcggcgcactaatgatggattcggtgcgtgcgtacgtgtgcgtgcgtgcgtacgtccgtcagtaacggtaacaacggccggggaccaaaccaacagagagagagagaccaactgctgcagagaccggtgtcgccatgttcatcatcatcaattcatcatgcctacctttgcttgcaatttcaacgcagcgattggtgcaggcatatgctttttcctcagaaagtttgctgcgagcttgacaatgtatgtccatcctgaactacctgcaggtaaacacatctatatcctccccctcaattttgtggaaattattaccgaaatccttctgtttttatttgatgtttaaaattgaactaaccaacgtcatgttgataaaaatagagggagtacgattaatttaaggctcttgagaaggtacagagagactgtatttttttaaaagaaacttctcttacgtagttagatatgagggtaataacaagggaattgagaattaacaggtttctgccagtaatatattgacaatctaagtgtctattcttttgagctaaatgctgagtgaccgattggttcgtgacaattatccaaggatacaaccgaatgaattaactattataaagttgaaacgattttctaagagattcatatatataaatctttttaataaaagccgcatcatttggtagtttaggaagcatgcatttatccgttaaatataatgcaaggaatacaagtaatcatcttgtggtgagtagagcctagctagctagactatgtcacatggattcagatgagcaaggggatgcggctggagtcctgcgtatacactataacaaaaaaaaaaaaggaggaggcgtgattgattaggtcgggcaacttctgaaaccaaggcaaaaatattctccgttttccttttttttaaaaaaaaaaattgtaacggaaacagtgcccatatactgttgatcttaacaccccaaccaccttactctttcttttctcctccctcctcgtgatgtcattcagcttcacacctctctcttctctttctctct

SEQ ID NO: 30775 - DNA, 203 bp, Oryza sativa
actgatacaaactcagtggcatattgttgattatctcattaagagagtgttcgctatttttttgaaaaaatgaattaatatgattttaaaaataactttcctctagatttttctgtaaaaaacacgtcatttagcagtgtgagaaaacacgcacgtcaaaaacgagagtaaaattgggaacatgcaccaaagaacacaccctt

SEQ ID NO: 30776 - DNA, 389 bp, Oryza sativa
acaaatgggaccaactttgttgtgggctcatgaggaccctgcctaccaagttatacaacaaaattcttcgtcaccgtgtgatagcccaactattaatgacaaaatccacggcgtttgtgatgagcccgtttgtcgccgtgaacatatattatgaccaaggcctccagttattgctaggattggttgagggtgaagtttacgatgactgtttaacgaatttgtcatagatcaatgacgtacggattccctattcgtcacacggaatgcgtagaaagcctatatctattttattgaagccctgggaagcccccgccttccattccccccaacccctctctcaccccacccaaccttgggacttataattggtctgtgctgccatctttagg

SEQ ID NO: 30777 - DNA, 1501 bp, Oryza sativa
caaaaaggtactagactagctagcacaattttacggaaaagatgcgacaatgaagtcttgttcactacaattatcagtaatggtacaggaatctctgaacgaaacaacttcactcgtattgtgattacttaaatgttgtttacaacaaagtaacataacagaatattataagatggaacaggcatatagtgcgatgatagttcctgagttatgagggcatgaaccaactacgattatttgttaaaattccatcgcattgctattttttattcaaaagatggatgggaaacaagaaatatcttactttggagaatatagtgcactgatttcaactcctgggattattctcatgccaaatctgtgagccgctgacacagcttcaggtataccagccatggtatcatgatctgtcagggcaagtactttcacctgtagtaccgacatatacaatttagccattctaactcttcttctttttctaccattcaaaattgtggcatgcacatggtaagatttaacatctgaacaagcacccaatacataagacaaactttgggacaatgagatatagcatatacatgaagatcacttcactagaaaaagggatgctgcactgtcaagcaaagcacgatctgaactctgaactacccaacgcaatcagccgatggccgcttccatgatcattgaaggggtactgattcaagggcataagtaccctccaagagtacgagtgatcacagcatttaaatatagttaacagattaaggaaacacggaggctatgcggctggcatccaatattgaacccagtaggcacattacctactgcttcacaggaaactggaaaacagattggaaggtgtcaaggtgatgcttggaagtgcaacccttggtcccttagagcacgtttaattactagtaggctatataagccatctataaacttatatgaatgagaaagaacccaaaaaaaaaagggtgctagctctcatgcaagatctagatctatatatgctccaaggtaaatgcattaattacataagtgagaaaaagagagaggagaagagaattagaggcaaccttatagctaatccattgtacatgtcagctctaatacatgttagttctcactgttaaactagctcttactcccttacacaacgaagcagctctgaggagcccatttatcgcacaatataaccgctatacgagttacagacctcacaggcatttcctcaaacacctaccggctaccaggcaaacggaggagagtccagatcgtgtacttactccgttgcggtgggcgcgctccacgagctcggagggggagaggaacccgtcgctgtggttggagtgggagtggagctcgaacagcacgctccctccgcctccagaggccatgcgcgcggcctggtgcggcaggaagtcgtccccggcggcatcggcagccgagggctccggcggcggcgcggaggcagcgggatgcgcccaggcgcggacgt

SEQ ID NO: 30778 - DNA, 1501 bp, Oryza sativa
tggcccacttcttaagtaccttttcagaggtatcttttgatgtaaaccattagattggggtggatcaacggatgttatggtttcaaagtaccggagaaagtctcctcctgcttcttaaactgtaactgactcaacatttctactaggttcaaatgcatggaaatgctgtgggcagagctgtggatctagctaatctagacggatatgagcaactgatgaatgagctggaagagatgttcaatataaaggacctcaaacaaaaatggaaggtggctttcactgatgatgagggtgacacaatggaagttggagatgatccttggctgtaagcttctgcatatttttaatagagtggcagattattgttcatccgacaaaaacttatgattgtgtatatttgcgattcctgcagggaattttgccagatggtcagaaagattgtgctctatcccattgaagacgagaagaagatcgagcctcacccgaagttactgtcttcagctaatccagagcaggatcagaagactgggttttaggagggaggctagggctgaaaggtggattttttagcctttcaccattgaagcgttggtggctatcgttttgtcgttggagatggtcgtagctgaaaaaatggtggctactggctagttcatcgtattgatgcaacagatttgttgctggtgtcaaaactgtttcttcacaagcattttgaagaacaaattgatgtaacataggtttcaagaaaaaaaaagatttgacaatgtctctttagtagtttgctcaagtttagtcaaaaccttaatggtgcttaaggaataacgtgaagctataaaactggtgtgtaagttctgtaaatattataagggagattataattttgtgatattagctttcaccctttaatttattggtatatattgacatgtagatttcattgttcttgatcagtctgatcgtctgaccttgctatcagatgtactgaaccatgtttctcaatattttcactattgcgatttaacattctaaaattcaaggcgaatgtggctattccacttctgaattctgttctctttggatttgtttgttgactgaacatccttgtcaatagagaaagaaacttcctgcataatggttccagatattcaatttggaaaaaaaaaacgatgcctaacatgcttatgatccaaacggagggaaggcttgaagaaacgagctgggatatagatttggaagtttgttttaactttgattttcagatttttttttatcatagtatatttcttattgattttgaaatcgctataagaacgtagacctagagaattcaagattttggccaacagaacgtcaagacgttcattcgaaacgcatgaaattttcctcaatagccttcgaaacgcatgaaattttccagtatcttcgtagtaggtttgatcagttcctaggaaaaatatctcccttaaaaaaaagaagaagaaaatcctcgcgtgcaaggaga

SEQ ID NO: 30779 - DNA, 1501 bp, Oryza sativa
tcatatagtggccacgtgctctttgatcattcgaggagacggaggttgaggagggattggtctatttgttaatcaggttaagccacaagaggagataagtgatttataatgtagttttttttactagaatgactttggtttattaatatttgtatcctaattagatggattcttcaatcttatgttaatattgaaggagctagaaattgtaaaatttactggtgggtaaatgacaatgttttaaataaatttagtttatgaaatttcaaaaccaggggttttcgtatccatgtctaccttcttcagttcttcctccccttaggcactaatgtgtataaaaaggttgtatttaaacttccctatgtttataagtgttgatggatgtaggatacctaataacccaaaccacttcatagagcatagaggaccggctcgctacaagccatagcttacctcttgcttactttcaccaatggaagtagaatttgtgatatttattaaatttcaaaaccatggggtcttatgcccttccccaccctcttgctcggttggcactaatggatataagaaagattttgtacttcgtaagatatttttggactttcccggatatggcaatgtggcggatatagtatgcctaagccattcaatagcggtttggggctttgggggaagggggaaactcgctccaagccattttggtatacatttgtttgggacatattgctttcttttaccacgacggatgtggcattcgtgacatttatttgggcagggacaaagatgaattaacacattaataggattgagcaatgcaagtaattttagctattaagattaaatctgattaagatgcaattgaatcatggttgtaaaggtagaataagcaagccaaactagagtttcttccccctcaattgtaaacttggagagaaatgcatttataggaacaactctaaactctcttttcaaattgtgctctttgtttgcccatttggctggctagctagccaaaaagatccctcttcaattctccatattttatgtgtgctccaacaagctctccatctatagtttccactatgatagtgggacccacatgttagtctctctcgcatacttcccctctgcctagttctcctccatgccatttctcgatctaccctctccaatgactacttctagccttctatcaccaatgagaagacatcgtctacatagacagccttgcaaaggaggagacggggatgtagagcttgggatttggaggacgtcatcggccctattgacctcgctccgtccttcttaacaacgggtgggaaactatgaaagaaggccacactaggaggctaggagaggcatcgccttaagtcggtggtgataatggacgatgacggaagatgacgatgtagtagtttggagcaaggcatacttgggctaggggagggtgggtaaggtggcactaggtgcccgggggatgtggcgcttgagttagcgatga

SEQ ID NO: 30780 - DNA, 1501 bp, Oryza sativa; identical to SEQ ID NO: 30535

SEQ ID NO: 30781 - DNA, 1501 bp, Oryza sativa
cagaagactaaggcatacttttccattattgtataagtttgggttaatccgtagtccgccagagtggtagtatactgactgcaacatcatcaacaacaaatatttcaacaaaataaaaaggtgaaaatgtcataaaagcagtgctgagacttaggcacatactggaggattagcagggtaagagttactaaattgaatatcaaagaagaagagcccatcgtggtacggtgttcccttaggtccgataatagcagccctaagaaggtccattctatcttcagcaacacggacataaatagatgctacataaaacaaaaataatcaggattcagatttctacaatgagaaaatacactgcaacaaagaaagctatagtttgtccaatttcctctaaagtttttttcctgatatgttcaacatctatgagctatgaatggtgagtgacaggatgctaaatcctaacataagcatcattcactatttccaaactcactgcaggattcccaagaatttttacagacaaaaggcaggtgatcagcataatgtaaacaacatttggaaacaaacccaccacaggattcccaaagatattttacagacgaaaagcaggtgtaacataaacaacatttggaaacaaacttgagaactgatagtgttataagaaaaatcaaatctggtccttcttataaggtgcactttaacaaggctcaaagatgtaagttctaagattgagaaggaaaatagctttagtaccctcactagatagtagtaaaagataatggtctgtgcaggcagacataagttccacagtgagaataaaacaataagaggaaatgaaaggaaatagcatcacatctacatgaagccttatcaaaaggacaggatgaaatactagtttctcaaagggaaattcaggttacatatttaaaccatgaacagttgtgttcaacttacatggcacttacatgacgagcatatatagtcaataaaccaaatagtgtaagcagcataatcaatgcttgtgctggattattgaccagcaaactattagcactaattgcatcaaaatgcatggttagtgtgaaaggggtacttaacgatcaactcacaggtgcagccatgcagagaagaaactaactcactatgccagtaggcaaatagctaacctggtagatctttctccaaaagtttccagtcatgctgaatcctcttcacccagtctctctttgtctaatataatgtaaacatggaggaaaaatgaaataacagatctaaaacaagcataaaacaaaagcaaacaacaaattcaacatattaccacatcccctgatgttgctgcataatgatgatcagagaaatttttaacagtgtcaaactgtttgaacaactgagatttatttgcacttttatttgcgctttcatcttcaactgtcaatttggaactgctttgctcttcgttagttataattttctgaagccaaggtacagtagcctccacgcc

SEQ ID NO: 30782 - DNA, 1501 bp, Oryza sativa
ttttgtatctttgagacgcgcatgggtttatttgtaggtttcctttttaaaaaagaggtttggaaagatctaaatgttgctaaaccgagcgtgtaaagttggggttattgggatggagaagggtggtagtgtgatatggtatgcgcgagaaaatccagcgaggatgtgaaagctagcactggccacgggtagcacctcggattagagcgaagcttatcgggtcacatttgtctggtgcgcaatagaaaacaactccgacacatcactcaaatatgagggatagatcatatgcatcggtctgatggttattttctcagtggaccccatatttaatacccaaggtgatcatataaaacttactttacggtgctctctaatctaatagtgttgtgttacaagtagaaaatgatccaggttgttgatttctaggctataatgtatttccctacatatatgctttagacattttgatcatgcacataacctctgttgcatactgattggcgatacaacaatgtaagacctcgcgatataggttactctagttaaagttactaatacattgaatataaaaactcatcatatctcgaatatagtgctaggattttcaactctaaaaattaaaactttagattttagaagtccatcccctaatgaaaattataaggttacttgacaaacctatttttctcatgggcagactaactcatgaaccatataggtaatagctttcattcttcctccttccttttctctacgtgacgaaaaaccatcaatttctgaagagcgtatattcttctattatactccctccgttttgagttataagacggtttgacctatttcaagtttgattaagtttatagacaaatataataatatttataatactaaatttgtttcatcaaatcaataattgaatatattttcataataaatttgtcttgggttgaaaatgttactattttttctacaaatttaatcaaacttaaagcagtttgatgttgactaaagtcaaaacgttttatagcatgaaacggagggagtagtaagttatatccctcaaccatttcacttcacacatgataaatatacatgaaaggaaaacatatatcagaggtctcttatcttatcaccgaattacaaaattatccctcaactagcagaccttagatatttgggttttcggttgaaggacggttttgtaattcggtgaaaagatgagggatttcaatgtactttttcctacatgaaaaatagaggaagaagagaaagtcaaggcccaacaaaacctgggcacgagccaagcccaaaaaggtagaggccctaaggcccaacggcccaagcccaaaagctactctcgaatctcgagctagccaagccaagccaagccaaaaaaagccctagccgcctcgtccccacccaatcctcctccctcgccgctcgccgtgctcccgctcccgctccggccggcgaccaccgggaagaggagagctcgaga

SEQ ID NO: 30783 - DNA, 431 bp, Oryza sativa
tgacgctggtggcgaaagtggcgtgggatggtcgggagatggagctgcacgttgtctcgtggggaggaagaggcagctcgtcgtcttgccagaagcccctcgcggattttctttttcttgtttttttggtttactaaaggatgtggaaggacctcgttgtaaaagaagctttaggaaggatctagaagatatttcgccattttgagcgatccgacggcttccatcatttgaacgaagaatcggacggctgatgttttcttaacgatgtggcgcagtcatatctaaaaaaaatctaactgtataggggtaaatatggaaaaggcagcaccggtgcccgaaataaaaatcggagaaaaactcacgcccccattccctcccctctcccctctccgccctagagctcgacggcggcggcaacaagggctggggga

SEQ ID NO: 30784 - DNA, 1501 bp, Oryza sativa
actaaatcatcgtaactcagtttaatgtggttcaagttgcaaaagttgtataaaataaagatatacatattaaaattgtccataaattgaattaaatttatttaattctttttaaatgggctttaattagatttaatcttgtaaaactcataataaattcatttgaagtcagaatgaggctgttcaagtctcataattcatctaaaattatgatctacgtgtttgtttactttatatgtattgtttatttggtttttattagtcttttacttcgttttgcgtgttagcttgttgtttccgtcgttgcgaaggttcgcgagtgcgtcggaagtgatcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttaaggccaatttgcattgaatgccctattccttgataccttgggtaataaattgattagcttgaaccttatgtattggtttggttcagctaaatgttatatatataattgcttagcaatgcttagaaacattagctcactaatgggatgaatcatatatactacattattattcatggttatatttaatggtagctcacgatggttaatcgtgttatgataattaattggtaattaaaatatgattaatggtgggttgtgagcatatggttttgaaggtcgtgctcatggcaattaaggaccggttcgcgagctactgttgtgaaacatttaccgtgccaaccacaagccagcatgggcaacggctttatcttttgtatagcgtgattcattatagtgcgccagactgagaactggcgagaagtccacgggggtcgctggggagtccatgccttgttttataagggagtgattatgatccaggaaaggtgcgctgtaatgggttatgttgtgcaaggggtattgtcacaactcctttccgaggtaccgtggtggtactgaggcacatggtgacatgatgtggggttgtgtcttgtgggtacagtggtacacctctggccagagtttaatctattcgaatagccgtgcccgcggttatgggcgagttgagcaatgtttttcatgattagtctcacacctctcacaataattattgatggttataactggtaatgatttgcttagctcctggtttggagttagatctgtacagccgggaatggttgttcaggatggttgggcctgagcagcatgggtgtgctgttcagtgttgattaagattgatgattaattactctactgttttacttatcttaaatctttgctaaatgctgcttttgcaaatgagcctatattatgccatcctttggaatccttgtgcacttgcatatttgctgtgtggcttgttgagtatgtcatatgctcattcttgcaataatcaatcaacctca

SEQ ID NO: 30785 - DNA, 1501 bp, Oryza sativa
ctgggagaagcatactacgcaagaagtttctgaattaactttgcctcccttgaccaaaggcggacgaaaagaaaggtcaaaataacactccgaaaattgacgagcagagataaatttcagcagcagcttaagcgtgactttggatagtttctgtgtcggtggccggcacgagatgatggactccgacaacctatctcttacgatgccaccggccaccccagtgaagcaggaaagataattctaacactgaactattactggcttgagatcgaagccagaatatcccagctgcctcttgtcttaagaaatcaggacaacacagtgtttatgtttcttgcatctgatcccttgctccaatgcttgagcatgagtctcggctttcccttctcttttcctaaccacccaagggccagtaagagtgcaagtatctaatcgatggcctagcacggtactcctcggtaggtttgccatggcacaagaccggaatcaacaagccatgtcgctactggcccgtggcacatgctgtcggcgtctctctcttggacgcagatgcctcctgcccaatatctgcgcagatctaggagcagcagaagcatccattccttcccatctgaatcgattcctctccgattctcatgttgccttccattgcaggtacactgaaacacaaaccaaagcggccgcggtgccggtgcacacgcgcggcaacggatcggggagagattgcgtgtaaatccgtaggcaaactcgcgcacaccgacaggcgcgcgtcgcggagtcgcggttaaccgaggcgcatcgcggaggagtcgcgtgaccggtgacaacctaactgcttattagccactccttagccaaatggcgtcgcttctcctgtccgcgtccggtatcttggcgaaaatcatgtacaagcgcggcgtcctggtcgaccgaggctgtcgagatgtggcctgccctggccaggccaatcggttagccaacgaaaacttgtgacctcagagctgcgacgtggaagcgatcgagtcatgcgcaagcaagcaacgtcccaacgcgacggtgagatcagatttttttgcgatgcgcaacgcaatgctgtcgtgaacttgatgtgttcgagaccacacaaaattttactagtagcagactcggatgccacagttgggccggtatgtattaaaaaggaagcccactagtatgtaagcccattaacgcgcaggccttacggcccggtatgtgaagtgggcccggcccgtattcacttttacgaaaagcaccttggagaggaacgaaatggcaagcccactcttctcgctggtgtcgaggagattccccaaaaacttggcccccatttctttcgcatcgtcgtctcgccttgccccgtccactaaccctagcggcaactgcgatctccaaccgctcgatctctcgccggaggctccagatctgcgggaggtagtcgacctcgtcgccggcggtggggtttccgaatcgggggcgaaga

SEQ ID NO: 30786 - DNA, 799 bp, Oryza sativa
tagcgagtaacgtggcatattcaccatagatgtcctcgacatttacttctcctttgctctatgtcacgcccggaaattcactagtaatttccgaacttatttgtgcataaaatcctcgtccaggaatcagccgaggtacacaaactgacaatttaatatacaaatccatcataataactaaaccgatatatacttacttaagaggcacttagtcctcaccatgaagaaaactgcagcggaaaataaaatctagcgaagctccggctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggattccaaaggatggcataatataggctcatttgcaaaagcagcatttagcaaagatttaagataagtaaaacagtagagtaattaatcatcaatcttaatcaacactgaacagcacacccatgctgctcaggcccaaccatcctgaacaaccattcccggctgtacagatctaactccaaaccaggagctaagcaaatcattaccagttataaccatcaataattattgtgagaggtgtgagactaatcatgaaaaacattgctcaactcgcccataaccgcgggcacggctattcgaatagattaaactctggccagaggtgtaccactgtacccacaagacacaaccccacatcatgtcaccatgtgcctcagtaccaccacg

SEQ ID NO: 30787 - DNA, 459 bp, Oryza sativa
ttcctcccaaaccaccaccattcatttagtgttccggtggtgatccagtgcaacaaattgggtagtaattttgttggtttttggagattgctcaattttggggcaaaatttgagaagaggatggttaagttctcgtcagagcctcatcaggggtaaaaatatcttgctcctcctgtgagagaggaactgttttagcctctctgttttgctactataggatttttccttggctgcgatgctacaaagattgttttggacctgtgcatgatgaaatgttccgtatgtttatttcgctggctcaattttgcaggacttttagctgatcgatgaattgctgttcaagtgaagcggttttaagttccaaagtggcgcttctgaattcactcttctgtactatagtattgccaaaggagaattgctctaataagatgaactgtacaaaaggagggggatttcccc

SEQ ID NO: 30788 - DNA, 1501 bp, Oryza sativa
cgatatatgaagaaacaaaaataacaaattttatctacgttgtacgggtactattcattgtctgattttattatttttgtttctctaattgtagatcaaatttagttctgcatgtttgtgtatagacttatatcatcataattgatgttactaatttttttttaattttttctataactatttatgtcgcatgcaaacgatgggtgccatggcacctaggtgtagaaaatccgtgtccgttgcttatgcttatgtttaccggtcaaaatttgaattttcaaacttaaatttaaagttgattttgagggtttttttatcaaagtttatttttcagccattttttagatcgctaaaaacacgcatatcaaagttttgtcacttcacaaattaatttttatttataaatatgccgtctcgcttatgcttgaaaccagccaaactatggctttttttttgttttttttatataccgatgtaataatgtaacgtgaccgagaaacgtatcctgaccagtaatccaggagtgcgggttccggcagagcgtcttgccgtccgtgtccacgcggaagggcccgatctcctggaacgctccgatgcccatggatgagcagccaggccctgtaaacacagcagtaatttgatgaagaattccaacatgtactcgatctgtttcgatcactattctgaacatactgattgggaacgcaattggatacggaaaaattacctccgttgagccacaaaagaagcggtttgtgggcagcatcaacggaggcttccacaaagtagtagaagagcgacttcccggaagtctcattgacgttgatgtagcctgaatattgctgtagcttcacgtccggtggctggcccggcagcgcggcgatcttgtccgcttccttggagccctcgccggcggcgagagcccggcatgattgcacggagaagacgattgcgacggagagccacaaccacaacgccctgtagttcatcatcatcattgggaaacagaggaagaggaaaaaaaaataatggcgaatgcagattattggcaaacagcggatttatagcaagaaacaaaattttgtgcctgttttctggttattcagttgaaccgcggatgccacgttcgtctttgattcttctctttcaagaccctcccaaatttaaggacgtccttgccgataatagactgttctttcctgatgagctggttgactattttaagcactttattgcccgttaaactttaccttattatcactccaaattaaaattttaaatgtttagttcaaaaattttaaaaatgtggataaacaatactactactgatttgttagatcggaaaggaaaactaaaggcccatagataatgagatcaagcccggcccaaattcgccagacaaccagaagcctaggccctagagcggcgagctgacgccgtgacgcggcgacgaggtgagcgcacgggcgcacagcggaggcgccgatctctctctccctcc

SEQ ID NO: 30789 - DNA, 1501 bp, Oryza sativa
gttccttgaagatgaaggcttcggtgtctagctcgtgcctgccgtcaagcgcctgtggtcgtcgccctagtcttccgctgtttctcgtttgtctctgtgtgtgctgggccttcgttgcccatgtaataagttaactatatacgcttccgcttgttaaactctgaattgtatcaacttttggtgtaccttgcctcctgggacaaggattaatgcacgcacgtcaggaacgcccgttgggttatttccggtcatgacaagttggtatcagagccacccttgaccctaggacgagccgtagatcccaagccttagctatattttcaaaaataaaaatcctttgttatttgtgaaaactgtctagtctctccctgtcttgctgcttcatttatcgccaaaatctgacctttaaaatgttgtttttctttttgtttttgtttgtagatggccggcagcgtcacccgtcgtggtttggacatgactggcttcgtcttggagctgcggggcatgtgcgtggtcttggggtatccacatggagtggactaccaggcccggccgcttccggagcaggagggtgacgatgcagagccccacgctggttgggaggtcactgcagtgatcctctctggctctcccgagcggacttcgctggcagtcaccgcgggtggagattctttccccgccgcttgccagaacgccgctctcctcgccatcggcactcttcaccagcgctacccggacgagttgcagcactcgccctaccgctaccaccctcgtcgcggaggagcccgcgactacgccaccttccgggatgctagctcggaggatgacgctaccatcgtgcacctggcgcgcatggtggaggcatacgacgcggctcgtatcgacttccatcagatggtgcgccgtgggatggtcgagaacaacttgaagatcctggagctgcgtcaggagaacctgcagctcaagaaggacctagacgcggtggaggcgcagctgcatcagctcaagatcgcccagggagaggactgccgccccaagcgtcgctgcgtctgccgcagccagaagatcaccgcccgcaagagcacctccaggcccgagcttgttcgtcagtccctggcgtggacctgcttcgtggagacccctcgtgccgagcccgcgcccgtggttccccaggagggggaagcctccggcgttggtagcacggaggatgcgctgttgctcaccttccgccctggcccgtcgcagcggtagacgagcagttagtaggcttgcgcgtgtgttctttctcgtttgtcttcttgttggagtcgtgtggggcatggttatgccggtttgtggtataactatgtcggagcctgtctttattttgtttgcctaagcaacttgaactttaatgaaccaatttaatcgcagtaataaattcaagaattatggtagtcgtgggtggttagctttaattgttagctctctctgtttgctggttctgtgtggggttttcaga

SEQ ID NO: 30790 - DNA, 1475 bp, Oryza sativa
attgtgctattggctatgagcatggctactaagttggtcaaagtgttacctttttatttcttcctcgtgagaagatcagagaaataactctaacgcctcctttggattgaaggattcatgaaaattttgaaggtttcaaatccttggaaattttttcatatgaggtcatctggaacaaaggaataggatgttaaagttcctattggccttctatgcctccagttctataggagaattattcctacgaggaagcaccaatgttgtggtggtagagttgtgggtgtatgactctatccaccagggttcacaagaaatcctagtgctcacaagaaatattacacacatgtggatgagctttcaaaaaggatttttctgagatgagagatgtgtcgctggtttttatctactaaagcatgtgttaggtttcgtagaggatttttttgagatcagagatgggtcgctggtttttatctattaaagcatgtgttaggtttcgtaggggtgtgggtgtgatattacatgtgtagtgatgtatgtatgcatctgccgtgtaattgaaaaaaacaatcctatgcctaggtttcaaagagccctaaagaggttcatcctctaattgtttgagcatatgaagtcatttctataaaagaaaaaacatttttagatttgggtacccgttctctccaaccttacaacaaacaaagatcttatcatcttaagctaaagatgatgacaatactacaagacatacctcatggttaggcaatttctcggatcgtggatctgaaagaaagccactaacgactcgttctttcaagccctaatcctgccgatggaagccagacacgtggatattctccctcaccaaatcattctgtggctcttgattgctccagcctctttcttctccgatccctacctccttttttcttccccttcgtcgccgatcgaccattctcgcagcggccagaacacgcgtgctgtcatctcatcttgcccccaaacaggagctccatgaccaattttgcaaaagccactttctgcagcgacacaacgttcgcaactgcactgatgtttgctttattgttattgtattccttttctctggattagattgcaccgaactgtttggttgcccaaacggaagaggctgtaaacagtgagccactgttgctgatcgctttgtttgcttggtcacaaaaaatggctgcacatgctaattgccaggccgttactatccaacccgttggcaagtgtacagtgttgtttctggaagagaaaagagaatcgtttgcctgcaatttttttttcgctccacacaaagaaaagggaaatgggtcatgaatgaatagtaagtaaaccagacgagcaaatcagatgtgtgctggcgccatcgctcataaataaatggccttgttggatcaaatcatgaaaccgaattgcctttaacatcgcaatcgtatctaatagtagtagta

SEQ ID NO: 30791 - DNA, 1501 bp, Oryza sativa
cttctcaaacgacatggatgagacagtgcatctcgtccggtcggagtatgtgcattgtatcagtctttgattgattcaagattggcacccggccacaactttcaagcggccacccgggcctagctgatcccatcagccacagggtttccaaacatcgaatccaaatccacaacagcaatttcacaaagcagtagtcaaacaaaactacgctaaggaatcaccttacatccacccatgaccgtgggcacggctgttcgaacagtttaataacctctgcagagggggtacactttacccacacggcattactaacccggatcacccagcccgtggggatcagccacgtcgggagacctccaagctttcatgacaaggcatttccaaagccgacacagatttaccatatgccgacgagaggggtcccagaccaacaacaggttaggtcccagaccatactgtgccaggaagcccagggtcctccccgacaccaccccggcgaatccacttgtctctcggcatcaaggctcccctgattagctaattactcagccaggggtgtcccattccacccatgtggtcgtacttgttatatgttcggatgaaattccaaaggaatcggtccttaagtgcaagaacaggaaaccgtgctcccggcacgtcccctggtctgcgattttggaaattcatttagttcgcaagcaccgacccaggcgtcgggtttttccaagtcttttgtaaaacccaagttttacccatacttggatattttaaatttgaggagaggcgttccgatgcgcttgcccgaaggcccgtgcatcgaagcacaacagtcgacaaagggagtttaagtgttcaataattcaaggagggtaattgcagcaattaggattgggaccggcaggctatctcgcaagccgcggccgaattgcttgtgtaaatcctattcatgcaatatttgcggaaaagaaatacttagatttaaattataggtgcaagatgatcaaaggtgacttgccttgctcgagatcttgagcttgattctcgaaatcctcgcattgcgggtcttcgggctccgaaactacacgcgaaacgggacaactcaacaaacggcgaaaaataaagccctattattgacctctaagcgtgccattagatagatctcgagatttgaggaattttggaagttgaacggagtcaaacggtcatacggttgagaagatattgaatttctaagattattggatttttgatctaaaggaaaaggatttagttaaacccttttgaaaaagaaaaagaaagagggaggagaaatagacttccctcaggcggctagggcgcggcccgagagaaaaggccgcggctcggccgagcttaatgggcctgccggcccgagaaggcggcccaaggcacgcgcgagaggggaggagagagagggagacggtgggccaggtccttctcgcgtggtcccgagtgggacccgcttgtcggtggcttggctcac

SEQ ID NO: 30792 - DNA, 1292 bp, Oryza sativa
gcccgcccgaccgagtacgtacgtggtgggtgggttcggagcttgggatttgttcgctaaattcgttttcggcccagcccaatagaaccaagcccggcccagcaaagcttgtgggctgtaaatccagggatgagcccaactttgtgaaatctggtaaaagttggttgggctgagtctgcctgagtgcctggcctgagtcctgttatcagcatacagtggaaaaaaccggaccggaccggcggttcgaccggaaaaaatcggaaccagaggtgaccacggttcggtttcctttaaagaccgaacatgcaatcgaaccgctctgaaccagatgaaccggccggttttcggtgaaccggacactaaaccggcactggttggaccggctagccatactaatgggccacagtcggctgtttaaaggcccatttggtgcagctggtggtctttttttttttttggcaaaaatagcaagaaatggtgcgctacgtgggattcaaacctgggtccaaaggttacaagagcaaagagctagccatcaggccatccaacaacatgtgtatataagtgaatatgtaatatacatgtactttgtgaaccgcggttcgaccgcccgagtcactggttggaccggtggaccgttgaaccgagaggttggccggatcacttaccggtccggctttttttactatggttatcagggtttactccaggtatgtctcgttttagggacaaattaaacctttccaaaagttaatgtagctaaattttagtaaggattcataccatgagttttggtaaagttaagactgtaggagtcatatgtgggtatgtgtggtttgttgttgttttttttttgtgtgtgtaggtgatagatagatgttgaatcctggtaaggtattggttattcctcacgaaaattgataaattgataggttggaaatgtagtaaaccaccctagtcatatatccaaccgcgcctcctaattttccaccagtagatttagcatcacctatacgcatggtacggtccagtgaattggattgttgttccattatttttaaaagctacctgtatatataagaaaagttatatataaaaggagtactgtgtttgattgccagaaaatgaggctcttctcgcggagattttctggaccatgataatccactaattttaaggagcgctaaataatcattggataatctgtacttaggcggaaaatccttctataaaatactcagggcagggttaagaactcatgatatatgctatatgagcctttgagaggacaa

SEQ ID NO: 30793 - DNA, 194 bp, Oryza sativa
tgattatgtcacgagccacgcaccttcaacttcttctaaagaacaattaactacttaaacaatgttattagtaattaataagcatgatgtataggctcacatcatgtatatgaaagaaaccccgcggcaaaaaaaattaattaataagcacataattaattttaaaagagcatgtacgtattgccgaatatgaa

SEQ ID NO: 30794 - DNA, 528 bp, Oryza sativa
aagtatctattcctgtcttccacaaattaagctcagtcttatacagtcctttgtcttacaaatacctcactatgtcacacatgtttttctgaagctatatgtaccagtatttccatgctcttccagaaactaattgcaactctgaaagttaataccgtggtagtggctggttgcagcaaactagaaccttaacttgctttaaaagattttcttttttccttttaggagagtattggagtacttccttgtcatgatcaactgatgcaaagtatgttgttatctaacaatgtatgcactgtagtcttgtcatgctctgattgcctggaggacctcctcatatttgaatatgccattgaagtgtgcatattttccaagtttagtatgttatgccccatatttctcttttttgtcatgctgcatagatagaatatcgcacacccatcttatgtggaaataatggacttattggtggcataaacttcatttgatcaatttttcttactttatgtaattgttttcaactttaga

SEQ ID NO: 30795 - DNA, 513 bp, Oryza sativa
caacactggtactataaatgatgacgacgacgatgaattcgtatcggagagagaagaagattgcaggagtaattaatttgttgatcaggtctgtatgtgttgtcaaaaataaaagcaggtctgtatgtactgtcaacttaaatgtgagacataaacagtgcaaaattgcacctattttaggattgagggagtactaacacaaaatagaaatagtaatagacctcctcgtgtcgtgggacttggaattggactccctcttcttctttctttcctcttctacttttcttcttttacataatagtattagtattacaatataggagtaatactaatactctttgttccttttgttggcattgcatgtttgtattggtaaggttgttcaaatcaatcaagtctagtgtagtagctaattaagccgccgccgcgagtcgacctcgcaaccatccatggccccgcgcctcctcctcgccctcgccctcgtcctgctcgcctccggcgcaagcgcggcga

SEQ ID NO: 30796 - DNA, 1034 bp, Oryza sativa
atttctcaaatatttgtttttaaaaaattctagaccataaaagttgtactctctgtaactatatatctgtatgactgcaactcgatatacttaaaaaggagcaaggttgttaaaattactatcctaaattaattagaaatgaaatttttagttatgattgtaatcatataattgtatatcaaaaattgtgaaatcgtatagatgacaaatataaaatcttaaaatcagccaccttaattaagatcgtaatagaagtcgtaaagtaatcaagatttttgacaaccttacaagggattagagtaggtggggatgggaggaagaaacaatctttaaaggcttaaagcctactctctccataaaaaaaaacttaatataggaagagatgtgatccctcctagtgcaataaggtagggcgatagcaagccttagggataagtccataagcacggtagtgaatagggatacaaatagacagttatactatggaataaaaagtcatgattaatagttaatttcctttatagtagtataaaatttggaaaaaggaaaatattagaattgttatagacggggaaaaaaattcgtagccgtgaactatatatctaaaacatgctaataataatatagcatagcaaaatcgaccgaaaatgccatgtgtaggaagttggcatgaaattcatcgatgaggaagaagataggaggagaggtgatcaggtataccgggaccatatatatgcatatgagaacagcctagatttgggtacaagtggggatatttttgaaccttgcatccttacgagaaaacaaaagtgtttagttcacgttaaaattagaatttggttgaaattggaacgatgtgatggaaaaattgaaagtttgtgtgtgtaggaaagttttaatgtgatggaaaagttagaagtttaaagaaaaagtttcgatctaaactcggcccgtcaagaggggggaaattaagaactcgacccccctctctcgcgcaacatttaaatgctggaagtatataggtcatggcgtca

SEQ ID NO: 30797 - DNA, 745 bp, Oryza sativa
agcattcaaggctttcgccatctgttggcccagtttggacaccaagctggtttgtgaataacatacatcagtactataagtgtgtttgtatagcgtgtcagtgtgtgtggatagtataaacatcagtcagtctcgttgtgtgcagatgcaggtgcagtttgttgttgctgttgatttagttgtctgttcttcttgtgtggcagatgtgaacaaagaatggcaacacatctcaagtgcagttgtttgctgctactacatttatatcatgtaagtatttggaggttggaagtggaacaaccccaggctcctctagtttctcgagagggtatgcatcttacttgcgaatgtgatttatctactcggtctatatatcttggtatcctttaggatcatagctgctatatgagagaagctacactgctacagcctgcatatgtgcttgaaggagccacttggaaaggaggcaatatcagttgatcgattcataggcatgcagattatgtacaattaacacttaacagtaatgaagcaccattcctgcaatcttggaaacaaatcctagatgaaaaaaaaaagaaaccttcataaactgcttaacgggagatcgttacaggaagaaccctatgatatgactgactaatcaacagcccactcaaaatcccaggaagagatggcaacactcaacatacgtcaaatgacatccggattccatttgtacacctgatgaataacaagttgttggttg

SEQ ID NO: 30798 - DNA, 1501 bp, Oryza sativa
aatatttttcttgtttgatggcagaacagtgaagccatggtttctatagacatgcctgctggcccttcagaagtattagtgatagcggataaatatgcaaacccagttcatgttgctgctgatttgttatctcaggtatcttctattcttaataccctgcttcatactggtgaaatgtgtacttgttattgaacttcctttactctttgaaatgccatatttgagaatctgaggcataggaattacatgatgtcgtgaagctttgttaagtatcatattatattatataacagttgttcgttcaaaattttaggcggaacatggcccagacagtcaggttgttctagttgttgcgggagacggtgttgatttgggtgctattgaggcagaagttagcaagcagtgctctgctcttcctaggggagaatttgcttcgaaagctcttggccacagtttcactgtttttgcgaaagacatggttgaggtaattcttcattcctgcccactctcgaattatttataatttgtaaggcacgtactatacatcactggagtttgaggtcgtagaattttgcagcatgcatgaaggtaaatgaaaattatctgatctattgccgttcccagggattgttgacaagccccctctttcttccttatgtaggcaatttcattctccaatatgtatgcccctgagcatttgatcatcaatgtaaaggatgctgaacagtgggaggatcttgtcgagaatgcaggtataggcatacctgtcagcgtcttaatcttgacctgaacattttcatacttcaatggtaatctcaggcgatcgttttttcatcacagggtcggtcttcttgggacaatggaccccggagagcgtgggcgactatgcaagcggcacaaaccatgtccttccaacctatggttacgcaaggatgtatagcggcgtgtcactgaactcattcctcaagtacatcactgtccagtccttgtcagaggaagggttgagaagtctgggtccgcatgtggcaaagatggctgaagtcgaaggactagaggctcacagaagagctgttaccctcagacttcaggacatcgaagccactgtaaccgtgtagatttgttaccatgattgttctaggggccaacttggatgcagagaacaagaatctgtgaacaccctaatgagaagggatggtccagctgtttctcgaaataaggctcatccattttgatacatctttgaatataaagtttgtttgattgtgttacactttcaagtattcaagaggacgaaatctgtgaagactgtaaggaaaagggatatgatccagctattactcgaaataaggcccatccattttgaatctttggtccgtctattgaatgcaaagtttgttgactatgttactactactactcaagtattcaagaggggtaaacctatgtgcaaatggtatacaatttcagtataaaaatattgacagcagggtttcacttgcat

SEQ ID NO: 30799 - DNA, 1501 bp, Oryza sativa
ttagtggaaacttggaaactaccgttgaatcgaaaaatgaatgtctgagattcctctacgtcatctcgagtaaaaattttactcatggatgtactcatgagttttaactcgtgattacgtggacgaatttcggacgtccattttttgatccaacaatagtttccaagtttacactacatttgtggtttccaccacatatttttcctgaatgaaatggtaagggtggcttagaatttacggcatgggtgtctattggttcctggattaaatagagagaataagaagaaggtcagtgatttatggcatcccacttcaaacaagagtatcctatataaaaaagtaaagctatgctgcaatgatatatgtggagattatggataccccatacccatacggcatgtatatccgactgggtatggggtgccatgtatagataaaataatatctttacagggactcgggttaaattctaaacgtatgtcaaggaaatacccgggatcctagtcggttacaattgtatcttatctgtaactacctattcctattccgttagggatatgggctgtactacggaccccttcccctatataaggaggggtccgggtgcctcttggggcacgattttctcccagatcatacgatcaataatacactcggcggatcaatccccggacaggagtaggatattatttcttattaagaaggcctgaacctgtataaaattcattgtctctaaatccatccacttttctagcttgatagccacctccttttagtattgccgaaatcttgtttcgacaatataagtatccagtgatgcttagatttaatagaacgatatgatattcatatatcgcacatactctctcatctaattgctgatatagtagggtgacgtacgtggatacacctaaccacaattaataggaatacttatataggattaatttatagataagtattaataggtttattcagtaaagtttaagaataagataaagctagatgcaaagtcgtctaattggttcaattttgagtttcttggattccctttttaagcactgatcaaacaattataaaagtgctcacattatatattggaattattgtctcagaaattgaaacggagggagtagcagctagctagctgcagatgcatatcatatgcgtttaattaagtgtgttcatatatatatatataggacgatgaatcgaggaccagagactctactattcgtagtacagatcgaagcgcgtacagttaatggtggtacacacacaagtgtaaaagcgatctatgatctgttgttgcattggtctttagctctatctagcttctgcttcggtggccgacttaattataagcgtgggtttaatttatatttcatctataccctgtcgtttcgtgattaatttttcgatctatatacgctgtcgtctcgtctcttgattaatttattgaaccaccgtgatcgtcgctagcttatgtacgtacaagaga

SEQ ID NO: 30800 - DNA, 1501 bp, Oryza sativa
aaaatatgtggtcaatctgggaggtggagaatcaacatttaagcaagttgctggtttacaaacacaatcaaacaaggataaaagaaatatgatcaatgcattggcgagaaggacctcatacctttgataactttatcttgtgttcagtacagaaacgttgaagaccctatcagacagcaaggttgttatttagcacattaagttcaccaaaataagacatgacaaactggttaaggatgataaaattagataaataaaatacagagcaatacacacaaaaaagcaggacaaacggaactcaatagacctgagctacaaatttgcccctaaggcaactagagtttaggaacaacttgtgcacttaagaagcacattaattaaaaacataagtatgttttagagagagagagagtgatcaaataaatacaagtgctgcagatacctcgccagcattaaatataaacctctgtttgtcaaagaagagtaaaatggaaggtgaagtatcttgtgtgtccattcctgtaccaagtatctgcacagcaagaagccaagaacgaaggggtaagatcactggcaaaggcatttgtccctgttcccatgagttgatctaagtgagggggttgattaactgaacaactatctctgaggggggtgacacaaaaagtcaaaaacagctggaatgattgcattctaggcctctaggggtgcttatacctagttttctcactcttactaaactagctcgatttgatcgcttgctttgccagccagcaactgcagcatccacaagaccctgacaacatagtatttttggtcttcaacaggtaaaggaaacccagaatatacaccctacaagtgattatcaacatcgttatcatcagagcattgatgttctgaatcatttctaccaatttggtagcgggtggcattaatatgtatatcctccgatgaactttggcatcgtgacaaaatttattattttataattttcttagcacgcaggtaataagcgaacgatggtttaaagtttggttcagatgctataccccctttaaacctaagtaagacatctatcgcaatcaatttgggataacattttagcctatgcccacagttaggtcagcagaaaggcgacacatgcacattcttacaaagcaaagaaaattataaccggcatgctgaaacccaaggcaaaagatatcgcgccatactccaatggggcatgttttgtatcccaagtaagcccaggaattaaatgtgcttgctaagtcatgaagtaaaccaacatgcacaatcgccatcaaaggattgtagcaggtactaaccttgtgctaaaaggcatatatatataatcatattatcattttgttgctcgacatcgttcgcgtcttaggaaacaaaatgtatgtagcataaaaaaagcaggcaatccccgctttaatcgagctgaactgaaagctaggcgcaaagcagagcggcttaataacgagaccatcgggaa

SEQ ID NO: 30801 - DNA, 1501 bp, Oryza sativa
aaaattggtcctaacaggatcgttcaattgccacttttgatattctacctcatagcatattttgtagtaaaaaccggtgatcacccaatacatgtgagtatagctcgttatttgaatgatttcttccgatcgacgtgaattcgcagtggaccatataccaatcaagctgggttcgtgcgtctagcactagcgtgactatgaagtgataagtccgactcgagctagttctcaggctaattcagagcagaaagacgacggtgaacactgagaaggcctgagcatagttaatttttacaacaaaataaatcatagggtaaaacttaaaactaaagtgataattaataattgagatagttaatttacgcaatttttaccttggccgaaagctatgctgacaagtgaacaacacgcttgccgttgccgacatctcttgtacgtacataagctagcgacgatcacggtggttcaataaattaatcaagagacgagacgacagcgtatatagatcgaaaaattaatcacgaaacgacagggtatagatgaaatataaattaaacccacgcttataattaagtcggccaccgaagcagaagctagatagagctaaagaccaatgcaacaacagatcatagatcgcttttacacttgtgtgtgtaccaccattaactgtacgcgcttcgatctgtactacgaatagtagagtctctggtcctcgattcatcgtcctatatatatatatatgaacacacttaattaaacgcatatgatatgcatctgcagctagctagctgctactccctccgtttcaatttctgagacaataattccaatatataatgtgagcacttttataattgtttgatcagtgcttaaaaagggaatccaagaaactcaaaattgaaccaattagacgactttgcatctagctttatcttattcttaaactttactgaataaacctattaatacttatctataaattaatcctatataagtattcctattaattgtggttaggtgtatccacgtacgtcaccctactatatcagcaattagatgagagagtatgtgcgatatatgaatatcatatcgttctattaaatctaagcatcactggatacttatattgtcgaaacaagatttcggcaatactaaaaggaggtggctatcaagctagaaaagtggatggatttagagacaatgaattttatacaggttcaggccttcttaataagaaataatatcctactcctgtccggggattgatccgccgagtgtattattgatcgtatgatctgggagaaaatcgtgccccaagaggcacccggacccctccttatataggggaaggggtccgtagtacagcccatatccctaacggaataggaataggtagttacagataagatacaattgtaaccgactaggatcccgggtatttccttgacatacgtttagaatttaacccgagtccctgtaaagatattattttatctataca

SEQ ID NO: 30802 - DNA, 1501 bp, Oryza sativa
tttctccacaatgcaagctattgttgatgggatccatagtaatatactattttaccaccttcttatttgagctttagtccttcaattagttctttttatttttttggtccaaaattatgcatatagtacccccaatagaaaagagaaattgtataaacacacataagccctttccctaccatcgcgggcatcaagtcccactataggcctatcccctcttcccgcctcgacaatgagcaccactgccgccagcgtcttacctcttccaaacctcggcaatgagcgttgtcactgctgacctctgtgtgtgtgtgtatgtgtgttcaccgtgacgagctccctctctagcagactctcccctcacctagagtcgcatctcccctcctactagataggcgttgccgccattatcccctcctcctcaccaagccgcgggtggtgtagatcaagccagcgggggcgacgaagatcagggcaaccggcaccaacgacaaccttgacaatggtaagacatgcggatggtgtaactgtgtaaaggatctcagcgcgacagatagtgcgaggtgtcgagggtgaagcatgccgggacgatcgaggagggccatcgccaatcccccatggtgtcatgcgcctgggcatcttccaaagcagggcactcgtgtctcatagaaggcatgagcaccccgcgcgaagacacggccctctctcctccacgggctacgtggatcctacgaaggtactcgccagcgtggcgcattgtccatggccgaaacaaagcaacaatcccaccagagatgacaccaccaaaattcaccactagccgcttcttacggcagtacacactgcagtaactaaaccatgcagttccttgccgggacgacgtcgacgtttgtagctatagctaagcctaggcctagcttgccgttgcctgcacgcgcgccgtacgtacgtacatccacacactgacagccatcaatctcgcgatcgagatcttgcaagatcctctcatcaaccgtccgatcgacgtcgtcctcgctcgccgccggccagccatggccgccgtggccgtggccatatttacctccggcgagtacacgcatgtgcacgcgatatacatcgagatctttaccctctctttgcccatatcttcccacctcgtaccgtacgcgccatttactccgccccccttaactccggcgagtaatggcgctcccgccgtggtaccccaccaccaccaccgcgcgccgctgcatatcctcgccgtccacgtagacgactagctcgcccatccaccactccttcgtttcatcgacctcgatttatacctcgatttaacgtggcgttggtgggcagtatagctagctactagcatggatgcgatcaattcgtcgtcgtcgtcgtcgtcgtcgccattgttgtcgtcatcgtggtggtaggtggtagagtactgagctggaggtttagtggtgcagggagaggatcagggaggtagagctagtca

SEQ ID NO: 30803 - DNA, 1501 bp, Oryza sativa
acaatattgccaatgaaaataccccatataaacaccatttacctaatcctgcacctatagaaaactttgcggccacagtttcacatggacaatgtttcatttttttgctttggttattccaaattcctgttcattgactctcaaatcatcagctgtcaaagcactaagattaagatttgacttttgtcccttgtggccagttgatactcctgcttctgtttttgaattttgaaatctgaatccccagggtgagatggtggtggaggactcctttgtcacagtgcaatttagggaggaccaagaaagaggtcatcactcatcaatgtacttactgcatggaaagagagcaaagcaacagcaaaaggctgcgtggatggagtgttctgttcaaccttcaacggtgcgctccctttctttattcaaaaaaaaagaagaagaaaaaaacaaatccccatttgtttatcgccacatctagtggagggaaacgggcacgtttgaatcgtcgatccatcccagccgtccatccgctcagcgacggcggggaaacgccctcgcgtggaggagcgtgctgggccccacctcgtctgggtgagagggcagaagggtgagaggattaccggggaggtgagcggaaggggcttcgtctggatttgaatcttctttttttttttgaactgattgggggaggactaggagagtgtgatttgggatctcggggtgtgcattcgttcaaatttcaaaaagttcaaaaagaacgttgagggcgaggcagacagacaacgtggggggcccacctgcctgccgccgtggccgcgatgccgtttgttcagtgaccgtttgttcatgcgtgcgtagtgaactggtgaacggggtgtggaaaaatcgcatagtatgtttgtgtttgcacttgcacatcttttttttatctttggattttgtaggaaatgatttgatagcttctctaaaaatagaaggcaaatcctatgttgtaaatgagactaaatgctaaaaaggatacgtgtgtgattctattctcttgatttagggtaatgccttttcggggagaattgaattgttcgtaggaatagaacggtagtactattttttttccatgaaaagaaatgcaagtgctttgtgtattgaagatccttggagtacaaccttggaatttggtgagaacgaaacactattgttcttaggcttcgttcgttcctgggcgatttgggggattgagagagaaaagcatctcgttttccgtgcgcacgcttcccaaactactaaacggtgtgttttttgcaaaaattttctatagaaaagttgctttaaaaaattatattaatccatttttgaagtttaaaatagttaatactcaattaatcatgcgctaatggctcacctcgttttgcgtatcttcccaatcccctctccctcaaacacagccttagagcatcactaagagcaggtacaatagcagactataagtcagttataaacatatttt

SEQ ID NO: 30804 - DNA, 1501 bp, Oryza sativa
ggtgctcttcccgacagaggccagggggattgggaggagaggggagggtaggggatgaaagaaaagggggaggagtgctactttaagaatacacccctgtactttcgattctttgcagttttgggcctaccattctactcacattttcttctagggttgtactggtaagcagttcagttgttcaaatttcaagcagtggcatgtgcttcaaccttgctactaagggggtgtttagatggggttaaaactttttagcccatgtcatatcggatgtttggacgctaatttggagtattaaacatagactaataaaaaaactaatttcataaatgagagctaatccgcgagacgaattttttaagcctaattaatctataattataaaaagtttactgtagcatcacattgtcaaaatcatgacataattagactcaaaagattcgtctcgtgaattagtccaaggatatggaatgtgttttgtaattagtgtatgtttaatactccaaattagtatccaaacatccgatgtgacatggacttggaaaaagtccctggaaaccaaacaggccctaataatcatcgggttgggttgcggttattttatccgtaaacggtttttagttattcggtcacctcgtgggtgggttattatgtttccgaccgtttttttatggatattgtggatgtagagctgaattgattgcaatgtgttacttcttttgttcgtggacggtaacggatatttaacatgatattgatgcttagatattcatgtttttagcttggagtgtgtccaaaataactttgtttttcgatagtggatggagcgctatgagtatcataccggagatttattacaaacggacaggaaggtctggaactttgtgcaaaacgacgtgttttaaagattgaaggcgttactctgttactccatacatgccggatatttataactaacggtcgaggagtttaaaatgtgtacaacagtctgaaagttcaaaatgtgtcaaaaacgacatgtttttaatatttgagggagtaccatgatataataccatatatttataactaacggttgagaagtttaaaataacgtccaacggtcggaaagtttaaaatatgtcctaatagacatgttttatatatatttataattaataattaatagacgggtcaaaacgtaagattaaacctttcttaactgtgtgaaaggctactatggaaaaatttaattacaccataatggcacaatattgccaatgaaaataccccatataaacaccatttacctaatcctgcacctatagaaaactttgcggccacagtttcacatggacaatgtttcatttttttgctttggttattccaaattcctgttcattgactctcaaatcatcagctgtcaaagcactaagattaagatttgacttttgtcccttgtggccagttgatactcctgcttctgtttttgaattttgaaatctgaatccccagggtgaga

SEQ ID NO: 30805 - DNA, 1501 bp, Oryza sativa
caattcgccaatccctgattcagtgacatgttcagaataggtgccaaccttgttagagcaaaagcactgtagtttacaagagcactggagggcaaaggatcacaaattctttctagttacaacagcagagagaaaagggtgtagatgaagttaacttgccagtcacatcgtaaacaatcactgccacagaagaatccctgatgtaacttgggatcaagctccggaacctctcctgcccagctgtatccctgcacattatcatcaccataaaactctcccggtttttactagctgaaaacctcccagttttcactagctgaattgtcttgtgcgcgtgatttcagttcaccaggaaaggataaaaaaagggcaacaattgagcattaatattgcctccatcagcaaaacgaaatcaacgtaattgagggtggaactgagactaaaaatcaagacttcgaaactagtaggcactaggattatatggtaataaagcaggttgtgcagagtaaaatcggtgatcggacaagtaacagcagctaagctgcaccaactgaattctcgtaagcaggacaagcttgataagcagagtatgatgataggggaaaaacaaagagagagagttttcagaatctcagataccaaagctgcagccgtacggttcggtcttcgaggtacatcgtcttggagaggaaatcgatcccgatcgtcgcctgcacgccgccgccgccgccgcaacaacatgaacaccgtcaaattcatcgaacaaaccttgcccaaaaaagaaaaaaaactggaactctctccagcgcgtaagatcgatcgatcggggacgcgcgcgacatcaacgaacctggtaggtggcgtcgaacttgtcgtacatgaagcgggtgatgatggccgtcttccccaccgcctggtcgccgaggaacaccagcttgtacttggccagcgccgacaccaccggcgccatcacagcacgccgacgcctagcctaccctgcgctgcgctgatcgattccgcgtgtgggaggagagaattggggcttcgaaaatttcgaaatcgagtttgagctttcttgtttcggagtttggacgaacgcgtgcagatgatggaaaagaggaaggtgtaaaggaggaggaacgaggtgggcttgctttgaacggagaaggaaagaggcgacttttgcgtttcgaagcttttgtttttgttttttttataataaaaaaaagagttggtaggtcgatgtaatagagtgagaatacgttcaaccttggggagtccgggcgttgactctatctatgaaccatacgaaacgttacatgttcatgtttgaattctcatgaatttctttcaaaaacagttggttttcagctgtaaccgccgtaagacgacagtttcttcgtttccagagatgctgcttgcgtgtactacaatcgcagcagcctactcgaccaagttgatcttttcttccgatggctgaccccagcacatatttttcagc

SEQ ID NO: 30806 - DNA, 607 bp, Oryza sativa
tttggccaaattttgttctctaacacctatgtactgagttagtcctacagtatgtatgtagcttcttgaaatgttcctacttcctcaacacttgtatatgaattagaacttcaaaatgtagattatccatataccatgtcagtgctttatttctttttaatgctgtagctcatttctcacattaaaaagctattttttctgtttgacaattatgtataacaattcaaaacttctgaacatcccaaaccactctgatagcagcttagccattcacacgtgttgttgaaaaattactcataactcatgtatatatgcatgttaaattctcagtgcttgacgtaatctgttgcatctcacaaacagatcatttatgacggtgctgacactcactacaagaattctctgaatgttttaacgtgtactctttgctgacttgagttgaaaacatctgcaaccaaatctatcttgtagtcattagtcaaggactccacataaaggatttttatttatgttcgtactttgagattagtttattgatatttttatgatgttcgctgacatgtaaatccacaaactaaaattctttcctgtttccccttattacagg

SEQ ID NO: 30807 - DNA, 777 bp, Oryza sativa
cctgcagcccgggtagtatttttctaatggaaattaattctgataaggtgatttgggtgcattattagctacgcaaacatcgtttctttttatctgtcatactgctcacgtactgtttataagagtacctgaaaacaatagcctaaaatatgaatcattctcaagaaatacagattcaattgtcgcatagtcgaataatcagaataattttttgaaaaaaaaacatatttggaatgcttagattaggaatcactaggcattttatactgcttcatgactcgtggtgatattgtcaacgggaggattagactatcttgtggtggagtttcttcaactcaaagcatgccttttctctgaacacttcccaaagttctgaccatcaaggggaaaaatttattggcgccatcttcaaaattcaacggtccggtgccctttcaccaaacttttaggtcgcaaaactcaactgcctcacgaaaatttccatttgataactatcggaacagagtattctatcggaagatgtctgaaattttcagtcctgaaatagtagcacacgttttctaatatccactttaaaccatttgatctgtatgagtaggttaagaaagaattatataactgcaatattatgaaaaccatgttccatgagaaatataactgaaaactttgaagtaatcatacaaagtagaatttgcacataattctggtaaattttggtgtgtgttgatacaattctgaactgatcaaacctcacatctctttccttctcatctgcgt

SEQ ID NO: 30808 - DNA, 1501 bp, Oryza sativa
attttatttattggttgaggttagttggatagacttgctcggtatcttccaaatcgtttcatattcgtgtttactggaataatgttttcatatatatatatatatatatacactagtgctactagtacgtatcttgccaaatctcaatcgacctcataagtcataatgataatataaagagttcatccatgatccatccccttgctgtttctctctcaactgcttcacactgttgctctcttccctctctgcacctgcaaccaccaccacaaccatataccagtaccatcgaggaggttgccttctcttccggtcggaagcttgctttccttttcttcttcttcttttcagatccaaggttaatttcagccgacacacacaggaattgaacctgtgctcttcccaggtttctgtctgtctgcaaagttggccgctttctgcagattcatttcctttgccacgttttctgctgcaaaagttggatctttgcaagggggactggctgatttcatttgaggtttctgaataagttggggagcttgatttggagagggtaagatacggatgttccttttccttcttccgcctgattaattgattccatccctaccatctcctcctccgtctttcaggagaaattctgttttggttcctcttctcttcttgtgtccaatttggttttgcacttcgcatagaaaaatacagaaacatttatatttatccaattcatttctctagctactcaaacagcgcttcgcttctctaccctaccccttgtgcaaagttcttgcagatcttagaatttctcctcaccaacataggacatatgcaatctattgcacatcacaaagttgggataacaagagccaaccttttatcctctctagtctcagcagataaggggtcaaaattttacaacgctggtgtatgatgtaattagattatttgtaattaacgcggccttttgttggcctttcaccatcacggagttggtcgcctacgttgagatcttgtattaagtttgtgacaataacttgtactcactaaccgcggtagcccaccactttagactattcaaatgggaatggtatgctctagagtaggcttgacttaatctacatgattggattatttgtcctggattccttgttgaatgctactaatcatcttccatggtggatgctttagttttattccatggcactaactgctttgtggtcttcattgctctgacatcaccgagtaatcacttttgtccttctcaggttacttttttgggggtgatgtttcgatttgcaaatcagaacaagattacttaaggtattaccatggtgtactactgtgattttgttctccacgtactttctgattgcaggagctcagcagttgctgatgttttatcttgtgcatatgcagtgctgctaagctcaattggaagtggaagatcttggtcacgcggcatcaggtgaaagtttggtcgctgtgcatttttcacaaggga

SEQ ID NO: 30809 - DNA, 1050 bp, Oryza sativa
attcgttcagaaaaaaaatatcaattacaatgtactaattaaggtgatacatatatatcgatctttccaatctaggagtatttatcttaattacatgcatggcgtctagtgcatatggctatcttctaggagatgctggcacgcgcatgcatatgcgccacgaacagaaatcacgcacacatgactacgcttgccgcttcacacaagtcggactctgcttcaaaaacttttaaccgtgcgttaaaactttcatttcgaaaatcataaatttttagtttcaaatataaaactttatctcaaatcacaaaactcttccatgaaactttcatctcataattaccaaagggattatacccaaattcccaaaaccttccaatccaaccccactttttatacaaaaagacataaaacttttatccccaaacactcaaatccatctgcctgttcggttctagccacccatcgataccttccaggcagggacggatctacagtactagagccaacaccgacgactttcggcaaaatctatagcaaaactacttatctatatattataacactatgatctaagtattatcagcatactatgacaccgatagacacattataacaccaacgaatcgattttctagatccgccactgcttctaggccatcacccaaccaccgctatagccccaaggttagggcaccgagtccaaggacctgagagcgttggaacatgaaggagtttgagaaggagaggaatgatattgtaggaagaatagccggtgtcttaagcctctaaaatagaccttatatatttgtgagagtagtctttatgggatgtatttcgttgagctagctatatgtacataaagactacccacaagggaaaaaactcttctatcttttacggtagtgctactctctctcactctctcaatgtctgctcttaggttggtgggatccatcttaatacccttctcttatcatatacattatgtgtatgacgatatatttttataggccctacgataatattaaggtaggtcatgtacatcgagca

SEQ ID NO: 30810 - DNA, 278 bp, Oryza sativa
catgtgttgttcacaagaactttggtaagactttacattcttagcatatatctaggtgcttgattgatctcatgtaatcatttacagttttacacaaaggtaccatacatataattgaacatgattttacctgttttagagacacaggaaaagtgagctttccacagatttccgggctttgcactatatccttacatatctctctccatgttcggcagactgctgcacaggcaacaacatctttgcgggacggccaattgctctctccttcctccagt

SEQ ID NO: 30811 - DNA, 193 bp, Oryza sativa
acaaattgaagtctgggaactagaggcaaacctctacggggggtcgatctgctgagcccggactccggcgacgaccggcgcagcgttcggcgggggtcttccctacagaggaggctagggtggataagtggatggcctcttatctcccgaacccttggcgactgacgtgccgcgccgcgttttcgccattagt

SEQ ID NO: 30812 - DNA, 1050 bp, Oryza sativa
caacaaagacataaaaaaaattaattgtgtaatatatttacataggagcctttttggaaggaaattcgatatgaaatatatagcctctcattgtttgctcaacggttgataaaccatggaaaaatgaatgaagcaaccaaatataacttatagataaaactttcatagatgtattcttagcaattgaaaagcccatgttgaaaactaaactacaacaaagaaaatcctaaaatcatttctaaaattaacttccagaaaattaaattttgcatgtgacctgtggctgataagccaacgggtaaatgatggagctgatatatttttatttttgtgtttgaaaatgtttatgacaagttaacttgaatatttatatattttttaagtttcaatttgtttatgattgctatgtcacttaaagatttgtcaacctgctgccgatttaggtgttatatagacacacaacttgtcgacgtttgaggtcgcgactacggtatttgtatgtatggggatcctcggtaccaggttatatgcgagattgaggtaaaagagatggggacaaggatttttatacagattcgggctccttacctgtcaaataatagccctaaatcttgttggccaaagccggtgttgctctttattcatctagatcacacaagtacaatatttggaataacctatctagctgtcgtcgacttggcagcatggataaccaactcgtagtcgatgacggggtagtcttcctcctcgaatatgaactcatcgagatcagagatggtgctagatccctcttgctggcctccataggcaccggatgggggatgtctaggctaatctctgatggatctagcggtgtgtgttggcttctggcttatccctctcctcatatgtcacgcccagaaattcacgaaccagaatttctaagctgaatgtgtattaaacccctatccaggaccagccagggtacacaaacgacaattgttgacatacagatccacgtcttacaaaaatataaaagattacaaatgcagcggaaaagataaaacaagc

SEQ ID NO: 30813 - DNA, 347 bp, Oryza sativa
agaataaacttcaataaaaaaaacttaaaatcaactttaaattgaaggttgaaaattaaaattttggctgataagtacttcctccgtttcacgatgtaagtcattcttacattttccatatgtctatctagatttattaacataaatataaatgtgaaaaatattagaatgacttacattatgaaacggagggtgtataagtataagcgataagacgtggctgaacgaagctgaggtgggtccaattcttcaaaaagttttttttttcagggcctgttcttcaaataagttttcaagaggggtcaaaatgtcaaaatttcagcttcctcgacggctcgacgccatgg

SEQ ID NO: 30814 - DNA, 1501 bp, Oryza sativa
atcttcactggtccacgtagtagttcataacagaattaagaaaatcgatatttttttagtacaccacagtttttttcccctcatatctctgcctcatactaatccacaagttaaataaaacctggttatgctatgcctgaaggcttcccccccatagtcaagactcaaaaccacaaaccttatttactggtggattgtagaaggccaaagattatgtagaactaacatctaaacatttcttaatctgtttaacctgaactataaagaagacatcatgcaaagttgcatattcattgcatataaagccagaaatgggtggacatatttagaaaaaaggcaataacatacctactgttctgcggccttttcaccaaccacagaagaagatggtctccattttctatcaaaaggcccatagcttctctccacaatagtttgccgctcggttagtttcttatctattagctccagtaactcttgcaatcctgtccctgtcactgcagaagttttcacatgacaagtggacattggttgtgttgaactgcagctatctgtactaatagtttctggaccacaaagctctccaaaacaatcttttgatgatgatgatactgagttcattgctctcatctcactaggctcaagtgaggatgatatttcaccattgttgccttccaaattttcctctgataaatattcggagtctgttccatcatccaaggactcaaatgatgattcttctgcaggcacatcgttttcagaaaataattcttcctccttatcctcctcaccttcggtcaggaaaatctcatcttcaatatcatcagttacatcattatcattgttgtccacaatatcaatctgaagaaacaccataaaaaagtcaagttacatgaaaacccatgctaccaacaattcaccatgcaagtgtgacagtcacagccaaattaaatttcactactaaccttattccaaacttcgatcatactgttgattttatcctgtgaaacaccaatctgttgcaatacttgcagaacagtagaacgatgttcctcgatattaggagcactagaatctaatacatgctgcaccaatgcaaataaagagacatacaatcaactctatttctcttttttttattaagtaatttatcttaaaacaatttctgaaaagaaaatgtacatggctgaagaactatttgttattaaactagcaatggaaagattttagaagctgtcggagatatgggccgggggtatgcaaagtgaggggaagttaccttcccatccagccacgtggctctacagtctggccctaccccgcacctcgcgagtcgcagaagcggccggggcgcctcggggcgccacgtcatgcccctcgggctctcgcgttgccttgccccgaggccctcccccggctgccatgtggcgggggagcgagaggggaggaaacccaggctgaacagccatcaatgcgcggcgccccaactgtccctcactgc

SEQ ID NO: 30815 - DNA, 342 bp, Oryza sativa
ggaatttgcttgcaaagctgctgatgttgctgctgcttcaaacaacacatcagagaggtacggtatatattgtctgaatagtagtatatcttaatttcgtttcacttgattcaagattgttgcccatcggattatattagcgacattaatttgattattctcttctttgtatgatctgtagggtcactgattcaatggaaggctctagtaataaggatatgaatagctcaaagtggaagttgaacagtaatcaggcggcggagggtaattctaaggagaagaggaaaatgaagaagaggatgttcagaaagcaattttagtatggacgttcagaagaggtga

SEQ ID NO: 30816 - DNA, 199 bp, Oryza sativa
tcatctcacgcaaagataattcaaaggtggtaacaatggtatccaactttttcctacaactggtttttatttgtcactatcaaatcatcaatacaatcattttcacataacaggtaaagttccaaaggcatcttagattccaaggacactgattgacccaaaatctttcaaagttgataatgcaacactgttgcagtga

SEQ ID NO: 30817 - DNA, 1501 bp, Oryza sativa
tgcaaactatagcaatgtgttgcaaattatagcaaagtatttcttaagtgattctcgcaaattatggtaaatggtgagaacttccacactcgtcaataagaagaagaagaagaagtagaagaagcatgcgtgtctagagtgatcttttggggatgtaagaatttcttttatgaattttataagcacgaataaaatgttttatacagaattcacaagactcaaaatttttaaaaccaatgtttgttgtattttgaatgacaaactgccgagttagtctaataatactgataactaccatgaaaagaaatgaaagaaaacaaaacaaaaacgtaggccattctctattgtcctaaataattttaaaattcgtatccacttgtcacatgacagccctcatttgctgtcacctgtttatgagccaggtaacgagaccagctaactgatgcatatacctcaatcaacacaccaattcttagctcgaaaattatttttttaagcattttttagttctagtcagcaagctatgcttgagtgtgtgcagcacacaagcaacaatggtggtgtacttctactctgtttcctgcacacaaattaattaggtcagaaatggcttcctgaaaaagataaccagggagccccaggaatcaaattttccaggtcaagttacttgtgataactgaacactcaactgatgagctaagatttagtttgtttaataccaactgaataaaactttccttgcaaatgctgtttgtgtcactacaatcaaatcaggttattattcaggataaccaaccatccatccaaatagtaagtttttttgttgctttcttgaggacagaaattgcaatttcctcataattaaaagagaaattgcagggatttttcgtgaggagaaatattaaggtccttcctctttgtgccagcgcatttgccatggcaatgggacatgcaaatggcatttgccaagaaaacacttattcacaccctaaaattcttggcaatagaatatcaatcatatgtaatcatctgcccccacaaaaaaaatgcattgtacatgtattcctaattgtacaactatttattctggaacacttgatattaattattcaagccacccgatttaggagcaccatcttacaatgattgaagatacatttgtaatcatatttcctttgtacgtatgaagtgatcacagtgatctaggaatcatgcaatcacaatttcttacaaatatttcacaacataaagaatagtgttagttgcttttacactaataaaattcttataaacagtgacaccccctgagcatctatgtccaactacttctgctaaaacacaaaagtttagtaggctagctattgttttccaacgaatatacaaaatacatgcaaatattctcttaggtaagcagtgaagtacacgcatatatacacaatgacccttaaccacagatcatgaaaaatacaggaactaataaatacatgaaccaatcatgctt

SEQ ID NO: 30818 - DNA, 778 bp, Oryza sativa
cgagttagtttttttttctataatacactttcttaggaaatatatttttatggtatttactccctagataatagataatatgatcatacaaattatataaagacaaactaaagcgagtcaaagaaaggtaaataccactaaaaagaatattccatcccctgtttgtctttatcaaaaacctatcctttccgaaaacgaccaatggaaggaatctagctcccatggtttattatgtattgtgcctttgacaaccagctttccctatggtttagattcctatgaatctttcccattttttctaccgagtgcataaacttaaaaatagccacatcattcttgtgcaattcattcagctgtaagcaattgtatttatctgtttatgttcaagctcggttgcagctaatccgttctagctaaacgaacttggtatatgtaactactaggaaaaacacgtgatcaattatcaactactacagacttgaaaaaaattaatttatttgattaaaaaaactatatagaaagctttttacgaaatacactttttaagtagtttggaaagcatgttaacggtgaaaaaagagaattagcccacctaaacaatacttccaaacacagcctaactctcagtaaatagaaccagacgaagcgaatcaacaagaagttatttcataggtaaaaagtgaataaatcccaattaattaagccaatagatgaataatctagctagatttaatcatactatgagcctatttttcacggtgacattcctggcgacagg

SEQ ID NO: 30819 - DNA, 1501 bp, Oryza sativa
taatcttagtgctttgacagctgatgatttgagagtcaatgaacaggaatttggaataaccaaagcaaaaaaatgaaacattgtccatgtgaaactgtggccgcaaagttttctataggtgcaggattaggtaaatggtgtttatatggggtattttcattggcaatattgtgccattatggtgtaattaaatttttccatagtagcctttcacacagttaagaaaggtttaatcttacgttttgacccgtctattaattattaattataaatatatataaaacatgtctattaggacatattttaaactttccgaccgttggacgttattttaaacttctcaaccgttagttataaatatatggtattatatcatggtactccctcaaatattaaaaacatgtcgtttttgacacattttgaactttcagactgttgtacacattttaaactcctcgaccgttagttataaatatccggcatgtatggagtaacagagtaacgccttcaatctttaaaacacgtcgttttgcacaaagttccagaccttcctgtccgtttgtaataaatctccggtatgatactcatagcgctccatccactatcgaaaaacaaagttattttggacacactccaagctaaaaacatgaatatctaagcatcaatatcatgttaaatatccgttaccgtccacgaacaaaagaagtaacacattgcaatcaattcagctctacatccacaatatccataaaaaaacggtcggaaacataataacccacccacgaggtgaccgaataactaaaaaccgtttacggataaaataaccgcaacccaacccgatgattattagggcctgtttggtttccagggactttttccaagtccatgtcacatcggatgtttggatactaatttggagtattaaacatacactaattacaaaacacattccatatccttggactaattcacgagacgaatcttttgagtctaattatgtcatgattttgacaatgtgatgctacagtaaactttttataattatagattaattaggcttaaaaaattcgtctcgcggattagctctcatttatgaaattagtttttttattagtctatgtttaatactccaaattagcgtccaaacatccgatatgacatgggctaaaaagttttaaccccatctaaacacccccttagtagcaaggttgaagcacatgccactgcttgaaatttgaacaactgaactgcttaccagtacaaccctagaagaaaatgtgagtagaatggtaggcccaaaactgcaaagaatcgaaagtacaggggtgtattcttaaagtagcactcctcccccttttctttcatcccctaccctcccctctcctcccaatccccctggcctctgtcgggaagagcacccaaaccctcgcttccgccctcgcaaaccctagcgcccggaggaggaggaggtgggttgcggtggtagtttgccgtccgccga

SEQ ID NO: 30820 - DNA, 1501 bp, Oryza sativa
catcttatcttgataataagaacagatggaatttacaggttgtagctaactgattttcatttttaccctagagcaacaaagtgttctcaggcacaaagaacaacatacaagaaatagaatggtcatattcgacaagaatatcaaattgatactttcttcccttcctcctaattctatccaaattgttcgtcacaattgatcctctctgtgaaatgacaatcagtggtcactggtccagcatattggttccaaataggttcatatttctatcattcccaaggcattaagaaagattgcacaataaattggggactgtgtgtaagacctaacctggcgctctatggagcggagctcctcctggagcttggcgcgcttgctcatcagggcggagagcatcgctgtggggttcgcggccgccgcccccgagggcgcagagcctgacgctgccttgtgcgatgcccctcctccgcctcccgagtccatggttagggtttctagggttcgagttcgtggtttgcctgtttgggcgttcgttctgttttggctcggacacagttcactgttgtggagacgactagcccctcctctccaataatccgatcggtcctcttagccaaggtaatcaatatcgagatactaggtaggatcctttctcttcttgatttgatccttctcgatcggtttgatcccttctaatggagaaagattcttgtttgctgcaagtcacacctaagctgtcaaatgcacatgtgaaaatgtttagcaatcaatgcatacatacgcatgagtataacacagaaaaggttaatagagtatttagcagaaatttgtgtttcaatttttttttctgttgatggataaatttcactccaaataacattattggaatacatttctgcctataatctaagatgcacatgttttatgagcgatttgatcatgaccacaaacatgagataatgtccataccctagttaggtgcccatgtgttgcaatgggaaaagaacatttggctatgtacaatatgaataccctaatactccttcccgtcaggattatttgatccaaagtactgaggtatcccgcgccaaataatgactcgaggggcaacaaatgaaacatgcataacagttcaggaccttgagctgttgagcatatagaagaaacaaatgatacaacctatgtcacttattatctacaacacgttgacctctgtaataacagaatgacattatcaccatagatggtgaaacttccttgaaaaacacacaaaaacgaaatccagaacaaatgtggatcccctggcagtgatatcacacaaaacacataaaaaggaatgaaacctctctccctggcacagcaatcagcacaatcctttctttttcttgatttgcaaaccctttgcaggcaattttaaacattacgaattctgagtgcataacaaaaataaaaactacattattccactgtatgtaaacaaattagtgaaatgaatgaaata

SEQ ID NO: 30821 - DNA, 1501 bp, Oryza sativa
agggtttacgcaagcaaattccagacagaagcactcccggtgggagggagagattaatcatcagaaagaggatgtggatgctcaccaggatcccttgctcgccggatggagatcggcgcccctcccctcccctgttcagccgcgaagggcgcaagaagcggaggagacgacgagacgggagattttttttttctcttttacgcgaagggaagggggaagagatactcgagtactccacctttagctcagatttactatgttacccattatgtgtagcaggccaaatgggcggcccggcccatcacggcaaggggcccgctgatggcacggcaactgtaatgggccgtacggtgccagatcttgggcagaacggcccaaggaggtgttgggccgtgtcgggccggcacggctactgttgcatggaccggtggcccacccactagcacgataacgttattcgtgagaaactacagtcgcaagttttctatagtaggtaacacaattaggcaaaattgtgttttttttagatattggaatagaatccagcctttggtcaatgagctacaaccaattattacaccaattcatacaaataaaatcgcatggcaaaaaagttataaaaacacggtcctaaaaggtcaggaacacacaccaagtactaaaaaccaacgcaagaaaagatcacaaaattattgaattctatttgtgaatcttcatccaaagttggcaaaaagccgcataaccgttgactcaagattacgacatgtagcttttattaacttgatatcttcttcacacttttgcagttgtgctcaggaccgaagctagtgtgttgccctgaaaagaacctgcatataagatatagatggtgatttgtcaaaaaccatatcatttctattcaaccatagagcccaacatatagcggaagctcctaccaggataagtttactggttttttttttatcaatcccaacaagccaagcaaaattgtgtttataagggtatttttcattggcaatattgtgccattatagccgtgttaaaaattcgcataatttcctttggcacaactaagaaaggtttaaccttacgtcccgacccaagcattcgttgtagatatcctgaaacactaggttcggacctgttttacacttttcgaccgttggacacattttaaatttatcggccattagttataaatatatggtcttatatcatgttactccctcaaatattgaaaatatgttgatttggatacattttaaacttctcgacctttggacacattttgaacttctcgacctttagttataaatatctggtatgtacgagagcaatggttttaatttttaaaacacaccgttttgcacaagttccaaactcccaaacctcctatcaaagtgctccatccggtcttaaaaacaaaggtccggtttcccacacaaaaatgttacaccctttcacatcaaacgtttgaagtattaaatataagctaaaaata

SEQ ID NO: 30822 - DNA, 1501 bp, Oryza sativa
gggcgagtaccatgttcatcagcgcctggaatgtcgccggcgcgttcgtcaagccgaatggcatgaacaagaacttgaaatggccttggtgtgtgcggaatgccgtcttgttgacatcgtccgggtgcatgcgaacctgatggtacccgaaatggagatccagcttggagaagaagtgggcgtcgcaaagttcatcaagcaattcgtcgagaaccaaaatgggaaacatgtccttggcagtcaccgtgttgagggctcggtagtccacgtagaagcgccatggcttgtggaccaacagaaccgacgacgagaatggcgacgtgttggggcagatggagagcttgtcagcgcattatttctccaattcgtcgttttgaagctgtgggtagcgatacggtcgaaccactaccgggggcttgccgggcttgaggtggatgtgatgattgatggatcgggtcggtgggaggccggttggagcgcgaagaggtcgtcaaattccgccagcaaggacggaaggagatcgtcggcgtgcagtgcagcgcaggtggatgtgaatcggttgtcgaggataccatagagtgtgacccggcaaccgcaccagatcgccatgcgcatgttgacgaagtcccacaggattggtcccaatattcgtagccactgagtgcccaagatgatgtcgacgcagctgaggtcgagggcgaagcagtcgacgtcgaacacctcggtggccacctacaggcgaagcccgtgcacgacacccgcgccgcggatgcgatcgttgtcagccaccaccacgcggagaccttggcgtaccggttggagaggtaggccgatgcgctgggccagcttggtggtgatgaaattgtgtgttgaagccggagtcaacaagggccatcacctgctcggccgcgatacgcgccacgaggcacatcgtgctagtgccattgacaccgaaaatcgcgttgagcgagatgtgtggttcatcggtgtcgtctgtgtcgtcccattcgctgaaattagccgtggtgtcgtcgtactcaaggtagatcaggcgagtgcacttgtgacctaatgaacttctcgtcacatttataacagaggccttgtttacagcgctctggtaactctgctggcgagagacaacgaaattggtgtcctggtgtgtcagccgccgtggttggtgatgaggttgcgccagtcatcggagttgacgccggggcaggagcgcgcgacgcgttttgctggcccttccgttcgtaggcacgagccaaggccatggcctcctggaaatcctcgggctgttggagctcgacatcgatgcagatgtcgtcggtgagccccgctgtgaagagctgaacttgttggcggtcggtgaggaggtcggacgtgcggctacccaacgccaaaaggcgctgctggtacgtcgtcaccgtgccaacctgagtgagatgcttgagttcacccagggaattgttgcggatcggcggtccatactgaccgt

SEQ ID NO: 30823 - DNA, 1501 bp, Oryza sativa
gctgtccctgatcttctgtgggggcaagggtgtgtgttaatgtgtaggtagttatagccgatgacaaaggtgaaattttaaatggcgtgttaacatattgtactcgtgatgtgatcgcacgtattttttctcgatctatataaagaaatctagaacaattcggatagtgatatattagttaatgctatttagcaaaaaaaatcaattgatatttagttgaattaatttgctatatagacaaggtggtagtgttacaatgaagtttgaccaccaactgtcattgagtaaacactattctttaaaaaaggtgaaagttatctaggagagggatattgtcctttttatatcattctaacttcttccaggaaagttaccagtttgatgtgaactcgttatcaacgaatgtcaaaattaaagctaacactatcccagaatagttattctagtgctaaaaaggaaaaaatatattagacaactatgtgatcttctaggaaaacaaggaacaataaataactcattaaattgcataaccatatcacatatagtttattaatatctaaattggacttttcgattttataaaataacagttaagcataatctatgaactcgcttggttgtgctagctatgggcaataccaatagctaagccaagccaaatttcttctagcaataatagggcggctgcactagccggctagccctatatttttgctaatttttccttatgtctttttttttgcaaataaattacttaaattaaaggggtgttcgataatgttagatgtgattaatttacaacctacagctacagtaaaaacaagaggatctatggtggcagctgcagctacggctgtacaattgcaatgtagcatagccgaacatcctctttgtaattttattggcatccattcagttgataaagaccacagagtcatagtaacacagaggatcctagcaaaaatactcttcctctttctctcccctccagcgcagcttgcaagcctccacgacccaccatcatgtcatccgtggcttaatgacaccccttccataatcttctccattttgacacttatgcccctgccacctcactgcaaccatggtgtcatctgcaggggtagacatgtaaatctctcccaagttcagggtggctttctggccagcccattatatatcactctcatggcaaggtggctcctgtactactctgcccattgataggctgctggtgatcacaagctacacaacacatcacacaagcaataggcatctctctcttctttctctttctcctccttgcttcatgtaagcttcttcttctctagcttactttgatcatttccatggtttcatgcatgcatgtttagtttcatgatatatatgaaatatcctatggatttttgttctgtactttttttaagaaggggtttttgttatggattttttattgctgttggacagttggagtactagagattaatttcttgaaggagagaaa

SEQ ID NO: 30824 - DNA, 210 bp, Oryza sativa
tgcaaaaatactcttattagccaaagtactccgctctcaagtttatgcgccaaagcacaattcactatcttgaaatatccattctatgttcatctatggctatatatttcaaatgtctacattatctccaccatctttcatagctcagacgatagtaattcatattttgtacttagtacacaagttctaaaatccaaaggccttttatct

SEQ ID NO: 30825 - DNA, 191 bp, Oryza sativa
agacggagttgcaagccagcccgttccattgggtcacgacgcgcagcccacgtcagcacctaaaagtcttaaatgggcctgaacacttaaatgggccgaatttactttagcctcccttgtaaagcttttctctttttttttttttgagaatttcttgtaaaacattagatcttggctggatcacagcgaca

SEQ ID NO: 30826 - DNA, 483 bp, Oryza sativa
  unsure (1)..(483): unsure at all n locations
ttatagtgtcaacttctccttttgacttgccttgactaacgacaattgtcaaattttgccgttaacagtttcttacaatgatctagctcgagctacatcaggcttcttcgagtaaaacctaataggaagagaaatctatggttcatagttactgacttagttctaagcacgacttagtagatcaaacttaactgatgcatcactaagtatgaaaagaaacataatatctagacnacaagcctttgattgattttcagggtggtggataccttagttaatctaatctagcaagataatttaaccgataccagtataaaccctaaaatgaatctcagccgatatgatcaaattaagatgctaatctagattaactaagatatatgataaataggtaggtaaatatatcaaccgatccagagtgatccaagagggcgaagtgatgtaaccttgaacaacatcaatgtagctgatacaatctctagg

SEQ ID NO: 30827 - DNA, 351 bp, Oryza sativa
cggctttgatttaacaaaggatgaggttaagtcactgctacaaagcattaaggagacagcttacaccactgactgatcttttgatttgtagacatgtcaaaggtcaatgtagctagaggctgttataattttctttacttctggcctttttttttgttttaccagagaccaaaacaaagttgattattatactctatcaggcaaactgaaagattctgaagtgaataactaaagaatgcagtaaaatacatgtacaggagcagcgaaggccactataatacgaagtactagtacttaggtgcaacaactacagctgtacaagtgttctaaggtcggctttgccatcgagga

SEQ ID NO: 30828 - DNA, 433 bp, Oryza sativa
ttggcgactggtccatccaccggacaacagtttgatgaaaagcactgttatttagtggacgatattaattaggcagaagctcaattagggtgcaaaactgacggtgattgatccatgacagacagcctaaccggctaacccccaccattcttgacattgcaaagaccacgcaaccacgtcgagagaaatctgctagaggaatggctgtgcaacacacataacttgtgtgacacaggacaccatctgaaacgagtgtcaccatttccgaaaacaaaagaaaacgcccgcaagattgttgagcctgaagttctgaacacgacaaatcttttcttcttttttttctaaatggagaaatgctacacaattggtgttcctgaatgattgtgattatggaataactaatgactgctatactttatttaatcgctaagca

SEQ ID NO: 30829 - DNA, 371 bp, Oryza sativa
gacttgggttgttgttttgaacattctgtcttaatcgagtatgttttttgagcaggcaaacagcaggggagccagtcggcgttctagagctaagatacagaagaaatcacctcgatagagtatcataccaaaggttatcttgctctttggttttcattctttttggtaaaacaggctaacttgtagctgctttcttagcaactccacagaatgtgtaatttctttaggtctccttcaaatgaaggtatatatgcgtatatatatgtacttgccgatttgacggcagtaacagaatgactgcgaattcactgttggtgtcatctgtggactgattagaagatgaccattgtttgcttcccatcctcgatggc

SEQ ID NO: 30830 - DNA, 1455 bp, Oryza sativa
gagttttgttggaaaaaatcgctccaacagtagacctaaatcacccctaaaagcttggcgtttccaaacccgcatatttcgttctccacttgtagggaagagactcggcgcccaatccttcaaccgcatgcacttcgcgcgcgctgtgtgaaaattttcctaccaggttcttctttgtgcgttcgtctacctgtgagtcaatccatcacgccagcagcctcatcttccccgcagctgtctgggaaagcagccatggctcccccaagcttccccagcgtcgacatttttttctcagcggcagcgccagacccatctccaacccaattgggcggaccttcgtcggcgctcccccagcaccaccaccgactcgaatcggccgtcgcccctattcatctccaatcgtccctcgaccctaccgcatcctgcagcacagcctgtctctcgcgtcagactggcgctgcgctccccccggtaatgtgcaggcgacaaaggccccatgcgatgcgaccagcagccggcgacaaccggaggtgcccagtcgctggccttcatcgaatcatcgtgcacctcggtcggagtcgatttctgattgttgctgctgctcaaatctggagcttgctattgctgagaactgcttggtggtggtactggaaatttgttgtttgctggctgatgaaaactgttgttctttgctgctaaaaactgctgcttgctagtactgaaaagtactattgcagctgctgaaatatcttgctgcttgctgctgaaaacttcaagttgttaacaccgttcacactaaaaaagctgaaattttttttctgggctgaaaaccccattgttgatgattgcagaaccaatatttttccatgtaaaatacaggagatcgtggtaataatcaagtgaaatatcattttggggcaaatactcagatcgtacctgaagccaatggaaacattgttcaatgcttaaactgtcagttatgatgtcaaagagattgatcactgaatgtcctgaaaggagccgtgaggaggatgcagcattgcagcgtgcgcgagcgtgagtggaggagaggaatgacgattctgttggtagttgtcgatgtggcctactttttttgttttgaggattaaattttgggaatctcttggagataaaaggtattctcataccttaaatcctttttagagatctaaaaaaaatgatttaggggattgaattttgggtggctgttggtgatgctctaagttgcacatcctggggaaaaacctccctaatccatcagcaaaccgatcaaccacccacgacaagtcgacgccaccgttttttttttctccctcctaagtcctaaccccacaaaaatcccgcgaactttcgtctcaccacgcgccgcgtgccccctacaaataccaaacaacacccaccacgttcactcacaaaccacgcaggaaacctcag

SEQ ID NO: 30831 - DNA, 1398 bp, Oryza sativa
ggtcgaaagaaccctcccctccccccatgctgactccgccactgcgtagacacagcaagatcacaacatcgtgatttccccgacacgttttcaagttaaagtgcgcatcctgacccatcaaccatgggtcacctaggtcacagtcacattagatctgttccaccacaggtccaaccggagttataactttagattctaggcctatacaacccaaaagactagtctgatggatgagcatcattcctatcttttaagtcgtgtttctctatcgtcaattatcgatgtgggattacacccaacaccgtcgacggcgaaggccacgtcgtcgcggaagcgagacggcagaccgcccggcgggtggccgcgcctgcagcagcatatgcagcgttcggggatgcctggatggctgggtttgagttgggctagtcacctagtttcaccgtgggcccaattcggttgggatcccatcccacggcggaagcccaagtcgagccgagccgcatgggcggcgccgctgcccaccaccgcaccaggccaccaccacaacacctcggtggctcggtgcgcacgcactcgcgcttgcggccacgcgcgatgcgacgcgacccgactttttcccccctgcgcgtacgcgtgatggcgcgtgaggacggagaagatgagacgggaggaggaggaggaagagaaggggcccatccattccatcgcccgacgcggcccgctgcggagaagaggaggtatcgaagccatagctctctcccgtctcctctcctctcctctcctcccctcctccgccgatggggaggattccttccattccatccgcgcatccgctgcctccgcggaatccgagttccgcgtactgcgctgatctccggcatcggatttcggagagggtggggtgttctctccgctcggggttgttccactcggttctgaactgggagtgtgagtgtgcagggcaaggttgttgggatttcacgtcgggtagagactaccgcgactgtcctagttatgtcagtgccgttgtatttttatacaaagcggtagatctggtggaaggatatgaactgttgcagataattgttgattctgatttgtactggtgtgacatgtgcccccatgtgttcaacttgtgtagtacatgttttctgatgcttggattgtttattcagtctggaattctacttatgtttttctgatttgtacttgctgagtatctgtgcttctagaattacctcccatacaaaaattaaatttggagctctggtttattttggtactagtagcttgttgatggacctcttatttatatctaaactaattgaccgcatcttgtattgaactagtagtttctgatgcttcagatcggattgtactctacatgataagaaagta

SEQ ID NO: 30832 - DNA, 168 bp, Oryza sativa
ccaatctaatagctcattcatacaatagtcacatactacacaattaatatctggtcccatctgtcatacacacattacgtcttagagtccgtgctacagctggctacaaatctagagccccgctacccttacctctcctcatttatcttcttaaaatatatttacagc

SEQ ID NO: 30833 - DNA, 172 bp, Oryza sativa
cccaccggacctaagggaggcaaaatagacttttcgagaaggattgatattagggatttgaatttgacgatggattggggatttgagatttggaattggcacggagactgacaacaagcaaagaaacaattttcgcaattagggtttttagaatttaaattttcccgctagg

SEQ ID NO: 30834 - DNA, 230 bp, Oryza sativa
tcctgcggccctttggtgggatgtaatacatcgtaatacgataaatttggactgactatttgtccagattcgtggtactagtatatgtcttatctaaccaaaactctttataggttaggacgaaggaaataaattcttatattttggtacggatgaagtacattttaacaatggcttataattgaatctaactctgatgacacatacaaacgctgttttttttttccagc

SEQ ID NO: 30835 - DNA, 477 bp, Oryza sativa
agattgactatgaaccgagtagggagatggcattgggcccggttcacctattagggcccagcatcctaattacgatgaattttggtactaagttcacttttgatccctcatttgagatcgagtttcaaacacatccctaaattgcaataccagaaatcttaacatctaacttataaaaccgagttaaagtaggtacttcgacagtatctatggctggtttcgctaacgtggcaagttgacccggtccactcgtgctgaccaagcgcttatttggcaaaaataaaagtgagccccacatgtcatctacaatctactcacctccccccctacctctcctctttctctccatctctccccctcattcctctggagttcgatgcatcaagtgttctggcaaggaacagcgcccagcgggtaggaatgacttggggatggttaggagatgcgatgtggtggtggcggctgccatcgcaacca

SEQ ID NO: 30836 - DNA, 382 bp, Oryza sativa
tagggttagggaattgcacgaatcttaaaacgatatattgggctatccaaagttttactaattttttcttgttttcaggcaactaaacaacacacagccccttaagatttgtatttttaaggctacaattttaagatgtaaatgacacacgatcatacatcactcttagataacacgccaaggccaccacctctttactacatctacctcctcctcgatctacttaactgagaacctctaggaatagtgggacgcatgaggacaagttacctacctgcctagcacaagtaacctgatgctagtcttaggttcgatgaggattgcacctttagagcagggttttaattgggatgaaaattttagtgatttgaggggggggtca

SEQ ID NO: 30837 - DNA, 472 bp, Oryza sativa
cccaatcgtttaattgggatacatactcatgataaacgagacgtggccattccaagaagcactttagaacttagccttaaactcttttcaaagctcaatattttgataagcacctagtaaaaatgtggaaaagatggtgttttatagctcctggtttctaatttattttatataatcaagaactactaattcttatatttcatatgagaaataatttttttttcgcgaacgcgcaaaaggattgcacgtcaatatattagacgaaaagagttttagttacaccacacaatcagacagaccagcttatgctaggggaagggagaaaaagcaaaataaagaattgaagctagagaaactacggcggctaagaacaaactccaagcagcgggaagaggcctagccgcgctacactcccaacaagtccccaaaaacggcaacgccagctaaaaccacatatggctctccgaacgaa

SEQ ID NO: 30838 - DNA, 437 bp, Oryza sativa
ccagtcgatatcaatctcgttcatagaaatggtgggcaaaaattctgcagtagaaacagaggcaacccaaatacataaggcttagtgtagctgcaattttgcatatacatatataagaattaagaaatcttgtcttatatattttgtcgactcctagccttaatagattccatacgatattgtatggataattaagaactgattcgatttttacaaattgtcatgtaactggaagtgaagaaacagcaatattgtactgtcaaaagtaaagcatacctggcatttttccattatcttaatcatggtgatgatgcatatggttgggttggccggtcgcacggggatgatggattaagagtcttagaagctgacgatggtatattttgaggacttaaaaaaggcttaagaagatactcccgactgcttgttgctggcga

SEQ ID NO: 30839 - DNA, 266 bp, Oryza sativa
caacctggcttcaggctgcataaaaaataatgtgctacacttgcaaacattacgttgcttaaatcttctttttactcttctctttagaattattgctttcagcaacttgtcttattcagagttcaggctagtgtaaaaacaatggccttgataggagttctgatggagttggacaactgcagattttacacaatatcatatcaaaccttttaggatttcggaattttcacctttgcttgcagtttataccagcagttaatataaac

SEQ ID NO: 30840 - DNA, 1501 bp, Oryza sativa
gaactcatacaattcgcaatggaaaactcaaaattgtgatcagacacgatagggttttatgtacgcatgttcataagaatgagtatgtgtgcgctttaatgtgtaattaaaaaaaatgtgcaaccgaagcaaatagaaaaggataagggccccattgaattacaggaatgaaaaaacggagaaataggaaaaacataggattctgacaggaatgcaagtgtaaaacagaggaaatcaaaacacaggaaaaacatatgaatgattgtttgattgggccgcaggaaaaacacaggaatttaaggagagataaagactcaaagtattctttccatgaggttctacctcatgttaaatttcctgcaaaacttgcataggaaaagacaatccataggaatttcataggattccataggatccattcctttgattcaaagggctatataggaaaaaatcctataggaataaaattctctgaaattcaggctgtgtttagttcagcgtaaagtttggattttggttgaaattggagatgatgtgactgaaaagttgtgtatgacagattgatgtgatggaaaaggactaaagtttggatccaaactttggatctaaacacagcctcatatgaatttcttttgaatcaaaggggcctgaacctatggatgtgatgccaatagggcaataggagtaaatggtgatgtggtatcgcattactcccatccgctcgtgccggcgactcggcgagtgcttagcttgttcgttgccagatcggtgtgtgcgtgcgtgcatgtgcaatcatgcaccggccgccgccgcttcaccgacaccggccggccactggtaatccgccattccggcagccgctccggtggtccgtaacatggccgcggccacctccaatccggatcgggctccaatgcttcaatttgtttggtttgtgaaggattggaggccgctccaggttttatcaaggttttgggggaaaaaagaacggcaatgtgtaagttccaaaattatatagtaattacattacatgtgtaagtggggtgtaaatttgtataaagtatagtatgcatgcgtgtaaaaccttgaactaatgaagacgttaagttttaattaatcatgttgacagccgtaacgttagcctgccatagcaatatgcacggacatgattgcattggcacgggacaaaggaaatcgaacgcttcaaaacaccgactgtgatggaggagaaaatgtgtcgacataattatagcgattccgtaaatttgttactccctccgtctcttaatataagggattttgacattttgcttgcactatttgaccactcatcttatccaaaacgatatatacgaaggctccaaattcatgaaatttactccgaataaaacgaggcaaccgcatcttctctcccccggatctctcaattaattccacgagtgtgaacacacaacactgacacacaccacccaaaaccctagcgccgccggccacgccgcca

SEQ ID NO: 30841 - DNA, 1501 bp, Oryza sativa
ttcattctatttatttgatattagatcattctctaatattcacttttttttaaccatgtgtgtggtgggctggtgtcgttgctacgtaccttgaagatcacgagaccagagcctacatcagagattaattaggaggtggaaggggaagtgctgaaaagggtttccctcgcggctcattgcatcctgcgttatgtcggtgcgtgacggtagtatgcggtcgtgagaagagatcgtgagagctcatgctgataatagggtaactgataaattgggctattgaatgtgtcaactcataatatatagagtagatagtgtgattatgcatatattatttcataggatagtccgcatctattgaattttagggataccatattcgtattcatatcatattatttgaatccgtatccatattcgctaaaatttttataaacccatactataccgtcattttggacagactcaacgcagaactaacatacgatccgttattaccctaggaggagatgtgacgacgtgtgttctaagggcaaacgaatcctggccgttggttcgatggttgtattgatagatgcttcagcttcacgttcgttttctttcgtgtcagtgaagctgttactgtcgtgttagctagactttgttctacgctgaactgctgatcagctgatcagcacagcttcactgattagctgggctttgtcgagcaatgtgggataaacttgcaccgcatttagttctaaacttttttttcaaacttctaattttttcatcacatcaaacctttactacacacataaactttcaatttttccatcacatcgtttcaatttcaaccaaatttttaattttagcatagactaaccacagctttggtattacgagtgtgacttgactaagcaaagcaaagcatagcaaagcgacgagcgaaagggaaaagaagttaggacgcggactccaccaaacaggaaattaacaggaacggagttggggattatggctgatgaggttcggtattctttttgtagtaatggtatttctttggcttttttttttgtgtgtttcttttgggacgcaaagctctcgctcgcggggagcttagtgtgtaagcaacatgccgcgttgattgcgccttcttttcccttgggaaaaagaggccgaatcgtcgtcttctttcgcttgctttttggcaaggatgctggattgctggccacctcacttcgaaataataaaaacaaagtaggagtagtaaggtagacggtaaaaaaaaaaaaagaaaagaaacttcgacgcacatctggccatgtgaaacaaagaagaaataaaagcaaaaaattccgttgccgggactcgaacccgggtctctcgggtgagagccgagtatcctaaccagctagactacaacggatgctggtatctattcctgcattatacaaattaaccatggcctgatctgatccaaaccataaacacgggtcgggccgtacatccagctgatgcatta

SEQ ID NO: 30842 - DNA, 1501 bp, Oryza sativa
attaaaacctttttttccctgataatacataaaatatatatgtacctatgcgcacacaccactgcaaacatcacgctatgcaatttttttcctaaagaaaacatgtatattactataacaaaacttatagttatcgatctcactttatttgactcccccctttgggcgaaaatgagtttcgacagtggcaggaatttcgaattcaaataaatttttgaggaaaaaaaaatggcattcacccaaccaaaatgctaagtgcacaccctcatcagttcatctacctctctccttcactttactctctctctctctctctctctctctctctctctgctcccgccggaggcaacggcggcggacgtgctcctctcctcccccgatcgccggcgagcgggttcgccgggggcggcgacgcggccggctcatcccaccggcgcccccacctcgcggcccgattcgaaattttgaaggtagtattcgttctcgcctcgcttagccctccccccttctcctgtggccgcttcacgagccggcgtggcgcgtagattggggatccatccggtgattgaatcttcccccaaggagattggatgggatttgtttggaagggaatagttccacgcgtagtgaggtgtggtcctcctagggattaaccgaacaaagcccttggtttgattccggatttcttcgctgcttggtgcagtactgacattgaggggacttgttttgctagcagtttgtttgcaaaaataattggggattcagttgaaaccccatgcccccacattaagcggatatttgcttcattacctgcaagagtggtcaattatgtagtgttacagggaaattggtctgtagggctataggcacagactgttagctatctactttggctgaatttggtcaggtttctgcacttcctaggttgatcgtaacattgttgttactagtctcactagtgttatgcagggggtatgattagtttataatttctaggtgttcctgtcaagcttaagaatatcgaatatgcgcttatattttataatctaaagttttactggtattggttgtcgtaggcctttagcatgtgtagatagtgattgattgaagaatgcaaaagttcagacgacttccacctgttctgctgcagcttgtttgatcactatcatgcatccctgttggctttcgtatggattgcgtttgccctctgaaactaggaagcttaatgtgtgttacgctgttactgtttgagtagttggataatgaatcccatggtagcactatttgcactccggtttagacatagtgattaaaatggaatttctccaaaactagatctggcccattgcaataagtagaattcacattgaacattaaaactttgcagctaagtttgactatgggacatgtctaatgtatcttctaccctttatctgctttaccatgcaggtggcactttcagattgcctatgctagttcatttcacgctgcatatccaaaa

SEQ ID NO: 30843 - DNA, 727 bp, Oryza sativa
gtcatctattaaaaaacggaaggagtatttaatatgttcgtttgtatctgtttagttagaatttacaattttgggcatcgtgatcatgtcgacgtgctggtttgacctttggtaggaaatggcacacatgttgttttgttcaaagaaactcaaaacggatcaagtatagatgtgccttttgttgttctagctgattctttttttttcaattataaagcttcaaaagtatattttgtgatgcgttcaagacatttgcacgacctatattatatatacctgcatgttgtattatattctaaacacatagtatgccctgtttggctcgatattgaaaaactatcatgatggacagtatgctataggagacatggggaaatgtaaaaagaaaaaaaagaattaaaaaaaaggtgaacgcatatgatctgatgatccgtatatatgcatttgtcggacctgcatttaccgttcttggagatgctcttgttcattggccttgtctgtttgagttccatataaatgtatctggaacaaattctgttgtctcacattctgcttgattttgaaatccattgaattctgcttctggctgatacttatgaggtcaggcagtaaatgatcaataaaccattatcatcactgatttgttactatcctaatctgtgcattttgtgcaagtttcagatgaactccatgtcatacaacaagctgtccataacgaatgacagaa

SEQ ID NO: 30844 - DNA, 1501 bp, Oryza sativa
ggatctaaacaagacctaggcttaaaaatataactaattatatagattacgtgtaaattgcgagataaatcttttaagcttaattgctccatgatttgataatatggtgctacagtagacatttgctaatgacggattaattatgcttaataaattcatctcatatgctaattagcacacgtttactgtatcatcacataggctaattatagattaatcaggctcaataaattcgtctcgcaaattagtgtagggttatagaataagctttataattagtctatatttaatacttctaattagtgtctaagaccctgtttagttctaatttttttcccaaaaacatcacattgaatttttagactcatacacggagtattaaatatagatcaatttaaaaactaattgtgcagttagggaagaaatcatgagacaaatttttttagcctaattagtccatgattagccgtaagtgtcacagtaatctacatatgctaatgacggattaattagtctcaaaagattcgtctcgcggtttccaggcaagttatgaaattagttttttcattcgtatccaaaaactccttccgacttccggtcgtctgatgtgatacccaaaaatttccttttcgcgaactaaacaggccctaaacatcaaatgtgacatgtaagatcaaatttaatcgttgatccaaacaggcacttggggacggagggtgtagtaaaaatctcctgcgatattgctgacacctagtcaaatcagtcaccacttgcgcggagctgaagagccggctcgttcctctccttcccgttcacatttcaaaacctcaaagcccccacaaacttcggaatcgaggtgagcgggagttcggagagatcaacccgagggccgccggccgatggcgatagatcagcccatcaaagcaagttctttcctctccctctctatctgtatctctcgtttctcgattaaacccagtttttttgggggtcatttgcttcgcttattcactgttcatccggttgattagagaccgagggttctttgatttgttccactctctcttgaatcatcgattaatggcggcggatttgggggctaaaagtttttgtcttttgtgttagatttcatcttcttagctgcttttcttgttttgattcttcgatccgagtgggagactgaagagagtgttctgtgtgtgtgagagagagacgtgttcttgaaaatttccccatgctttttttttcggatgacggagtgatctgatatttcagctatgttatatggttatctgtgatcttcttggagattttgcttcctctttgatcaatttggttgtactgctcgttcttggatacgatttttgttttctgtttaatgactgaaatattggtgtttacttccatgggtaatctgaatctaattcgcttgtcctttggttggttgttcttgagcagaagagagggagaccaccaggttccaagaacacgaagaacaaga

SEQ ID NO: 30845 - DNA, 1501 bp, Oryza sativa
ggaatcgctataattatgtcgacacattttctcctccatcacagtcggtgttttgaagcgttcgatttcctttgtcccgtgccaatgcaatcatgtccgtgcatattgctatggcaggctaacgttacggctgtcaacatgattaattaaaacttaacgtcttcattagttcaaggttttacacgcatgcatactatactttatacaaatttacaccccacttacacatgtaatgtaattactatataattttggaacttacacattgccgttcttttttcccccaaaaccttgataaaacctggagcggcctccaatccttcacaaaccaaacaaattgaagcattggagcccgatccggattggaggtggccgcggccatgttacggaccaccggagcggctgccggaatggcggattaccagtggccggccggtgtcggtgaagcggcggcggccggtgcatgattgcacatgcacgcacgcacacaccgatctggcaacgaacaagctaagcactcgccgagtcgccggcacgagcggatgggagtaatgcgataccacatcaccatttactcctattgccctattggcatcacatccataggttcaggcccctttgattcaaaagaaattcatatgaggctgtgtttagatccaaagtttggatccaaactttagtccttttccatcacatcaatctgtcatacacaacttttcagtcacatcatctccaatttcaaccaaaatccaaactttacgctgaactaaacacagcctgaatttcagagaattttattcctataggattttttcctatatagccctttgaatcaaaggaatggatcctatggaatcctatgaaattcctatggattgtcttttcctatgcaagttttgcaggaaatttaacatgaggtagaacctcatggaaagaatactttgagtctttatctctccttaaattcctgtgtttttcctgcggcccaatcaaacaatcattcatatgtttttcctgtgttttgatttcctctgttttacacttgcattcctgtcagaatcctatgtttttcctatttctccgttttttcattcctgtaattcaatggggcccttatccttttctatttgcttcggttgcacattttttttaattacacattaaagcgcacacatactcattcttatgaacatgcgtacataaaaccctatcgtgtctgatcacaattttgagttttccattgcgaattgtatgagttcccttcgtagtttaaaatcggtgtgtaaatgactaaatgcacaccaaatccagtcgacacacccaaaacttggcaatatgaaaatcaccgaaattacaaaaaaaaaaggtgaattccgaagcaaagagtggccagtgtgaaactaactcagcgaacactctcctcacagctataaattctatgcttcacttgtctcgcttttgctccacttacaccaacagagatttgcgagtagattttgca

SEQ ID NO: 30846 - DNA, 1501 bp, Oryza sativa
ctcgacaaagcccagctaatcagtgaagctgtgctgatcagctgatcagcagttcagcgtagaacaaagtctagctaacacgacagtaacagcttcactgacacgaaagaaaacgaacgtgaagctgaagcatctatcaatacaaccatcgaaccaacggccaggattcgtttgcccttagaacacacgtcgtcacatctcctcctagggtaataacggatcgtatgttagttctgcgttgagtctgtccaaaatgacggtatagtatgggtttataaaaattttagcgaatatggatacggattcaaataatatgatatgaatacgaatatggtatccctaaaattcaatagatgcggactatcctatgaaataatatatgcataatcacactatctactctatatattatgagttgacacattcaatagcccaatttatcagttaccctattatcagcatgagctctcacgatctcttctcacgaccgcatactaccgtcacgcaccgacataacgcaggatgcaatgagccgcgagggaaacccttttcagcacttccccttccacctcctaattaatctctgatgtaggctctggtctcgtgatcttcaaggtacgtagcaacgacaccagcccaccacacacatggttaaaaaaaagtgaatattagagaatgatctaatatcaaataaatagaatgaatgaggcttcgaactttggtcggctaacccaccaccatgtggagctagccaaaagaccctaagcacttctcccaccacacaatggggttcacatcgtctgctgttgaggcttacggcaaacattgccattgcattcatccgtgccacacatccttctatcaacggctgtatgcagtgatcccaccatgattaattagggcctactaatcagcataattactaatttctcttttttaaaaaaaatcagaaaacagaatatgcacttggcggcaaagcgtgtgagaacaaaagtagagtagactgttttttttaagatttgataaattctatttttttaacttatatcagtctatacatttgtagggtgattcaaatggttgtgagttgtattctcaaggattttgttagtagcttcatttcgctgctagtttttggataaaaaatactctgtatggacatagtagtagtgcggcaatgctatttttgtcaaatgaatacttaaatagtattttataagatatgtactattgttcgaggatttggatagctctcagtataatagaagcttgctttgctgcagtattttgctctgctctgcttctatgcttgattgctcgcacgctttgccgccgagtgcgtattctatttgctgatttttttttcaaaagagaaataagtaattctgcttattagtagttcataattaatcacaatagtgggatcacttcatgcagctgttgatagaagaatgtgtggcacggatgaatacaacggcaaaatgtttgccgttagcctcaa

SEQ ID NO: 30847 - DNA, 1501 bp, Oryza sativa
gattaggcccccatctttttctctattcatcatcagccaatgccaaaatttaaattttaaagcttaattttgaagatgaatttgaagtttcttcatcaaagtttattttttagcattggcatttaagtcgctaagaacatatatataaaaattttaccaacaatttactgtattattattttgctaatatgccatatggcatattatccgtattatccttaggttctgcgaagacaaatggttgggaaatgtaaccctgcgagaacagtactcgttcctctacaacattgtcaggcacaaacatgcaactatcgaagatgtctttcaaaatggatatcccaattttcatggagaagggatcaaattggatcgaagttagtcacatggaacaccttatcaccacacatcgctaatattggtttaatttaggagcaagatgagtttccatggaagatgacccctaatggacagctccatatggagtctcattatcatctctagtttatagtgacatctcgaatataaatagacgcccttggaaactaaatatgccattgaaggttaagattttcctttggtaccttcatcgtaaagttgtgttaacccaagacaatctagctaaacataattagcaaggcgatcaaaactgttgtttatgtaataataaggatacaattaaacacattttctttgaatgcctcttagcccatttagtttggtccatcatttttgtggcgtcaagaattactccacccgatagtgtttcacaagtggtcactagttggctttcgggttttcaaaaagatatgtaaccatatgtcctgttaggggcgactgccacatgctagttgctttggttacgtaagaactatatagtttttgatagaaaagttatttatcacacatacatgtcatatttgtaactatccattggatgcacacctaggttattcttaaaaagccgagctcgtgggatttggttattgcgacgtgtctacacttggagcgggtggtcaatgagtgttttaactagggacataggtggtgatctagtcttaggatgatggtccttgatgcttcttgtacttaatttcttttaaattggttcatatgtgtttagttgtgtggatccttgggatgcagaggctgggagtgttacttagcgtagtaatatcaccttgatataattgaccgagttcaataaaagattccattgtcaaaaaaaagcaaccagttaccatgactatgcacccgacacctggcttctcgctaatgacatgtgattgggagaaatgcgtggtggcccaaagacttggcacatatgcatgcaaccaactaatttttgaccacaaagctcctgcggtcctaggccatcgccttacactatttaaagcaatcacatcccactttcataatagcaagcagctcatcaacctaggttagctacttcttgttgcattgaatcatccatcatcaaatcattgggatatatattccacga

SEQ ID NO: 30848 - DNA, 1501 bp, Oryza sativa
cttgatccatgctatatagtactatatgacaataattcaacaaaacaattgtcatatcccgtatggtttatgaatgcctgaacttttcttgatttggtaggagttaaattgctctccatatgtattaactgacggtaaacaactgctagctccatccgttctcaaatgtgaacatttctaatatttttttgcccccttcagcttcagaatcctgacgaaacaaaagaaacataactacttgctagctaccagcacaacgtctaaggctctgttcttttggttgagttgggaacccatccctccggtacggaaaacgaagcagtccattagcacgtgattaattaattatttgctaatttttttttcaaaaatggatcaatataatttttttaagcaactttcgtatataaactttttgcaaaaaacacaccgtttagcagtttgaaaagcgtgcgcgcggaaaatgagatgggggagttgggaactccaggaaacgaacagagcctaagactagtcttctgctatactctgttcttaacttataaatacaggcctcctagaacatttcccctcctctcaggtggccaggatattttttttcttggcctctctctcctgccatcttcacattgacccaaaatgtagtgcatcccctggaaaagctatacctcccccgtatcagcttccaacttagtacatccctcctctcatcctcaccaatgttttcactgctgctctgatcatcagcaagaaaaccaatcccactgttctatcagcttcttctccccctgagatggcttctgcaaacaactggctgggcttctcgctctccggccaagagaatccgcagcctcaccaggatagctcgcctccggcagccatcgacgtctccggcgccggcgacttctatggcctgccgacgtcgcagccgacggcggccgacgcgcacctcggcgtggcggggcatcatcacaacgcctcgtatggcatcatggaggccttcaataggggagctcaagaggcacaaggtatgcatgcacgcgtgtgtctctcgttttctagtagtacatggagtgatgggtgtttgatcttgatatttgatgttaacgcagattggaacatgagggggctggactacaacggcggcgcctcggagctgtcgatgctcgtcggctccagcggcggcaagagggcggcggcggtggaggagaccgagccgaagctggaggacttcctcggcggcaactcgttcgtctccgagcaagatcatcacgcggcggggggcttcctcttctccggcgtcccgatggccagcagcaccaacagcaacagcgggagcaacactatggagctctccatgatcaagacctggctccggaacaacggccaggtgcccgccggccaccagccgcagcagcagcagccggcggccgcggccgccgccgcgcagcagcaggcgcacgaggcggcggagatgagcaccgacgcgagcgcgagcagc

SEQ ID NO: 30849 - DNA, 166 bp, Oryza sativa
cacaagcagagagacattatcacaatttaaagaaagggtagagttgtaccaagttcaacaatacaagcattacaagttcatcaatactagatggtggcatttatactaatttgactgagggaccacatgtcagttgattttcgcgggtaaacgggcgaagcgggca

SEQ ID NO: 30850 - DNA, 188 bp, Oryza sativa
gtataaaagtagagtcaggtatgagctctacgctatttagaggctagcatcatactccctccgtttcgaaatatttgacgccgttgactttttagcacaggtttgaccgttcgtctttgtcgacgtttgatgttgcaatcctggtatttcatagtatggggatcgttggtgctaggatatatgcgaga

SEQ ID NO: 30851 - DNA, 1123 bp, Oryza sativa
attgaaagtatgtgtatgattttttctagattttttggtgacattttttagttggtgtgcacgtgtgtacacgtgagggcctgtgtgcataggatatgttgccctattagatagagccatcccagtgacattctccttacttttcgaaggaattcgtcactcttcagcatggagtgccatttgaagaagatctcggctggagtacaaatatgttatttacttacactgcttgtcctgtggatggagttgtttgagttaaaacaactataggatgtttggaggtccattgaaattatcataggttatttggaggccagagcttgttaagctaaccttgtagaactctggagatctctaagtagaatgttgagcagattagctgtttattattccgtgccatgagattagttccaaatgttcatccttcagtaaatagaagcacgaaattttatctggatttattgctgtaacttgcattgaagtaatcatgtttggaagtaagaactcctatcatatccttctcttagccttttcatttcagttgttctcttgatgtcatcatgctagtaattaatttagcttgtttcaaacacagcttgtagtttgttatatcctagagaagtacatgttagttaatccttcagagttagtatagtgatagataatgttcatatgatagtatgtaagtgaacatcagtgctcaggcttatcagttgttttgtgtgcatttcccattgtgaaggtcagaccatgttacatgaaatcttccattcacatgcaccatcatgtgttcaatgttggtcgtgattgttatcatattgaaactagatttgttgatttattttttgggggtaatgctgactagctgagacaatatgggaaaattatcacctcatgtcatgtttcaatttttaatatgatagccatagttatgagtacaagcatcttctcctttttcatatggttctgtttatattacagtccacatcagcaagcattttctttccatatgtgatttgtctttagccttaagcaaaaaatatgcactggttcagtggtttatccaccttttacgcttttgtgctagcattgaaataatgtctatctttaattaattttcagg

SEQ ID NO: 30852 - DNA, 1501 bp, Oryza sativa
cctcctcgccggctcgtcgtctcgcggcgccgcctccgtcgtcggcatcgcagcggcgtgttccgcgccgtcctcgtctccgtgcagccgctgccggctgccctcgtcgctttctcgccggccccggtcgtcgtcgtcgtcgccctctcgtcgttcctggtcgtcgtggcgttcgtccctccgtccagccgttctcgttcgtcgtcctcgcttcgtcaagtgccgcagccccatcatcgtcttcgtcctcgcctccgcgtcgtcaagcctcgtgccggccgtgtctcgccttcgttcaaggatcgccgccgaagtcgttccctcgccgtccgtctccgccgcacccgttcgtcgttgtctttcccacgccttgtcgcgtggtggtaaggatctctcctctcgctgccccgtcctcgtcctttcggtgtcgccccgtacccgttgtgcggttgtcgaccccggtacctgtgtaccggtgtcggtagtcgttcacgtgtgcgggtggtgaccgtgtagtgtccgtgttagtgtgtccgctcagtagccgcgtggtttccatgtgtgcagcccgtgtggtgtctagtggagtccgtttgtcggccactcgcctcggttgacacacggggtccgcttccgtcgacccgtggaccgtctctgtgtactcggtctaccgcggtcctttaggttgacatgtggggtccgcatgtcaacagcgcagccttcctgtcttttccaggctagcgcttccatatgttttatagttgcaaagcttaattataataatccgcaaatctccatataacagcattaaacttcggatgatcatatcttggtcatacgagctccgaatcgacccgttcaagtctcttaatgtttgttataacctaaagaaccgtgtgctttctttttatatattgttattgcttctttataggcttgtagctttgcttgtgtgcttcgcgtagcttctgtcgttccggaggttcccgaagcgtgctttgtggtcgtcgccgaaggttcggaaggccgttctctctgagcaaggcaagtcacatcatccttgaacatattgaatcccagtttataaaattattttgatttaaattaatgcattatcgctttatttaaattcccgcgttatcattgttttatttagtcatgcctatttatctttgttatgaccttattattattgctattgttattattaccttgttcaccctaggataaacaaaaccccaactagtgggtactctattcatggttccactagtatgaatttaggtagatgcttcgctgattaattaggcaacattaggtggttttataactttagactttgggaattctcatatcatttggacactatggaatggttggcttatgatggaattggacacacacctccccctctattcaaaacccccaaaatggttttaggctgggctcgaggtgcgtggttgggttttgttagtcgtacctcgggtactataaggattaa

SEQ ID NO: 30853 - DNA, 1501 bp, Oryza sativa
ccgcaacccttgacgccgtacctcattggcactatggcgaagggcatggcgtgtggtgaaacctcttcgcccgcagcccttgacgccgtgccatattggcactgtggcgaagggcgtgggttggcgaaacctgttcacccgcagcccttgacgccatgccttattggcactaaggcaaagggcgtgggtagacgaaacctcttcgcctgcaacccttgacgccgtacctcattggtactatggcgaagggtatggcatgtggcgaaacatcttcgcccgtagcccttgacgccgtgccacattggcactatggcgaagggcgtgggttagcgaaacctattcgcccgcagcccttgacgccgtgccttattggcactatggcgaagggcgtgggtggacgaaacctcttcgctcgcaagcccatgacgccgtaccttattggtactatggcgcagggcatgggttggtgatacccgttcgcccgcagcccttgacgccgtgccttattggcgctatggcgaagggcgtgggtggacgaaacctctttacccgcaacccttgacgctgtacctcattggtttgatggtgaagggcgtgggtgggcgaaacctcctcgcccgcaacccttgaggccgtacctcattggtactatggcgaagggtatggcgtgtggcgaaacctcttcgcccgcagcccttgacgccgtgccatattggcactatggcgaagggcgtgggttggcgaaacctgttcgcccgcagcccttgatgccgtgccttattggtactatggggaagggcgtggcgtgtggcgaaaggtgtgcagaggctgtcacgccctgataaattcatcccgaaataaaaattattttctaaaaggaataatagaattaattaaaattcaaaaagaaattgacaaacactaaaatacctgctagaaaaattcgaatgtggtccggagaatttttgttaaattctccttggtctaaaaggagccctcaaattttacttgaattttcagagcaccgaaaatatttattaaacaacaacaattaacaaagtttattaaaaagaaaaagctaaaaataatccccctcctccctttgggccaagtctggcccaaagtctccctctctccccctcggcccacagtccaaatccctctcccctctctttgtttttctctctttcctcccgggcagctcactccctcctcctccttcctctcggcctgcctcggcccagcagcccggcccaagccaggccgagccaagccagccgcgtgcacgcgcgccgcgcgtgcgctgactgcgcgcgctgaccgcgtggggcccacgcgccggtcgtcttcctcctcccgcacggcctcctctctctcccgtgaaaaccctagttcgttcctccctcgaaaccgcacgatttaagcattggattccaaaattaattggggggaattaatcccctttccttcctctcccttttccccctaatctcccctttaa

SEQ ID NO: 30854 - DNA, 1176 bp, Oryza sativa
cggctgaaactccgatgctaccctaatcggcaaccagaggacaggctagagattgatattctaagcacgacttaatagatcaaactcaactgatgcagcattaagtatgaaaagaagaacaatatctagacaatcaagccgttgggtgtttcataaagtggtagatatcttatataatctaggacaacgtcgctatttaacctaatcggctgccttctattaacagatattagccgattataggttagatgatgatattgccaaagattatgtaggatatatgataacttgacgaattatatagacaagattagagtgtcataaagatggaagcactaatctcgagaacgcaagtcgtcataacaagttttacctcttgttcaagatcgaaaccgatgcagctcaacccaaaagcaagaactcgtcgaaacaaaactaaagcaaaaaggtggcgatgcgccgaaattgtattgaacgtgtgtgttaccaattacatagggctcggggtctatttatacccaagaattacaagatatgtccataccggacacaaccactatctctaacaaactctaagataccataagtctttgcggcagacttttgcccaaacatatctctaaggaagttacataaaacatcctaattaatagatacaattgccttctcaggactctatccatgtgcggcaatcatcttgaagcacctcaattcaacccaatgtcatacaccaaattatactatcagaatcggctgcatcggctcacctagtccgattcagacccagccgatcctaatcgtagccgatctggagttcagctgattcttgctctgttctcggattaatctccgccttcgactccaccttgatctaatctccttttccgatgctgatattaccaaatttggtcgttaacacatgccccccaagtccgggatatttgataatgttccggatttgccttgtaccgactccgagcaagtttcgcactctgccatttttcgaccgttattctatcgctttaaatgccaaccattgccctcgagaaatctcacgccgtgacttccgttttcccgctcaagcgaaactttgtcctttgtctctccggcgattcctccgacacaaaagcgatccccaggcgatttcgcttttgatcagatctccgcctacggcga

SEQ ID NO: 30855 - DNA, 221 bp, Oryza sativa
tgctaaggctataaataaacctctagggccatgtaatggggggatccccaaaaaatatttcacgaatcaatacaattgcttttacattccaactactgttgagagaaccacgcctttcgacatggcatagttgtacattcgacaacagctggcgccgtccgtggggaacccagaccgaaaaggcgaaatgggacccctttcaccacaccctttgccacagt

SEQ ID NO: 30856 - DNA, 1501 bp, Oryza sativa
tcgggcttcctgttggagtgtgatattcttttttttcctggggctgtccaattcatattgatatatcaatatgaatgtataacacatgctacactggatgcaattagtttcttgtgagcctctttcgtacttgatcaatcatcagtgacaaacttcattgattctgaaacttgatttacttacaatggaaatgagagttctagtttctatttcttgaatcattttcatataaaagttttacatcataatattagtgaaaatatttgatcaataaccttgtgccaattgagcaggttggaaccaaaagagataaggccactctggatgatacaacaaacagaatcaacaagttactattcaaggtaagccttataagttatacaccaatattttcatgacatacaattatagttcaacagatcggtgcactaaaatggtatatttcattatttcagattagatctatacggatgtgtggctcgttggccttgaacatgtgtggagttgcctgtggtaggcttgatttgtgttatgagattggatttggtggcccctggtatgattaatttaattactacaaatgcagtgtcttatgaaaaatataaactatctaaacatattttattgtcaattcttcactctagggatgtggccgctggagctctgattcttcgggaagctggtggttttgtttttgatccgtaagttacactgtttagtcaatgtcatagtagaatcaggcagcgtgagtatctattattaattgtttgttccattctggcttgtaggagtggtggggagtttgatctgatggcacgaagaatggcaggatcaaacagctatctgaaggatcaattcatcaaagaattgggagatacaagttgaacaacatattcctcaacatgaagtagaataagaatataagatcgccctgccaattttattggggcaaattttctttctagtggttctgcataaacagcatgcctgttgcggaaaagttttggacgcagtatggcattgtattgtttgaaacttttttttttttggcactactatccggtgttacttcggaaactagtgcatcgaagattcgaagtagcttaatcagaattttgaaccgaatgttcagatggattgtgcaatgtgcatttcccccatgatttcgtctcctatgcacattatgtggaagatgttccaaaataatattatcagttataaccaggggcatgtgtataaacaaatgtgtttcaaaaaaatcctggctataacaaggtagcatgtccaaattcgtagtattaaattcgtagtattaggaaatgttttattttgttcagttttttatattttgggatgtaggaagtagcacagtagtatgatcctaccgatcctagtcttgatgggaattgggaaataatggaatttggttgcaacttgtaagaacgaaggatgctaactaagtactcttgatgggaaatattggaattcggttgcaactagg

SEQ ID NO: 30857 - DNA, 1501 bp, Oryza sativa
acccgttccaggagcagcagcagccgccgcccgtggccaaacccacggacgccgccgccggtgacctgcttcctcagcagaagcagttgatggccaacgcaccaaacgccggagaacacttgctcccggagcaacagaagcagcagcccgtgacagctgcaaaacccgcgaacgcgccgcctctgcagcacgcggcgaacgccaccaacccagccgttctccggcggcagcggcagcggcagtgggttcgacttcgaccaccgaccgccactaacctgccgcaaacgaagcaggagcagcatcatctgttcatggctgacgacggcgccaacgcccgcaatcccctgtcgccgccgccgccgtgcggcatggccaaaccccccaactccggtgacccgctgacggatcagaacaatcagcagctcatggcgaacacccactctgcccctacaccggtttccacaccattggttgcatcgaaccagagtgaatcatcagccatgacgacgacgacgacgacgaacagcaaccaaaactccggcggcggtcgcaccggcccgcaacccgtagcggccggcgctgctccaaatccggccggcaaccagcagcaagggcagcggaaaggtggtgcaaacaggcgaggcggacgaggccaaggcaacaagaacaacaacgttgctaataccaatattagcaacatgagcaaggtgattggcaagggcaacaaggggcagggcaatggaaacccccagctcaacaagaatgggaacccccagttcaacaagaacgtgccgggtgatcatcaccagaagaacaagaatgcagggcagctttgctacaggtgcgggtgcagggggcactggtcgcgcatctgccgcactcctgagcatctggtgaagctttatcagcaggacagaaaggccaaactgcaagcaggagcgaatacgaatacggtttatgtgggagccatgacggattaggggttataagatgggtacattgattatatatctttgtgcgtgtagcatacccattttcgagttatcttaatgttatcgtactagacatgcttttcgtgtttcctacagcatttccccccctcaaattcttagttacagttatgttatcggtttttatgttagatctatattctagtatcattttattctggtaaaatttgatataagacatcatagtgttgtgtcatttgccataacacacttaaaaaaaatgtttgtttgtttgtttttgtgtgtgtcccctggccacatgacactttgttttggtggtaatgtgctaaaacactacaactactccatccagttcaaattacttgtgattctacatatgtccaaagttgaatatatctatctttcacaatcaattttgaaattcatacattcttatgacatgcaaattacatattactcctatgaaagtatttttcatgatgcatctaaaagcataaattttatgatgtttgaccatataaacttctaga

SEQ ID NO: 30858 - DNA, 1501 bp, Oryza sativa
tggtcggtgaagacgtagacgcccaacaacggcggcataataggccagccgtgcaggcggagacaccagtcggcggcagcgaaggcgagctggtcagtgaagacgaagacgcccaacaacggtggcagaataggccaaccgtgtaggcggaaacaccagtcggcggcagcgaaggcacgccggcggtgaagacatagacgcccaacaacagcggcataatagaccagccgtgtaggcgaagacaccagtcggcgacggtgaaggcaagccggtcggtgaagacgtaaatgcccaacaatggcagcataataggccagccgtgcaggcggagacaccagtcggcggcggcgaaggcaagccggtctgtgaagatgtagacacccaacaacggcggcataataggccagccgtgcaggcggtgacaccagtcggcagcggcgaaggcaagccggcggtgaagatgtagacgtctaacgacggtggtgtgaccaaccaaccgtatagacgaagacaccagtcggcggtgacgactgcaagcctgtggtgatgttctgactaatccattcctggagtgtaagagataagcttaaagccatgaatcctttttatgcatatctggatctggatcctgcagaacaaatatataggatgagtagtatctgatgcaaatataatactcgaggaaaatttaagtattttaaaatgtttataaatatatatttctcctattgtcaattttgatttccccgagcagatgactccttacgtttaaacactctgcccgactagtcatagcccccaaacattgggagtcggcctaggcacttcccaaacatgcatatgagtgacatgagttcgtcattagtggaacaaagtttcatggatcagagtttactacttaggtacttttgcaattattaagagtagaaaataaattatcttatctctatgcttttgatttcttccgagtaatacttagcaccttgcgttactcggtccattcaacgagcccccgggtgctaggaatcggcccaaaggcaactatccatcgacaaaccaaacggaaagtataggaagatagaactccataactcgataggcacttttgtactcagattatgtcgcaagcaatcaagataaatattatgaaaattgtttaaaaaatatgatataacatctatagccctcgactcactagtcaacggcgaaccagttgatatagtgaggcagaggaaaagaaaaatatcatataaagaaaattaatgatgacttagctttgtaatattccccttgatgatggcagaggtggccaatgtgggaacaaagtcgtccgtcaataacaatgaagacaccagtcggcggcgaaagaaggcggtcgacggtgaaagcgaagatgcccaccaacggcgtcataatagaccagccatgtaggcagagacaccagtcggtggcggcaaaggcaaaccggttggtgaagacgtagatgcccatgaacggtggt

SEQ ID NO: 30859 - DNA, 1501 bp, Oryza sativa
tgatccatcttctttgttgcagagcttcctggatggtgctgtttttcctcttcgaatgcctatagaggttcggcacttgacattttacactttaggtaccaaatcaattagattcttagaagctcgccttttgcccatcaccaatttggactttcatcgatgcatcaaacgtatccttatccaattcatcgcaaggagttttagttccaatccaaggcttttctgacgtgctccattcaaaccatagccaccttagctgaaaagctatggtaaatttttctaagtttggaacccccaagccaccataccgaacggagaacaaaccttaggaccaattgagcttaaatttcccaccatgcatgttctactttttagtactctttattaacatcaacgacacatctttattatcactttctctaattacatctactccttccttaacctctgctattccatgtaaaaaaaacttcaaaataaaaatcagcttaaatcaaccaaaaaaaggtaaaaaaaaataaacttgtttcatatatcaaattaaacaaagtatcttgcacagacatgtgacttgtcaaaaaaaaatagagaaagagcacatcttaaaactgcaaatactttgataaaattatcacaaaactacatatttacgatgttctatcacaaaactatatagatttaacacaaaatttctcaaaaaatacatatttaagatggagtgtcaaaaataaagattgagtgtcacaaaactacaggtttggtatcaatttaattagaaaactacaaatgtttatagctctaacataacgtaatgatagagatttaaactaggattgtgataacttcaatactaaatatgtagttttgtaatattttatcttactttattggtaaatctatatttttttatacaacacttttaaatctactgtggccctgtttagatccaagagatattttttagcctttcctcaaatagctcaaaaagatctaaaagttaagctattttagggttatttggaaataacccacccaaaaaactatcccacccaagaagtgttaattggagctatttcaagtggggccactgaaaaagtgtcttttttcctctatctccctctatggaaatgtacattaaaagccaaataactctcaaaataacctttgaattcaaacaacttagggctattttattggatggctatttccttgtgttaaaaaatagctctcaaaataaatcttggctaattctctaaacaaggtcagtgatagtttggttaaactcgtactactagaatttactctttttcattattaacaaaaataatttactctctttctaaaaaacaaaacagtgatgtccagaactgaaacttgtcgaaacacaattctccaatcatataccgactgttgtacgtatattttactccgatccaccgccgatcgcctccccaagcaagcaagcagccgctcggagcgaagactgaggcggcggcgacca

SEQ ID NO: 30860 - DNA, 1501 bp, Oryza sativa
taaaatttaaaatagttaatacttaattaatcatatgctaatggctcacctcgttttacgtattttctcaatcttctcttttcctctccttccttgagggcgtaggcttatctccccatcaacaacatggggtaagtacctgaaagaaccaattacaaaatttccttgcgcatctcgtatgctctggctcctctgtactcgaaagaatgtcaaaaacaaagcatctacatttaccttgagagtttcttcctgtaggaggtggtttatgccatccttcatgtggttttgtatctgttttttgcttgccattttataatttagtgcaagagtaataatagatatagctgatctagtagccatttgaatcatttcaacattcaccatttgcctcctttcccaccaaatataccgtattcccctatcgaaacaatttcagcaaatttcaaatcattgaggtgtggttacctcctctcatgattgtcttctagtaaaacgattgtcttctagtaaaacaaaacccgattgatcaatattggcaatattctcaattttgtttcaaattcacatatttatccacacttctatatagctctatcacattgaaaataatatgtttaatatcctcacatatacggtccaatcgtttggtttattcatcatcatgaaataaaccaaacaacatatttgcaaagaaaaaataatttgtaaattttatgatcgttaatagaatattataaaataagttagcgagaatgtgtattatgagagacggagtaacaaattaagttaatatgcaaggacgagccgggggagtatgtaatactagtattatcaccatcagtcatcaaccattcttactctttcgttagatatgataaggttggaaggttcattttgcctctaatatagtctgtattaatgaaactaatcactagattaagtctactaagtgattattagactaaacaacatcttctggtggcttggtgcttacgccacacggaagcttattagtagctactccctccgtcccaatatgtaacaagttttggcattcaaaatttgtcccaaatgttacaacctagtacaacttttaccagaaatctatcgattctacccctcagcatagttatcagtgaaaaagaagaaaagaatagagtactagtttgtattgccgtatgtgcttttgccgcctaccagtttaaaatttaatttgcgtgtgagtgggtttttactgtgtttaaccagctttctggcgccaatgtgtttgaaatgcacgtgtgagtttgatggcagcaaacagaccgccaccactgagttttagtacaggaataatcattgagggtagtatggtctttttgcaccttttcttaatacttgtgaacaagcttaaacccccgcctcgtttctggaagattctctcctcccccgctctctcagaaacaactcaaatcacgattcgctcctgcaacgctgcacgcgcgcggcacgaggagtagga

SEQ ID NO: 30861 - DNA, 1501 bp, Oryza sativa
gttattttatttcttatagtactttaagtgttatttatatcttatacatttgcataaaatttttgaataagacgaatggtcaaacatgtgagaaaaagtcaacggcgtcatctattaaaaaacggatggagtattaattaatacgcttttaatctctcggcagagcacacgtaactcaggaattaaacgaggttaatcgctaaactaatcaggttgggttagccgtcgaggacgcccgaggccagcgcaaatcgagcaaattaattaattagttaactgtttaattaacttgcggaccaagtgatgaaaccaaatctactcacagatgacatgtctcggtcaagcgatcgagcaggtggacacacgactagtcgacgtacaacttgcatatcagagtcttttttatctactcgctccgtattagattataaaccattttaattttgattaaagttaggctgttttaattttgattaaatttatagaaaaaaatagtaacatttttaacacaagacaaatatattatgaaaatatattcaattatcgatttaatgaaattaatttggtgttgtaaatattataacatatttgtctctaaacttaagttaaatttacaataatttgactttgacatcaaaacgacttataatttaaaacggagaaagtagcacgcatatacattttcgttcccacgtgtagtggcgaagccaccggggtgccagggtgggcctggcaccccccatccccatgcacccccggtgattaggcatctaatccatacaattaactcattagttagttgcaagttgagcctatacataactaaccaatacgtgattacctgagttaatgcaactaagcgatgcggttgcaagtctccaaaactaaaaaaggatgaatagattcatgtattcagtaaatttggtgctatttagttgcctaattttaaaaaatgattctttggcgaccacgtatattagtgcgaacaagaggtgaggtgagggcaatctgccactcagcatgaactgagccatcaagatccacacttttgtctaccgaggcgctggtgagttcttgcatctcgtggccagcaccccctatcactaaatcttggcttcgccattgcccacgtgtgctctacctggacaacgtaccagtggtaccacctacgtactttcttcgttttagaatatattttttaaactacagagaaagtaagttgaaagttacattaacaaattaagtcacagataagtgataatgcatctaacaaatgatgagatcgatcgattgccacattatatatatatatatatatatatatatatatgaaagtcgaatttcttccactctcatttgagagtgcgaatacaaggaggtattttgtgtttgggaaagtccgaagaaaaaaggattttgaatcctccttttcctttttcccttagaaaaataactcaatcaaaatccaattatctactctacaagaacgaaacgcttgtta

SEQ ID NO: 30862 - DNA, 1501 bp, Oryza sativa
aaggcgatggcctaggaccgcaggagctttgtggtcaaaaattagttggttgcatgcatatgtgccaagtctttgggccaccacgcatttctcccaatcacatgtcattagcgagaagccaggtgtcgggtgcatagtcatggtaactggttgcttttttttgacaatggaatcttttattgaactcggtcaattatatcaaggtgatattactacgctaagtaacactcccagcctctgcatcccaaggatccacacaactaaacacatatgaaccaatttaaaagaaattaagtacaagaagcatcaaggaccatcatcctaagactagatcaccacctatgtccctagttaaaacactcattgaccacccgctccaagtgtagacacgtcgcaataaccaaatcccacgagctcggctttttaagaataacctaggtgtgcatccaatggatagttacaaatatgacatgtatgtgtgataaataacttttctatcaaaaactatatagttcttacgtaaccaaagcaactagcatgtggcagtcgcccctaacaggacatatggttacatatctttttgaaaacccgaaagccaactagtgaccacttgtgaaacactatcgggtggagtaattcttgacgccacaaaaatgatggaccaaactaaatgggctaagaggcattcaaagaaaatgtgtttaattgtatccttattattacataaacaacagttttgatcgccttgctaattatgtttagctagattgtcttgggttaacacaactttacgatgaaggtaccaaaggaaaatcttaaccttcaatggcatatttagtttccaagggcgtctatttatattcgagatgtcactataaactagagatgataatgagactccatatggagctgtccattaggggtcatcttccatggaaactcatcttgctcctaaattaaaccaatattagcgatgtgtggtgataaggtgttccatgtgactaacttcgatccaatttgatcccttctccatgaaaattgggatatccattttgaaagacatcttcgatagttgcatgtttgtgcctgacaatgttgtagaggaacgagtactgttctcgcagggttacatttcccaaccatttgtcttcgcagaacctaaggataatacggataatatgccatatggcatattagcaaaataataatacagtaaattgttggtaaaatttttatatatatgttcttagcgacttaaatgccaatgctaaaaaataaactttgatgaagaaacttcaaattcatcttcaaaattaagctttaaaatttaaattttggcattggctgatgatgaatagagaaaaagatgggggcctaatcagggccggtcctaccattttgggggcctagggcgagagggaagtaaatgccctttttatcttggattttttttgaaaaaaagttgtttaatttaattttctgattgcaaagtgattgatat

SEQ ID NO: 30863 - DNA, 446 bp, Oryza sativa
  unsure (1)..(446): unsure at all n locations
agtgggtaaaatagagcaacgtgagactacancgcgaattttatttcggtacccacctggacaacgtaccagtggtaccacctacgtactttcttcgttttagaatatattttttaaactacagagaaagtaaggggaaagttacattaacaaattaagtcacagataagtgataatgcatctaacaaatgatgagatcgatcgattgccacattatatatatatatatatatatatatatatatatatatatatatatatatatatatatatatgaaagtcgaatttcttccactctcatttgagagtgcgaatacaaggaggtattttgtgtttgggaaagtccgaagaaaaaaggattttgaatcctccttttcctttttcccttagaaaaataactcaatcaaaatccaattatctactctacaagaacgaaacgcttgtta

SEQ ID NO: 30864 - DNA, 1501 bp, Oryza sativa
caaagtatttgcagttttaagatgtgctctttctctatttttttttgacaagtcacatgtctgtgcaagatactttgtttaatttgatatatgaaacaagtttatttttttttacctttttttggttgatttaagctgatttttattttgaagttttttttacatggaatagcagaggttaaggaaggagtagatgtaattagagaaagtgataataaagatgtgtcgttgatgttaataaagagtactaaaaagtagaacatgcatggtgggaaatttaagctcaattggtcctaaggtttgttctccgttcggtatggtggcttgggggttccaaacttagaaaaatttaccatagcttttcagctaaggtggctatggtttgaatggagcacgtcagaaaagccttggattggaactaaaactccttgcgatgaattggataaggatacgtttgatgcatcgatgaaagtccaaattggtgatgggcaaaaggcgagcttctaagaatctaattgatttggtacctaaagtgtaaaatgtcaagtgccgaacctctataggcattcgaagaggaaaaacagcaccatccaggaagctctgcaacaaagaagatggatcaatgacatccgccacaacctcactatccccctccttgatgaattcttatgggaagttctagcccgtgacaccccacaactaacagaggaggtacaagatttgattgtcttgcgatggacaaccgatggggaatatagtgcaaaatctgcatatcaattccaattcaacggaatggtactatcgccatcaacaaagttgtcctgggaggaatgggcttcagcaaattgcaagattttcagctggctagtgcttcaaaaccgggtgtggacagctaaccagttgcagatcaggagatgaccaaataattatttctgtcagttatgcttccggaatcttgaaactgtcaaccattgttcgaatgcccgatctcgaagcaaatctggtttgacgttctcacacagctacgtcaagggcacaacatcctgaaatgtaataacaatagaaacctattgggttggtagacacaagaaacaagcgacccataagtaacaaaactaaaaggactcgtatctctcttattgctcattacttgggaaatctggaaggaacggaacacaagaatcttcagagaaaaggaggcgacagtacactagatgatcgcatccaagaggagttgggttggtgaggtatggccggcgctaaacatattgggagaatgttgccatgagaagttaggagagctgcttgtttgcatgtaggcatgtacggttttttctcttcttccttgcttagccttttggctgtttgtactttaaccctctcctatcaatataaagcaagtcaaatctaaccgggtgtaaaaaaaaagtaagaggaccaccttcttcagtgcgtgattcctctggattaggttaaacgagtgaatcatcaatagcgagca

SEQ ID NO: 30865 - DNA, 219 bp, Oryza sativa
caagaattgatttataataagcactcttatcaataaattaggttaggtattgtgcggttacctaaagatacctgctcaacgtagatgcagggagtagaaagactgatccaaatttattgctgcagctatacattcaatgtagaagaatttgaattttagaatcgaaggttcataatataagacttctcggctcttatccatatttcgaatttttttaga

SEQ ID NO: 30866 - DNA, 1501 bp, Oryza sativa
tattcgagatgtcactataaactagagatgataatgagactccatatggagctgtccattaggggtcatcttccatggaaactcatcttgctcctaaattaaaccaatattagcgatgtgtggtgataaggtgttccatgtgactaacttcgatccaatttgatcccttctccatgaaaattgggatatccattttgaaagacatcttcgatagttgcatgtttgtgcctgacaatgttgtagaggaacgagtactgttctcgcagggttacatttcccaaccatttgtcttcgcagaacctaaggataatacggataatatgccatatggcatattagcaaaataataatacagtaaattgttggtaaaatttttatatatatgttcttagcgacttaaatgccaatgctaaaaaataaactttgatgaagaaacttcaaattcatcttcaaaattaagctttaaaatttaaattttggcattggctgatgatgaatagagaaaaagatgggggcctaatcagggccggtcctaccattttgggggcctagggcgagagggaagtaaatgccctttttatcttggattttttttgaaaaaaagttgtttaatttaattttctgattgcaaagtgattgatatgcaatacatcaatatatacatactttatttaattttttttaaaaaattataaattatacttcattttatataaaatgagctaattatatatgttgatatttatttctattagaagttgagttggttttcgtgttccgagaaaaaaatgtttccgtattcgtgcccgatcatattcgatttttgttcgtatttgagataatccgtattgtttctgtattcgagctatccgtatttgtttttatatcggtaaagaatatgaacacaaatatgatacgagcattatctatctatatcccctccgttttcatcccacatcgcgcaatcgatccccgtgccgatgctgcctccgacggtgcgtccccaacgagtggcggtgagccgtcacaactcacaagacctcactgagatgggctagcaagcttggtgggctgggcccaggatcccaggggcccacaggcccagcctttttccttctccaagaagggcggcccaaatccaacggctcagctctctcctctttccccatctcttcctcgcatcgaccgaccaagcaaaagcattttcttcttcttcttctctctcctctctctctccttccccacgagaaatttcaaaaaccctacctccactcccgatctccacgaaaccctagccgccttctgctagatcgccgcggcggcgggaatggaggtggcgccggagacgctcgacaccctgtcggggtggttcgcgcagtcgctctccccggacgccgccgcgcgccgcgccgccgagcagagcatcgagtcggccaagtgctcgccggggttcgggctcgcgctcctcggcctcgcctcctccccgcgccacgacccgcag

SEQ ID NO: 30867 - DNA, 312 bp, Oryza sativa
aggaactagctattgggctgtcgacaggttttgaggcccaaaactcattttttgcacctcacgatctgcaatcaatgggtcacagcaaaataaaattgtctaaataagaatctttataacaacatgttttttcctgtcgatccaggcattgtaacagaaacaaaaatgtctaaataagaatctttataacaacatttttttttctgtcgatccagacagcgtaacaaaaacaaaaaatcgagaaaacatggggtcggagaattaaacttcgacccccagcctccaggttgctatgccgccgtccacgagtga

SEQ ID NO: 30868 - DNA, 227 bp, Oryza sativa
cccccccccccaccaccacccagcccagccattcatggccatcaccaccatgtgtcgcctccccacctccgcctctcctcacccactccgctctccgctccattaaacccaagcgagggacctcgatcgcctcccctcctcgcttccctccccgtctctcctctttcgaccgcgttggaagcaagcgcggcggcggcgcggcgagctgccggtggggggttgcggct

SEQ ID NO: 30869 - DNA, 479 bp, Oryza sativa
tagtaatttaaaaatcgtgttaatgaaaacatacgtaaaatcggtatgttaatcagaaagcgtcatcaaaagctcaacaccaccaccagcggtaaaatcggtatgttaatcagaaagcgtcatcaaaagctcaacaccaccaccagcggaaactatcgagtgagctggattttttacaatttagtccttttgaaaaaattattttgtaaatagacacttggaaaaacttatctaaaaaatggtccattttggggccccaaagtcgctatcgccgtcctcctgccactgtggtgggtcggcgctgaggtggcagggggagcgcgccaatgtggctggcgtcccccgcatagtgtagaggagagagagatgtgcaactattatttttatttttctttcacgtttagaagcatacaagaaccaaccatagaaaaaataaactcaaatgtacgaaatatgtgacttataaaattttccaaagc

SEQ ID NO: 30870 - DNA, 1501 bp, Oryza sativa
gttctgatatactccctccgtcccataataagcgcagttgtgggtttcagtgcccaactttcaccatctatcttatttgaaatatttttatgattagtttttttattgttattagatggtaaaatatgaatagtaatttatgtgagacttaacttttacaattttttcataattttttcaaataagacggacggtcaaacgttgggcacggaaatttatggctgtacttataataggacgaagggagtattgtcccatcaaatagttcaatatacgttatacttcttatggtatctcttactctcttatcacgacactctttgatcgatatattatgccccacatgcctcccatgctttcttcttcggcccaaaagaatcacttttgcatgcagtatatcttactgtgatgactgcgtggaggggctgactggagcggcggggcaacggcaagacggccacggcgcgatggcgcgggggcgacgggcgtcgccgggcggcgggattgggaacaaggaggtgaggagatagggtttgatagagtttgggccatatttttttttgctattgggccaatgggccttaaaaagtggggagaggaagatggtgggagggataggtttgggcttcttttggatgagtacaccgaaggtccctcgtcttgtcattgaattacaaaatcacccttgaaccacaaaacccgacatgatacatcctccaacttacaaaacagtgcaaaactgcaaactaggttcctcgacggtattgtctccggttttagatgacgtggcatctgagttagcgtcgtccccatgtgggcccacctgtcagcgactatttgcactactctctctacctctcttcctccgtcctgcagtcctcttcttggcgattgacaacaagggcgcggcgcgacggcgacgctccctggcaaagacaagtggcggccatcggcggcgctcgctggcaaagatgggtggcgggcggtggcggcggcgtcaccgaccacgacctgggcacttcctccttctcctcctcccctttctgtccgtgtgtgagaccttcgaggcgggggggaggggtgctcagcgaaggcaacagagacggcgacgcccgacgctctttctcgccctctccgccaacgccttcaaccaccccgagcaccgtcgccatctccaccacagccaccgacaacagcctcagctcctcttcctctttcctttctcttccaccatctctttccagtgcacgagactgaccgacgggaggcggcggtgccggtggtcgccgcatatagagcccgcgctgcaggagaggaaggggtgtgcgacaacatatgcacgccgtcttcgctgcagtgggggcacgggatgcggcgcatggcgaggccgtggcggagctgacaaggaaggttgaggaacaagagcagcgcatgaaagagttcatggaagttgtgggtggctaaggagcagcgaagcacaccgggaaggaggtgcaggagc

SEQ ID NO: 30871 - DNA, 353 bp, Oryza sativa
tatcggagtattagcggatacatgctagatctatctgattggctatgctataaacatatataatcatgttattaatatatatttcgatataagtgatttatactgtctcggcatggtgaccgatctatcccaatcacttgatttaagtatatattaatataagaactatatatcgttaatatctacagccgatcgaatagatttagttccttactatatatttataaccgccgatcgattcacatatgacatcggcttaaagataaatgatatgtcattggtacctagccgatcggctatcatttatagatttaaccacgaattctttgtctctatttcttgttgattacagg

SEQ ID NO: 30872 - DNA, 1501 bp, Oryza sativa
ttattttcacaccgaacatcatactaactgtacagctgtattggatcttctctctgctatcataagcagaatctaggtacctttcaaattcagctctcgaccaatctgacatgtgacatctaactccccatccattttgaaacttgtttagtatttcgaatgtgtcaaaatgaacaaacaataatttgcatgactacatcttaactgaacaattaaattacacaaatatgtaagaaaaaaatatcattggcgcattgaactaatgcttgcagaggaactttatttttttttactaacggaatgtggataaccataaactaatttggggaaagatttttcattgttgtcacacattagttgcaatgccattattgatgtgaatataaaactccatataaaattcaagattcaagaacaagaagatctttcatgtgatggaatggtcacaggcaacaacaggagccgtacctcattcatctcaagagaattgcacagacgcaacaatactcagttgttcgatacaatgctcctttctttcaaatgccacacaaaagtatgttggaaacaatcttgtcatgtggatgagttgaattaatcatgtgcatttgttagtgtggttgattagccatgaatggtgtttttgtgtcattgtaaccagcttgtcaagttgcaaagataagcaacaaaattaaaatgcactagaaattgtgcgcggtgccaccaaaattatgtgtatcgggtgttctcgttccaaatgaatgtgaagctgtctccactatgttcgtgttaatccttatattcccaagaaagcaaagctagcacagcatccacaatcgcaacgcagtacaaagcaatatgtttttcaactaaagttttcaaacagagaagcaaattttccctggaattttactaattgagattcgagttccatcaaaagctgaatgcaaccgagtgtataaagatcgataatggaccaacatttttccttgaagaaatgttcttggcatgtgtgttgtgttggaacaatttctgctcaggaggaatggaggtcacaacctacagaactagggagatttaccatggcaatgatccatgattgacaccgttgactgcagcgagtcgcagctctagtgaactgctatagcagaggcatcaattccgatgaaatatagcccctcctttgtttatggtacgctatttcttccagaggcttctcattcctatcactatttcacttgatcaaagtacagagaattctactcatcacagtaaggtatactacatgcaaaagtgattcttttgggccgaagaagaaagcatagggggcatgtggggaatgatatattgatcaaagagtgtcgtgataagagagtaagagataccataagaagtataacgtatattgaactatttgatgggacaatatatcagaagtctagtcaatctattacactcaaatgcgacctccctcgttcaaaagtttggttgattcaatccatgc

SEQ ID NO: 30873 - DNA, 1079 bp, Oryza sativa
tcaagttagtacgtaagttaattttttaaagagatttcttatacgaccgttcatgtatttccaaaagtgaacgaacttaaaaaccgactcaaatacagatctgtatttctaaaaacaaacgaacttaaaaactgactcatacacggatgacgtacctaagtaccaacaaaaacatcttcaatctttataatagttttactgtgagaatttgcttggatatatatttttctagaaaatcatgagctgcaattagaaatccgatcatctcaagttagcatgcaagttttttttaaaaagatctcttatatgactcctcctgtatttccaaaagtgaacaaatttaaaacccgactcaaatacaaatatatatttccaaaagcgaacgaacttaaaaaccgactcatacatggatgacgtaccaaagtaccggcaaaaacatcttcaatttttataatagtagagatatagaaatatcaataaatatatgattttattgaaataatttttaagattatttatacataaggtcttcatgtttgtaacacaaatattttagaagttattcgttgttaagtttttaaagttcaacatcagttttatccgcaacaataattaattttaacctagagaaaatattattttttattatgtagctactaatactactagtaaaaatctgaattgtttaagaagctaaggaatttaagatgtagctagacttgtactctctccgtgtaataaaaaaatctaatccaaattggaatatggacatagagtttgaatcgattcaaatttggattgggttttatatgggaccgagtactccctccgtcccataatataagggattttgagtttttacttgcactgtttgaccactcgtcttattcaaaaaatttgtgtaaatataaaaaatgaaaagttatgcttaaaatacttttgataataaagcaagtcataaaaaaataataatttcaattttttttaataagacgagtgataaaaaagtgcaaataaaaactcaaaattatttatattatgggacggagggagtagctaacagaagcttcacacaaaca

SEQ ID NO: 30874 - DNA, 1501 bp, Oryza sativa
gagagagtagtgcaaatagtcgctgacaggtgggcccacatggggacgacgctaactcagatgccacgtcatctaaaaccggagacaataccgtcgaggaacctagtttgcagttttgcactgttttgtaagttggaggatgtatcatgtcgggttttgtggttcaagggtgattttgtaattcaatgacaagacgagggaccttcggtgtactcatccaaaagaagcccaaacctatccctcccaccatcttcctctccccactttttaaggcccattggcccaatagcaaaaaaaaatatggcccaaactctatcaaaccctatctcctcacctccttgttcccaatcccgccgcccggcgacgcccgtcgcccccgcgccatcgcgccgtggccgtcttgccgttgccccgccgctccagtcagcccctccacgcagtcatcacagtaagatatactgcatgcaaaagtgattcttttgggccgaagaagaaagcatgggaggcatgtggggcataatatatcgatcaaagagtgtcgtgataagagagtaagagataccataagaagtataacgtatattgaactatttgatgggacaatactcccttcgtcctattataagtacagccataaatttccgtgcccaacgtttgaccgtccgtcttatttgaaaaaattatgaaaaaattgtaaaagttaagtctcacataaattactattcatattttaccatctaataacaataaaaaaactaatcataaaaatatttcaaataagatagatggtgaaagttgggcactgaaacccacaactgcgcttattatgggacggagggagtatatcagaactctagtcaatctattatacccaaatgcggcctcccttgttcaaaagtttagttgattcaatccatgccattataaaaaaaaggaaaaagtacaaactctctggacaatcgtggctgaccgaattaccccactaagctcaaataccagatattttacacactccattattcatactgaacgaattatgccctaacactgttttgagttgttttgaccaggagtttgcacacatggcgtcaacgtgtcaatccattcagaaaaaataataataattcactctaacaacaaatttgtagggccttccagtcaaaagaaaaaaattgtagggcccacttgtcatatatttcttcttttcctcgatctctcctctcctcctcttttccacactcgtcaggtcgggatgggcggcgactagatggaggaagcgggagaggcagggctcgggacgatgatagcggccggtggcggaggcgggagaggcagtgctcaggataggggtagcagccagtgacaaaggcggctggaggcagggctcgggaagagagcaacagctagtggcggaggcgggactcgggatgggggcggcggccggtggaggaggctgctggaggcaggactaggccccttgtctttccctcttcccaagtag

SEQ ID NO: 30875 - DNA, 182 bp, Oryza sativa
tggagttgctcttaataaacatgtatgtacgtagaaatgtcgttgacattttgattagaaaattcaacgatcaaaaatgtgtattggatgttactgtactaaacaataattaaaaaaaacaatattgcgagtatctaaacactattgcgcccagcttttaaaagttggactagctaggtaca

SEQ ID NO: 30876 - DNA, 1111 bp, Oryza sativa
tgatctttggcaatagctttggattagtgccaccgtaatggtgttggcttattaaaatacactacatggtgggctgtgggtgcatggttttgctagttgtgcccatggcgattaaggaccggttcgcgggatgccctggaagaacttatcgtacttaccacaagccatcgtgggcaacggctgggcttgtagtgtagcttttctctagccgacgtacccaggcgagggtgggcgtgatggagttgggtcgaccggggtgtccagttgatcggcttccggattcactgcggcatgaaaggggggctgcccgttgcctgctggggacggggcgaaccctaaggtgtggtgcgatcggttagagggggttatgcgaagggtcctgtcacggcctctttccggtatgtcgtggtagcatgtcggcgcacgggaatgtgtcgtggggctgtgtcttgtgggtacagttgtacacctctgatcagagtaaaactattcgaatagccgtgcccgcggttatgggcggtcgaccagattcaccgtgattagtctcacccctagttagctaatgaactggcgtagttcaggtggttggttgggcctgttgcaacgtggtgtagcgttggacagtgagtggttaatattgattaattactgcaattgttttactgctttcaacaactgcttttaaattctagctttatgcaaaagaaccttagcctcccttggatataccctgcatcatacctcctcttccggtatgacttgctgagtacagtgggtagtactcagtcttgctctcttttcccccacaccagagttgaagtccttctcagttgaagatgtctcgaagaggttggtttcgtcgctgccgttaaggatgcctgtggaatggagtcgtccgctgcaggagtcaagtcttcaggctcagctcgcttttatctttttccgctgcatttataatcttttatatttttgtaagacgtggatctgtatgtcaacaattgtcatttgtgtaccctggctggtcctggacaggggtttaatacacattcagcttagaaattctgattcgtgagtttctgggcgtgacaacggccgacctagtgccccggca

SEQ ID NO: 30877 - DNA, 1042 bp, Oryza sativa
ggcgtatgcatgctttaaatactccatcattcagcaaataaggcaggcatgcgcgcgcaatacacggtacaccacacgcatacaacgtacttcctccgtccattaatataagggattttgagtttttcttgcaacgtttgaccactcgttttattcaaatttttttgaaattattatttattttatttgtgacttactttattatctatagtactttaagcacaacttttcattttttatatttgcaaaaaaaattgaataagacgagtggtcaagcgttgcaagcaaaaactgaaaatcccttatattgtgggacggagggagtactaaattgaatgtgcattctcaacgcatacgcatttttttcttataagtactactccctccgtttcaggttataaaacgttttgactttggttaaagtcaaactaattcaagtttaactaagtttatagataaatatagtaatatttataatatcaaattagtttcattaaatcaatacttgaatatattttcataataaatttatcttgggctgaaaatattgttattttttctacaaacttgaagcagcttgactttgaccaaagtcaaaacgtcttataacttgaaatggaagtagtatcataagcaccgagtaccgtataacttcaaaacaagcatttgagatataggacttgtaaattttggtcacctgaaaataccctagatttcaatcaattttttggacagttatggttctatcgacttttgtacgtggacagtagtatcttccttacttatcatgttatccttctccctgagagtaagttagacagattgagatctgcgatattgctctcctccccacctttgtgcggtgagcctcatttggttgactgtccttctctccctccccatctcctcctccccaagccaagcggtgacgccatttccttgtcgtgtcatcttctaactccggtgactcgcaccacagaaacaccactgccaccaccgtctcctaacctatagcttcccttgcacctcccctttccctagc

SEQ ID NO: 30878 - DNA, 1501 bp, Oryza sativa
ggggaaaatgccatgttgggatgcagtgggctgtgatggaattaatttgtcatttttgggggaaaatgccatgttgggatgttgtgggctgtgatggatgtatttgtgatgaatgtccaatgatgattgctcataaatagaccctacacacttgtgatttttggggttttttcaataagaacagaccatctacacttgttcattttatttgggggagggggagtggcagtatgggatgttttgcaaaatggatgcatttttgggctggcctcactcttgggccagcctcactcttgttcttgtttaggtttaaatgtgggtttttaatgcataagaacataccctatacacttgtgatttttgggtattttcaataagaacagaccatctacgctggttcattttatttgggggtggagtggcagtatgggatgttttgcaaaatggatgcatttttgggccggcctcactcttgttcaacatgtggacagatcctctacacttgttcttatatggctgcttgcaatattcttgggattttttgggtccaatgggatggatgaattgatgtgagctatgacggttgaattattttgggggaaatgtgagttttggtatgtgacttgtgttttttatagctgtttctttttttgcataaggacagaccctctacacttgttcttaatttcttttgggggtgggggcagttgcaaatgatggtaattaatgcataatttctgagcaaaactgaggccaaacttattatatgtcaagacttgtgtttttttaggtacaaaaataatatatatgtgacttgtgtactatgggctattttgggtgattttgagggatatgggatggatatgcatagggctgttattaaatgaagttagtgcaattatggcatttaggagaatacgaagtgttccggttgccaaatctggtttggtcgggttacttcttgcacggtaccgaccaagacaaggaataaggtcatttctagattgttatcgttactaatttcctagattgctttctaggtcatttctttctgaaaccccgttcacataaattcagtatccaaagctggttgttgtatctatggaaataagagtttcagaatgaaatgatattggatgcaatctaggagtttgctgacgataacgttaggggtctagtgcaattgtatggtaacaaggataggaagggttttggttgcctgtgtgttcaatctgcgtccgcctcgtcagcagatatgtagcatccatgttccttaaggccggagtagacgggatctcgacatcgacatccatatcccactagaacttgcaaccgctgccactatcttatggtagtgacattgatagcaagttcgagtgggatactgatatcgaggtcgagttcccggctgctccggccttattgagcatggatgctatggttccgtcgacaaggagaacacaggtaggagatagaggtacatcaaccgtgacataggaca

SEQ ID NO: 30879 - DNA, 1501 bp, Oryza sativa
ccagggtagtccaactcaaggtcctagtacgcggctttcaccaactcaactttcaccttggagtatcctactggaatcggcctgcagtggtaagtctttgaagggtccgttaggatggccatgcccgacgccaccttcacgtggtgagaggttatttattagtaatcaacatatataagcagcaacttgcggaatggacaagtctaaaatctataaactacgagcttacctttattgataagttcttgaagggaatatgcacctcacatggtgtccgctgagtgatgtcatcaatgaggcaggtggtttcgtcctgggtttggatggcgtccatgctctgtgatcctacctgccccgttgaggcgcagctgctacgattgcctgaagggctcatcattgcaggaggaatggtcggctggggatcatgggaccgatgtgcggccatgcgttcatccaccttccttaccacctcctcttgcatgctgagctcgtagctcgataccctgtactcaagatcttcaatcttcgcctcggtatctctcttgctcctcatccgactcctgtacgtgtggatgtcctccttgaatccaatcttccaaggaatcacccctttccctcgtgttcgtcttggatgctccggagtctgtagggcgagtgacagctcgtccttctctctgtcgggtcagaacgtgccctgagaagaggcttccactgcgtccgttagtcgactcgcagcctcgcgtatctgatcgctgaagaccaaggagccatcaactgggttgagcgttccaccgtgagcatagtaccagaactttgatcgatccggccatttagcggtgaccggttcgatacctctctcaagcaagcttgcctccatctcctcgcacttcggcatcgcgacgctatagccgcctgaccccaagtggtgatggtacttcttcttggcggcattttctttgtttgtttccatcatagcctgcccttgttgacctatcttgtaagcaacgaactcgtcccagtgatcccttagcttcaggaatgtgttgaagttcggtgtctgccccttcaggatgtatgtgtggaacagatctcccttgaagctctacaactgttgtgccatttagttaagagtccaccttttccctatgttctctgtacccgcgggaagggtgaatgtctcgagcattgtggtccacaacatctctttctccgaatctaggacaaagccctcatgatctccgcgtgcctttgttctgcgaatacactgtactgacaggcacgttatcccgcacaacccaaccgttgtgtctacgtagttcttggctgcttctgccggggcactaggtcggccgttgtcacgcccagaaactcacgaatcagaatttctaagctgaatgtgtattaaacccctgtccaggaccagccagggtacacaaatgacaattgttgacatacagatccacgtcttacaaaaatataaaagattataaatgcagcggaa

SEQ ID NO: 30880 - DNA, 1501 bp, Oryza sativa
aatcattcatatgcaatttggttgcaatctatcttgttcttgcttgtgttcttcgatacgcatgcaggtattagccttctcggcgaggtcaaccaggtttcggcacgattgataaccagaggagacgtggtgttgcgattgcggggctcagtagcgtgttcgttcagaagccggattgagttgtgtcgcgactccgcccaaatcgattgtttatcaatacctattggaagatcgaggcctaacatccctcatcaattttactatttcttttttcatattatagcaaaagtaggatgattacaattttatccctcaagcctttctgcaatttgttttgaacaccatgactgccagtgtcaagagcgatgtgggtttgcttcaaaagataattttattcctgtgttccctttgcaatttttttttattttctttgcactctctcccacttgtgtggggaggaccggaggagctggaaagctccagaagatcagttttaccctttttcactgatacaatccaatggcttcctttatccgatggtccaacttttttagcttacgcggatcaattaggtgacatttcaaaatccaccattcacttatagagattgggaagaatgtggtcttgacgtagtgaatttctgatgcttagttctactatgtagtaataaggatcttattttttgtgagagatttctatagcacaaaaagaaaagtaggattgtactgttatctcaaaattaggggcctgctcttcattttaggaactgatactaccaaatctttagctgcatcgaagaattctccattaattgtaatacagcggtaagaaggcatcatgtgttgatttgctagagagctaattgacccaatggatcatattcttttgccacttaaacactagacgacctcacaaacctcccaactatattacgtttgctaggagtagatatattagcactcatgccattatttaaattcctaggacaacaatcaacgacacggtagcatatgtaaactagagcttcagctggtattgggttacatcaatccagttccctgtctgtagaatttgctttactagattctacaagggctaaccttgattttgtccctgccagattgttctggtacctgatgggcgcgagcctccaactcatccaggatcataatgacaaaaggtgaggatactctgctattaccattataatcgttggtatagaagatattactatattagtgtctataatagtataatcatagttttgttatgataaaggacgtgaaccgaaatgataaactcccatcatagctagcattaattgtcccaggtgcagggccctgtgcgaaaatcaattgcaactcccgcgtagctctcgcgcgggcggctcgggaggcgaaaatcctagccgcccgcaccgccactccaccttctccatctcgtcgccgctggagctcgccaagacccaacaactcgacggtctccacctcggtgcgacgag

SEQ ID NO: 30881 - DNA, 1501 bp, Oryza sativa
ttgaaacacaaattaaaatgaagtgaaaaaaaataaaaatgttcttcatcaatcgaaaaggaaatattaatgggtgagtatgtgtatcaaagaaataaaactcatctttcgacaaatattgatgggtgggtatgcttattgaaggaataaaactcatcttttgacagatagattaaaaagtaaacttatttaggataaaaagtagaacctaaaattaacttattttagaacaaatgaagtactctgtatttagcctgttgatccgttctggccgttcataattacatggatggacaaaaacttcgtctatgttgttgacaaatatattgagaagaaatatagtcggttggtccacaaaacaaaattacagttttccaatatatacaacactaggagataactctttcctcatggtatcccctcacatatgtaaaacgaagtagcttattaacacataattaattgaatattagctatattttttaaaaaaatagattaatatgatttttaagcaacttttatatagaattttttttaaaaaaaaagacagtttagccgtttagaaaacgtgcacgcgaataacgaatgaggtgagttagtaactgtaagagcaaggctaataatacagccgatctgttggctataagagcaagtttaatagtatagccaactactgctccaaatcatctagagccaatgtaatagccaattcatacaaatagttgcttactatactattaatacctagtctcacatgtcatacacacgttacgttttggagtccgtgctgcagctggctacagatctgtagcccgctactcttctctctcttcctttatttctttaaattatgtttatagctggcttatagcctactattgtacctgctctaaagttctttgtagtcttctctcagcctacccatataatagttagatctttacaattaatacagggttcacttgtctctctcacagagtttctggtttttatatccaaaccggctgtaagtttacaacccgcttctcttttcttctctcctccacctcaacatttagccggcttataacctactattatacttgctctaaccaaagaacacagccacagtttccatgttatctttcggtggaacaaagaacgaatgtgatgtgtgctgagaatctcaacctctcccaggcaaaggagagctggagagggtacacaggaaccaaaaaaaaaaaagcacacgtcagattctcggtgatccaatccaatgaacaagatcacgcgagtaaagtaacactcgctgcagatgaaaataagccagccaaactcaccagtcaccagtcaccatccagtggcaatgtggcatttcgttctacaggtaacgcatatgggtatgtgatatctcaagagatatgggcacaagattgacaagaatcagtgtgccacaggccacagggcacagtctgcgcacacacaaagaagccaatatcctttgcactcgtcaccccccaac

SEQ ID NO: 30882 - DNA, 1501 bp, Oryza sativa
tgctaccggcattcacattttcagggtcctctcccttccaaagaaaggcacgtctgaaacgatcaattttcttgaaaacccatttcatttgtggcagtaccgtgaggtggtaaattggtgttgccgtaagtgttgttttcactaacacttcccttcctgctgaagtaaagaatcttcccttccaacctggtattcttgcacccaccttatctactagaggctgtagatctattttcctcagttttctcgtatgaaggggtatgccgagataattgcatgggaaggtttttaaattccccatgaatgaatttagaaggctttcaacattcagattatcacaagctatcgggaaaacctctgttttggaaggatttgtgtggaggccgctgatccttgcaaaagtgtggagaatgttctttacagttgttagttcctgtgcctctggagggatgaagagagccacgtcgtccgcgtagaaggaacaacgaaatctttgtcgtctcggatctattttcttgagaattaaggcttcctcggctgctttgaagatcagatgcagtggttccatagctagaataaatagcataggagaaagtgggtctccttgtcttagacctctcttatgtaaaattgggttaccggggcatccatttaggaggattctagaggaagaacttcctaataaatttgagatccaattgcaccatttgatcagaatttagggggtgggagagtacttgcttccaggtggaaacaacgattctatcctggctctttaaccggtgtgcccagagagttgcgtcttcgatacatcgttggaggaggcgacgatgacaaggctcctggtttctgaagatggcatcatggcgcggtggttccagagtccccaaaggcagagcagaaagaaggggcggaagtgcgctgtcgggatgactgatggtggttgtaatgcatggagttgttttacatcgtcaatacctggatcgatgtggagtgaagcccatagaccagaggcaaaaggacagtgaagaaagaggtagcttgttgtttcatctgctaagctgcatattttgcgcaaattggagacggaacaatattctttgcatgtactgccactgttgcttgttgttgcctggaaggggtgaatagagctgggaatttctcttgcagtggcatttgtataagccatcgatctttccgaaagctggctctgataccattgcccactacaactgaggtcaatctattcagatagggaagaagcttcagcattgcagcccagtgaggtcccatggcttgcaacgccaatgccaaggagcactgtaaaagagctcaaattctctcttttcgcgaaaagaagagctcaaatcctgtacatattccctccgtactcataaaggaagtcgtttagaacaatgtttaagtcaaaccttgagaatataaatcatgaataactctcaagttgttgagtttgaaaatataaaaattatatgaatagatt

SEQ ID NO: 30883 - DNA, 1501 bp, Oryza sativa
  unsure (1)..(1501): unsure at all n locations
ctttttatcttgcactaagtctcttctaaagcgcacacagtcatcagcacttaccaatttcgctttccgatttgatgtgtcattagctgatctttctctggtggcgagacattttacctggttttgacctgaccagctgatctcattctgcaggggaaaccatgcacttggtcatactagttctactgcccaaataatgcaaaactgcaagaattacccctcttggctactggctttgtttgacacaatggcacttacactctttcaggatttgatagtacataaccacaaatagtagacgcacatatgcatgtagctggcaatggcatcttcttgacctgccgctccaattgtaattccagtacagtctatagggaagttgaagtatcatattctatagactgtcttaatttaagactaattgcacaaattttgtacgacctagtggcctaagacttcacatcttgcctggtttttttttttttgtgcatctttcagcttctagaaccggctggcctgcgagcacaccagtagtgacttcacatctttaatctgctagtgctagttgtctgaaggtaagggttcatgctcaaccgctcaaactangacctgccatgcaagtgtcgtatttttcttctcacattcttgtaacataacatcagtgcttggacagcatcgaccaactggtctttcttctcccttgcccggtcttggatccatggatcgttttcctgcagctttctgatcgatgcaattaagcttgctttgccttcagctatcgtcagtgcttgactgaccatgcgagtataacgtagctgcctcttcctggtcaatatcgttacctgccatggacaaaatgtaaaatactccagaaaatccattatatatctatatgatacccacaaaaccttatttttgtggtgtactcctaatcttattgtatactccctccgtactcataaaggaagtcgtttaggacagcgacacggtttccaaaacacaactttgacttcttgtttctataaaaatatttattgaaaaatgatatatgtatatttttatgaaagtattttttaaaacaaatctattcatataatttttatattttcaaactcaacaacttgagagttattcatgatttatattctcaaggtttgacttaaacattgttctaaacgacttcctttatgagtacggagggaatatgtacaggatttgagctcttcttttcgcgaaaagagagaatttgagctcttttacagtgctccttggcattggcgttgcaagccatgggacctcactgggctgcaatgctgaagcttcttccctatctgaatagattgacctcagttgtagtgggcaatggtatcagagccagctttcggaaagatcgatggcttatacaaatgccactgcaagagaaattcccagctctattcaccccttccaggcaacaacaagcaacagtggcagtacatgcaaagaatattgttccgtctcc

SEQ ID NO: 30884 - DNA, 1501 bp, Oryza sativa
atttatttgtgggaaaccacttccctctggttccactgcacattatatgtgtgatgtgatttgtttattgacatttagatgcaccattagaaataaattgtgcttcttagtggctgcacgaacaatggataaattcatatgtgtaatgagtggctgaaaatgtataagggcatctggatattactatctttaatttggctccataatccccattccttgttttttttaatctttggaagcttggaattttttttgaggatttatactgatgttgaatttgcccgcaaattaatatgctattacatcttatgccttaaagctagaccttatctaactttggttttatctttctacattccacatggtagaattctggctccatcaacagcaatgaaaagagcaacggagaacaaatatttggcgaacttgaagacagatattgttgagaaggcgttgaaatatgatagaaaagagaaaatgaaggaggttatgaggctgatgatattccagaggagggttttgtattagagcctacaggtcacggaaatgggaagcaatttcgtcttccgcactctttgtatgatgtcctccacacttatcagaaagaaggtatcaagtggctatggacattgcatctcaagaaattaggaggtgcactatgtgatgaaatgggcatgggaaagacccggcaggtaaattacatgcaatggtttgttctttaggtgttagaatttcaatggttactctcattgagaagaggatggcactcgagatggggcaattttctggttttcttcattcactaaatacaaaagccatacctacccgagggaggttggatacatatatatagccatagctggctgctagcctattgctgcaccctcctagtctaaaattcgaaatttgaatgggatgctgtcctagagggcatccaaactgaataaagcataaaggaggcataaaggagatgctaactgctgcagtcctactaaccgcagctgtcctagcaactgaaaaatatgctaaagggtagatgctgtcctgaaaaaggtgaaactacccaaaagcaaaaagaagaatcacgaccaaggaccacaaagacttatccaacattctccccctaagtcttgtgcgtcgtcttgtggggaagttgggccatcccgatcctggagcagagctcgaggaacttgatcctcccaagaggcttggtgagcaagtccgcaagctggtccttggtgttgatgtagctcgccttgatgctcccttcctccaagtagcttcggatgaagtggtacctcacccggatgtgcttgctccgttagtgaaaaacggggttctttgccagggccagagcggacttgctatccaccctgagctccaccgttctagtgtctctgccgaggagatcactaagcagtcgagcaagccagagcgcctgggtcgaagcggcggaggccgccatgtactcggcctcgcagctggacagggccaccacctg

SEQ ID NO: 30885 - DNA, 1501 bp, Oryza sativa
cctcgtgcgggctttgctcgaagcccatccccttgagcgtggaatccaacttggcattccacgccctcggtgcctgccgcaagccgtaaagggccttgtgcaggcgtagcaccttggcctccttgccggggatcacaaatcccggcggctggtgcacgtagacctcctccttcaagtcgcagtttaaaaacgccgacttgacgtccatgtgatggacgccccagccttcccgagcagccagcgcaaggagtcgcacagactccatccgtgccacgggagcgaaggcatcgtcgtagtcgatcccctcctgctgcacgaaaccgcgtgccaccaagcgagccttgtgcttgatgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctacaaaagaccgaggctcaccgtcgtcgcacgcaaggtgcaactgcgcctctaggtcgcgaggcaccagtcccggcaccggctggtcgccgagaagatcctccatcgtacggtaccgtagctgctcgccgtcgtggtacgcgtcgatgcgctccccgtcgtgggagagcggagtagcgaactccaccgggctgcgctcaacacgagctggcgtcggagtagacgtgcttggaggagtggctgttggtgctggagcatgtggagtcactggctggggttgtgtcgacgaagagctcgtcgtagtcgaagtcgtggcccgagggtgtgttggtgtcggagtcggtggagattcgggggctggggtagacacgctaggtgaagaagagctgcctactcccccagctccctcgaagtggacgtactcgacggtgaagtcgtcgtacgtcggagtcgaaccatcgtccaccgccttgtcccatacccaccctcgcccttcgtcgaacacaacgtcgcgcgcagtgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctgcccccagaagatggccggcatccccctctgcttgaggagggcccgagccatccccacaaccgtcgggttgcgccgctcgacgacgccgttctgctgcgggctgtacggcgtggtgtagtggcgctgaatgccctcatcagcgcagtacgacgcgaattcagccgctgtgaattcgccgccgttgtcagtgcgcagcacgcgcagcttgcggccgca

SEQ ID NO: 30886 - DNA, 1501 bp, Oryza sativa
tgagaagcgtaataccctactcctgtgttttggtggatctgtgtatgaaggagctacaaagtgtgagccaacctctcccttgttctaggttccgaatctggagaaaaatcccctcttctcaatgggcaaggtcctccttttatatttcaaggggataccacatgcacccccccctttccaaactggacttttcttctcttcataaatggacggagatttgcacggttgccctccgaacatccttctgacgggacggcacatacctacctccacttctgccggaggcaggcgcgtcgtgggaacgtggctgtctgctgacggcatgatcagtgtcagaccggtcacaaatcggtcattcttgtccaccacgcgtcagcttagcaacgtgcatgtttgcccttcttcacacaacatcttgcttgtaatggttaggatgaagcctggcatatatccgaccggggctaacgtgccatctctgggaggtaacacgctagctccagctggggacgagtgcctagaagctctcgtcttgacgggatggggcgaagcgtgcgtcagaccgcctgttgccacctaacccgcgatctgaccggtctgtgactggtcacagaccggataaacgagtgcactgcactgcatttcgtgcggcgtgacacgtttagccgagccgcaataaatgcggttaggtgagccccgctgtgctcacctaacccatacacgcggagtagaacccgcgaggggtcggggcgcctcggccctcgggggcgaggcaggagtggtccgacccccctcggggagaccaagaggtgggcgcacacatcaccctcgggcccgacgtcccccgagggtgccaggccacgtgggcgattgtgtctgcctcaagcctctagtcatgatactcccggtcccatgtcaccgacagtagcccccggcgttatgccagggcgatcgcccttttcaagggaagcggtcgggcgtgacgccacccctaaagcctggtgacaagtgggaccggtctctacaattaggcagaaacccaacggtcacaaactacgcacatcggcaatggtaactcggctgtcagtaatgagcggtctcttccagactgccacattactcgagtagtacacgaatctggacgagccgattcgctttgccaggagatatgtgatggcgcttcggtcggcgagcgtaatcaacgcgcgcacgaaatgatctatctcgactgccacaaccgcatatccacctcacgcgccgcaagcgggcgaatgggattagtggaggtgtgggcgcgagaaacgagggggcgaaacggtgggtgcgagaaacgaggagccgggcacagcattggcaagagtataaaggcactgaggagaggatttgtttccttcctttcgccatcattccccttgtcttcgccgcttgcgccctaactccttctttcctgcgcccttctttcgccacacgcgctcgctctccatcttctcttcgtccggcgcca

SEQ ID NO: 30887 - DNA, 1501 bp, Oryza sativa
gcagagctgctccacgtggtcaagacacggcatgcctcgcaccatctccttggcactgagctgcttcagggcctcgaagtggaggtgcccgaagcgctcgtgccactgccacgcctcgtcgtcccgatgagcggcgaggcaaactggttgtgcgacctgcacgttgaggatgtcgagtcgattagtgcctctggttaccttggcaagaaggcgacgacggcgatcccaaatcctcatgagtccgtcctcgaccaacacgcgtgagccgttctcatccagctgtcccacgctgatgatagaattcctcaacgcagggatgtagtagactccggtgagcagcctgtgctcaccggacttggcggtgaaggtgacggagccaacacccttgatctccacgccggaggcgtccccgaacttgacggagcctcggacgctggagtcgaactcggtgaagaactcccgtcggccggtcatgtgatgggtggcgccggtgtcgaggtaccacccatcagccttgtcgttgctggagccgttgcagagggagacgagtaccttcggctcatcaaggtggaggaaagccgctgcggccggtgccgctggaggtagctcgatgcttgcgtgagccaggagcagagccggctcttcctccacccgtgcgacgtgggcctggccacgtcgtggctgtcgacagtctttggcccaatggccaagcttgccacagttgcggcaggcgtcgtctcgtgccggcttgtggttgccggtggcaacgccctgggcgcctctgcgggcgccaccctcggcacgtcttcgcgcccaccgtagctggacacctccccgcgccttgcgcggcttacggccggctgtcggggaagatgactcccccttcctcccgtcaccctgagaggcctcccactgctcccgagtgagatggagcttcccgccgatggtgatgggccccgagagaggctgtggctcatcaccatcgacgaccttgaggcgacctaacgcctcctcgatcgacatcgtggagaggtccagcagagattcaatcgagcgagcgatctacctgtacttctcagggacgcagcggaagagcttctcgacagctctctcctcatcgtaggtgtcgtcaccgtactgcaccattttctgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttttgggaaagcgagaactgcatctcgggcgggactgcagcgatgagggcatctagtgcccgccgatcctcgtcgtagtcgacgtcaccgtaccggactgcttcccacatgtgccgcacctggagcctcaccctcatcatcgcggcccactcgatgtagttggttttggtgagggtaggccaccga

SEQ ID NO: 30888 - DNA, 1501 bp, Oryza sativa
ccagggccttgatgcacacggcgatccggtttggtgcttgccacatcattttctctttttccttctcttccttctttaattaccatgtcacatcaaatttttattaggtggcatcctaataaattccatagacaccagcttagagcaaatacaatagtaagctataagctagctataaatatattttaagaagataaaaaaaaagagaagagcagcgggctacaaatttgtagccaactgtagcacggactccaagacgcagtgtgtgtatgataagtgggatcaggtattaatagagtatataactattgtatgaattggctattaaattgattatagataatttgaagctagtggttaactatactattaaacttgctcttatgtggtgggttgggactatatatatagttagagcaggtacaatagcaagttataaggtagctaagctagctagctacagacatacgtagaggagaggagggagaaaaaaacgggttatatatttgtagccaactttaacacgagctataagatattatatgtgtatgagagatgcgccaagtactaatagtatagtgtatatttatataaaaatatttgacggagcgtggggctcctcaccgggagaccgcacaggccccccctttgccggttcggccgggggctcagggtgaaatcccaagctctctctgtatgtggaaagatcgcgacctatcgaaagagcatgaggcacaggcgatgtatacaggttcgggccgctgagaagcgtaataccctactcctgtgttttggtggatctgtgtatgaaggagctacaaagtgtgagccaacctctcccttgttctaggttccgaatctggagaaaaatcccctcttctcaatgggcaaggtcctccttttatatttcaaggggataccacatgcacccccccctttccaaactggacttttcttctcttcataaatggacggagatttgcacggttgccctccgaacatccttctgacgggacggcacatacctacctccacttctgccggaggcaggcgcgtcgtgggaacgtggctgtctgctgacggcatgatcagtgtcagaccggtcacaaatcggtcattcttgtccaccacgcgtcagcttagcaacgtgcatgtttgcccttcttcacacaacatcttgcttgtaatggttaggatgaagcctggcatatatccgaccggggctaacgtgccatctctgggaggtaacacgctagctccagctggggacgagtgcctagaagctctcgtcttgacgggatggggcgaagcgtgcgtcagaccgcctgttgccacctaacccgcgatctgaccggtctgtgactggtcacagaccggataaacgagtgcactgcactgcatttcgtgcggcgtgacacgtttagccgagccgcaataaatgcggttaggtgagccccgctgtgctcacctaacccatacacgcggagtagaacccgcgagg

SEQ ID NO: 30889 - DNA, 1501 bp, Oryza sativa
acggagtacttcgtcggcttcccccgtcctcgtcgcaccgaggtggagaccgtcgagttgttgggtcttggcgagctccagcggcgacgagatggagaaggtggagtggcggtgcgggcggctaggattttcgcctcccgagccgcccgcgcgagagctacgcgggagttgcaattgattttcgcacagggccctgcacctgggacaattaatgctagctatgatgggagtttatcatttcggttcacgtcctttatcataacaaaactatgattatactattatagacactaatatagtaatatcttctataccaacgattataatggtaatagcagagtatcctcaccttttgtcattatgatcctggatgagttggaggctcgcgcccatcaggtaccagaacaatctggcagggacaaaatcaaggttagcccttgtagaatctagtaaagcaaattctacagacagggaactggattgatgtaacccaataccagctgaagctctagtttacatatgctaccgtgtcgttgattgttgtcctaggaatttaaataatggcatgagtgctaatatatctactcctagcaaacgtaatatagttgggaggtttgtgaggtcgtctagtgtttaagtggcaaaagaatatgatccattgggtcaattagctctctagcaaatcaacacatgatgccttcttaccgctgtattacaattaatggagaattcttcgatgcagctaaagatttggtagtatcagttcctaaaatgaagagcaggcccctaattttgagataacagtacaatcctacttttctttttgtgctatagaaatctctcacaaaaaataagatccttattactacatagtagaactaagcatcagaaattcactacgtcaagaccacattcttcccaatctctataagtgaatggtggattttgaaatgtcacctaattgatccgcgtaagctaaaaaagttggaccatcggataaaggaagccattggattgtatcagtgaaaaagggtaaaactgatcttctggagctttccagctcctccggtcctccccacacaagtgggagagagtgcaaagaaaataaaaaaaaattgcaaagggaacacaggaataaaattatcttttgaagcaaacccacatcgctcttgacactggcagtcatggtgttcaaaacaaattgcagaaaggcttgagggataaaattgtaatcatcctacttttgctataatatgaaaaaagaaatagtaaaattgatgagggatgttaggcctcgatcttccaataggtattgataaacaatcgatttgggcggagtcgcgacacaactcaatccggcttctgaacgaacacgctactgagccccgcaatcgcaacaccacgtctcctctggttatcaatcgtgccgaaacctggttgacctcgccgagaaggctaatacctgcatgcgtatcgaagaacacaagcaagaacaagatag

SEQ ID NO: 30890 - DNA, 1501 bp, Oryza sativa
tgtgcgctttagaagagacttagtgcaagataaaaagatagaatgggcaaactgaaacgaagagtcgtttgatcaaaccacaagctatcatgtcaagatccaaactactattaatatcgttgatttcgtcatccaaattgctatcagtggggcgcttcttatattgggcaaataccaaagaaatgacttttaaatattgagagagagatgacgacgacttcaggtcatgaacaaaataagatcgtacacaaactttttacgatacgatgcagccatactatttgttttgtccatcataaattgataaatattaaacatgacatcagagacagatctggtgggtagataatgagaaaatatccagtgaaaatcataagtgaaaaccatacctaaaagttctctaaattcatcaaaaaaaatattggagttagcagtaggcatcacatacattcacacgaaatcacaagttcaaactcaacttcatttgagaggaaaaaaaagagataaattttaggtgaatagtgccatattactatgagagaatccattatatgccactaactttgtcacatgtctacgatttaccattgaatttgtcacattctacaatataccatcgacttttgcttaacttctacgatttaccatcgctgtccggttagcctccgttaacactgtacaattttgtccaaatgaccaaaatacccctacgacaaaaactttcaaattttggataaaaatttcaaaatatcatattataaacataagattgtaaccatctaaaatttggtctaaaacatgaaatttgatatttcagaatttttgtccaaaatttgaaagtttttgttcccagggatattttgatcatttcaataaatttgtacagtactcactgagactaaccggacggcaatagtaaatcgtagaagttaagtgaaagttgatggtatattgtagaacgtgataaagtcagtggtaaattgtagaagtgtgacaaagttaatggcatataatagattttctctattactattcatccaaaaattgtcctctttttactcccaaataaagttcttctttaaagatacttttaactttcatacactagttgcttatgtaaaagaacttagcttggggcagaagggaggaaaaactgatatatataatatacaaaatcacggtttcatcggtactcctctttcacacattgaaagaaacatggatgcccccatgaagttgacaatattccgtcttgcagtctaaatcaagcaatatagtaggacaatgcaatgtgtacaccgtggagatgcccaacagtttttttgccttaccaaccccagtattcaattgttcaagtcagcaacatacatgggtattacggccacatgcgcgctaatgcatatcgtcacctaagtaagccgcatagtgttaaaactgaacctaaagctacctgcctctctctgtctctcttcttctctctacttcgatagccaaagctccc

SEQ ID NO: 30891 - DNA, 419 bp, Oryza sativa
tcgagtgtttgcttggattagcagatctgcttagtaaggtaaggcgtcatttgccgatacgaattaggcattgttatatgatgtacttccggttttggttgatgcgtttttgctttgagcgtcattgaaccgagcaaatcctgatagtagctgtcacctccaaattagtacgccatcatggtgtgtgatacacctccacctttgggtagtgcgctttatggagagcagtaatgcgttccgttttaagcatgggcaaacggagcaaaacattgtatcctcataggtagaggttgttactaaatctaaccgctttaagcggttaaatgaacggtattgagaccagacaggttggtgcatggtaatatcattggtggagaaaccatctttcctcccggttcgtaacccccatttaattccag

SEQ ID NO: 30892 - DNA, 297 bp, Oryza sativa
ttccccgacgcttttcaacatcacctggcttttttttctctactaacctaatactattgttctgaatatcattattcgccatgctcctctcattcacatcccctctgttcctctgagatcccttttgcctatcaaaagatgtactccttccatcacctgacctctcgtcccctcgccgaacaaccggtgcatcgccatcgcctgtaaacctcctcctcgagctccttccatccgattctgtgctctctaaactcttgctcctgtccaacttcaccgactccatgatcttcacatagt

SEQ ID NO: 30893 - DNA, 1501 bp, Oryza sativa
gagatcccgtcgacggtgtctccgctgcggattgttaggcgaacgagccgataaggagccacctgaacgtctctataatctccgcctggtcctccccatggaccaaacttggtaactatcatgctctaaatcatccacagacagatcggtatgttgttacagttttgaatgtggaaaatgttgataaaatctttagagggaggaagaggataacacaccattttgactgatgtagctaacttcttcttaagttcgcaaatgtatagcttgctgcactagagtaaccaggaagattagaaacagttcatatttgtactagctaagatgtgtatacttgggttttgagcatcccacactatagatagatagacggatatataggtccaaagagagaattctttgtatggccttaatttttttgtcaatctcttttatacccctgtttattctcactttctttgcatactattgaatttgtgttgattcttttcatacccattctatcagtttatcattagctgaccaattaatagctctgaaaagtccaatttacccttcgagcatgacaggaatgtaagaatatttggagtacatgagtttgttctatgagttcatattaatcataaggtttacagtatgaggccatattgttagtaaacaagtttatttttacataatgcaagataaaatttaatacacactaaagagattatattgtatttttttgatgctatatacgacaaattttggatgttgtatgcagtatctgagaattgctatactggtctcacctttgtacatcgaatctaaaataatgttatgcatgtctttttgaatatattttaaattttggcctcatatatatagaacgaagttaatattataggtaaatataagatgacattactctataaattttaaattttcgtccatgttcaaggataaaactaatataaatttcgcagggttgttaaacgactcaccaaggaagaagtataagtggatcaaaaccaaacttaggcgtacaagtcagtaagtagaatggaaaggttcatctcagattttaaggcactactacagaaatcctaataggggacaacgttatatgcgttggattaggaaaaaccggtaatgataagtggttcgtgcccacccaaccccgccacatcctgagagagaaaaaactggcactgataactcctcgtctgtgcaggttctttaataaaaatgaaccatatatatttcccatactttttttattagctggtgcatttaaaatgacattggtgccagtttttattaaaccgacacatatcgagcagatagcaatgccgagtgcgggggagaaaaaaaaacagctgcttccttatcctttccctcacattctcattttctcccctcgtccttatcctttcccccttcactctatctcctgtctccctctcacatctacccacccgaaccaccactacttctgcagccccttctgtatgctgatgtg

SEQ ID NO: 30894 - DNA, 162 bp, Oryza sativa
tcctatggtggtgccgaattgagaggtgtcctaacttagaaggcactatttttactgcgccttgcactcgagacaatattttccggagtctcgaaacattctgggcatctcaactcttaaaggttttctacatctgggactgggacacgtcattgtttcagc

SEQ ID NO: 30895 - DNA, 1125 bp, Oryza sativa
ttgccttccattgcaagaattccagcatggtacccaactttttgtgtacatgttcgcaacctgggtgttttgtggtccgctaacatatgctccaatttctagacctcctttttaatttcgcaatccttctttacgtcacacaacatctcaccaagatcatctgcaccatcgttttcttcaacagctccgtctgcctcgcctgttgtattttatggaagtccatcgtattgagcccaatccggaatgttgtcgtcttcttcttaatcttcttccattgcaacctctaactcttcgtgcgagatccaacaattatagctaggcatgaatcctgactaaaacaagtgcatatgaagaattcttgatatagaatactccatctggttttgcacttttcgcatggacaatatataaaacctttaggcttgtgggcattggccacactcaaaaaaataatgcgagccattaattaattccttcgatcgtcggtccgtggtgtacatccatagccgattcatctacattaggaagtaacaaatgtaaaggaagtccatgaaagtgaaactacttcaatagtaatacaataatttaaaacatcgtaactaaactgaaaactgagggtaaacatttttaatgtattcttcttatttctaacgattttaatgagtttaaagatccgaaatatttgttggttttgccgatcgagcaaagatcggttgtccagtagtagtgtcagtagtgtcttatgggaagtgccactgatgtgaagaaaattttgctaaagtgactcgttaactttatgttgaaattctctatcattaattcctgtagatatgttcaaaactatctaaatagttcttttttttccaaaaagcagttgttatttttccaaaaagcacttgttatttttataaaatagttctaattagtttccaaacatcccatcttttctagtagagacactccatctactagaaaagactaagaaaattaaggtctactgctggctcagtcgctcagatgtgtggcaaaggtcaggatcactctcttgctgatttgctgtagaacaaaagatgattctgcatacccttgcccggacgcctcaaaccgctgctcttatgtcataga

SEQ ID NO: 30896 - DNA, 1501 bp, Oryza sativa
attcatgtattcatgctattttcgatgatgtgtcaagtgattggatgaaatgacttcccaatgcggaggccccagtcaggttacagaaccctggaggggtcggggacgggggctgatttggtgccgcatctccactggggaccagggccgggtggagaggtccggggtcaggggcaaggccattccagcccaacctgctccgttgcatccctatatggaaaccatcattaccatcacatgtagtgttctttagcctatggatcccacgtgatatctccttaacgatttagagctcatcttcaaatatgtctagtcctaatccatcaccggctatacttccatggcttcgagcaacacctacccattaaacaagaaagaaaccatatccgaacacaagttcaaattaacttgactcacattagcacacaaacatcgctaaaccgcacccagggtgcgctatatctaaagcgctcccctcacatgcctcccacaccttttcttgctcatatattctttctttcagcaaataaattactcatagtaaaatctttctattagtaaataaattacaaacagatatgttgatctttacattgttatcccacaccttttttccttgtccatcctgactgccaccacacatttctcttgcatacatagtcctcttatagtaaattaattacttacagttattatattgtgattagtaaatggactactcggatgccttatcttagtaaataaattactattactcgtagttattatgtttttgttagtaaatgaattactcgaacatcttctcttagtaaataagttactccttgcaatacattctgtcagtaaatcaattactccttccgatctcttctttaaatttaaaatatactaaaattctagccacataatttctcctagtaaattagctactatccgcaccaatatttctccctcaataaattactcatagttattgtccttcccttaataaataaattactcttacttctcgtagtaaactaagaagtccttctagcgatgcttctcttagtaaattaattactctttccaacaccatctttcaaaataaattactccagggagtaaaagaatcacaaacatattgttccaaccacataatttaataaattcttaccaaaccagaaaatttttcaatggtattatatcaacgatctgatcacacatgcaatgtggtacatcggtagaatgcagagaagtaattaaagatcacaacagctcccgtaaatgaatcacaacagcaacagcactgatggatacggtgatgaagatttgatgccaagactaatacgacaatctagatcaaggccaatgacgcatctatgcatgcacgaatccaacaagcaagacaacaccaataacataaatcgacgttgagccgtagaggtgctgcaaattccagttctctctgtcgacagatatctgtcaccacggctgtgtggagaggcattccatagccact

SEQ ID NO: 30897 - DNA, 249 bp, Oryza sativa
tttctctctttgatgatcctccgtttgactaaaaccattctgttgaagagttgcgttgatttattgttaaaatggacgttccttccccactacttttctcctctgatctatgtgcggtttgacttgagaatacatgttagaaaatgcagcaatgcttcagttgaatttctggcaacacaagcatctatcaactttatagcccagagaagttagatgtgcaatgattgacttgttgtatttggtaacaga

SEQ ID NO: 30898 - DNA, 1501 bp, Oryza sativa
gtaaaaaatataggagacatatttttatacatgttcggaccccttaactaaccggtaatagccctagtcttgttggctgaagccggtgtagccattatatatcagtatcacattagtacaatatttgggataacctaatatagtctcggttagtttggcagaaaggagttctcacacgtagccgatggctagcgtagtcttcgtcctcgaatatgaactcgatgagactgaaggtagcgctagatctctcttgtcggtcattgtggctggcccccgattgagtatgtctaggcttttgttgttgtctgttggcttgtttcctctcctccaaggggtcttgtatttataccctcgaatgtccccctgtcgaaggaaaactagggagacaagtatggatacgatccgagtagttctatttttctttccttatccaaaacaccttccgtatatcaggcatgattctgcataaaacttggtatatggtgggctacgtcgataccaatccaagactattgggtatgcccgatctataacactgacggttagtataataaacttataccactaattttgatagtatatttggcatcttttatgcaatagctaacggttaaagtttgcacttaaggaccgtcaacagtaacgaaaatgatggctttcattgtaaagtattgtcttaaatacttatcccacacattcatcccatcctaccataaatctttcatatctttcatcaatggctcatggacatggacaatgtatctgtgttccaactgctcaacttcttttcaattctctcctctttcattttccaatacttgttatttaactttctagaatgcataggaatgccaagatatttaatagggtaagacccatgcggcacccaaaaatttgagaatattgttcttaacattcttttgcttcaccaaagcaaaagaattcactcttatgaaaatttattttaagaccacaaagcttttcggacacaaaaagaagtaacttcattttcttagaattttctaaattttctcaatgtgtcatccgcatactacaagatagacaaaccctcatcaacgacatatggaaccaaccatttggccatctgaataagtacagccaacatatcaacaactatgttaaacaagattggagagagaggatcaccttgccttaaacccttccaaggtttaaaatttggtccaatctggtcgttaacttctataccaacattacccattggatgaaggaatcaatccattcacaccatttagtggaaaagcctttcattctaatagtttgttgcacaaaagaccaataaattttatcacacgctttctcaaactcaatcataaaaataatcccattttgttttttcctatgcaactcatgaatcgtctcatgttaaataactacccgtccatgatattcctaccatgaataaaagccatctgagttgggcttataacattttgtgccattcccataattctatttgtga

SEQ ID NO: 30899 - DNA, 1501 bp, Oryza sativa
cctagcatagtctgatcaaattttagtaccagtgttcacattaaacaacgacggttctgtccaccatccattgtgatcctaaggatagcttcccgccattgagtcgtcatggttttctgaggacgtccaccttccctcctctcaggaagtggctccatcaacataaaaatcatcatgcaatatcccatcccatacaagttaagaatttagagtctagccaagtgtaatacacgtcccggtgttcaataaccgcgagcacggctattcgaatagatttggtttactcacactgcagtggatgtacactttacccgcacttcgcgactgcccaacatatgagcctcgccccaacacatgaaacgcgtcacggcaaagcctttcgacaacctcgcattggcagtacccgctccataaactttacatcctcatgcactccaggcgtaatacgatttctagcagtgataggagttctggcgcacccgggaagggaagactcacacatgcattaagttataattatgtttagattctcacatggcagtcctaccgatggcgacaccactgtagacacctgcctcgtggtcctaccaatggctgccccaccgtagagcccttgcctcacacatcaagaaaccactatgcatggatactgcctccgctcagctatctactccgctaggtctataaccatacgagaagtgcggttgtacgggggtcgtttcatgcttaacttcatggttcggtccttaactgaccagggacggcactagccttttctggacactaccaaaatcctctagccgccccagtcgaaaacatttgtttagttttatttttttcctttcacaaatcatgtcatcaatatcatggcaatgtggcgttcatgtctccacatgccgcatctcaattaccttcctaaaggtaatttcccaagcataaaacatttgataaatatgagtatgcatgaatctagaataacatttctaagcatttgtcataattgactagggactcatacgtactcatggttacagggatttaagggtaaacaataatcaaggcatggcataatcataagtaggatgttcatcattgcatgcaattttatttgtaaacaaaataatttcgcaattgggatcaacatgttcaaagaatagtgattacttgccatgctcgtagtcctgcaggtcttgttcctcgctcggatccgcaactacctcgggctctaaaattacgtgcgaagaaatgatttgaattcaattagacttcaaataaaatccaaataaactcaaataaaagtcgaacgcgaatcgatctttctatatcgactacaaagttagcgaaactacgttattccaattttaagctcattcaacctaagtcattttgcgatttagaagtatcttctttaaaattcatcaaacaatacaattcttagtaattaaatccgattatctaccatgaattaattacttacagagattaccaaaataatctataa

SEQ ID NO: 30900 - DNA, 618 bp, Oryza sativa
  unsure (1)..(618): unsure at all n locations
ttgcttggcgaccttcgaataatgtaattaaacttgagagtcgcctgcatccaatcctggcaagaaaatcataaagttaagtaaatacaatatctgcattgaacaattaaaacatcacacaagttgtaactataattttatatattatctatattttactttttttagaattttttaaaattctaaacatattttttagtgtgttctccttattttctaaccattttaatgaattttaaatggaattatatacattgtaaatagattctataagattgtaaacattgtaaatagatttttaaatggaattgatgtattatttatattgtgcaatgtaatgtattactttcagtttatatattttttaaagtttgtaatgtatttcttaaaaataaattcaaaaatcggggacggactgacaggtgggctaaagatacctttagtcccggttattaccacaaacttgttgaattgaaagttaagttagaaaattaaataggaaataacaatagatataatctagtatgtagacagtaaataannatcttttcagcgatgaggcttcatatcatcgcaggtacatggtaccaatgttggtgggatcatgtgatccacagg

SEQ ID NO: 30901 - DNA, 1501 bp, Oryza sativa
tctgtttccatggggaatacaatgtgttgttgctttgcagtatgtttagctagcacttgttaaactacaagctggactagcagctccatctgcatcaatgctttctggatctccatatctcaccatctgctcgcaaaactatctctttgaagctccctacttccttccagccaaccaatatttcctacacagatataaacagatacacttgatgggtccaaagtccaaactgttactagctccttaattacatcgatgatgaggtacatatatgatggctattcatgatttggcttaactaatcattctcaaacaaagtaaatacaagctgtaattaaaactggagtgtcagcatgtattcgtgaaccctcgttgaacatttaaacaagcttgaactatatataatgatgcgtaaatgggtagaggtatagactaatcaccttgatcttgacttcaggaaaccatgcatggttgcatatgcataaggaggaagatgagcgataatgtctggagagcagacaactgacatgcatatactaggtgcttctctaatgcagaggcttcaatgaaatgacgtgcggcgttccattccctggcatatattcctgccttgtgcttcctttgaattgcttttctgcaaagcccccaaatcggtcatatgctgcacgcagcatcaatcatcaaattctttgcttgtatctgtgtcagatgccaggctagctgggacctgccatgaaagataactaaaggtaaaggtacaaggcaggtagagacatgtacgatccaattggggatgggaatggatcaatcgactgaagatttgtctggttaggttaggcctacatggaagaagattagtacggtaatgtaaaactatttcgacccagtgattgatagaataatcttgggcatttgtatttttcttaagtttagctgcatttcagttcgttagttgtttcctcatgcatgtaataagctgactgaaaataagtttagctgcattacagttcgttagttgtttcctcttaagtttagcctttttttagtcgttgtggccgagctgggaacggatcgtgggatggcacgaattctcagatctagctgtttaatcggtcaagttttgcatgtagcaaactcttaagatggaggtgaataaatagaaggagaaaaaccgaaaagctgcagcggcattacgcaacgcaaaaccagtcgttcttgttgctctgttttcttcgtgctctgttcttcagtccattgttcacgtctggaaatattcagagatagtaggatagccatagatcgagtgcagagtgagggaaatttgctgacaattggtatcagagcgaggttccggttccgtttttgatgttgtcggatgcgcgctacattccgccgccgaggcgtggtggaagtgacggtagtagcagcgagcaggggagcggcagtgcaaatggcgcaacgatgccgctggtgccgctgtccagagatggtggcacagctg

SEQ ID NO: 30902 - DNA, 1501 bp, Oryza sativa
ccggtgttgtgccgtgatggatccattaggcggtcgccgccgccgtactgctgcatctgagagtggaggaggatggatgaagggttgtaccagtgtgagggcgagagatgtaagtcacctccgatcccttcaaaacccaccattttttttcttgtcttggcttattttgtggcaacacatcaggccagccagacacataatttaccaccagatctgaatcgctcccgcggttgtaatgtataggatgtatgtatgtatgcatgttcatctgtttgtttggttttccctttcactagattcattctttcttagcacaaagcacccccccaaaaaaactctcttttcgttgtccttgtggatttctcagaattcggcgcagctgactccgattcgtttttggtgttagagagacaccgattcggactatgttatgttaccttttgtgaataaatatagtactagtgtatatgtgcaccgcaatctcagagttaagcatcatacatagtctttgtttgtgtgtttgctgcatgtacgacgacaccatggacgtgaagacgaggagcaggaataggaagaggaagaggactgtagtaccacctgcagcagctacttttcctgatctgctgccggaggagattgtggtggagattctggctcggctgcccgtcaaatccctgctacgcttcaagtccgtctgcagagggtggcgtgcaatcatctccgagccatccttcatccgaacgcaactccagtgctcggcttctaaacaggagccatccatcctcatcagcccccacaccctccttgggcgttgcgatattcaacccccagttggaggactaggtgattggcccaacaacttctccacccaaatcagcttctaccaatggcagcgaggtgcctccattgccaggttcatggatgccacggccttccctgccaacgagttccacctcgtctgccacttcgcccactgcgatggcctagtgctcgcccccacagacaccaacctctacctcttcaacccggccacgagggacaccatcactctccctgacggccatggtgataaccaccaccatggcacggaaatggaagcttgctacgctgcagggctaggcctagatcctgtcacacgcaagtacaaggtggttcgagcattctaccgttcaatggaccccatccgcatggggatggaggtgttcaccgtcggtgaaacgggcgcaggctgtggctggagggagaccgtcactgatcctccctaccctgtcagtagatggctcactgccttcactgtcaatggtggctacttgttctggtacatggatcggtttcgctaccctaatgacactctccatggtggcctcctttggtttagcctgcaagaccaagcgttccgcgtcactcttcttcctcattcactggaccctgccctagatgacaaggtcaggccggacgtgctacacggcgaattgtgcgtccttcatgccaacagtgacac

SEQ ID NO: 30903 - DNA, 1501 bp, Oryza sativa
aaaaaagaatcatacgttttccctcacttttgttggctttgaaagataagaatgcatacaaggcaggcagcatggacagcctaatatatgattggctgttggcccatgtatttctagacacgttcatgtagtagctgcatgcacttcgtttgtttatagatcttgatatatacaatccacgagcaacttggtatatacatcgatgtctttgtgttccattagaagtgtacgtccaattcaaaatttaagaaaaccatgggtcaatttttaaattaatccctacatctgcaatttttagttccatttgtgggaagatcaactcattgaccggataggccttcatttctacgaaatggcagctctccatgcatgagagcagatttaattgacttttgcttgtaaggtttttgtcgtgctacagtgctgctctctctttttttccctttaattcctagaataggagctctactaattcttcaaaaataattaataagaaattacaaacagcgtgtaaaagtctaaaggcataatatcgtgagctacaaattaacatttacgccacgtggacaacccaatacaacataccacacgccaagtatataaaactcaagaaaaacacgacactctaccaaactatcgcaccctcacgctctacatccaactcaccatttacaattgtcgctttatatcgctcacctcatgaagctagctctaacttcaccaacgaaggcattgtcacgtgtaccatctattgtacatcatcgcgacggtagcgccaatttcctcgtgatacttctaaaaatatcgggaggctttttaactctcaagatgttccaaatatctcatgttattggtatgaaacttacttttccttaattatcctttctttggtatgattaattacagcataaattaggccatgttgatatattcctttcttaagaacattagcactaccaataaacttcccaatcctttagctataatttatatccaaagtttaaataattcaaaagaagataagggaaagcaaagaattcaacggagacaaaccctcttgagcccccccaaatcccaaattgcgaaaatctagtacactcaaatcacaacactagccaagccagcacaccactactctactggatcgagtacagtacacagtatgatgattttttttgtgattatagaaattaaatgttaaatagtgaaattaggagaggaagaatccaagagcaattaggatgcgagtgcagaagcgtccctttcccggacaatttcccggcagaagtataaatcacaagccgccatggccgccctcgcttcctgccaaaatccttacttataagccacagacaagtgccgtagctaagctagctcacctttctcctcaccggcaagatcgcaagaacgcaacaagagaggaggagattgatgtcgtcttcggctgtgattccgccgccgtcgccggagaggagggtgccgatggtggctgtgccggtgg

SEQ ID NO: 30904 - DNA, 194 bp, Oryza sativa
taaacctgacttggccgagctgaaagtgtgttcatcgttcacttcaatttagtttacttccaagtgcaatctgcctatctatctagctactactcctagattgttagaccagtgatcaagtagtcgatcaaactgttgatctgtttgaaatcctcatacttaaactggcaacttgtgcttgattttgctttcca

SEQ ID NO: 30905 - DNA, 1501 bp, Oryza sativa
tttttatcttgcactaagtctcttctaaagcgcacacagtcatcagcacttaccaatttcgctttccgatttgatgtgtcattagctgatctttctctggtggcgagacattttacctggttttgacctgaccagctgatctcattctgcaggggaaaccatgcacttggtcatactagttctactgcccaaataatgcaaaactgcaagaattacccctcttggctactggctttgtttgacacaatggcacttacactctttcaggatttgatagtacataaccacaaatagtagacgcacatatgcatgtagctggcaatggcatcttcttgacctgccgctccaattgtaattccagtacagtctatagggaagttgaagtatcatattctatagactgtcttaatttaagactaattgcacaaattttgtacgacctagtggcctaagacttcacatcttgcctggtttttttttttttgtgcatctttcagcttctagaaccggctggcctgcaggcacaccagtagtgacttcacatctttaatctgctagtgctagttgtctgagggtaaggtttcatgctcaaccgctcaaactaggacctgcaatgcaagtgtcgtatttttcttctcacattcttgtaacataacatcagtgcttggacagcatcgaccaactggtctttcttctcccttgcccggtcttggatccatggatcgttttcctgcagctttctgatcgatgcaattaagcttgctttgccttcagctatcgtcagtgcttgactgaccatgcgagtataacgtagctgcctcttcctggtcaatatcgttacctgccatggacaaaatgtaaaatactccaggaaaatccattatatatctatatgatacccacaaaaccttatttttgtggtgtactcctaatcttattgtatactccctccgtactcataaaggaagtcgtttaggacagcgacacggtttccaaaacacaactttgacttcttgtttctataaaaatatttattgaaaaatgatatatgtatatttttatgaaagtattttttaaaacaaatctattcatataatttttatattttcaaactcaacaacttgagagttattcatgatttatattctcaaggtttgacttaaacattgttctaaacgacttcctttatgagtacggagggaatatgtacaggatttgagctcttcttttcgcgaaaagagagaatttgagctcttttacagtgctccttggcattggcgttgcaagccatgggacctcactgggctgcaatgctgaagcttcttccctatctgaatagattgacctcagttgtagtgggcaatggtatcagagccagctttcggaaagatcgatggcttatacaaatgccactgcaagagaaattcccagctctattcaccccttccaggcaacaacaagcaacagtggcagtacatgcaaagaatattgttccgtctcc

SEQ ID NO: 30906 - DNA, 1501 bp, Oryza sativa
tctagattatgaagatcctcttcctgttatacaggaaagacggctgaggctctcaatgtgcttttgcaggagagctgaattgttcctctttggtaggaatcgttatttgttgaaaaaaaaaactgaacagaggaatcttgttgtgtttttccttttattttctccatccctcctccctctcccgttgtgtgtttgtatatggtgagggaacggagttttccagatggtcaggatttttcagtgattttgtcagcgagtacaaggtttacagtaggattgctatgactgaaagatgagtagtcagttgaattgcctaaactttgaagtgtgtcatgtagctacagcagcttatttcctttcgtccctgttccgtatgttttgaactcagaagtatggtatttatgttcaataaaacaattcgatatgactgatatactgtttttcttgtcactacaggatgggctagtggaactgtggaacatgctggtcaactttaacagacagacaacattgtatgcaagtgaagagtaatcttcatatttatttcctcgtaggcctttttttgcagcaatttagaagctaacagttactcctatttgtgccgctggagatgtaatttggataacaatatgtcctgtacgcttggcccttgaatgattggctcatctatgtggccttgtaattataggagtactaattttttggtcactggaagatcactgaaaacgccagagaatccacagtaaaagcctgtttcacagagcccatattttcagggtacgatgaagtggttacgctcggtagtgtgttcttcattagttcatcgttacaacaacagtattgggatacgggatcaatttgaaggtccaatcaacttaatattgtcggtaggcagtgatattctcacattctttgtacatctagaaatatgaagctttagggcccctttgaatcgcaaggtagaaaaaacggaggaataggaaaaacataggattctgacagaaattgaagtgtaaaacagaggattgcaaaacacaggaatgatcgtttaattggagtgcaggaaaaacgcaggaatcggataagagatagactcaaagaaaattttccaagaggttggagctcttgctaaatttcccccaaaatccacatgcaatgtgccattccataggaatttcataggatttagaaagcttcaatcctttaaattaaagggccaaatagtaaaatttactataggatttaaatcctataaaattcctatataaatcctttgattcaaagtcccttagttttgctatctttgtacgtaaaagatcgtattggtagaaatgattttgttgaagtatcatctagttgtcacggctatttctttttcatatattttgtagaagggcacagtatcaaagtattacatgtaacagcgactttatgcttcagttatgcttcacggtactttttttttccttttcattcatatgcttacagcatgaaaatattg

SEQ ID NO: 30907 - DNA, 1501 bp, Oryza sativa
tcatcagcacttcaaatcaaatggaatgttctatactaagcagctggttccttccaggaacatgaaaaattgaaaactctaaacactagcgacacgctcacggcggctcacccgtgacagatcctgacctctctcgcggagcactcgccgcctcgtcggcccttggaccggcatgaggaatccgactcactgctgaactttgaacagctccagctggttcattgagctgaaaatgttttggatgtttgtttagagatcccctcggaagtgttacaacctgcaaagatttatcgacgtaaaatcagcaagcataaatcataagccagctttaggaagcgtgatcacaatttgccggctacaccaatcaatttgggaacctataataacgggcacaactttagtgttcagtctacttttaatagccaattaaaaagaaaagataaaccatgtcagttcggctagcatcgccgcaatgatattggtaccacgactccacgagacagtgacaacacaatgatcaatgacaatacaataccgaactgcccggtcagacatggctacatgacttgcgcgtcactgtcaccctaacgatcagggcatttatcatgcaaattaccaaacgaattgtccacctctacaactggcaatcaacaagtcagcatcccaaacaatggcatggaatgaacatagccaatctttgctccaagtagacaaattactcccatatatagttatatactctagagtccatatagctagcagcaccaaacagaatgttttttttgggatacgcgagggacgcatctttgtattaaggaataaagtatttacagagcgggccgaaaaatcaaaaacacgaaggggacaagatacaggaggggggaggaggaagaaaataaaagcctaatctcccaacgaatgtggcgaccttccacccgacataggggtcgccatggccggtatcgcggctctagccaaccgccaaaggtctgcttcgcccgtcatggccctagcaatttccgcccatgtcctactcttttggttgaagacccgattgtttctttctttccaaatcgtccacgccaaacagaatgttggtattgagaaataatgaggcagctctcaaaaatgtgaaagctgtcatgaagattgtatgaccaagacaagaaacatgtcaaatatttaagctgcacgattagagaatgatggtaaaaacaaaagttcagaccttctaaaattagagagctttaaaagcagtaatatattcaatcactttcatatacctgaaagccgccaggactgaatgcaatgcgacaatgtcctgaaggagcacttaactattcccggtttactggtttaggcatgtagaatttgcagcatggattcaaatttgactccacgaaagaacctttgcaacaagtggatatcaaataaggatgaggcagagcatcataaatggaagcaaacaccttcctccataccatgatctgatggcctgaac

SEQ ID NO: 30908 - DNA, 391 bp, Oryza sativa
atgttgattgcgtgtagtattggtgtgtggtggtgcccttattgtaattatgctggttagggtggtcttatcttgaagttattggacttgttattgcttacgattgtaggcagttcatctctcaagatgatgggtagtgaacagatggcattcaatatgttttcctgcatttgtatctcgcctggtttggtgtgactcaaacagaacgatcttatttataatttggttcaaattgatgaaagcaataatctatcattctatctgttctctgaatgtgttcgaaattttgtattgggcactcacattagtgttgtttgcattattgtttagtcgtttgatgttatcctttggattcactaactgaatcaatcccacgcctcttggttatagg

SEQ ID NO: 30909 - DNA, 1501 bp, Oryza sativa
catgttatttctatgaaatgaaggttgtggggactgaggtgtgtttggttgagctgtggcttttgaaaaaatagctgtgggctgtggcttttcgaaaagtagctgtggaatattggtgtggcttttggaaaagctcgtttggttcaacagttgtgacttttgaaataactagtcccacttacaagcgggctccacatgtcatacacccattggaaaagaggggaaaatgaaggaaaaaaaagaggaaagaaaaaacacataacgtgcgcggcgtcggccttagcggcggtggcggcgacagacacgcgcggcggcgaaggagacctcagcggcggtggcggcgtgtcgcggaggagggcctcggcggcggcagacgcgcgtggcggcggaggaggcctcgacggtgtcggcggcggaatcgaacgcgcaggaggcagacgcgggagtcgacctcggcggcgtcggagctggcctcgacggcggcggcggggaggcagaacgtgcaacggcggcggaggggaggtagacgcatgcggcggcggagtcggcctcaacggtgatggagtcggcctcgacggcaaggaggagcggcggcgcccgggggggaggaggagcggcggcgacggcgaaggtgaagtgaggaggagggacgcacggggggaaggatgggagaaaaaagaaagaagaagtgaagcgttttttgtgtaatggccgaggtggctaatttttcccccaaaagcagatgaatgagggagtagaggtgcttttgatttgtactataccaaaagctgactttgggcaaaagtagctgtgacttttggaccatttggttggcttttggcttttacaaaagcaaaagcaagttgaaaagcccaaccgaacacaccctgaatcctctcacatatgtgtgtgctgtgatttttttccttcctcacttacatgaatcttgaaacaaatctaatagtttaaaattatatgaaagttacgtgtaggttatattacggttatatgcaagttccaatgtaattatattacgattatactataatttcatttgttaaatttttagaaaaacacttatcaacaaatatataacaaaattggcttagcgtgcaccgaggaagcgcatgagagatggagagaggcacgacgggcgcgatcggcagcgtgagcgcgctgggatgccataccgttctgaaatttgaaggaataaaaacactatttgtaattcagttctgctaaggtatatgatgatgtttgagcctcatcgtttgccttatagcatataaagttataagccaatgctaaaatttgaattttaatatttgattttgatgttttttcaaagattttcttttttagctttagcttttaagtcgctatgtcgaggagtgatcctctctagcgggagatcgtgagatccccttttgtgagttcggccgggggaaaaggctcgcttgtcgagatcgtgtatccgccctgagggtttctagatcgcgta

SEQ ID NO: 30910 - DNA, 1501 bp, Oryza sativa
agtattagcctgtctagattcgtaatgtagacaaattcatagtattagaacgtgtgccttatcatctaaaatcgaaagtatgacacatcgatccttatgtattactatgtattttggaaatccactaccacggactcttgctgtcactatcggacagaagatatcaaaacagtttatttcagcaagtggttatcagaaaggcgattcaacgcatccatctagtctacgcacgcatgcgttgcacgcatccgattttcacatcgatgtttcgtattagacccacttttagtttatactttcactttaattcattttcttcttttttatgttttaacaaaactgatataaaaatatttggtgattgataaatactgctagcaaaagtcgtttattgattaaaacaaagagagcaattcacttcgcccctaatgcagctcgagtttggctcgatactccctcgcacgattttagatgtactctgacgtcttctgtggaccaaaaccgtacgttctatcatcacgcaactctattttaaggctccttagaacaacagatttttaaacaaattatagaggaatttattcttatagaaactttttgtttgatcatttggattaaagaaatagctatccaaaaatcctatgaaatttctttgaattagctcaaaacagagaaattttgtaggaattttgacgtgagtttcaacctcttgaaaaaaaaatcctttgcatctatctttattttgattcctacttttttctctccatccaaacacatttgttaaatagtcccacattggttgtggaagggcaaatgacctaaaatataagtgggggagcccctcacctcaatggagcttttggggtgggaaaggccctttacgatcctacaattggtatcagagcctggctaggttaacatctctggcccgatggacacgtgtgaaggcctgatggaccgtgggtacctgcggggcccgtatacctgatggaccgtgggccggtggggtctatacacggtgaaggggcggtgaagggctgagggacaccaatgtgtgaagggggagattgttgaatagtcccacattagttgtggaagggcaaatgacctaagatataagtgggggagcccctcacctcaatgtctagcttttggggtgggaaaggccctttacgatcctacaccatttctacaatgttgtcgtgttttcaaaatcatactcccttcgtccaaagaaagatgaatttagaactggatatgacatattacattataatacaatgtatctggacaaagatatgtccagatttgtattactaagatgtgtcacatccaatattatatcggttttaaatttgacggagagagtaagattgaaggtgttagtctgtttaaattcgtagtactaaaatgtagacagattcgtagtatttgattatgtgtcttatcatctaaaatcgaaagtatgacttatcgatccttatgtactttggaaatccac

SEQ ID NO: 30911 - DNA, 1501 bp, Oryza sativa
gggggccaccggacattccggagactcgcaacgaaagccctacaacctgcccccccaggggtgagcgtgaggggagggccgcctcgcgaagaagagcgtggcactccagatgaggaggcgccttcccccatgcgggtagcccggcgctcgtcccggcgtcgctcgatgttgacccgagcgtcctgcgccccgtagaggtcatcgtgacgcctccgccttcccgagacctccgatgtcgttggagccgtggatcgcctcgaggttgtggccgatcgacgggcccttctcctcgccgacgaggaaagggtagccggggcacttgatgtacctgtggcggtggattggccacccgtggccaactgccgctgggcagcggtgaccaagttggccacgtcgtccagccagcgccgtacgggggtctccggctccgggttcaccgggggatgccgcagaagggcgcccaccgcctgaagcgcgccttggggcgaaccaccgtctccgtagtcgagacgatgacgtgctccgacgcgtcgcgacctccctccgcctgggggcgggagagggccgtaccacttgaacgggttggatcctccctccgcgaaggctcgcggcggggaggacttcgagagccacggcgatggtgatgagggtcacggttttcgcccgaatccccactcccagacggggtgggggtaaacgccaccgcttcccccgcttccaggacctcgaccatggcggtctagggcctggtccgacttggagcggaaggaagcgacttcttctcaaacgcgcaactgccccctacctggcgcgccagctgtcgagggaagaccccccgatcgcgggaagtcgcgtgacccccctttcgtgagttcggccgagggcagagactcgtctctccgaagtcgcgtgttcgtccctccgatccccgtttagatagcacacaattcgattacccaggttcaggccgctctggagcgtaataccctcctcctgcgtttgggattatcagtggacttttacaaggttctccttgctcctctccgctctccggtgggcaaggtcctccttttatagcttaaggggataccacatgcaccgcctctaccctccccctccatcggagggaggggagggggcccttctccctcttcccaccgggtttcaacccgtgccttttgctggaagctaagcatcggtcggtccttgagtggggcccagcgccgtctcccgcctgacacggggggcagccctgtcattccctcataaatgagtgaggacttgcggcagccctatatcgaacgacgtccggatgtgacggggcgtacctaccgccactccgcggagacagaggcgacgtgggggcacgaccatccattcaatcggccgtgaccggcaatagactggtcacagaccggtcgtatccgactgacaggggtcggtcgggcacgccgcacgtctgccctcgccgcattgaacgcagcgagggacggttggggcg

SEQ ID NO: 30912 - DNA, 265 bp, Oryza sativa
caaacccaacttttcaatgtaggtactgaatacttttataaacatgtaatggaatcattatgtgtttgctaaaaaaaataaaaaacaaaaaggtgtctacactattccatttataaaagtgcaagtttcttcgtattccaccgatgaaaactgacaaaaatagaagcaaatgaaggaggagaacaagctctacaccttttatatggaacccaatcaaagatttgaggtcgaaaaccttccccccataatttgcggatgtttaaga

SEQ ID NO: 30913 - DNA, 178 bp, Oryza sativa
attttttttctctttcctctagacttttgttttgggtactgcttgtgctgctgtttcgagattggttctgggaattctggaagtatttggtccttttgatctgagattgtccttttctagattggtttgagcttaaagctatctcctttgttcctgtccttcctgttttaactataga

SEQ ID NO: 30914 - DNA, 1501 bp, Oryza sativa
atggcagacatggtgtaacaccccagataaccactgccgctgccgctgtcgacccggttgctgccgccgccacggccatagccggaggccacagccgtcgtcaggctctgatccacttgtaggatcgaatcacaagaactaagccaaccagagggggggtgaatggttggtgtacccaaaaaccgaaaacttttagcggaaataaaagttaccctcgaattcaacggatcgcggtctgaccgaagttgtcctgttggtctaaccgggtagatgccgccggtctgaccggtattgaatctccggtctgaccgccgaagtagcctgccgcgcctgtcgctgccgccgctggtctgaccgccgtgctcccgccggtctgaccgccgcttgccgccagtctgaccaccggtagatcaccggttagaccgccgaaacccgctcttaaagtagatgacgactttattgattctctctatgtttacaaagtgcaccaacagcactccttagaaaaatttcgactaaactcgaaaccctaactcaaaactcaactcaattgctctctaaagcgataccgggaagcctcacgctccccctctatttatacatgaggtagccagcctaaagccacgaaccaaactcatactacgagtcctaaacaccttaggaaaccctctaatacaagaaagaaactttatataaccaatcgtaccaaatttggactccttccaaattcgactccgcatgtcatacgcacacaatacctccatcgtatgccatatgaaatctccatcaaccacgtgcatcaactctagcctaagtatcccgcatgatctctgaccaccacggacgtcgtcttatccccaagccgactcccggtccatcaccgcaaatactctcccgagacatcgagtcacctacacatggaacaaacaaagaaaccatattccgaaaccaagctatctccaacttgactcattagcagcaaacaatagtattacatacgtatagtatccatttagaagccataatcatgaaataaactcggatatcgaaacaaacaacccaaaaccgaaaccgacacagtgtcggccggtcaaaccgcgggctggtcggtccgaccactcgatcaccgccggtctgaccggtacacaatgcccggtctgaccagtcacatgaaataacgatcctgcgattcacgtgtaaatccaatcatctccaaaaccactttgtgaataaattccaaataacaaaaccaataatctccaatgcccaattgttcatcacagaataataatcaaaaacacctttgattttatattgtttgctaacaatgagtcaagttggagatagcttggtctcggaatatggtttttttgtttgattcaagtgtaggtgtcttgatgcctcgggtgagtattgccggtgatggatcgggagtcaacttgtagataaggcgatgtccagacggtcagatatcatgcgagatacttaggctaaagattaa

SEQ ID NO: 30915 - DNA, 1454 bp, Oryza sativa
ggctctgttcgtttcctggagttcccgactccccatctcattttccacgcgcacgcttttcaaactgctaaacggtgtgttttttgtaaaaagtttatatacgaaagttgcttaaaaaaattatattgatccatttttgaaaaaaaaattagcaaataattaattaatcacgtgctaatggactgcttcgttttccgtaccggagggatgggttcccaactcaaccaaaagaacagagccagtcttgtttacttttaaactttttcttcaaacttacttcctccgtttcacaatgtaagtcattctaacatttcccacattcatattgatgttaacgaatttggataaatatatatatgtctagattcattaacatcaatataaatgtgggaaatgctagaatgacttacactgtgaaacggagagaatacaacttttccatcacatcaaaacttttctacacacacaaacttccaacttttccgtcacatcattctaatttcaatcaaacttctaattttagtgtgaactaaacacaccctcaccacgggtaagggataatgtcactgcgaggagcgcgtgaggatcacgcgattgcagcgctggcgaagtgggtcggcgccgtccgagcgatttttcacggatcaggtcaacccgtatatgaggggtatattcctttttgacctaacccatcccagctagcactctaaccaaacacctatgtaaatgggttcgacccaacccgacccaggaaaacccttcaaccaaacacacgctagactccatccgtttataagatgttttgattttaatcaaagtcaaactagttcaagttacttcaagttttctaagtttataaacaaatatagtaatatttataataccaaattagttttattaaatcaataattgaatatattttcataataaatttatcttaggttgataatgttattttttttcaaacttagtcaaacttaaaacaatttgactttgaccaaagttcaaaacatcttataatctggaatggagtgagtatctaattagcaagcatgccgaccctttctttttcatttaacgtttgtaaaaaagtttaaccacactcggcatttttttccccaaaataaagatgttgtgcattcgacatatgcttttatttacgtttttttcatcacgcactaattgtcaaagactcaaagtacagcataatgtttgttgacgtgtggagtacagcagtcgcggaagtaccccatggaaggctctatctctgttccacggtatcgcgggtataagtgcttaacagtgacaaaagaaagcatcatcgtgcattcattatcatgccacccaggtaagttgcatttggttcgtcgctatacacgctaacacgcagcacacgctctgtgcgcgcatgcatacggcggtttcgcacattcgtggcgcccgtgttgccttgc

SEQ ID NO: 30916 - DNA, 1501 bp, Oryza sativa
ggcgagatggaggccggccggccggacgcgtgattaggatggagcaaggatgggagagagagctggacgcgcgtggctcaggctttttcccccgtttgttgtgttaagatggaactaaaaatagatttttagtctcgatagtagaggggtctgacaccgccccctccgccatatccggtcggaggggaggcgatgggaagggtggccggccggcggcgggaagggaggccggtcggtggctggtggccaggtggcacgatgggattttgatttgtttcagtttttcttgatttttttagatgatttgttgatgttgatttgtgaatttttctgtgaataaatttgtgatgtgctatgaatgaaaaaggagaaaaaaaacgaaggaggaaaaaaagaaaaaaacattactttcgatttgtgttaccaaccgggactaataatgcatctttactcccgagtattttaaccggattaaagatagcgatctttaatacctgattcttactcccggtttacaacccgggaatataggggttgcaaaccgggattaaagagggtttcccagcagtggcgggagataaaaaaattccaaaatactccaaataaagtgcaaggtaactcctataaccaataaataatctcaggtcaataaaattgactgaactcttgtcaaagtttagtttacgaggattagattattttctacgctaagatatagtctaaatatattttattgtttaaataattctaaataatgaaaatcgaaaaaatttgatgttgaatataggtttaggtgtgtgctagcaacaaaattaacaacgggtaactcgtaagtacgatcgtttattaagtgaaaagaatactatgcaaccttgaacttttcctatataaaatgtaaataaaaaattctgaactaactaattggtaatacaaatccattcttcttgtcaagtcccactagtaccgtaaaaaaaaaccgaggagttcccatgtcaactcccagacactgtttttaaaaaataaaactctcatggatatagttcaatttaagtttaaattggcatttccacttcttaacgcctaaattttttttccataagccaaaacatgaaataaattaaagaaaatagtcctatataggccatatgtccatatttacaacactaaaatcttctctatttttattagcgtgcaatcctttactacctagcctttgtctggcttgcacttattagatggaggtcaacgaagatcggactctattggtgttagaggctgtagtaatggtttacaccatccaaatgatagaaaaattctagcgtcgtagatatgacttgaaaggattatttatttaatttttatttcctgttttggcttatgggaaataaaattcgtcgtaacactagcgctgactaaaaaagaaactaaaaatcgaaaaaaaggaaaaaaaaaacaggtgagaagaaacgggagtcggagacgaccaagattcgccgccgat

SEQ ID NO: 30917 - DNA, 561 bp, Oryza sativa
ggctctgttcgtttcctggagttcccgactccccatctcattttccacgcgcacgcttttcaaactgctaaacggtgtgttttttgtaaaaagtttatatacgaaagttgcttaaaaaaattatattgatccatttttgaaaaaaaaattagcaaataattaattaatcacgtgctaatggactgcttcgttttccgtaccggagggatgggttcccaactcaaccaaaagaacagagccagtcttgtttacttttaaactttttcttcaaacttacttcctccgtttcacaatgtaagtcattctaacatttcccacattcatattgatgttaacgaatttggataaatatatatatgtctagattcattaacatcaatataaatgtgggaaatgctagaatgacttacactgtgaaacggagagaatacaacttttccatcacatcaaaacttttctacacacacaaacttccaacttttccgtcacatcattctaatttcaatcaaacttctaattttagtgtgaactaaacacaccctcaccacgggtaagggataa

SEQ ID NO: 30918 - DNA, 1459 bp, Oryza sativa
tgtgggctgtgttcttgactcttgcatgagtccatgggcttaggaggtgtcgaggatttgagcatgagaaacagttgatgtggaaggatcaaacatcacgaactaagccaaccagaagaggggtgaatggttgtagtatccaaaaaccaaaatttttagcgaaaataaaagttacccttgaatcgacggattatggtttgaccgaagtagatcggccggtctgaccgcgcctatgtcaccggtctgaccggtatagattgaccggtccaaccgtcccgaagtcgcctctgcttcctgtcaccgtcgccagtctgaccgccgtgtacccgccggtctgactgctggtgtctcgccggttagaccgctgaacccgagcaaacacaaatcaaagaactcttgatgtagatgacaactttattacttatctctgtgtttagaaagtgcaacaacaacactcctaaagaaaatctctactaaactcgaaaccctagctattcttacaactcaatgctctctaaaatgataccgggaggcctcaccctccctctctatttatacatgaggtaggcagtctaaagccacgaaccaaacttatacaagaagtcctaatccacctagtataccttcctgtacatgaaaccaactttacaaactccaatcataccaaatttggactccttcaaaattcgaatccgcatcccatacacacacaatatctccatcgtatgccatatggaatcttcaccaaccacgtgcgttaatctttagcctaagtatctcgcatgatatctgaccgtctggacatcgccttatctacaagttgactcccgatccatcaccggcaatactcacccgaggcatcaagacacctacacttgaatcaaacaaaaaaaccatattccgagaccaagctatctccaacttgactcattgttagcaaacaatataaaatcaaaggtgtttttgattattattctgtgatgaacaattgggcattggagattattggttttgttatttggaatttattcacaaagtggttttggagatgattggatttacacgtgaatcgcaggatcgttatttcatgtgactggtcagaccgggcattgtgtaccggtcagaccggcggtgatcgagtggtcggaccgaccagcccgcggtttgaccggccgacactgtgtcggtttcggttttgggttgtttgtttcgatatccgagtttatttcatgattatggcttctaaatggatactatacgtatgtaatactattgtttgctgctaatgagtcaagttggagatagcttggtttcggaatatggtttctttgtttgttccatgtgtaggtgactcgatgtctcgggagagtatttgcggtgatggaccgggagtcggcttggggataagacgacgtccgtggtggtcagagatcatgcgggatacttaggctagagttga

SEQ ID NO: 30919 - DNA, 781 bp, Oryza sativa
tggtgtatcatgaatgttcagttcccacgtaaaatttccccgtttaaacacatgcataaagtattaaatacatatttaaaaaataactaattatatagattgcgactaatttgcgagacgaatcttttaagcctaattgctctatgatttaataatgtggtgctacagtaacatatgctaatgatagattatttaggcttaataaatttatctcgcggtttactgatggattctataattaatttttttatagtgctcaaacaacctatacaataactatataatatccgatatatccctgaatccctgaatctaaataccccttaaccggtcaagtagctttgcacggctgaattaaggcgcaacaatgcaaccgagcgagcgtgctccatactctactccctccgtcctaaaaaaaggcaaatcctggtttctgtgccaacgtttgactgtccgttttatatgaaatttttttataattattatttttattgttgttagataataaaacatgattaatacagaaatcaggtttgtcttttttttttttggacggaggggatatgtccgagcttctacaggatttttagccgtgtcaggaaggtatagatgggactgacggggccagagagtggcaggagccgtgcgacgacggggcaggactaccgcaggaggcatgggccatgggtcatgatgagctcctttcatctcggctcctttttccactctcccagcgttctccctctctcccaagcgcggccgggcgcccggccgtgtcccc

SEQ ID NO: 30920 - DNA, 1501 bp, Oryza sativa
caacatcaacaaatcatctaaaaaaatcaagaaaaactgaaacaaatcaaaatcccatcgtgccacctggccaccagccaccgaccggcctcccttcccgccgccggccggccacccttcccatcgcctcccctccgaccggatatggcggagggggcggtgtcagacccctctactatcgagactaaaaatctatttttagttccatcttaacacaacaaacgggggaaaaagcctgagccacgcgcgtccagctctctctcccatccttgctccatcctaatcacgcgtccggccggccggcctccatctcgccgccccgcgctgggttgctatcggccggccttccatcacgccgcctgtcggagggaggggaggaggggaggagaggggagggggccggaagaggggggaggaggatgggtgagagaagaaggaaacggaggatgagagaatgggaggagagaaggagattaggatggagcaaggatgggagagagagctggacgcgcgtggctcaggctttttcccccgtttgttgtgttaagatggaactaaaaatagatttttagtctcgatagtagagggatctgacaccgcctaccatatattgaaccgggcctaataatgatttttagtaccagccagtcaggcagcactatcaggttgtgattgccacctctcctatcatgctatctagcctgagaattagttagcaatagcatatactcgctccttcaaataattatatctaagtacatcttatatgtcatactggtttttttattttgttagtatgtgttacatcccgaaatagatttgtttattttgttatgaaagcagtttgaatttttttttgaaaaaaagacaatcactatcgtgactcctacttacggtgatatggagttaccaatcacttcgatctagtcaaaagctaaatcaagatgagttttgtaagactaaaccagctagcaaaatcgatttagatggaacaaaggataaacacccatttcataggcaaatggtaggtttacgagacaaacctgcaaaagggataatcatactctcatagctaagatggacggctttcagtataaaccggtgaagttggacaaaactaggctaaaactagttaaaaagtaaatgcgatattgaaaagcgattgtgttgaaagtagattgtgtgtccaattaaaccggtcttgtctcttataaaaggattagtcttgcctcctacataaccttttccacatcaaattatggtagagataaattagaatttgaaaaatatctccccatgcaagaaaactcgaaacccggcgaaattcgcttcaaacttggaaaatacctccccatgtctctgccgccaatgaaaatctcttttcaccaccaacgaaaacagtttttctagtagcgcttgtttgtttctcactgtgctctgcaaatatgggctggacatataggacgtttaacaagaacatatgggctggacattctagcat

SEQ ID NO: 30921 - DNA, 779 bp, Oryza sativa
gatcatgatgtgcatgtattataccggttgagattgattagatatctatagtaatggaaactatctagagaaattaatcctactcagacttggtaaaaaaaactttgctactctacacaacaaaacataaattatgatggaattatgtccggacactcaatcggacagggtctttctatatagtatacatttttcttaataatatctatagtacacgtatacagacaccacgtacaacagtaacacaaggcctcatcagtatatacatttatggataaatatatatggtggactgaggatatatattattagtttggttgattgatggctgataaagggcatcaaagttggcaagtacatgcagcctgttactgcccagacagaaacaaaataaatctaaaaataaaataaattctgaataacaaatagaataaatttagaaaacaaataaataattataggagttcaagtagcaaaataatttataaataaaaatatcgaaagaaaaatatggaattttcaaaaaaaaatcatctagaacacagataataaatgacaataaagatgggataagtaataggcctgtaaaggagtacagtggtgatggttgatgggacatctaaaaagtattaacaaaaccccaaattgaattccaaagactattaaaaggagggacggtggacatgttgttaagcaatatggtcatgacggttggcgggacttctaaaaagtaaaaggtaaacccccaatgataatcatgtctgattttaaaatcttaa

SEQ ID NO: 30922 - DNA, 333 bp, Oryza sativa
tgttggagcagggcttaagtactgttagaccatgccctacgcgtgatcttaaaactgtggttctagcctccaactaagctcatatggcatggtgaaggttcgggaagagttttatttgtgtcacagtactatgtagatgccgcagtgatttaagaaagaaaaagagtgatccaagcccggatcgagatccatccaaagaaaccctttctctgtcgggaggaccccactaccacggagcttgctgaccacgccggagtagggggaggagagtggggacgccactaatgatatatccacgctaagctcgccaccagatccgtgcttgttgccagg

SEQ ID NO: 30923 - DNA, 1501 bp, Oryza sativa
agaccatgccctacgcgtgatcttaaaactgtggttctagcctccaactaagctcatatggcatggtgaaggttcgggaagagttttatttgtgtcacagtactatgtagatgccgcagtgatttaagaaagaaaaagagtgatccaagcccggatcgagatccatccaaagaaaccctttctctgtcgggaggaccccactaccacggagcttgctgaccacgccggagtagggggaggagagtggggacgccactaatgatatatccacgctaagctcgccaccagatccgtgcttgttgccaggatttcgttgatcacatcgtcgtcgagggctcgccctcccgacggcttacgtggtctcccaacaaggaggggatgtcgtccgccttgatatgccacgcataatcatcattgtgctttctggagaggaggggaggcccgccgcctcgatcaatcgatggggttgaaaggctcacgagcaccacgaccgaagaaggggaaacgagagtcgagagagtagcagatggggagtgggagagaggcgggtggtgcttagacgaggaagagaggtggcgttgcggctgcggtgcttagacgaggaagagaagcgacgatgcatttggttgggaggggggagagaaaggcgaatcaatgagaaagaaggaagggtggtgaaaaaaaattataagagtgactggcatgtgggtctatatttgttaatggtacacatgtatttatcttatagttgttatacggtacaaaatataacagtttcagtgggatttgataacaattagtatttcaataattgacataagggttgaaacacaaaatagttggatgtgacctcaattgtgagagttgtaacctatgtgaggtatcagtccatataacctactcactatgtcccataaaaaactaacctagtatcgaatgtgacgtatgtatgtccagattcatagtattagcatatgtcacatccgatactggattggttttttatgggatggagggaaaatctaagaacacttttacatggggtctccattatacgtggctttaggacaaggccaatgtttatgactcgatgagcgataggggtgtgacccgctaaaaggagccacaactatagcgatccgtacaatgctatgtctatcagtctatgtaaaaaaaaggtgagccttattcagttgcggatctaggaagaaatagcaagcggtttgaataaactagacaaaactacaatctcctcccccatgtatagatagcaaaaaaaaaaaagtcgggactttcatgtacctcgcgtcagtagtggatgcttgagactctaccgtctccatgctagattcgctcttagggctactttggattgatgccaaaatgtgccatgccaatttttttggtagtttgaatagtaaatatgatggtttggtttgaagccaaatgaatggtactgcccatgcttaatttggtataattctagaattttcttcaccat

SEQ ID NO: 30924 - DNA, 1501 bp, Oryza sativa
gaagcctggaatgtggtgtatggctaaaaatatgcaaggtgatcattggaatagtagtagtactatcactatgtatgattttcttggtctgactgtctagacgaccattcctttcggataaactagataaagatgcaagaaaacaagagtagggtggtgttcacttgtagatcctgtagcttgagcgcataaagtatatgaagttggtccttctctgttaccagttctgtgaagaattgtaaagttggatggtctattcatacatatactaggtatatgctttccatggtgccaatcaaccaaaacatgtgttgatggttggcagtaagagcatcaagatgttttgagggaaattgttgtttgagtgattgcatagacaaatcaaacgaatgtatccgtggtttgcatgttacgacgattgtaggtaaattcacattgtatatggaatggatttcaatagttcatgaaagtatgcacaggattttgttcaacttgcacgatgctatttatcacgagaagcatatgacagtaggcatcagatggcaattccatcatgtggcatcatggacggatgggctgggaactcctcaggccacctatagaatattctatgatattaagctgtttcatctaaatagtggcatgtattcgttgcagaacagacaatggcatgcatttattatatttagagtagaacacaatgtgttgttcctagaacttggtcaaataccagaaggaacttgtaaacccacttgtttttccttttgctagctattgaccctgtttatcaatgaaatatatccatttttgctgcttaatgctattacatttttttgaaatactatttcaggtgatgtagaactcacgaacatgcagttgaagcctgaggctctcaattcattaaagttacctgtgagggtgaaagctggttttcttggttcagtgaagctcaaggtttgctgtaattgcttcagctcagtgcatttacttttgccttaagatatgaagtgctgagctaaagaatgaatgtgtgaatgattattaggtcccgtggagcaggcttggtcaagagccagttttggtttatcttgatcgaatatttatattagctgaaccagcaacacaagttgaaggttgcagtgaggatgccgttcaagaggcaaaaagaagtagagtcagggtaattactttgtgaccttttaaagtgagttatggaaacaatgccagtgccatatgcattgatgatctgtggttattcactcaggaaatggaaatgaagttattggagagccaacaacagctgaaatctgaactggtatttagcccttttagtttttcgctgatgtgtttatgtactgatgataatggatcacctagttggccagatagtcaatctggctacctttgtttcgattgatgttgtgtgtttaacattcattatttttggaacacttcatttatttcttactggcacttttgttcttgaagaattcgtcatggc

SEQ ID NO: 30925 - DNA, 158 bp, Oryza sativa
gggtagagttggtatccgaatgaataaaaaagatgaacagagaaggggattagaaatagaatattgactaaacccaaataaagtgtaaatatgagataatgaaaatggcacccagagaagaacaatgaccgataggacatcttaaagtaggaaaaaga

SEQ ID NO: 30926 - DNA, 1501 bp, Oryza sativa
tctggcgtgcatttatcaatttcgcgcatggcaaccaataaaacaaggttaaagaaagtgccattgccagctatatattgcgaattaatattctgatattttttaaaagcatgacatgtttttcttgtttcagagtccaaaatattctagccataaagttcgttacgaactgtttgtgcacccagctgcatatgccctggctctccgaatttgagcggcaatagctatggctttctttcaccgataatcacgatctgaaaatttcataaatattggaccattctatgattcttttattattttctcctaatcctacggttccagaaaacaatcataatcctgtcaccttctcgtatgcatgaaaatgtttaattccagccgtgcaatcaaaattcacacttttcacattgccatgtcagcgtggtgccgttttgtacgctccaaacacattcgtgatgtctgaatttttgaatggtgaatgtgttgtcacttagcatcttgtgttcttggcagagcgaataggtcagtgtccgtgttcagtttcagacgagcagattggtagattttgagttttagacggacagattagccggctttaaacagggtcgtcctcacgtttatattcagagtcctgactagataaacgaggcctgaaagtctgaaacacatgcgacgtagctttcgttgctttggtcaagcacaaagccatggtttgatggtttccatcgtcaagatcgattgttacccactagcatgtccagtagtaccactatgatttgaactgctgacagcttgctcattttcgtagcaaatgtcttgtttttctttctaatttcaaggtatagctagacgggcgtcttctgaataaatacagactacagaaaagcttgcgcctgagaattttactcctatacaagttcagagccgacaaattaatccgagctaatagtatactatagatataagtacttatataggactatgctagacgtttttattgtaaccttggggaagtagatggaaataaaatattctatccgttttgaaatgtttgacactgttaaccttttacactttttagcatttgtttgaccgttcgttttatttaaattttttgtgaaatatataaaattatatgcctatataaaaatatattcaacaatgaatcaaatgataggaaaagaattaataattacttaaattttttaaataagatgaacggagggagtactaagttagcttttgtttgtttttgttttgtttggtcaagctgtaggttaactaggggctgcacagcaccaaggaaaaatgaggtggtagtggctgcgttaccattcaagacgaggcgatgggaaagagacgttgcattgcatactcgcagtcgcatgcacacgcacgactgactgccgccccgcactgtggtctggcctggttgactcgccgaacaaaattacaaaaaaacctgaaagaaatcaaagcagaaaccgcggatgcgtccgtt

SEQ ID NO: 30927 - DNA, 1501 bp, Oryza sativa
ggtactcgcagaggccgtttttgccgcacagcccgtgagcttggcatggctgcttgagcgccgaccatgtcaccgcccagcctccggtggacgcgttcaggctgtacattctcaggttgccgtcctgttcgatggttatccgcctcttgatgccgaggcccagatcggtggcctcggctttcgtctggtcggaggacaggaacacgccggcgtcgtcgaggatggcgatcctcgtgctgttgtagttcgtccggccgttttcgaacacggtcaaccccggcagcggccagtagatgctggcgatctccgggccgtcgtagagcatgcgcagcacgttgtcgttgtcgaagtagaggctgaagtagccggcgacgagcttggtctgcttggtgaaccgctgcgacgggagcagcgtgtccgtcggccactcgaagctctgccacacggcgaggccggtcgacgggtccccgacgacgaggttcccggtgtcgcggagggagacggtcaggccccttctgttcccggtgccagccgtcgttttgctcgaccacaccgtggtcccgttggtgtcggcgagggccagctcgccgtcgcggctgaacgagaccctggagcccctgccgttcacgggggcgtcgcggttggccgaccagacggcggtcctgttcgggtcggcggtgaaccagacggagaaggtgaaggcgttgtcgccggcctcgaggaagccgcaggagaagctgccgtccgtcgacaccaggaacggccgcgcgtggtcttccaccgacatggaggatctgcccagcgtgtgctgcgccgtcgacgaggacgggcagagcagcagagacatcagcgagagctgcacggccaggtagccgatgaccaatccagccatcgtttcaactatagcagtttggcaattggttgtacacttgtactacatagggcaaagaaattatgagcgcatataaggcgatatcaagcagccaatgcagtcatgtgttgaaaagtctaattattgatgacttggacatacgccgtgaggcgtgtgccacaggaaacgatgcttcgtttgatgatgattaggagtaagcacctctctacgttttatttttgttttcgtactccctgtgttagttaattagtgagctgaggtcaagatttcttgtgagggtcgtggatcgtttttcgcaaggttttgtgtggacgcgtgcatttgctagcttcaattctgatctcggttgttgctggtcttcgttcgtcgactcgtcgtgacagtacgatcactttttttttaactactcgcacagacagtacgatcaccaatgccatgcaaaataaattgctgttcatacagggaatttatgtcgagtaataaaaaaagagatcaaactgttcgtccgcgaaggttctgttttcctcttacatggtctgcggaagaggataattatatcaaggccatcccagaaaatttcatggctccgggcgaaactctaagcagggt

SEQ ID NO: 30928 - DNA, 1501 bp, Oryza sativa
tgcactgtgtgattgctttatcatttttgtaatgctcatttctatttgttccacacctgggacgatcttatatcaaggtttcttgaagaaaaatggatcataaattcgtaacacatctctccacaggtccatgtattcttacttctgagacaaccaaactgaccacatgatcaatgtatgaataataaaaggcctctggcatcttttttttttttttatgcttatacttatcggccaaaatttgaattttcaaccttaaatttgaagctgattttggagcctcattggagtgccgcatgtatatctaatatgcaagtttgaacaattatacgttgatacgttgcaagtctgcgtctattatcaagtgctagaccttttgcaattagttttcagcgaaaaaatttgcactttgttagtggttttttcttaagaactggaatgtttattttccaaactactgacaggacgtgcgcgctcttttgtctggtcctgattcaacacagatggtttgtctacatcagaccctttgtataatcatggtgacatggcaaattgtatctagggataatccagtttccagtaaaaatatattgacaatcatcctttataatatatgaaaaccagacggtgccccatcattacaacggctgaattctggacatctcatgagtgccttcattttccataggtacgagcaagcattgagtttcactagtgaggactccgtttttggcctttactacgattgctctgctcatatggtttggtgaactgaccattagtgtctgagtacatttgcagtgcgaactgaggaattcacttgcagatctgtcattaccacacgcactatgaccccatgctgaatgcgggcatttgtgtgccgatcaggctcattacttcggtcccaaaacatacatattaaacttgaaaaacagatttatttgatttcgcacaaaaggacaccatttattagttggaaagcatataaataaaacagcttaatgaaacattgccttacctcagaatttcgttggcttaatgaaacatagtcctactagattgttgtcattctttatttcatttgaacaattaaaataataggaccgatgtcagcactctcttctgcttcgttttgtatttaactttgacagaaggctagtcgaagttcctttttgttttcaagaagacttgactaacaaaagaataaattagaagcttaagtgcaggatactcttcagtcttgttctgagtgcaaaagagcaagaagcgcgaagaaaccggcacatttcgctataccctctttgatgcatccagagtgttgttttcagctgtccagatgtccatgacaactgataagctatcatagtacccttaaaccagccattaatttgattcatggagaaaaacatgttactacagtgcaaggcttcttcaagttactgtcacatactccaaggcttaggatcatcaaaacatagaacatgacacaggacactgattg

SEQ ID NO: 30929 - DNA, 1501 bp, Oryza sativa
agttaatggatatataggaaaatattagtgccatttattaatctatgtccaaatataattaaaacccacgacttattagttatttaaatagagttagccttataattattaggtaagtaaaatatagatacacatagatcggtcctaagcttgtttatggcaaataataacagagctagtgtgattaaatcacctatatgaaattaatcaacgacatatcccatataatagcatatagtgggagaggtgagcaacccttagttaaccaagcagtaaatagaaattattcaaataaatgattcaatatactaagatattgtgcacacatatattgtacatcccattatagatatatggtatcgtattaatttgcttgttgcgtatattaatttagagggagtatatgacaaacatgaatattagataaatactagttatacatcttgtcctcgtataattacagatcaactgtaaatttggattattcattgtaaaattatgtgatgggataatccgtaaccataatatgattaacctaaacaattctaacatacaaagcatgggtaattgttaaccttttataatttattttgacaagtgaaatatgtacataattaaaataaagcctccattaataaaataataatacaaatgattcacagtaattatttgaccgatccaaaatccatccggcaacagaacctctagtgtataaccgtgctatgtagataaatgcatgcctagccataatccttccatagccatttgatagactaaaccaccgattagccaaatatatatgtatcctataaatgctatgttggttaactcctaaataggccacgttgacaatagaaagattaagaaaccttagcccctagcgagattggaatccattagcagacatgagtagtatattttgttgtgcatatttggttgttatttgaatattggtttttcttgcgtattatagaatttatgtatcggttagtcgtgaggcaacgtcaacaacttccaggaggtgaaggttaatcaagaattacatcaagaataaggactatcctgagcaaggcaagtcatcactattctttgaacatgttgatcccaattgcgaaattgttttgtttacaaataaaattgcatgcaattatgaacatcctacttgtgattataccatgccttgattattgttcacctttaaatctttgtaaccatagatacgtacgagtctctagtcaactatgacacttgcttagaaatgctattttagattcatgcatactcatatttatcaaatgctatatgcttgggcaattacctttgggaaggtaattgagatgcggcatgtggagacatgagcgccacattgccatgatattgatgacatgatttgtgaaaggaaaataaagtaaaacaactgttttcgactggggcggctggaggacttgggtggtgtccggaaaaggctagtgccgtccctggtcaattaaggaccgagcca

SEQ ID NO: 30930 - DNA, 1501 bp, Oryza sativa
aggacacggacgccgcccctccgacgcaggccgtcgaggagatcatgcggatcatccaggaggccaaggtccccggcgacatggccgccgccgacccggcgctgctcgcggagctcgccgagctgaagagcgacgacgaagaggaggccgccgatgagtatgacacctactgaccatccatgatccatatgcatccatggtcgttgtgctgcagctgtaaatatgatccggaatatacgtgatcgccagaccaaatgatatgcgtattctgatgcattttctgccgtgtatactctgcaccggattttcctgcagcgtaaataataaagaaaaaaaataattatttgtttgcagtttcgtgtgatcatttggcaaggactattcagtttgcatggtcattttcccagtttattcattgaattatgtaattggattatttgtgctacacttccttgtctttggattatttaaacatattatttgcgcttctcaaaatatttttctattttaagatatttgttaaatttatttcttaaataatttattctctctataatcaaaacgataatctgttcaatattctaatcaaataaaactttaaggccccctttgattgaaaggaaattcataggaattttagaggattttattcctatagaaatttttcctacaaagcattttgaattaaaggaatgaaccctatgaaattcctatgaaatgcctctttccatacaagttttagaggaattttaacaagagatagaatctcatggaagaaatcctttgagtcttttatctctcctcaaatttctgtgtttttcctgtggtccaatcaaacggtcattctttttcctgcgttttgcaatcctttgttttacactttcattcctgtcagaatcctatgtttttcatattcctccgttttttcattactgtgatttaaaaaggccctaaagctttgaggttaccgtagtgaggtgagtgtagctcaattagaaacagcgagatttgtcggtttcgttatccagttattcggatatgctatagataatgtgtgtgtatgcatatggagatgagtatgtgcgttgttacttatgaacgtatacatatttgtaccatgttcataaaatggttattgtatagacgtacagtacaacttcagtgtgtgtacaccattgtgactattatatgttggtgtactaatcgggtttttagttcccattatcttttccatggagatgtttttgttcgaattttggtcggctcagaagaagctaaagattcgaccacctaagaggcggaagctagatctagaccggtatatttttggatttttgatgtttcatacgtgctagaaaaatatttcaacttggggtaaaatggtgttgcatttgtttgaaacatgtagattttcacgattttttttaatgtttcaatcaatgtatctttgttgtttaccgcatgattgaaaaatgtttcaagtaaatttagacgatattgt

SEQ ID NO: 30931 - DNA, 1501 bp, Oryza sativa
tttgttttttttttcctaatttgctagttgagtagttgacccccctcaaaaaaacaactaaacaaatttctagcagttggcattggccaacgccttcatccaagctttgtgccattttttaaagagcttatcatacatatgtcatcccagtttgatatagatgatgcttgttgaaactcagtttgtgtaacaattatacacaaacgaataattaaatattagaaagctcaaaagtccatgtgctgccaatgttcggatggtggtttcggattggctaacagagcatggcggcagggttgcagagggttccaagcgaaaacttagcccaatgatttattgggtcaactacgcttttgggcgtggtaatcatcctgaggacgctgttgggatacccctcctccaacagtaaggagctctgagtgaaaacctgtctagttctttggacggatgacaacggcgtctttcggcaccacaaccttcgtgagggcgtcgttttttagagtctccgcttcgtggtggtgttgtaaacccggtggtgaccggtctctcgtagcgacggtcggcttggtgctccgcttccctctctgtaacatgtgtctgtgcggttggcacatggttcggggcgtgtgctctagttcatattctttctcgacagtcagttgtcgatgaaaaatttttttgcaacatttttttcatctatcttaataacatttggataaccttctttggtcatcccggtaagaaaaaaaggaaaagctcaaaagtaaattaaaaaacttttataaggaatgccaatgaaaaaaaaaaggacatcgctccaacttgcaatgtcttttctaaattactgtttagtcgatgactcgatgtaatacattgtattcgcattgttatttttattttatcaccctgcttagagtttcgcccggagccatgaaattttctgggatggccttgatataattatcctcttccgcagaccatgtaagaggaaaacagaaccttcgcggacgaacagtttgatctctttttttattactcgacataaattccctgtatgaacagcaatttattttgcatggcattggtgatcgtactgtctgtgcgagtagttaaaaaaaaagtgatcgtactgtcacgacgagtcgacgaacgaagaccagcaacaaccgagatcagaattgaagctagcaaatgcacgcgtccacacaaaaccttgcgaaaaacgatccacgaccctcacaagaaatcttgacctcagctcactaattaactaacacagggagtacgaaaacaaaaataaaacgtagagaggtgcttactcctaatcatcatcaaacgaagcatcgtttcctgtggcacacgcctcacggcgtatgtccaagtcatcaataattagacttttcaacacatgactgcattggctgcttgatatcgccttatatgcgctcataatttctttgccctatgtagtacaagtgtacaaccaattgccaaactgcta

SEQ ID NO: 30932 - DNA, 1501 bp, Oryza sativa
tcgcgggtcgcgtgacccccctttcgtgagttcggccgagggcagagactcgtctctccgaagtcgcgtgttcgtccctccgatccccgtttagatagcacacaattcgattacccaggttcaagccgctttggagcgtaataccctcctcctgcgtttgggattatcagtggatttttacaaggttctccttgctcctctccgctctccggtgggcaaggtcctccttttatagcttaaggggataccacatgcgccgcctctaccctccccctccatcggagggaggggagggggcccttctccctcttcccaccgggtttcaacctgtgccttttgctggaagctaagcatcggtcggtccttgagtggggcccagcgccgtctcccgcctgacacggggggcagccctgtcattccctcataaatgagtgaggacttgcggcagccctgcatcgaacgacgtccggatgtgacggggcgtacctaccgccactccgcggagacagaggcgacgtgggggcacgaccacccgttcaatcggccgtgaccggcaatagactggtcacagaccggtcgcatccgactgacaggggtcggtcgggcacgccgcacgtctgccctcgccgcattgaatgcggcgagggacggttggggcgctgcacatttatggccgcccagcctagactctcctctcacccttccccccgagggagggcctcgggctaaaacgacgggagagcccgagggggtgacgtcacccccgaggggatgtcgtcgacccccgaggctctccccatcaccttagtgactcacgaggtatgtgggtgggaccagctcgcagagccacgtggctggaaagggaagtagctctcctttactccacatacccccgggcccatatctccgacagtagcccccggcgccatgtcagacgcgggcttcctgggatcggtctgacatggtgcctcacgacctccctagctggggttgtgggcccggcggggagtttaaaggagtattgccgagcggccagattagcgggccagccatagcggcggttcggtcgcctctgatcgcgctaaagacgaggatgcttgggacgcgataatcgggggatcggttagaccacgcctcgattacctcgcccgctattcctacggcggttgtggtgacggttcactcagcttgcgcttatagccgttgcgcattccacctcgagtgcgccgctgataggcgcactaaaggtgggacgcggacacgacgggcgacgtggtgaacgggcgcgggaaacggagagacaactgcggacgtgggggcaattatgagggtgcgaaacgaggaggcgagcgcggatgagacaagaattaaaagggagtggaggcagggacctctcctccttcctttcgccaaccgccgactcgtcctctcgcctctcgaaccctaacactctcgccactccacgcagctttgcgcgccacgccttctgccactgcctcgc

SEQ ID NO: 30933 - DNA, 1501 bp, Oryza sativa
tcatcagataatctcatttctgattcacctagaagagcaatcaacatctgttttacctgtacaagagaataagaatagaaattttagttaccaacgaacaataggatgtatgttaaagcatgtcgtaaatatgttacttcagaggtaaagaagtttgcttacaaaccactggattaccaccaatacatatctttggcataaccattttattaaattccgaatcagaaaacagttggcatatgcagaatcataggcccagaaatagtaagacattacctcctttcgttcaataaacccagtgttgtccatatcatatagcttgaaggaaactgtccaaggggtcaatcatttaggaagtgaaattatggtatcaacgaagttgagataaaacagaatggcaataacttacaatcaattttctcttccattgggatgtttggatgaaatacatttaaagctcgaacaaagtcaccaaagtcgatgaccccccttttcttcacatcaaaaaggtcaaatatctgcaaggtccattctgtgtaaatttcaagtgatagaataaggttgtgcctgaaagcactcagaatatttactaacagaacctaagtgagaatggttgataaggagatggatacccgattagcgaaaagattttccttccttttgtttttaaacaatgcaagttggaactcttcctgcatagcaaaatgatgtcaggtattaattataataatttcatcggaatcgcaaaataactttcgacatatttttttggacaaatctgtcagttttggggtcgtacgatgtgctctgagattcgtgctaggaagggggaaaaaattccgcatgctgtagctgctgggtatcgaaccccaggcgcaaggatatcatgcgtgcgcacttccccactgagctatggtgtatttacataccacttacaccctagttatattgtaattacatgctggttacgttgcaattgtaggaataagtcttggctggttggtcttggtcttgtggtgccttttttcctgtttttcagctttctaggacagcatctctactttcagtttggatgctctaggacagttaggacagcagtttgttgagatgctctaggacagtttgttgggatgctctgctctaggacagtttgttgggatgctgacagcaccctcttagactagcatggctgcatggctgctacaagcagctataaatatgtatccaatcctctttgggaggatatggcttttgtgtttagtgaatgaagaaaaccaaaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcagcagcagcaccggttgctcctccttcccctttcccttccccctctccacacagcagccccccggaggtgcgcca

SEQ ID NO: 30934 - DNA, 287 bp, Oryza sativa
tgcccgccgcctccgcgcccgggctagccgcaccacgctgccccaggcgcccgccgcctccgcgctcgggccgtccctgcagagccaccgccggtgagccgcagttgccctccgcctccgcgctcgagccaggccgaccgagctgtagccgcacgccgccgcgccgcctcaagccgcgtcgcgccgccggcgcgccagatctaggcgaggggtggccggattcggccttgggggcgccggatccgccgcctccccacgcctcgccgccgtggccgcctcgcccgagc

SEQ ID NO: 30935 - DNA, 1501 bp, Oryza sativa
tttaatgcaggcttcaaggaaaggctgttatttttgcaatttattttatttgaactcttttctaaaatgattaggtgagtgcttctcaaacgactcggatgagacagtgcgtctcgtccggtcggagtatgtgcaatgtgtcactctttaggattgcaacaaggttggcacccggccaacagcttttcaaacggccacccgggccaacaacttttcaaacggccacccgggccaacaacttttcaaacggccacccgggcctagctgatcccgtcagctgctgatttttcaaacatcgaaccccttttcacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcattttgaaagccgatacaggtttaccatatgccaacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttatcttatgtttggatgaaattccaaggaaatcggtccttaagtgcgagagcgggaaaccgtacacccggtacgttccccggtccgcggttctggaaattcatttagttcgcaagcaccgacccaggtgtcgggttttccaaatctttcgtaaaacccaagttttacccaagttgttattcagattataagtttgaaggcgtccgtcgatactcgcacaggatgcacgaatatcaagacgcaactaggtggttacaaggggacatgctgtaacaattaacaaggaaaggatcaaatgcaacaatttaggtaggtccgccaatctgccttgcagacggaacaatagattaagtgcgatcctatcaatgcataatattttgcaagcaatataattagatttcaaatataggctcaagatgttcaaaggtggcttgccttgctcgagatctggagcttgatcctcgaaatcctcgcactgcgggtcttcgggctccggaactacacgcgaaacggaacaactcaacaaacggcgaaaataaagccctattaatgacctctaagcgtgccattagatagatctcgagatttgaggaattttggaagttgaacggagtcaaacggatttacgggtgggaagatattgaatttctaagattattggatttttggtctaacggaaaaaggatttaattaaatcctttttggaaaagaaaaagaaaagaaaggagggagggaatatagacttttctcgggtggctagggtgcggcccaagagatt

SEQ ID NO: 30936 - DNA, 1501 bp, Oryza sativa
acgttgtccgctctgcttcgccggagaagaccccacgcgcgcgccagctgctcccaaagcgcccccaacagtcaaggcattgtttgctagctagcttccgacgaccgcgcataaagctcacttacacaagcggttaatgtgcggacggcccccgccgtcgggcgaacgcagcgggggacatcaagcctgcaacggtgacaagtcggggaatccagcgacgtacacgggcgctcagtcgccaactcgccaccaccgggctttcgttcgtgtttagctctgccccgctgcacgctcgcctcctctcctccgcgcggttgcatgcgtacgttggtcctttttatctttttcagatcagcgaacgcatcgcgtctcctgtgcctgatacttttcggggccccgctcgattgggcgggcgatatatgtggggcccggtgccaggctctggcgagaggatcatggggggcttttggatcgactatgacgcgcgggaccggggtgtcacgttctgctgatgctgatactgctcccccccggtttaagcgcatctttcatcagcgcagcccccggcggggtcggtcgtaccgtatgatgccgtgcatccacacggtactggggccggtgcttcttcgccgtattgccggcatgcagtacggttccccgcggccgccacgccagaattttgcgtgtttctttgtgatttcgacgatcaacaaggcagtttgtggattatgccccactgctaactctgatgagccgtataacccgggaaagtaaaccgtagcccaagggctacgaaaggaaagcaacaagaacgacatgctgcgcgctagtggcgaaaggtttgaagtagctcgctagagcttagatcgagatggttctaattatggtatttttggttatgtttgccgtacaaagtaagtctatgagtagctagccatctcattgttggctagcaaacttagaccccttttgattgaaaggaaattcataaaaattttagggaatttcattcctatatgatttttttttcctatatagccttttgaatcaaaagaataaatcctatggaatcctatgaaatgcctcttcccatgtgaatattagaggaaatttaacatgaggtagaacctcatggaaagaatactttgagtctttatctctcctcaagatggccatgcagcaatgtggttgccattccaaagtataaactttcaaacccaccccgtacttttcagattattttgcagcttattgcgatgggttttaaggggtaaccaaaatatttttaaaaataaattaaaaagagtttaaaagttaaaacgagtgatctaagcaatatagtagaaaaagtttgtagaaaacatattctttttaaaagtatataccaaataatccgttttgataatccaatgaataatctgaaaaaaaaagtaagacattgttgtggcactctctcttctaaagaaaatctcaacacctttgctttctactccctccatcg

SEQ ID NO: 30937 - DNA, 491 bp, Oryza sativa
caatatagaaggtctgtaatcttgaatcaaaattagtgattagtgtcattgggccgagaggctaaggctcaaaggataacaaccagtaccggtcgagtaaccctatcctcacctcacctgtaacagtaatacggtaattcaacccataacttataaccgtaatgtagctcagttggttagagactgttagataggtacatggattaaatgttagactggtccttccctctatctatatgcggatgaattgtatcctgattcagggttaagcaatgaataatgaatcaaagttaatctaagctctccctcaatgttcttcttccctagtctaaatctacatctcttccctagtatcctcctggcggggtttatcctgttatggcctcaggttgtggatattagtttgggaaaatcattaaatctaagctacgttcatagttcatccaatgtcccctacatttgtttatggtcaatgctatcaaaactaataa

SEQ ID NO: 30938 - DNA, 309 bp, Oryza sativa
atgcctccacaccagccgatgcaggagcaaagttatcggccgagctgctcaaggactggttctgtagtttttatgagggtttccaaaaagacactcgagtttggttcctctacgaagattcaacacttctggagaatccattggactttaggttcgaaaatatcaatcacgaaagatatcagaaacccagagaaatcttctcagctgtaatcagtccatgtatcctccctgttggcattcatcaaggaagaaacatccaggtttcttatgagttttatcacccaatgagcacaatcagacaactaggaa

SEQ ID NO: 30939 - DNA, 227 bp, Oryza sativa
attcttcttctcgagctcttgaacatattaagaagaagaagaagaagaagaagaaaaagaagaagaagaagaagaagaagaagaagaagaagaagaagaagaagaagaagagagagagagagagagaagaagaagacgaagaagaagaagaagaagaagaagagcttaaactgaacgaatacatatggtgaagtagagctcattttgcggcgtctccatctatgagc

SEQ ID NO: 30940 - DNA, 803 bp, Oryza sativa
cttacacgtggcctccatgtgtttttttttaatttcgttgatgattacgctgctacatggataccatgtcagtgaaaaccactctcaaacacagtgaaaggagtcattttacatggctttaatggttgaaggataggaattagatttgaccaatagtttaagaagtccaatggatcagctcatgtgctggccgtttccccttcccccttgttaagatgtttgcagcctgttttccccttctgccttgttaacatgtgcgcagcgtggtggctaattggcgcgtgcgccacctggcaccacctcccccgcgcaattttttcgctttttcttttttttttgcaatttttttcgatttccttttttgcttttttctgattttttttaatcttcagcacacgtgtcttcaaatgttttgagttgaaagtttttaaatcttgactagaaagttttcaaatcttaacttaaaaattttcacatctggacttgaaagttttcaatctcaactttaaagttttcaaatctcgagttgaaagtttttcaaatatcgagttaaattttttcaaacctaagttgaaagtttttaaaatttgtcttacaaattttaaaattcgagttgaaaattttcaatgtttgagttgaaagttttcaaaattttatttcaaagtttaaatcttaagtcgaaagtttttaaatctaacatggaagttttcaatatgtcagtaaaaaagaatcttacaagaaaagagaattcttaacttaattaccatcattatctaaaactaatttagttagttaggccaaaa

SEQ ID NO: 30941 - DNA, 972 bp, Oryza sativa
ggaatatgcctgcaattgaactgaatgcttcactggaaatttaattcgcaaactaagaaatcagtgttagctgtaatggatggagcccaagatctgctttctagtaccacattatatagctcagatgatgctttcatgtatggataatttagctcttgtctgacttagtgaagcataaatctaagccaattattgtgatggtagctggagtccctctgcaaataacactttacaccactcgcaatgaatttgcctgattttgaacagcatgtgtgtgtacttcattaagaagtacctttggctagcagttgtgcttttgatctgaaatacatccatctgtttgcagctccaagatcaatagagcagtcagggcagagcagataagattaaccttcgtccggacgagaaaggcaactgatctagcagctttggaattgttcatcgcaagtatcccaaatatctcaatgtctgtgtagtttaatgtgttcatcagacctgtgcattgtatgtctgtaatttgttcctttcagatcgtgcaattgtgcgttgccccctcttttctttgcattgaaggtcaagtcgggctcttgtccgcttatttctctaaatcctagtcagttcaaaaattatccatcatgacacatgaactgatggtggataatatggcaagaagcttttctaatcattcaagcttgaacctcttgtgtgttctactactatattacatgaaagaaaatgtctaatgtctatatgttaatctccaaatttctccatgctgtagtaacttctatctacaagtgcaccatacggtgcaactgatactgaaaataaatgcttaccttgtctgtatcatgctgaaatttgcgggtaacgcatgatttggggtaggcattatactagggcttaagaactcaaaatgagaactacagcagctctatccattttgttggtacacgctgattccaatctagg

SEQ ID NO: 30942 - DNA, 590 bp, Oryza sativa
gccccacctcccaccgccacgaaatccaagacggaggaggctacaccacctcccgatgacgtgaaaccggtggtggcggctgcgcagactcccgacaccaaaatactcagggcggcgaaggaggcggccgcgactggatgcaagaggaaggccgacgtgaagagctctggtgcaagaaggggcaagcggctctgctcccgctgccgggcggagacatcggaatcggacagcgagacggcggtacttgacaggtcgccgtccatcgaagacgaaacggcggactcttcagaaatccatggaagcagtgatggcaaattcatcaggttcttgtgatttagttcgatctggagccccgagggtgctagcctagattggaatcagcgtgtaccaacaaaatggatagagctgctgtagttctcattttgagttcttaagccctagtataatgcctaccccaaatcatgcgttacccgcaaatttcagcatgatacagacaaggtaagcatttattttcagtatcagttgcaccgtatggtgcacttgtagatagaagttactacagcatggagaaatttggagattaacatata

SEQ ID NO: 30943 - DNA, 174 bp, Oryza sativa
atcactctcctctctctctctctctctctctctctctctctctctctctctcttcccttccttgtcctccccttctagcttgttcatcttgtccttccaagtcttcctcctggcaagctagctaggtcttcttcttcttggacatgagtgggagcaactttggagacagcatgg

SEQ ID NO: 30944 - DNA, 1501 bp, Oryza sativa
ttggatcaccttgttttttttacttagttgcctataacaatcgagtctagtacatcgaattcagggctttctcagaaacttatataattaatcaaacggtcaaatagtaagaccatgtactttgttttttttttcgagtaagagcataaactaacctgtatcaatatgaccaggaaagaagagtaaatgaatagttttatgtgtaccactgacagttaattgtaaggcacattctttctcatacctaactattgcttgctgcaaaatggatgaaaataagtgtgtccagaaaaagaagcaaaaccacaagaattactcatacctgatttcatatctccctcacaggtgaactggagagacacaagcatttgtaaatggaagaaaaggtcatacagattagtcaggattagtcaggacgtcacacaattatgcggaactgtataactgaaacaacaacctcattaccaccgacaccccagccatttcttctcctccttacccaaacacccaaacatgagcagatcacctaaagtaatgcaaatcttcattgatcatgagggaagcatcatatctcaaagagcaaaaccatgttcaatgccactgtacaaaaattaaaaaaacagtagtatttcgtgcaccctactaatttcaggagggtttacctcagcaaaatttagaaggatgcatgccataggagggttaacctcagcaaaattagaagaaacaacttcagctataaacactcttcaggaaattatacttagataggttgtaatgaactttgctcatgcaagaaatgcaagtttaccttatttttttgtaactatcctacaaggaagaaaactaacttgagctatttacaaaaaaaactaatcgcacaccacttctttatattcaactgatccaactgagcctattcgtcctgattcaaagtgcacccaagtttagaaatataaactgaatatctcgcgcataacagatgtacttcaaagtttgcccttaacgaatcagaaatgtgtcattatcctagagaaattagttatgcatgtatgtagagaaagattatctgggagttactaaaacagttgtaaatattccaccatatcttgagctaacaaaacacctttttcaagcaattggttaatgtccccttctccaatcaaacttataggtgtgtttaagaaacaatataaggcataaggatttaatttatctaaattttcttaacagcgtacattccaagaaagctctccaaatttcatatcagcatgtacattcaaacaaaagtaatgtaaaagcagcatatacttatataaaaattgagcatatgcatctaaataaatattgtagtacagtctacattattttagatacattactaaataagagagtagtacaaatatacaggtatagtattcactacccgattattcatttgtaaacagaaactaagtaagtctgctagacctaagattttctgggaaacaaagacaacttgaac

SEQ ID NO: 30945 - DNA, 1066 bp, Oryza sativa
tttcccttatttgtttttaagaaattgtattatagatatgtaaaatttgcgaaatggtgcacagagtaatagagttgccacttaagtatgttgaacaccctgttctgctgaaacttacagctattcctgaaaatgatgctctaaaaatacctctacctcaaaatagtttcctttcaccgtcaattgtgttatgtaaatcctcgcaaaaaaatattgttatggatatatcagaatgagggtgcttggtagggaggagaaaaagatatgtaagagacattaagggaagacgagacctaaaagaactttatatcccatgtttcgttattcttagtctggccagcagcctttttaaggctggcttctacctcttaacaacttttaagcagtagattgtgcttcttatctctagtacaaattccttctagttgtctacaatgcaactcctaaatgtttatatctaacagtagcctttatgctacatcacttctgtctttctttttgccatgtgagtggcatttccgccttattgagtggctgcagcacatgatagtgcgaattaggccagcccataacagttccgactaggcctgtagcctccacccacgacagatgtatttgtttttcttgataaacagttgcatagtaggttctgcaagtatgctgcagtagaaaatgatggttaacattatgtgctagccttctgataactgtttcaaggagcgatagtttttgtttcatagtactggttttacttcagtcaatgaatattgttgatgctatacacttaatttgagcattcaattgtccagatggccctttacctagcagaggctagcagatattttgcatgcacagatttatttcgggaaccttcaaagtatgcatggtcagattactatgaagatcattttatcgtacaaaatcagaaggttgctttggtaacaaacaaacgagtgatactgcttcaggtgaggcctctttctgtctgattctcatagtaaactgcttctatttattttactaaatcccagtgttctttttgtgtagtgcgtggatctagataaaa

SEQ ID NO: 30946 - DNA, 1501 bp, Oryza sativa
ctactctcttggtcctaggctgttagctgcatgctcagtctttctactcccactgagtattgaaacactcctgctgcatgcacagcaaacaaataatcagtccaacagaagcatatatgtatagtgaatgctagtagtgatttgggtgcagtaactaaagatggtttggttggtgacctctaccacactttcctcagacatttgttgcacttgatatgtattgtaaaagataagatagcagacaattactggagctttgcaaccaattattaatggaaagcagccaagcaagatggcaaaaggaaaacaatgacatgcatgtatgaacaattgtgtccatatatgtaatatcagtgtgcagagcagaagaatcttccgaattataagaggaagtaggaactctagctagcttgcgtctccataaattcagacagcaaccaatggaaggctataaattaacggagagaggcgaggtgtgtactagcaaccgatattacagtctataatggctagagattttctagcaagtacgtacttgcagcacatttagtggcgatgacagtactacatgtgtacaagcacgtattgatgcaaaggcacactgtggatgtcgtagcagcagcattgtcattactaaagcgtgaaaagaatcaggtcgagttaatgccatggctgatatataggtaggctttgcaggatagaggattcaatataatcacgcagaataaatgtatgtaaatagggccatatgttgtggcgtcatggacgtcgattggcgaacactcaaaccaaatgttgtggtaagaaattaatgcctcaaaacatgatgaataagatgagtaggagcagataaaaacaggagcaacatttcgtgacaaagagacgaggagacactagaatcatggcaaggattaggttgcaggttagctcgatcgcgccatgattgcaacgcaggatggcaacgtaccggaggcagacatgtcgaagacgatcaagctaagacctacattaaaactgtactgacggcgcagggctgcaagcaagatcatggaatcctctagatttatttcactatacagggctagctacctatagctttgtactccttctgtcccaatatatagtaatttttttatggatagaacctatcatagtactacgaatctagacaagaggcatatccagattcatagtactaggatatatcccatccaaccaaaagttgttatattttgggacggagggaatagtcgtcatgaagtggcatgtgcatatggcagctacccaatttatcatcgttcatcgttgttgtaggcatcattttaaaaggggattacctgtaaggatttgaagcgaaattagaaaacgcgtactctttataaacagtggatggtgaaatgaaactgagtttactcgagggaattgcattttgtaaagttcataagttaattttgaaaagttctctaagaaatacgaacgaagaaaggttttgcaaaaggtg

SEQ ID NO: 30947 - DNA, 598 bp, Oryza sativa
agtcccggttggtgttactaaccgggactaaagatcatagggccctgacacagcctgacatggaatcaaccgggagtaaagatgatttttagtcccggttggtaacaacaaccgggactaaagatcttcctcttattaaccgggactaaaaatcatttttagtcccggtttttaatggaaccgggactattgtggatataggtcgaccgaccaaagatggtttctctaccagtggttattaaaagtggttcaaaatgaaatatactctaaatgttactatgttagtatccccctcgtaaatctcagaaatgtaaaaacaaggagtaagcaagttgttttctcaattcatatacacaacacaagtctaaacaacttacatggtatatttaaaatcagcacgagtacatttatatttttcgagaaagatgcacacacatacacctcattgcctgtgcagcaaacacccgtaggtataactactcttaatacacgtttaaagagatgagatgaagatcgatgacaaaattttctcacagaattcatgtttaagccggcctggcgctgtgctgaaccctcctgtactccactccactccagc

SEQ ID NO: 30948 - DNA, 1501 bp, Oryza sativa
aagggtaggtggaggggtgggtgatgcgagatcggccgcggcggcggtagagggggtgtgtgtgctcggctactccggtgggtcgggtctgggcggggtgcgcgtggggatggggtgcttccagtcgacggcgaggcgtccgcgcccggggtacgaggaccccgtcggcctcgcctccgagaccgcctgtgagttgttgttgctgtacttgccacttgaggagtactctacagtactgtatttcatttcatttcatcaagtagttcatctgatttatgcaatcgatgggcgtactggaaattctgagttagttgttttggatgtgtagttagcgtaagtgaggtggaggctttgttcgagctgttcaagagcattagtggttctgtgatcgacgatgggctcatcaataaggtgaacatctaactgtttcttgggggtatctcaccatattggcatcatggcatgtgtgattatgagcatcctgatacatttactaatctgcttttatagcttgttgtggaattacaaaattagaccttgccgcattcgaatatatctactgttccgtctttcatcaccatattggcatcatgtcatgtgtgattatgagcatcctgatacatttactatctgcttttgtagcttgttgtggaatgacaaaattaaaccttgccacatttgaatatatctccatgtactgttccgtctttcgctggatatgagaggaggtgctctcatatcggaatttattaagaggggagtgaggctcgaacctgggtcggctagcccacaacttgtggtgctagccagaagacccccacgcctttctcactgttccgtctttcaggtttcagctgcacaaattatgtggtggatgccattttctgtgaatcgttttgctatgctggcagttctattcattcatctttgaagtgagcatgaatctttgttgtacacaccccgatcctttattcctcttgtaccgctcattgtattatgtgtttgccttctaaattgttgaattttctgtgtatcaaaatgtgatttttttcctcaaagtttaataggaaaaaacttgttcctgatataaaccatctggctactatcacagtataacaacacaatgatagttcaaagtttgagtcactttcttcctgccttgtcaatattgatttgccgtgctataaagctagacataatgcgtttctcttgcatcttcacttttgttttttgcatcttcttgttgcgtcttgcgtggcgaagaagttcattaactgctatctgagaagccatacaggttcatgcacatctgctagttctcatgaactataatcttgacgtcatcagtagctaaattcacggtatgaaattagggactacctatctaacgttcgacataaaatccccccaaaaatatgccgtaactacaacacaataatagtgtaattgctgttagaatttcaatggttactctcattgagaagaggatggcactcgagat

SEQ ID NO: 30949 - DNA, 1501 bp, Oryza sativa
tgttccgtctttcgctggatatgagaggaggtgctctcatatcggaatttattaagaggggagtgaggctcgaacctgggtcggctagcccacaacttgtggtgctagccagaagacccccacgcctttctcactgttccgtctttcaggtttcagctgcacaaattatgtggtggatgccattttctgtgaatcgttttgctatgctggcagttctattcattcatctttgaagtgagcatgaatctttgttgtacacaccccgatcctttattcctcttgtaccgctcattgtattatgtgtttgccttctaaattgttgaattttctgtgtatcaaaatgtgatttttttcctcaaagtttaataggaaaaaacttgttcctgatataaaccatctggctactatcacagtataacaacacaatgatagttcaaagtttgagtcactttcttcctgccttgtcaatattgatttgccgtgctataaagctagacataatgcgtttctcttgcatcttcacttttgttttttgcatcttcttgttgcgtcttgcgtggcgaagaagttcattaactgctatctgagaagccatacaggttcatgcacatctgctagttctcatgaactataatcttgacgtcatcagtagctaaattcacggtatgaaattagggactacctatctaacgttcgacataaaatccccccaaaaatatgccgtaactacaacacaataatagtgtaattgctgttagaatttcaatggttactctcattgagaagaggatggcactcgagatggggcaattttctggttttcttcattcactaaacacaaaagccatatcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaaacaggaaaaaaggcaccacaagaccaagaccaaccagccaagacttattcctacattctccccctaagtcttgtgcgccgtcttgtgggagagttgagccatcccgatccgggagcaaagctcaaggaacttgatcctcccaaggggtttggtgagcaaatccgcaagctggtccttggtgttgatgtagctcgccttgatgctcccttcctccaagtagcttcggatgaaatggtacctcactcggatgtgcttgctccgttcgtgaaaaacggggttttttgccagggccagagcggacttgctatccaccctgagctccaccgctccagtatctctgccgaggagatcactaagcagtcgagcaagccagagcgcctgggtcgaagcggcggatgccgccatgtactcggcctcgcagctggacagggccaccacctg

SEQ ID NO: 30950 - DNA, 1501 bp, Oryza sativa
catagacaacaagcaaagaaacgactttcgcaaatatggtttttagaatttaattttcccgctaggcgccacgacggaacgggcgctacacatgtgcatggaacgtctttacgtgtttcgtgttgcatcgtgaagccaatcaattcaaatttctcatctcgtcagcatgtgttttcatgaaaaaaactactacatatataattttaggacttacatatgtaattttagaacttacattgtaaatatactaaaattacatatgtaatttagagacttacatatgtaattttagaatttacattgtaaatacactaaaattacatatgtaatttagggacttacaatgtaaatacatgctgactatttgttggtgaaaaatatggcgctataaatatagttaccccctttcgccgaaaagttttcgggaagggtgcattttcggatctgatgttgaagagccggcgcattgcacgtataagagtttttccgaggcgactacgaatcggacgcccgattaatcgggctctattccaccaagtagatcggaattatttcactaagtagatcgaaaatgttcaatcgtttaaaaaaatgaaatacaaccaaatcacctcatggaacattttgctacaatgtatgaaacaaatggttttcaaaaaatcgggtattgttttaccatatataaaaaatgtttaagcaaatagcgagatgttttaattcactgcaacatttgatctatacgtagtgtaacatcatgagtacaacaaaaattgaaacggattctcttaatagagcgtttccataatatgtgagtaatttgttgcaaaaaatacaccgtttagtagtttgaaaaacgtgcgcgcggaaaaggaaggagatgggttggaaatattaggggaataacacacggatccggagcgctcctgcatattggatgcgtgggaccggcctctctcccacatggcggatgcgcggactaccgctgccatacgcacgccctttcccaactcgtgaatacatgtccgcacggaaaacggagcagtacattagcacgtgattaattaattattagttaatttttttaaaaaatagattaatatgatttttctgagcaactttagtatagatactttttgcaaaaattacaccgtttagcagtttgaaaagcgtgcgcgcggaaaatgaaggagatgagttggaaaaaattgggggattaacacggaataacacacggagccggagactggctcgataccacgcgctggaaccgcgggaccgcgccggtgccgcgccgccgttatgcagtaccgccacgctcccccgacgccatcgctcccgcgcttcggcgccatggtaccgacttgatcccgcagtgtagccatgcgagaccggctcagtcgcgcatcccggttccgcttgaccggctcgagtctgcggttcgccctcgctcccgcgcaaccattccgcacggattagatatatttttataaaataatcttat

SEQ ID NO: 30951 - DNA, 1501 bp, Oryza sativa
cgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaactccaccgggctgcgctcaacacgagctggcgtcggagtagacgtgcccggaggagtggctgttggtgctggagcgtgtggggacaccggctggggtggtgtcgacgacgagctcgtcgtagtcgaagtcgtggcccgagggtgtgttggtgttggagtcggtggaggctcggggactggggtagacacgctcggtgaagaagagctgcctactcccccagctccctcgaagtggacgtactcgatggtgaagtcgtcgtacgtcggagtcgaaccatcatccaccgccttgtcccatacccaccctcgcccttcgtcgaacacaacatcgcgcgtaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcgacgacgccgttctgctgtgggctgtacggcgcggtgtagtggcgctgaatgccctcatcagcgcagtacgacgcgaattcagccgccgtgaattcgccgccgttgtcggtgcgcagcacgcgcagcttgcggccgca

SEQ ID NO: 30952 - DNA, 1501 bp, Oryza sativa
gtatccctacgccttgttgcaccttcactatggacatcggatgcgaactacacactccttgaacgagtggaagtaaaaactttcggagactcacgtaggggcccaaatccaattggcgagcttccagagcgaattgacatgagaggaggatacatgtcgctgccgtccggtgcaatttatcctgcaattttcatgtacatgaaccgtgctttgtgcggacgtaatcaaatgttccggctataggggcacataaataaaggagtagttctccgtatcacgaatgtatagtgctgctccgttggtcaggctgatggtgggcgttcattatctatctgctctaagcctaggtcgtcacatggatgaatatagctgtggcaaccatcgaattgttaaatcgaaggtgaagtttcagtaatctgtataatcgaattgttaaaaggagtaatcatctacacagagccttgcctctgctagcaaatggagggcagagtgctcagcctgcactcttttggtctccgctgtctcttactagattctataattagggccttaacaaatcataggaaggtagtacgactgggacccccgttttgcagcaagctttgccactgattgtgctcagttgaatgaactcgaatgtatgattgattgcctcagcacgcactcgcaaccggcctacgttttcattttcttttgcagaaaaagaaaatgtatagggcctatttcgtttcgagagacttagaataagtcactgtcttattgaatgtttggatactaatttgaagtattaaacatacactaattacaaaacctattttcataaccttggactaattcgtgagacaaatcttttgagtctaattacgctataattttgacaatgtaatgctacaataaacttttgataattatggattaattaggcttaaaaaattcgtctcgtggattagctctcatttatgaaattagtttttttattagtctatatttaatactccaagttagcgtctaaacatccgatgtgacataggctaaaaaggtttagccccatctaaacacccccatagtatggcgttgttcagatacatacagtgacttgttcaatggtttgttggaacgtacagctctcttctgctctgtgttgttcacccaccaatccctcgataaccaacatctgctgaaacttgaaagcatgtgtgaaattcggttgccgtttggcaacattatgtatgaacatacatacgtctgtataacaacaaacaccggagagatcacaaccaccctgcaaaatttcgctccgacgcgcatatatatatatgataagtggagtatatggttgcacacaccggtaagagcaagtttaatagtatagccaactactagctccaattcatttatagtcaatctaatagcttattcatataatagttacatactacactattaatacatggccccacctgtcatacacacattgcgtcttggagtccgtgctacagct

SEQ ID NO: 30953 - DNA, 270 bp, Oryza sativa
tggaatttttttttctcactggatcattcgaatcggccgtggtcggaagcaccgcctttttcctccacgctagatgcttagtgcgcgaggaagtccaacagctggcatcaaccatgctcaatctaacagctccgtgctccaggccatctcgcctccacgggaccatggttccgcccttgtctctttctccctgagatcgaactccactactgccgccctccaacatgctcctgcagccaccctcgagttcgctcccgcagccacaataga

SEQ ID NO: 30954 - DNA, 1501 bp, Oryza sativa
tcgtgccggcttgtggttgccggtggcaacgccctgggcgcctctgcgggcgccaccctcggcacgtcttcgcgcccaccgtagctggacacctccccgcgccttgcgcggcttacggccgcctgtcggggaagatgactcccccttcctcccgtcaccctgagaggcctcccactgctcccgagtgagatggagcttcccgccgatggtgatgggccccgagagaggccgtggctcatcaccatcgacgaccttgaggcgacctaacgcctcctcgatcgacatcgtggagaggtccagcagagattcaatcgagcgagcgatctgcctgtacttctcagggacgcagcggaagagcttctcgacagctctctcctcgtcgtaggtgtcgtcgccgtactgcaccattttttgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgtttctgggaaagcgagaactgcatctcgggcggaactgcagcgatgagggcatccagtgcccgccgatcctcgtcgtagtcgacgtcaccgtaccggactgcctcccacatgtgccgcacctggagcctcaccctcatcaccgcggcccactcgatgtagttggttttggtgagggtaggccacccaccgccgggaccaaaatccctgaccaccgtctggacgccgtggtgaccatggcgccggtcaggggagagggagccgtgccgcctgcgagggccgcgtgcgggctccgggctgccgccggcacgcccgcgcccgtctgggttcccgtcggcgggcgcgcggtcccttgggccgccgccgccgccgtggaggtgggctgctgcccaccgctctgctcgctcccgtgcccttcctcttgccagctcctcaagctccctgtcagcggtgatgtcgccggcgatggagccgttgatgctgctgcgcaaggtctcaacctctacctccgccgcacgtgccgcatcttccgccgcctccgcctccgcctccgccctggctgctgccaactccgctgccgccagtctggccgccctcgctgctgctgcagcggtctgagccgttgctcgcctgcgctcttttgctgcggcgagctcggcgtcctgctgacgccgagtgctcgaggcgaccgaacgctgagaccgagcgtcggacatggcgcacctccggggggctgctgtgtggagagggggaagggaaaggggaaggaggagcaaccggtgctgctgctgctgctggctgagagctcaaccgagcttgggaaggggtggaacaagagatgtttagcctacaggaaagtgtggctctgataccagatgttagaatttcaatggttactctcattgagaagaggatggcactcgagat

SEQ ID NO: 30955 - DNA, 1501 bp, Oryza sativa
tcttgtccccgcccgtgtcgtgcaagcgctcaatctcaacctcgacgacctcggcgcccagcctcgctaccccggcggtttcgttctcgatcacggtaaccaccacatgcggcgaaatcctcttttctcgacggaaatggcaagcaaaagcttatgtcgagttgtttttttttatgcagacgctttgattaaccggagcaacgccatgctggccagccagaagcggcgcgcgtctccagccgtgccgtcgccggcgccggcgcctgcgctctgccacagttcgtgaacttttttgtgtcggccggagcagacgaaggatgatgcaccaagattccggcggcccccttctggctttgcgtcaagtttaatcatattaattaaagttagtaacagtacttcgtctgttaggtggtagtattagccaaagagggtagtaggaggcagtagtatcatcagcgttaggtttgtttgtttgattggtgatatattggttttttggtgtggacggaaagcggcggagatggagacggagacgacgtgcagtagaggaaatccatgtcttcggtttggtggtttggcagagtggtttggaaggaataataataagtggttcttttggagggcgagagagaaatgttagcggcttgtgcagcttgcaagcaagaagtgacaaggtatcatcaaagtggtttatggatgggtcatcttgggggagccaaaaataaacccatttctacatcatccatggctttgcttgctttgggtgcttgccaagaagtgaagtaccagcgcacacccagctataaggtctctctccctcctccctcctttttgcagtcttttacttgcaaaagaagcttgccgtgggctccgtgaataagggcgttcctttcttaaggaaaaaaaagaaaaggaaactatgaatttaattgccatttttcttgtactagcttataggtgccctaaccttctgttttggttcggtacaataagattcttatttaggggtgtagtagttcggtgcttagccgcagcagcagcaaagttgggctgggtgttgttaaacaacagttgtatttgtaccatcaaagccttaatatatgaatgatggtgagtatttcttactagttgacaataaatacatgattatagagtggatggtgtagtacacttgcacaatggaggatgaacagtttgtccggcgactaaccgcctaggaatctgcctggctgtgggtcagcatctgactagatctccggtagtcccctgcgtgctcgccgagaaaacgacgcatccccaaagagagtcccaggcttggctcggctagctcgatcgcaggatccagcgtgggtctagctggaatgggtggctcagccgctggagccatcaccatccgtccgtccgttccgtcatagtagctctctgcctctgccgattttaatggccttgaagagttttggcgggagagcctctgcttgctccgctccgctccgctccaatg

SEQ ID NO: 30956 - DNA, 1501 bp, Oryza sativa
atgcgtttcatcatacaacaactattataggacaaagaccgttttgagtcgtcatattaatataataatccaatctggtaaggttgaacccatcagattagggtagctgaaaaatcgatcaagtcaaggtcctgtccagagaagaagttattcaaacgctctaagcaacctttaatcctttttaagtaataccctgcgcgtcgtttgcgcataccggccaacctgctcggctcaatttggttgttggctctctctcgaaccaaaagcttaacgaattctcgcgtttcggatcggatgccgccgcgacgaaccggccttctaaaaaccgtgccgtgttacgtcccacggcggcgccagcgacacaagcaggtgaaggacgacagaggacagacgccacgcagaaaaacgcgcgtttgcggccatttcccgtggatttctcccgtgcgccgcgggggtcccgcgcggccgccccactgaccgaccccacgcccccccacccaaagtacccaaccggccagccaacccccctcgcccgccgtccgctcgaccgaatcgccgcgccgagccgtcgtttccacaccaaaaaagaaacgaaagggctcccccacgcgaggcaatcggggcacggctccacctccaccccaaccccgcaagcgcaagcgatcccccccacgaaccgaaaccaaccacacgcgcaacgcgcacccgcacccgcccgcacggccgcgcccgcgtcaccaccgctaccgcccgcgcgtccctccaccccacccacgcggtttcccgcgggacgcgatcaccgcgacacgcacgacgtccaccgacaaccggggcccgcgcgcgcgcgtgccccacccgtcattggcgtggcgtgtggtatgggaggagaggccggagcccgcctgccgtttggtggcacgcccggcgctgactcggacggcggccggtggagcgaaaagagagagaaaaaaaaaggaaaggaaaaataaaaaaaatcccacggcgcgcaccatttcttcccacccgctgctgcttcctcgcctttccgataagaagcttcgccgtctcctcctcctctttcccttcctccgccgctccatcaaaaaatctccacaaggcttaagcagagggagggtgagggattagaaacaaacaacccttcggagaaaatcacgagaggcttcccgagggcaaagtctccgattcattcaggtccgactcgatcggcgatccgacgaagctcgagcaggtgagggagacggactcggactcggagcacggaaccggtatattagggaggctgaagagggagcttgagagggggtctagccttaagctcgaacgcggggtggtggttgtaccagcagcagcagggaatcatggactcggagcactggatctcgagcctcgccgccgccaagcggttctacgcggcgcagctcggtcacgtcgacggtatgcggccatctcgacttttccctcgaatctttgtttggctttc

SEQ ID NO: 30957 - DNA, 1501 bp, Oryza sativa
atttaaagggttaccaggtgttgctataaaatttttctaacatacgaaggcatgagagatctatttaactctagtgcatatccttaattttgacgaggttcaggcatgttaattaattggatcttacaactaacaagataaattggaagaattgaactaatgaaccaatcgaccaatactgatatagtgtggtaaatgtagatccgatggttttagcattcatcggttgaaggcctggtgcaggtacattaaaatatatatcgacaaattaaccgatacatctgacaattgatgtttagaataatgatatctcattggctacaactccgacgaatgttgtataaaaacctaccgacttagtagaaataaacttattagcagcaatctaatcgatcaaatcaaaccgagatagtataagatcgaaaataataagaaaaatctatttaaccaatagatctatacacatatgatggatatactagatcgaactagtcaaagccatatatcaagataaatcgataaccaataaatcgataaccataaaaactagttagaatatcaagcggaacttgagaaagtcttaattgtgctttgctgggtttacaggacttaccacttcgccaaaaattgaacttaaccgatacaaccccgcttgagggcaagaacatgtcgaaactacaagggtgatgatgcgccaaaatattattgtattgatataaggagatgattacaaagatatcgagtgtacatatttatacctttgaatttgtgcaagttcaaatcgaatacgagataaaaattcataacaagaaaataaaaatgactaatcctgcctatttaaaagatatactaagaaaatataaaaatgtcttgtcatggtattcatgattcatccttgaacttggccttatctagataaactttcatctactaatcgatttctttccttaaccaaatccaccaaagagacctaccaaattttggtgttaacaccgggttacagtggccgaatctaactctaccccctaccacctattatacgactatggttcaccaaatcattttgggcgtggtaccgccaccctgtggtaagtcggttatcgcgataaccacgtggttaccgtgaaaaccgtgcggttactgcgaggtttatcatggttttaaaaactaagaaggttatggcaaatgataaccacatgattttgtaatttacaactccaaatctaactataatcaaatagaactagtatattcgatacttattctaacaatatggaaatgcataaaaagagttgtgtggccgaagagtaccggcaaagaagcaatagtagatatgtcaatataatggtcccattctctcttttcccgcaggaaactctaccattaggagatgatgacggttgtagttggttcttcacatggaactaaaatggagggggaaagtccccattggccatcgggtctagcggaggcgggtatgagggcaagtacaaaggtagag

SEQ ID NO: 30958 - DNA, 1501 bp, Oryza sativa
aaggaagtcgttttggacagcgatatggtctccaaaactcaactttgacttcttgtttctataaaaatatttattgaaaatgatatatgcatacttttatgaaagtatttttcaagacaaatctattcatataatttttacattttcaaactcaacaacttgagagctattcatgatttatattctcaaggtttgacttaaatattgtcttaaacgacttcctttacaagtacggagggattacaaataaaagtagttaaataagtaaatattccactgtattttcttatggcaaagctatcgatatcatttcaaagtgacaacacaaatatttttgttatgtatatgttgtgatcgaagttttttaaaggtatgcatgaactcacatgttctaaaatgacgacaagacctagagagggacaaatagaagttttcaccagaagatcgatcgacaaagagcaattttcacaaataatttatcagcacactaggtagctccaataatgcaggatacaaccatctcagattcacaaagcaaaccaaattattggccccaaaatacatccgaaaagtcataatatcacacacatctaagctagccatggaccacgagccgggccaacaggggggaaggtaacatggcaaccaaaggttgttaacacacacaagaagaggaggatctttcggaaacagctcaacgaatcgtgcccgagatgcagaagaaggccggacccccgggctagctatttactggcgagtactgtgttgtactacacatctatagtagggtggggaagggaaaagacatggacaagaacatgctcagatggctacaggaagttgatagtaatgccaatgtggacggcgcgggggccggttgatgaaggcaccaccagccgttctttctttggacagcatggcccctaaaatccaccatgcatgatcagtgctgtttaattagggttcagccgctcagaggaccagtaagcaaaagttgtgggctttaatttgctttagcaatcagtatccctgctaaaagtgtgcaggttatgtaaagggtagttaaagatgtatataactacatgttcacaatggcatgtcacatgttcacaatggcatgtccttgtgaccaaggagaatatcatagaacaacttcaagttctattatatgaagtcttaaataacatgtgatacactatacattgttcaattgcatgactcggaagatacgcttgttaattagtatatatagtgctaaactaaaagatgtgcttactagtgtagtggaaaaaaaacatgtggttttaacatgtcaacatgtattatattctcggatagtattcacctcattattatctgacatcttatacactctatattgtttgattgcacaactcgggagatgcgcttgttagtgcaatggtaaattaaacgatgtgcttgcatgtgtagtgggaagatgtgtggttttagcctgttggtatgcatcagattctcggat

SEQ ID NO: 30959 - DNA, 1501 bp, Oryza sativa
tggatgcttctggtggcgatgaggtcctttggtctgctacctttcagtgaaaccttgaagtgtttcgccaaaagctatactgactgtcattgcctttgatccgaaaaagacacatctgaaactcttagtccaaacaaatgtctctttggttaatcacttgattttcttttccatcctcaggtgggttattagctcgagggtagaatatagttcctctggcacgagaccctaggtctcctttttcagtaaacaattatacacatgatcacatatccgcatcttccaatagaatcctctcagaacttgtctgtattacacatttctccctcattacatgaatactaagcactgcctaaaaggaaaggtgattggcattggtacattgtttctgctatgggttctgattaacccgaggccttacgggtacggcgtttgctccagtgaccacaatacgattgggatgtctgcttcgtgtaaattggcggtaatgtggaggtcgactttgccttggttgcaggcagtccctcgagtaatgccctggttctttgcagttgtaacaaatcaacgtcttctttactgagctgtccatctggggacgatcattttgacttggagttggaattggtggttgggaatccttgctaacattggcatcagtggtaccatagttgctatcaccattggagtctttctcagtgtcgaaattgctaaggttgtcattctgggttccaacattgatactatcgttgacatcttggtgaatgctactgacattgcacgctttattcgagtggtcactaatggggcaagaaccatggttgttggtggtatcatcatcattagtattgctagtgttgttgtctgtattgcgtccatcttcttggggcggaaactcttgatgcgcaacagaagatccggtgatctgaagtggctcagtgcgctgtctttggttaccacctggaaatactgggatgttgacaatccttctcttgcagttcgtcatccgattatgctcactttcgagttgcatggctttgtccacaagtttctcaaaatcttcataatcctctagaagtagttgcactgcaagctcatcttttaacccctggagaaacttctcttgtttgtcttcatccgtttccacatcttctggtgcatagtgagccaaacgatagaactcgtgcaggtactctgtgacggtcaaatctccttgcttcaggtagcggaactctcgttttcttagtgtgatcattcctgcgggaacatgtgatctcttgaatacagatgaaaactcgttccaggtgatggtatgtccttctggccgtgatgcttcgtagctatcccaccactctgaagccggtccaaccagctgatgagttgcgaagccaacccgctcctggtcggtgcactgaatcaaccctagcttcttctcgattgtgcgcaaccaatcactggcttccataggatcgacggccatggcaaaggttggaggccccgtttt

SEQ ID NO: 30960 - DNA, 258 bp, Oryza sativa
tcgaagtctactttttagtcatgcaactagcaatatataaacccacatcaagatttttaaccctaactctgacacccaaggaagtgggagtgacttcagagctcgtcaaatcaatcccataaattgtgagtatctgtataataaagcagtaatcttggatttggtccggacatcagctagtacacatttcagttttgcagtaaaatttctcgatctgataaaaagaagtcccattttttaaggaatttttttttcagg

SEQ ID NO: 30961 - DNA, 458 bp, Oryza sativa
cgtaacaaattttttaagcccacttaatctataattagcgtatgtttactgtagcatcatataggctaatcatcgattaattaggttttatagattcgtctagcgaattagtttaggattatagaatgagctttattaataatctatatttaatatttataattagtgtccaaaccttgatagggacttgaaagtctacacagtagtacagtaccactcgtatatccgcccaaatttttgggttcacactcggcggcacactcgaagctcccaacaaccaaccaaaccccaaagcatatcacaatcagtggggagggaagggccccttatttattcgcattcctctcctcatcatcactcatctcccttccctgtcgattaccttctctccttcctctgttcctcctctcctccacacatccaggcaggcaacacaagaatcatccgggagagcgaca

SEQ ID NO: 30962 - DNA, 1136 bp, Oryza sativa
attttgcagttaacgacccctttgtcatgaaggcgtgggcaaagtcataccctgagaataagcatgtgaaattccttgccgatggtttgggaacatacaccaaggcacttggtcttgagcttgacctttcggagaaagggcttggtattcgttcgagacggtttgctctccttgctgacaacctcaaggttactgttgcaaacattgaggaaggtggccaattcacaatctctggtgctgaggagatcctcaaggcactgtaagagcttcagctcttaggaacggcagcgatcacttggacctatcgtgtcaatcttgtttaaatttgtctgcaaaatacttgtgcgaataaaattgtcgatgagctgcctagttgtgaggactttatgataatgtttgaatctgtatccactgttgaatcaagtagtaatgttcagtgctcatgttaagttataatcttcagtttatatctccagaaaaaggtttgatctttccgttgacacttagacagtgacttctagagtaaactggattattggtcaagaagagagaattttatggtagaaactgatcggatcgcaacagcaatgcccgttctctgaacaggcatatactgcctctgcacagcttaatactcttttaatagatgacgctgttgactttttctcacacatttgaccattcgtcttattcaaaaattttatgcaaatatataagatataaatcacacttaaagtactatgagtgataaaacaactcataacaaaataaagtataattacgtaaattttttgaataagatgaatggttaaacatgtgagaaaaagtcaacggcgtcatctattaaaaaagaaggtagtatcagcgtgcgaagatggcaataaggaggctgtgcggttatttcatttacaaggtaaatatggtgataaatctaggcttaatgcctgggccatcttgccaattacttatactccgcatagtttacagcaactgtagcttgcatatctttgtgttactgttggtgcgcgcacgtctgcttttgtattccgaaggaaaatatgctagtgtgcattctgttattcagatactagcggtttcacattttgaatttctgatctattcatgcaaaaattttc

SEQ ID NO: 30963 - DNA, 1501 bp, Oryza sativa
tttggttcagattactcctgggcccaagcacaaatggccattctgtatagtatctgaattcccgtaaaaaaatattgtatctgaatttgtgtttttatatctcaatgtataagttgagtttgaacctagtatttcgtagagtggtatatgtattatatgaatattatcatttttttaaaaaaaatggtaactattttatatggtgtataagtttgagttggaacttaatattttgtagagcggtatatgtatattatatgaatattatcaatttattaaaaaaaattggtaactatttatatggtttttaaaggaggttgctagtgggcgggtgatcgcttccctctcctcctagcgatcacccatccctccctcctaatacttatctttcatctctcttttttacttttttattacatcataaatttaaaaaaaatagtaaaagaaaattaggaaaaaaatctaatactctcattcatgtgcatagactttataccgtaaactttgcatgcataaactttgtgtatagaaatattttatatataaaatatttgaatccgaatttgaatttgaattggatacataaacttttaacttataaacattcggtgtacaaactttaggtggataaactttagatgggtaaactttaggtgtataaacttactaaaatagaaaaatataaaatatttgaattcgaatttgaatttgaatcgggtatataaacttttgacttataaacattcgctttacaaactttaggtggataaactttatatgtgtaaactttaggtgtataaacttactaaaataggaaaatatcaaatatttgaattcgaatttgaatttgaatcgggtacataaacttttgacttataaacattcgttgtaaaaactttaaatggataaactttagatgtgtaaactttaggtgtataaattttaggtgtataaacttactaaaagaggaaaatataaaatatttgaattcgaatttgaatttgaatcgggtatataaacttttaacttataaacattcgctttacaaattttagatggataaactttagatgtgtaaactttatgtgtataaacttactaaaagagaaaaagaaaaaaaaaacgatcgccgacagcaatcgatcgcccgttagcctttccacgtcaggtgagcttgcttgctttccgaaaatgctgagctctgaccataccttgcaatgcattaattttatactagtaggattttagttcaaatcccttaaaattaccacgaatttctccgttccaaaggaggctttacatagggaaatttcggtactacagctggtataggaagccaagccacgaacattctcagtgaatacatgatacattagcacgcaacacgatatttgcattgacaggaattcagagatcagaacagagcaaggtgcaacgcagctgaggagaatgaaatattgaaaaggaacttgcgagttaggaccaagcacaccattgtgtg

SEQ ID NO: 30964 - DNA, 1501 bp, Oryza sativa
tgagatataaaaacacaaattcagatacaatatttttttacgggaattcagatactatacagaatggccatttgtgcttgggcccaggagtaatctgaaccaaacgggccaactccaacgatacgagtgggccctttccttctttcaacccacggaaaccggaaccccaccatctggccatctccaactccaatcaggcgtccaaatgcaaaaatccgttaccaaaattatggaaagcctccttccccacgccggctcattctaacaggctgcgttacccactcaccagtcggtatgccgtatgccaatcgggctgcgccctgactgcttacgacgatactatgacaaaataaaagcgaaaatgattatccagtcggttgcgttgcattccattccgtgtcggacacgatgagtttgccctgcgttcgcagcgatcgccctggactccgatcaggtctcgaggcgcatacgcattcgcgcctataaatccagggcatatgcgccatccaaacccccttccatattgagttcccgagggagaattcgatcgaagaatacgagcaaattaaaatcgatcgcgatacttcggtgttgacgaaacagcgtgatctctctgccccgcaatatgccgccggctgctgcgggctactccgccggcatgaagcggcctctcgccgcggtggcgccgtcgtgcgacgtcgacgggcgcaatgccgctgccgctgccgctgcgaaacggcgggaacgacgacgggaggccaagcgggcgcgcgcggcggcggctgcggcgacgggcgctctggtcccgtacgtggcgcccatcgacgcccggcccatacgcgccgtcccgctcgccgccgccgcggccgcgcggaggaaggaggccgacgaccaggcggcggcggcgccgtccgcggagccggcgtggatccgcaagatactgctcgagcggctggggatgacgtacgaccagccggtggtgttcatcgcgaggaagacggtgaccaggaccgacctcgacccgcaccagaaccggttccgcctcccgatcttcggcgtggagcgccgcctcctcccgatgctcaccgtcgacgaggccaaggaggccaacctggtggagaacgacgaggagaagggggttcctcgcccgaggccgaggcccaagaagaagcgacgcacggagaaaggcagcgtcgtcatcgccgccaccgccgccgccgacggggagctgcagaagccgcagggaacgacgccggagacgaacgtggagggagaggatcaggctcctcctcgcccaaagccggtgccgaagaagaagaagcgacgaacggagaaaggcagcgtcgacgtcgccgacggtgagcagcagcagcagcagaaggggagggagaaggagccgaggaagaaggcgcaggggaaggaccacggcggggtgccggtgacggtgctgcacctgagcggcgccatgaaggagctgcggctggtgctctgggacagcagc

SEQ ID NO: 30965 - DNA, 1501 bp, Oryza sativa
atcaggatcggcagagtgcgagtcggacaaggttagccgattaagccgattccgacaatatgactcgttacacgacatcgggttaggttaaagtgcttcatatagattgccatgcacagattgagtcctgaaaagacaattgtatctattaattaggatattttatgtaatttccttagagataggtttgagtaaaagtcagccgcaaagacttatggtatcttagagtttgttagagataagagtcgtgttcgacattgacatattttgtaatctcgagtataaatagaccccgagccccatataatcaatttaacacacgttcaatacaatcttggcgcatcgccaccctttactttcgttttgtttcgacgagttctttctttcgggttgagctgcatcgatttcgatcttcaactagaggtaaaacttgttatggcggcttgcgttctcgggattagtgctttcatttttatgatactctaatcttgtttatgtaatttgtcgagttatcatatatcctatataatctctggcaatattgttatttaacccttagtcggctaacatttatcgctagaaggcagccgatcaggttaaataccaacgttgacttagattatatagggtatccaccactctatgaaacatccaacagcttgattgtcaagatattgttctttttttcatacttaatgctgcatcagttgagtttgatctattaagtcgtgcttagaatctcaatctctagcctgcttttggttgccgattagggtagtgttggggtttcagccgatcttacctgatttagctttaaatcttacgtgcttaattgatatgctagatctgccctttatgttaagatcttactacaacaaagtatattaggcttctgtttgatatatattttacttgctttaatatcttaatatagagtagtatcggagtattagccgatacatgctagatttatctgatcggctatgctataaatgtttataatctttttgttaatatatattttgatctaagtgatttatactgtctcggcatggcgaccgatctatcccaatcacttgatttaagtatatatcgacagaagtattatataccattgatatctacagccgatcgaatagatttaattcttttatgcttatttatgattgccgatcgattcatatatgacatcggctcaaagataaatgaaacgtcatcggcagctaaccgatcgactatcgtttgtggatttaactactacttttctgtttttatttcttgttgatggcaggatcaaatcaactggcacgctcacgaacctaaaggcaagatttttggaccagcactggagttaagcagatctctcacgcctcgtgtttttcgcatcagcaaaagcaggtcccttaacggttttgatggtggttttggctgatgtggcgcctacgtgaccggtttgacttggtcctcgtcctacgtggtggtgatgtggcactggaagaaa

SEQ ID NO: 30966 - DNA, 184 bp, Oryza sativa
aggatatcttgctcttcgtcttcctcgtccttggccgcaggtggtggtgatgggtgcagggatgccgggtgcgccagtagcagcggcaggggcagcggtgtcgttggttcggttggcgatggttggtgggggaggaggggcgggcagcgggagcgggccgtcgccgccatgtgcagcgccggca

SEQ ID NO: 30967 - DNA, 158 bp, Oryza sativa
gcctctcctcacccactccgctctccgctccattaaacccaagcgagggacctcgatcgcctcccctcctcgcttccctccccgtctctcctctttcgaccgcgttggaagcaagcgcggcggcggcgcggcgagctgccggtggggggttgcggcta

SEQ ID NO: 30968 - DNA, 1501 bp, Oryza sativa
ttatttgttaagtattatctaaaaaaagttatttgttaagtttatttcataaaatatgcatttacatttataatcaagtggatgtttgcaataataatctgcttaataatctaaatcaaacatgtgatttttttctgaagttttctaccaagtttcctctaagcaatcccaacagttattatcagatctagtggctctgacgaacggagaggaaccaacggtacatacttgctcatcagaattggtccaacccaatacagtgaacaataatgaaggactactacgttgcacactgtcagaacacaacatcgtcagagaaaaaggctcaacttggagaaagatgagtccaaaagacaccctctgctctaaccaccatcacaaacgtgatttaaccggtaaagaaaagatcaaatgagtaaattaacagagagatcaaagtgatcaacttacttaattaccggcatctaatgatacccctgccattgctaatctcctccatttgattactgccattagtacacccggtgttttttctcgcctacttttatgcagttgcaggtaggattattccaggaaaacgccgtgcttaacgtgttaacgacggtggcttcttctgaagaagaaggctgagcaagtgcagtgcagtgcagtactctgcagtggccacacttcgaagcacgatcttggtcggttcccttctttaatcgccgtgtcggcgcctttcactgtttattaacgcacgatgccgttaacttttcatataacacaaccattcattttatttaaaaatttaataaaaaaagtgtaaaataatatgttgatgttgtagttcctttgatgataaaataaatcacagcaaaataaataatatctactttttaataaaataaatgatcaaacataacgttaaatgttaacggtgccataatacattatgaaaagagagggagtattagttagcaccagtgaaaaactgtaacttagctagcctttgctaattacgatgggccgtgcagtataatccgtgtgtttcaagtcaacattggcttaggtgagtcctaattacttaattagggatccaagtatattattaactgaccatgtaggactatgcggcatccctgtccctgtggaccaccactatagagcatcttcatttgccagagcacaaatagcattctttttttttaaatcactccgtaatttgttaaagaacaaataatggaagtgtggaaaagagcagggaatgggatgaatacaaaaggcacaaattagttatgtttcaatttgcacttaaaatataagttccatcgacgaacgtgtgaaacttccaattccaaacgccgagagtgcgccggacaccccacgtgtgggcgtagaaatggtgctcccctgcacttgctgctcctcaatggctatttcacattcttttttttttccaagttggttgtttggtttacattctcttggatatgtgcctcaaaaatacctcaagatttat

SEQ ID NO: 30969 - DNA, 1501 bp, Oryza sativa
ttaaccggtatgggaaactggtgagaacactttgtacacgctttcacagcaaagacataatgaggaaatgagtatacacgagtgggttactataaacatattttaaagagataaaaacaagtttaatagtatagccaacccatttatataatagttaagtataaaaatatacatcattaatacctggtctcacctgtcatacacacataacgtcttgtattccgtgttgcaagtagctacaaatatatagccaactttcttctctcttctcttttcttcttgttacgtggttatagctggcttatagcctgctattggacctgctctaaaagaggagagaggagagcagtgggctacagatttatagccgactgcagcacagactctaaaacacagtgtgtgtatgacatgtgagactagatattaataatatagtaagtagctattgtatgaattagctataaatgatttgaagccagtagttgactgtactattaaacttgctctaactcctagccttcttccttttggttgttgacgtcgaagaatcttcaaagtcgaacacccgtgctctgaatgcatccaggttgaccaacagataaagctggtcaagcagctttcagagaccgagtagaatacctgtggacgcaggaaacgagttactccctcgttttttaatagatgacgctgttgattttttctcacatatttgaccattcattttattcaaaaattttattcaaatgtataagatataaatcacacttaaaatattaaaatattatgagtgataaaacaactcatgacaaaataaattataattacataatttttttaataagacgaatggtcaaacatgtgagaaaaggtcaatggcgtcatctattaaaaaattaaaaaaccggaggtagtactatttattatccttcactaatcgaacaaagagcaccgctagtactgctttacgctgctttaatggacgatgaatgccatattacgtgaattaggccccctaacacctttctgtaaggaagttcagaaaacgtttcatatgcatgccattatctcttcttcagggaccaacttatatcgagggcgatgcgctaaaataatccgctacgttgccctggtttgtctgtgcatttttcgtacttacaagaaggctgctttctcttctttatgccaactggcaatggcatcctccaatccgctcagcaccaaaattcacgcgtctgttagacacgaaacaatggaaaattccagaaaagaaaaaaagacactgatatgtgtgcctacatataatatgtcagacacgtacctcacaaaccagccaaaccaccgaaaacaacaggacaggaatcttcgccagtcgagtccaagctatcatccaccgccaaatagatatgtttaaagtatgagaagggaagacttccgtctccagttgcggatcacatggtagcagtagcacagagccaatgatatcaaacaagagagttgtcaa

SEQ ID NO: 30970 - DNA, 1501 bp, Oryza sativa
tggtatcactatcttcactaccaccaatatttttgccacctctggtgggcaatattctctctatattggttgtcttgtctctatgccaactgcgtcagctaccatcaatgaacaattgtgactacgtgctcaggggcttactagctcaaatacaagtattatatcttcaatttggacttgctccggatacatgcaacatgaattcatgatcatgggtctattttctatgctcaaagactggactatttattattccccgtaagggttatcaaccgaatacttgcgccagtcgggattcaatttttatatctattttggagtatcccataagggataatcactcagatcagaagctattcatatgagctacgcttggtctatattacccggaagatttattactcgggagcatgttacatgtgtcatcctttaaagggtgtcgagggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaacagtaaagctttatatagctgtcccgctgacttttttatatataagtcaaggtgctgtttgggtttttaagcaattgattggatacaatatcatcgcttttcgccacgtaagtgtgcatttttattgaccaatattatgacttaggctaattatatattgtggccattttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttgaaaatttctttattcacaatatacaagcttctttatagctattttgctatatcactcatcatattttacaaagcagttggtatatcactcggatcatgttatttggaggattcacaccgcatatgctatatattgatatcaagtcacttggttgagtacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggagattatgggtaccccatacccacacggcatggttatccgactagttataggggataacttatatatatgtaatatgtaacagatcatgacttgggtgttacgtttcctt

SEQ ID NO: 30971 - DNA, 1501 bp, Oryza sativa
gattaggctaataggatgatatgcaaaatagaatatttgatgaaaatcgagataactcttaaaaaatcctgtaaaattttcatattctaaacacaccttgaaaaatttacacgtgttatctagcgcgccatactaaaggtgtgctctacgacgtttgacgtgacttttaaaaattataaaaaagaaacctaatgagaccataaactataaaaactacaggatccaatttttaaatgtttcaaggagaataaatataagcatgtagatcggggaagcatataaagaaggtgtgacaaaaaaagtaaggggtagcatctgacgtgatttttaagaatcataaaattaaaacatgaggatgataaggtttggtctttcaaaatcgtaagacaatgaaatagcgatttaacaaattttaagtaaaatcatattaaaaaatagataactctgtattgttgttagccgcgcagctagttacaagtaggagtagaagaaatccgaagagcttgctaaactagccacgaggacacgcttataaccaagaaaaaaaaatacttggcagacctgattaccgtgagtaaaggaaagcttgaacaggttcgctgtcaatcttttttccaaacgttgtcggtgacaaaaatttcaaagtcaaaattccgtgtccatgtgaatgcatgcatctacagacttacggttataccaggtcatagagattccatttttccatagaccaacactgtgtttagttccacgccaaaattgaaagtttgaaaaaattgaaacggtgtgacagaaaaattgaaagtttgtgtgtgtaggaaagttcgatgtgacggaaaagttgaaagttcgaagaaaaaagttagaatcaaaacagggccactcaggtatcttcttttctttaggactacactcaggtatcgagtcctgaattctagaacaagggggaatttttaaaaatctcacacattagagttcagttcctataaaagacaaggaaaaagaacaattcttgcatcacaaatggtattgcaataggaaattatttcttctgtaagagtcaatacaatccactcatccagtaccaccatacttagacgagctttccataatcatcagtaaccagaaaaagaaaagggagaacctaggcttccccttttcaaaataaactttacgcggattcagaaagatattttcgctagtatttagtcctagacaaagctcgttccacaccacagtccacacaatcaaaacaaggaccgttctcattgaaaaaaaggataaagaaaattatcaaatgatcagtaagaaacaaatggataaacttttggccatttaccagtcttcagaagcaaaaatgcttgtggaggaagacttaaatgatccttgaccccagattagaatagcgctcttctagtgctacataaatacagaacaaatgcatcattcccttccttcttccatctctgaagccaatcatatatctcatacacttatgcacctg

SEQ ID NO: 30972 - DNA, 1501 bp, Oryza sativa
cagaacagataacaatcaatgcactgcaattaaccatcgaaattcaaaacaaaattcgaaacttagaaagtgaacttactgtttcgaaagaacttctggtgaaggtcctgcatggattttcagggaaaacacaaaatgttaaaattagcataaagaaaacagaaggcgagcatcagattgggagataagtatatgcactaacatttgccaagttgaagtcaataagatacccctttgccagtttacgggagaacaggaaatttccaggtttgacatctctatgcactatcccctggaaacagaaatatcagatatccaagataagctggtgacaaacgcaagttagcagttgactaaggtaacatgcatttaaccagacctgcttatgtaagcttgccagagctttgaacagacaaaacccataccaccttaaatcaaacaaacctatttcttttctcagattctgcagagataaaagaaatattcaacaaaagatggaccaatatgaatagccaataaaaggaaaaataaacatcagagacaacatgagtgtttcaacctctggtctatcgtgctcaacatgttctagaacaaagcattctagatcaccactcctaagagagcactcatatttaatcacgaaattcttgcctctgcagcagaaaaacatgatacatatgtttaaagttactgcatggaacaagaaaaatatcattataaaattttcggaggacatgaacttattagtacccaaagcgttccaacatcttctgttcattgtaaacatgatgtgaatgagcatttgcatgaggacctgttaataaaaaaaatacaggtgcagggttaactcttgtaaagatcttagccatataattatagaaagatgactgagactgtcaaaagacaaaacaacagaagatacatttatagatcaacaaatccacatgaaaaaacatcaaatcgagactagcaaagagatgtacacacattttatggcaaacagtcttccatctgattttcttcgagccctataaacagtcccgtaaccccctgagtatgcgtaaacattcacattggtcagcaatcaatataaaccaagaaagttttaacagaatatttagaaattctcacctgaaccttcctcttcttcaatttcaaaatttttgaagttaggcagtggttttggttctgtatgaccctgcaagcagcaacattcaataaatcattttttgaagatcagtataagctatttttcaaaagaaatacaaggttcatgatggttacaacacatcagtagtgcatgaaactgttcataaatagaaagaacctgaaatagcaacagttgagtcatcatcatgtggacaaactaaccttttgaacctttgctgcaacttgatccttatcttctttgggcagtgcttcttttttcttgcccttatccctttgcttcataatctttctatcttgctctttcttagataatctgacagccacttcgttc

SEQ ID NO: 30973 - DNA, 1501 bp, Oryza sativa
ccctttcggcttaattaattacacgcgtcgcattaaccactcagatgatgaccaggttaaccatctgttattagttaatttaccggacaaacactacttagaaaaaacattttttacagacggccaaaagtaatttttccaggtagggaaaggaccgcctgcagatcaacgactacgaaaatcattcatttttataggcggcccaatggcccgtatgtaaaaatcctctagacgaaaaaaaaattgcgcccagccagccccgcacctcgccgccgccgctctcccccggccttcctccggccagatttgtaaggagaggggaggggagccgcaccggagccaccgtcgccgccccacgcggcatcgtcttcgccccgcgcctcgttgacgctgccctccccgggcctccctccggccggatctgggaggggaggggaggggagccccgccgttgccgccgtcgccgccgccgccccgcgcgtcatcgtcgccaccccgtgccccgcgcctcgccgccgccgccctcctccggccggatctgggaggggaggggaggggagccgcaccggagccgccgccgccgccgccctgcgtcgtggccggccccgcgcctcgcctcgccaccactacccttccccgacctccctccggccggatttgggaggggaggggagccgcgctgagagccaccatcccgcgcgtcgtcgttgccgccctgtgcctcgcctcgccgccgctgccctcccccggcctccctctggccagacctgggaggggaggggaggggaggaggaggggcccggtggggagaggagaagaagtgttgagggagagagagagagttaagagggaaatgagtggtggaggggtggaaggagaagataagagttaagtggtccgtctgcgaaaatcattttcgcaagcgccgcttaagtgatccgcagcgaacttcaccccaatttatatttttataggtggttatttggctaaagggttatgtccgcctgcgaaaaaaagatcctatgtcaggaaaagtgatttttctagtagtgaaaccaaattgcaaaaatatacctgttcgggagggttttaaatcattaaatctaactctaaaaacggagtatggaacggacatatgaagcagcctaaattaaccgtgttgaatcggttccactctttcatatcactttagcccttcgttttctgggtgaagtttaaatcatttgattggactttaagaagagatgaatctagagctagcggccggagcctgtcaaacatgccttaattataactctcataatctaatattgcgctggttaattaagctggtgttactttctcacttgttacacgggacccatccgtggatgtgattagctgtagagccatgctgtgggctgtggcatggtaatgatggtacgaaagccaaggcggtgccaagtcaactactagctgcttctagtgtagctttggcacgtacatacaacggcaaagtcag

SEQ ID NO: 30974 - DNA, 1501 bp, Oryza sativa
aaaagagagaaaatgattttgatttactacaaatgaagagaatggcatttcagcgggttgggctcagttgaaagtggtatttgggcgaatcccaattgtaggatggcatttcagcgaagccctgttttgaggatggtataatccccattttctcattaaataatatagggtagaattggctcaaagttttgcaaatccgaacataaaatgcaactcaatacaaagacttacttgcatgctagtaattataagagcaagtttattagtatagtcaattgctagctctaaaatcatttacaaccaatctaatagtctactccatatacaatattgtcggtgacatgggaccgggagtatcatgactagaggcttgaggcagacacaatcgcccacgtggcctggcaccctcgggggacgtcgggcccgagggtgatgtgtgcgcccacctcttggtctccccgaggggggtcggaccactcctgcctcgcccccgagggccgaggcgccccgacccctcgcgggttctactccgcgtgtatgggttaggtgagcacagcggggctcaccgaaccgcatttattgcggctcgcctaaacgtgtcacgccgcacgaaatgcagtgcagtgcactcgtttatccggtctgtgaccagtcacagaccggtcagatcgcgggttaggtggcaacaggcggtctgacgcgcgcttcgccccatcccgtcaagacgagagcttctaggcactcgtccccagctggagctagcgtgttacctcccagagatggcacgttagccccggtcggatatatgccaggcttcatcctaaccattacaagcaagatgttgtgtgaagaagggcaaacatgcacgttgctaagctgacgcgtggtggacaagaatgaccgatttgtgaccggtctgacactgatcatgccgtcagcagacagccacgttcccacgacgcgcctgcctccggcagaagtggaggtaggtatgtgccgtcccgtcagaaggatgttcggagggcaaccgtgcaaatctccgtccatttatgaagagaagaaaagtccagtttggaaaggggggggtgcatgtggtatccccttgaaatataaaaggaggaccttgcccattgagaagaggggatttttctccagattcggaacctagaacaagggagaggttggctcacactttgtagctccttcatacacagatccaccaaaacacaggagtagggtattacgcttctcagcggcccgaacctgtatacatcgcctgtgcctcatgctctttcgataggtcgcgatctttccacatacagagagagcttgggatttcaccctgagcccccgaccgaaccggcaaagggggggcctgtgcggtctcccggtgaggagccccacgctccgtcatctggcgcgccaggtagggggcctcagcgtgtgtcttctgagctctcgcactctgccctgtgcaccaagcttttcctgttcagcctga

SEQ ID NO: 30975 - DNA, 1501 bp, Oryza sativa
tatagctaattgatcatacgattcaacaggtaattggccagatctgcctggctgttcttgataaagtcaatcttggcatagaattttttgaaaaaaaaaagagagagaaaaaaaatcatccgtagaatgtatagatagtgagagagactcaactcgatctgagaaaaggaattgagaggtttcttggtaaggcattcattcttctgtagcaatagaggattgaccaatattgagttcttgatcaaatacctaatacatttgcaagaaatgactagagaatactctgtgttttggccactgaatctgatgatctctgaaattactgaagaatcaagtcgttgctgcattcattcaagttcagaaattattcatggtcctgcaatgccgtactacctccaagaagtttgttggttttatacccttttttctctccatttcttcgagaagaatgtggaagtgtagttgccatttgccaatcgtaccatgcgaccgtgagagacgagcgcacctaactgctaacaaccaacgcaacggcaacgccaatgcttcctggaagtcgcacttgcaaggtcgcacctcctccagctccagcctccacacgccgtcgccttcgcttcaccgatgcatttgctaattggcaaaatttgccatgtgctgatgtgcctacctctctttctctttgtgccggtacacttgcaagtaaagtcagctaatgccagcaaaactattcccattgacacaaacactattgcctttttttttaaatttattttacagtggatattgttgttgcagattatgaactttattataagaacaatatatatatatatatatatatatttttgagaaataaatttaagaactaacttaaacaaattgtccaagtaaaaaaaaacttattttttcaagtatgaagtaaaccatccgtttcaataatccgactaataagctgaaaagatccgaacctaaagcctcctttggtgtcaatgaactatttcttgtgaaaatcctacgaaactccctcgttccaaattcactactagttcggaacgcagaaatttaccgaaagtaatgcaagttgaactgtcagcatatacacctcattatccggaagagaaaaaaaatcaaacaatgtacaccgggaagaatttgttaatttttctttgagatgagtgaatgaagtgattagtatagttcctactactactctctataatgtcgagtgaaatggagacaggggtgaaatggctcaggccatgaatgccgttttggaggcccacgagatctaatttgggcccaagtttgcgagtctagctagggttgggtggagatcgatgcggtgtctcacgtggttgggccggacagtgcaggaggcctatatatgggaggggcacccacggctagggtttcccttctccctcaacctacggcgccgaccacctccaaaaccagaccccgaaatctcgaggagcttgtcttttttcggtagcaatggcgt

SEQ ID NO: 30976 - DNA, 1501 bp, Oryza sativa
aatcatcgaaactccagttgaaaattagttgggcttgcacacaagtgctgtcctaacatatgcatcagctggaccacctccactggccataaagctcacaatggaaaatcttgcacctgttttaattagctatgatccaccatagtatgtatatggtccatacatgcatgcaagggcacataattagcttaattaattagctagtccttttcctgtgcctcaaaaagtgacaaaacatttcttatgtgcggctctagctagctaaggtaagtggacccatcaagttcgagatgatgaaaatgcatgcatgtttgtagaatgaggctgatttgtgaaggtttaggtggtgtttagattcagggaccagtcctgttacatcagatgtttgacactaatttgaagtattaaacatagactacttacgaaactaattgcataaatgaaagataattcgtgagacaaatttttaagcctaattaatttataattaatacatgtttactgtagcatcacataagctaatcatggattaattaggttcaatagattcgtctcgcaaattaggccagagttatgaaatgagttttatcaatagtctacgtttaatacttgtaattagtgtcaaacatccgatatgatagggactaagaattttagtgccatccaaacaaccccttagtttgcatgttccaagatatactttgatgatcatcgacatgcatgtgggtgtaaattggatttggatttgtcttattgatgctctaccatatcaggaaagtagtcttagacattataaatagacgtgacatttttcataaaatagggggatacactgtgatacgggtacaaattaaactatacaaatacaacaagacactagcttatttccatccaaagtcatgtatataaagcttgtttcggttagaggaaaattgtttttttactgtttaatctgcagattgaatattgcaatcagaaggatgaaaaaaaattaaaattggtgcgtcacacgaagttgctaaaattacagacatggcatgttctagatcaaaattgttgtaagattcccattggcccaatttgccttacccacaaactgaattccctttccggcatctttgtctagcaggggtaccgagtgccgagtacaacctaaacgaccaaaccgttgcaagccctgctctgaatcgatcatctccatgactcctttctggtgttttggaaagcaaagtcttgcaccttacctctttctgtcttcagtccacccggggtcaaattgtagatgcctctctgcttccgtttcttgggtaactgttcagcactcccaagttccaactccaagtgatcatgatagcaaaagaaaaggggtaaataataaggaaaagaaaaaaacaagacgcacaacaacgcaaacgtatacagatcacatgtacactttctgcatttcttaaacaaaaacagtacaaagaacattccattattccatataccttcgagcatg

SEQ ID NO: 30977 - DNA, 1501 bp, Oryza sativa
ctgcttgtagagtttatcgccaacaaatcgtgcaatcttttcgctgaaagaagctcgtattgtactagcagaggagtagaagttagtaagcaggaactatatgtctaatgatcctgcaagttttctttgttggagtgaaacgactttgtaaagccaggctgatttttataaggttcttcagagaaaaggggaaaaaggaagcctaggtctatgctgttttttgactgaatgttgtggtatgagaaagaaaaggtcgtcttgggcaacacaacacgcacgcaggctaaaagtgtctcattgtctgaactctgaataacctgggcaacacaacacacacacgcacgcacgcaggctaacctgaagaaaagaacaagcccacagtctgttgttctcgagtgaatatattatttttaatacaatgttttattgagtgaatgttaagcaatcgttttcctagatgtccagactcttctgatagtgttcttcgaccaagcaaagaacaatacctagcatcttttttcccttatgctctcatctttgttattaggttggtgatgtatccacctccccggttgttcagcgaaaaaccgtgatgtctccgttaaggcaccggagcaaaaatcattaaaaaaaaactcacttttgattagtacacccttccaattttctgggcaagaaagcaggaacccaatcaagtgggggttcactgattttagcacactgttccccaatctctgcagtaatcaagcttgttactgtctgaagactgaatcggtgaaactctgaatattccaactcagtcagccagtctgcaaacaaaatactacctaatcagagcccgaccactgattgctactactaacatgcattactactttgtcaaatctatatttttttaggctccaacaccaacataataatatgacaaaaatatttctttcttttaaaaaagatcatcaagggaaacaaaataaagaaaggctatatgtaaagtttttcttatgaaattcttattatacacgctcatatggcatgctgcgagtaaatcattattgtctgtaagttaaatcaaacgattaagactttagtaagatttttttaaggtgtgtaaataaaaaattgaaacaaacagctgggctagcatgcgccagaagaggatgttggtgtcttggtggactcggccgaacatttgggaagaaccaaccacaccaccatggtccatggcaccatgaggtcggtggcgatcgcaacaaaaaattccacggaaaaactagtggaaacggccccgttttttttttttttttttctgcaaatacggcgacgaaggctccatagtttggtcaaataccgataatacgccgtataatgtataacgtaataaaaaatatggataaatcttttatacatataatccctccgtttctaaatatttaacgccattgactttttagcagatgtttgaccgttcgttttattcaaaaacttttgtgaaatatgtaaa

SEQ ID NO: 30978 - DNA, 1501 bp, Oryza sativa
ctctaggataatgacacatttctgattcgttaagggcaaactttgaagtacatctgttatgcgcgagatattcagtttatatttctaaacttgggtgcactttgaatcaggacgaataggctcagttggatcagttgaatataaagaagtggtgtgcgattagttttttttgtaaatagctcaagttagttttcttccttgtaggatagttacaaaaaaataaggtaaacttgcatttcttgcatgagcaaagttcattacaacctatctaagtataatttcctgaagagtgtttatagctgaagttgtttcttctaattttgctgaggttaaccctcctatggcatgcatccttctaaattttgctgaggtaaaccctcctgaaattagtagggtgcacgaaatactactgtttttttaatttttgtacagtggcattgaacatggttttgctctttgagatatgatgcttccctcatgatcaatgaagatttgcattactttaggtgatctgctcatgtttgggtgtttgggtaaggaggagaagaaatggctggggtgtcggtggtaatgaggttgttgtttcagttatacagttccgcataattgtgtgacgtcctgactaatcctgactaatctgtatgaccttttcttccatttacaaatgcttgtgtctctccagttcacctgtgagggagatatgaaatcaggtatgagtaattcttgtggttttgcttctttttctggacacacttattttcatccattttgcagcaagcaatagttaggtatgagaaagaatgtgccttacaattaactgtcagtggtacacataaaactattcatttactcttctttcctggtcatattgatacaggttagtttatgctcttactcgaaaaaaaaaacaaagtacatggtcttactatttgaccgtttgattaattatataagtttctgagaaagccctgaattcgatgtactagactcgattgttataggcaactaagtaaaaaaaacaaggtgatccaataaagtattaaaacacccatggatcatgttgctaccctgtggtgatgaaaagagacataagtgctagctactattttttgtttaatcatgaaacagaggcttcatgaaaccagatcaagcaagtcaaatgggattgcatcataggtaagatcaaagttttcccctttttgacatcaacagcgtattcttttgtctgtagagattgtatatttgttttcattcatagaggttacatcatatccaagagagtgccaaatctgtcatgtagcatttgtctttttttttttacccggcctctacatccaactggatatatgcaacctttttaaattaagaacttagccctcaaataacccaatctgaaattcgctcctatagcgatttaaattcaggaccttggggtgctactcaggttactgcaaccattaggctacatacccttttacatgttgcatttgtctagattatt

SEQ ID NO: 30979 - DNA, 1501 bp, Oryza sativa
agtcgagatgtcatggcagagggttggtgccctgctgctagggggctcagtcctgcctgcctgtcccgggtgtcccggccgtagggggattgggtcggtactcttgtttatggctaggatgggttgggaactatgtcacgtcttccgtccgtataccgtggtggtatgtggcacgtggttgcacgtgaggaagatgtgtcttgtgggtaaagatgtacgcctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatggctttgggcaactaagtgacttttaaaggctgttactgcaaaacttaacccctatattattatccccttgtactcccttgcattaattatgcatctccggtgtggcttgctgagtactgtggttgtactcattcttgctctatctttctccccccttcagtaagagaagctttggagaagaagtcttaggtggagtcctggcttataccccagttgagcgcctgtgaagatggagctgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttcctctttttctccttcccctaatgctatttgcaaagggtttacccttttcttccttcttcaaatttcaactagtactagatggtcagctttgcgaagaagaagatgtcgtcagttgtttgccgaagctccggaagaatgcaggatccgctagcgaagtggaggaagcagtgaagccagctgtgaagcaggagtgaagatcttagaaaacccgtcgcagaacctaagccgccctatagggtagtgttgttagtcgtgtgttccttgcttgtgtgtgtagcgcgtggtttgcatcggtgggtggtgatgtaaccatgctaggttgtttgcttaatcaacttgcagaataagcaaaacaaacaacacatcaacaaaaagagttagttcctttaaggtcctgtccctagctctggtctattctttccttgtatgcttcctctctcaacccctaccttgtgacagatggataacactggtaacaaaggctatgggaa

SEQ ID NO: 30980 - DNA, 1501 bp, Oryza sativa
tgtactggatgccttgggcactcaccattgcagaagtgcactgcagcgatccgtatgcttgcatatgggactgctgctgacactcttgatgagtacttgaaggttccccagagtactgctctagagtgcttagaaaattttgtggaaggtgtcgtcgaggtatttagtagtaggtacctgcgtcgtcccacggctgaggatctcgagcgtttgctccaagttggagagtctcgtggattccctgggatgttgggaagcattgactgcatgcactggcgatggaaaaattgcccaaccgcatggaagggacaatatacccgaggtgaccaaaagtatccaactattatccttgaggctgtagcttcatatgaccttcatatttggcatgcattctttggtattcctgggtccaacaatgacattaatgtgctcaatcagtcccctctgtttattgaagcaataaaaggtgaagctccccaaatccaatttattgtcaatgggacacaatacaacacgggatattatcttgctgatggaatttatccggaatgggcagcctttgtaaagtctataagatctcctcaactagagaagcacaagctgtttgcaagggaacaagaagggaaacggaaagatattgagcgtgcttttggggtgttgcaagctcgcttcaacatcgtgcatcgtccagcacgatcatggagccaaaaagttcttcgaaaaatcatgcaagcttgtgtaattctccacaacatgatagtggaagacgagggagaaatggcagaagatcctattgacttgaatgctgccccaggaacatcaattgttcttccaccagaagttcatgcagggagtaatgatcacccaagcttcagcgatgtgcggcgaagaaatgcttctatccgagccaaaccaatccatagccagcttaaaaatgacttaattgagcatatttggcaacggtttcaaactaggcaaaataattcagtataatgtaagctctagtgtacaatttcattgtaattttatcttagactgactgtatttatcactttcacttactgtacatgtttttctctctaccaggggcgaacagattcgatgtcttttacttgtttttgtggctgcggtccagcttttggtgatcttgttcaaggaatgggataagcacttctggttgctgtccagcttttggtggttgtcgaactcttctatcacttctgtgacgtgatgcagtcttttttttcccttcagtttgctcttttccgcattgtactaaagtgccatgatatggctatgatgttatctagttactgttgtggaccgtgagttggaagaattgcacttcattgttatatactctaagtcgacgttgtgctatttatctatattcacactatgctgagatgttcatttttaatcgacagatcttttgaatagcatcacatgaaggaccatagagatattgtgtagtttatcaccatgtcatttactacccatg

SEQ ID NO: 30981 - DNA, 1501 bp, Oryza sativa
gaatgctatgctccgttgatgcttgagcctatggattttactttttttttctattcttgctctgtttatttactctagtttctgttctacatctctatcttcagttggaactaggggccgctgtgttgaacactactaatattcataatagtattctctccgccccaaaatataagggtgtgtttggtttgtggtcaaagttgtataggatatggccatccatatttataaggatatggctctctatccaacttcgtagtattaggatatatctcatctatccaaaatgtcttatatttttggatgaagggagtatccaactttgtagtattaggatatatctcatctatctaaaatgccttatatttttggatgaagggagtattattttttaagttgctattgtatagcataggtattgaagaaaactctccctttcacgtgtgataccataattcttatttcctccgctttaagacatagggcatgtttggtttaaaaccctaccgagatgtaagtttaggtactaccaattttttttgttaggcaagagtatatcaactctattgattttggcataagttagcatcaatctaaatggctagtactccctccgtcccaaaataagtgtagttttacactgttcatgtccaatgtttgaccgttcgtcttattaaaaaaaatgattagtatttatattgttattagattataaatatgaatagtactttatgtgtgactattttttaaaaaaagtaataaattttacatatgagacggacggtacacggatatacgactgtacttattttagaacggaggtagtatatacaattaaagttgtcaaatgattggtaggcaaaatttaacaccaaactaataacataaagttaatctaataatatattctaatactataaatttggataatacattcgatcatagattcgttcttcatgtgacggagttactatgcattttgaattgatggagtattcatgttgacagcggaaattttctcttggagctactgctcacagttaacagttgacacacacataaattcaccaacaccatcatgactcgcgaccaagtctcactcacccatccactcaagttgatatccccccgttaaatccactgtctgaactcatcactgcccttgtcacacaccaggaaacaaaaaccctgttcagtacgccaagcacatcagcccggacactgacaggcctcacagtcccctgtcacgtgcacacgcccggtgccacaagtccatccgccgcagaagatcccgcgcgagttctaatctagcccccacgcttcgtccaacgaacgcctccctccctccgtccctcgtactgcacgagagagtcgatcgatcgatcgatcgacgaacacgcgcggtcgcgcaccaacaccaacaaacccgtcaccctccatacggcgccaatttccccccaccagaaaacgtccccgcgctcgtcaaaagcacaaaagcaac

SEQ ID NO: 30982 - DNA, 1501 bp, Oryza sativa
tcctgccgcctttaatttaaaccccagccaaagtacacgcatttcgcgcaaccttctcctcgaccaatcgcttcgtcatgcatttcatatgcgtttggtgtacgggtcttccggttaatcgcaagtgtaggtgctttcttgcaacgcaagcctttggccatggactatactatagtagtagtacgtacgaccagcgctatagcagcagctaagctatattaacaccggccggtgtcatttctgacgtgtaaatgttaaccgtcaaattggtgtggtgtgtacgtgtggtggccggacgtccatatctcgatcgggagatgtacacgcagcaactcgcgcgcagagaatccggcgcctggtttgcggctcacgtatacggtttgcattagcaagcccagacttgagggccaagcaacaccgcatcattcgcccggatcgatcccctgcgttctatgattcgctctcgctgttcgcctagcttaattagctatggagtttgattgattgatttattgtcagtttatcatccgcgcgtgttgccgcacacctcgcgacgacgacacacatgacacatatccgtccatgcccatagctgtcaaacgctcattgttcagcctgttaatcgatcgctttagcctttcattttgatctcctagctagctgttgcacgtacgtcccctatagctagctcgatctctctctaatcctagtctcttgctccttttgtggagtgttctttctgtagttgttgcctgcactacacagctgatgcactgccggttctgcctctgcctgcctcgccagagagagagagagagagagagagagagagagagagagagagagagagagagagatcagctcgtggcgatcttcctgggaagcgccaaccgaaaagttggtgtgagaattgatgtattctcctccggaaacacttttaatcacctaggtagatacacccatttgttgtatgtcaactaaatgtgtatgaaaaaaattcaaaaaaatttgacaagatagattcatatgtaatatatcaccccacaaatatgcaagttcaaattcaacttctataagttgtaacaaaaataacaaatcaaactctgattagtgtttagaatccaccttcattctcctccttggtctgtaccagatggagatagaaaatcagtagccgcgcgcagcagctgggccgggaaggcaggcagggaggattaggcgattagcagctagtaggagtagcttttaacagggacaagcttcctatagctcccctctcttttctctttgttctccctctcgtcgatcaggccgctttgttccctcctctcctcctttctctctccctcctcccgcgcgcggggtctcgccttaacgtttgccgcatatgggggcgacgagcaaagcgtaggccggagggagggacagggagagagagagagagaggctttctggctcgctctctctgcacgatctctcgtcttgttggattatacagcca

SEQ ID NO: 30983 - DNA, 1501 bp, Oryza sativa
ctaaccgttggcggctctgcaactatactcctatacaccccgcatgctgcttctcctttattctcattgagattttaaaaatcgaatatgtttatcaattgggttttttttttactttctagaagtcccggcaaccgtcttgctcgtccctccttttaatcatcattaggattctatttggtgttttactaacagtttttatatattgtatcaactgccaccactattcctaattgaaatctttttttctttttctaatttaaatttttttaattaataccgtatagtgtttttaatacttttatttttttttattttttgaatttcagttgaactctcttttatttttttattaattttggatattttttattttttattctgaattttaattaatctcatattggtttcttatattgattcttctttcactattacttatttttaatttcgtatttcagttgattttaaattgtattcctattttaactttttttctttttgctaatttcgaattttttttatttttattccgaatattaactaatctcgtattgggttattatatggactcttctctcaatattccttatttttaattctgaatttcagctatttttaaattgtattcctacttggacttccttttattttataattttggattttattttatttttatttcgaatttgtattaatctcgtattgggttgttatatagaaacttctttcaatattgcttatttttaattccgaatttcagctatttttagattgtatttctacttggactcttcttttctttttttctttttctccgattaatatgagaatttctagctcccacagcgaacgtgatgtctccttttaaagctgttttaataatataatagatagatttattaggtgactttttatatcgagatctatcagttccatttgtttttttaaggatatccattttgttctcggtatatatcgcctataaaaactgcattcctaattaccggtgaaatataagtacaaacgaagaagcaccgagacattgctttacgaactacaatgaagatttacgtgaaaacatgtggaacattacatgaacatctgttggtgagtttgatgttatttttgattattcatcatagtttttttatctatctatttgtctacttcgaagtcccaaattgctccgataagttatttctaccaattttttctcccgaacaggaagggtattgaatatattctccggtactttaggtggccgaaagttacgggcttttatttcttttaccaggtcgagaaggaataagttcaccgaaggtttatcaacttaacagcgagatttttgagatcccttaaccacaaaatcagaaatctccattcctaaactatacaaaaccgtgcaaaaaaaagtccctaaacagtactgatctaattttcccccgtttagctgacgtggcatatggtggaacccacatatcagcgcccttttctcctc

SEQ ID NO: 30984 - DNA, 1501 bp, Oryza sativa
gtcatgagcaagcaactggagtctcattccaactgcgattcccttcaagaacttcctgatctttttcttgtctgtgtccacttcctcaggggcataccgagccaacttgttgaactgacttaggtactcattgacactgttgttgccttgcttgagcctgttaaattcctctttcttcatatcaatggtgctttcaggcacatgagctgcacggaaagccgtagcaaactcatcccaagcaatgttagtgggtttagggtgtgcattgcagtaattctcccaccaatctgcagcaggtcctcttagctggtgagaggcgtagagcgtcttctcaacaggagtacactgcactaagttgagttttctatcaacatccttcagccaatcgtcagcctcgacgggctcgacggtctaagagaactctggcggacgagacctcagaaagtctgtcagcttggatctattgttgcccatgtgagggtggtcatttccatgcgcattatgctggaagccggctatggctgcggctaatccttgcaagatctgtgtctgaactgccatcaagtgttgcatgttgttttccacatgaggtagggaggggatgcgttcttctccagaattatgactggcagcacggtgagagcagtgagactgttccacctctgcattacgggaagctgtgtgatgcgagcggttgctgcggtggggttgctcaacttctgcattgcgggaagcagtacggtgcgaacggttgctgtggtgagactgctgattagctgactcatgatttgcttctggctcaactctaccttcctcaaaaccgaagcgggctggtgcatgagcagcacggcgggggcggctagccatctaaactcccagaagaaggcgaggtaagaatcatataagcacttaggagggcaaggagcaaagtaaataacaactcagatagcacacactaggcataaactggatttttcaaatcataaaaacacatgatacaacgggcgtggacaagtcacaaagttacgccgagcttgactgtacgcacaccacctaggagaaccagactaccaaacaacacccacatcaatcacacgcacgcactacctcgccacgattccaaaagagttggcggcggaacaaaagggcctaacacacggacggctgctgaagactgcctcctctactcctcgtctgcctggctgcctcctgtagtcggctcctcagtcgaagaaacatcgatcggctgacgcgaagggaccagcggaacctatcgagggccggcagcagcacgggccgctggcagtgggggagctgggtagtcgaagcggaacacagtggaagaaccaacaacacgcttccgcgcagtgcggataaagcgtgggccacggcgggaggaagcaactggggtatgtccggggtgtagaaggggctaactgggtgtgggtaggggaagtacactggtgagtatggcgcacgcgagctgggggagtgcgggctg

SEQ ID NO: 30985 - DNA, 1501 bp, Oryza sativa
actaaatgaatttccaaaatcgtggaccggggaacgtaccaggtgtacggtttcccgctcctgcacttaaggaccgttttcttagaatttcatctgaacataagacaagtgcgaccacatgggtggaatgggacgcccctggctgagtaaatagctaaacaggggagccttgatgccaagagacatgtggattcaacggggtggtgtcggggggaacccccgggcttcctagcacagtatggtctgggacctaacctgttgttggtctgggacccctctcgttggcatatggcaaccctgtgtcagctttggaaatgccttgtcatgaaagcctcaaagtcaccagacgtggctgttctgcacgggctgggtgacccgggttagtaacgtcgtgtgggtaaagtgtaccccctctacagaggttattaaactgttcgaacagccgtgctcacggtcataggcagatgtgaggtgattcctagcgtagttttgtttgactactgctttgtgaaatttgctgttgtggattgggttcgatgcctggaaaatctgcggctgatgggatcagccaggcccgggtggccgtttgagagctgttggccggatgccaaccttgatcaattcaaaagactgataccttgcacatactccgaccggacgagacgcactgtctcatccgtgtcgtttgagaagcacacacttagttgtttcagaaaagagtttaaataaaatcaattgcaaaaacaacagccttttcttgaagcctgcattaaacacttaatctccatggcttgctgagtactctcgtacttacccttgctctatataaataattcccccccagttgctgaagaagatgaagtggatctcgctgacgaggagttcttccaggagcaagtcggctacgatgagttttagggtttcagcctagttcccaagtcgcgcctgtgatgtttggtccaagttttggcttccgcttctcttttgtaatgcagttgtgagctcgggatctgtccgcagcccaacatgactgtactcctactctgtaataaagagaccactgttgctgtgatattctgtcttcctgtgataccagcactgtttcctgggactggtatcgattaacaagttaatttggagcgtcacgggctagttccgctcggggctagttcggggcgtgacaagagatggtatcagagcacaggcttggccctagggcgaaacccgacgtttaggatgaccctaaggatactaagttcaaaactacttgcgaaaagctaaggcttcttttggtttctttttttttaatagtttgttgctaaaatggttactgatcttttctccttctttcaaaattgtagatggcagtgaacgccagcttcagttcccacggttttggtgagggtcaccacgtcgctcagcttcgtgacctcgcccgcttccttggcttctcgtgtcccgagtacacggggtactccgtggaccgtgttccccctcgctg

SEQ ID NO: 30986 - DNA, 176 bp, Oryza sativa
ttgacccgaatgcgctagtatcctatccatatacgtattcaacgtacatctggctgattcgtattgtaatctgtctcaacttacataagtgcacaatggatatggtttaatcattatcaaattcagagtagattatttacactttcaattctctactgtttgcatgttgcaacaga

SEQ ID NO: 30987 - DNA, 408 bp, Oryza sativa
attttataaagggtaaggttgtgtttggcatagagggtatgaaactaatcccgcgcataaaatatggatggactcgttcgcacataattaattaagtattaacttaaaaatatattaatatgatttttaagtgactttttttttgaaaaaacacaccgtttagtggtttggaagtatgcgattgaaaaatgagagagtagaaaatgggaaaggaaagccattgttaaccatagcaacgatgtttttccctctccgctctttctctcttttctatgtcagtaaatatttctaattagcaatgttaaaaatcctcctattaataaccattgtatatatcctaataaaactattattgaaagtactttatctaaaaatacttttggtaactttccttccataatttctagg

SEQ ID NO: 30988 - DNA, 488 bp, Oryza sativa
tcgtctacctctcgccggcccgcgtggctgccacgaaggcgccacgttggcgccacctcgggcgcgaccaggtcaagccgaccccggttagccgctcccctcggccccgcttgcgcgcgcggtccaccgcgagccgtgaggctgcgcgtgggctcgccgcatccgcgcccaccgcgatccgcgcgtgcaccgcgcgttcccttcccaaaccctagcacgcaccgcgtgcacctcgctcacggtgagccgagccgccgacaagcgagtcccacccgggaccacgcaaggtggacccggcccaccggctccctctctcctcccctccccgtgagcccccttgggccgcccttcaggccggccggcccaatggcaaggccgggccgtgccaacccctctcgggccgcgctcaagccgcccgcgaagtccgttcctcctccctctttcttttatttttcaaaagggtttaattaaatcctttttcctttaga

SEQ ID NO: 30989 - DNA, 293 bp, Oryza sativa
cgaatccgagccgttggctcgtctcccctcgtctcgtgcaaccacccggtgtgctcgttttcgccggtatcgccgtggttcgctccgccgctcgccgctgttgtccgccatccgttccggtcggcgtcgtcgtctacctcccgccagcccacgtggcagccacataggcgccacgtcggcgccagctcagccgaggtcgggacgggccgaccccggtcagcccctcccgtgcgcgcgttccaccgcgagccgtgaggctgcgcgtgggcccgccgcatccgttcctccgcaga

SEQ ID NO: 30990 - DNA, 1501 bp, Oryza sativa
atcgtcgatggttgctgaaagcgtttcagtgttgcaaatttacatttctttttgtgcttacgacctttcagaattgtaatattgtaatttttctcctgctctatcgaaaaaaattacagccgttcgcatctagaatttgtgtgggccgtttgctttaaagctcctgtaccgaaggcttcttgtatcgtcttgggcttgtgggacaacacaaattcgcaattgtttagctcaaaaaccttgttactccaaacaaaatgaaacatttcaatcgatcagttagacagtaacaaagaaacagaagaatttcctggagaataagcattcgtagtggtggaccaaatcgctcgtcagaatgtcagaatctggctctagcgacgggttcctagtttcaaaggagggccaaacttgggcctttccttttgccgggcgtgttacagcctggtaattgggcttggtcttagcttatgctttcttctgcaacagcaaccgctcgtgtgacctggaccactttgcctgactgaaaacacttgaacctctgctacaatttcacccaaaagaaactacaaacttctgcaaagtggatagcacataacagcattcttttgggtaccctaggttgtctttagtcctcgtagtgctcgattgacatctgatatggtagtacagtagttcctcatcttttagtgaatttctccaatggtggttgcctggttggccctggttagatgtttcaaaaatattcagcatgtataatgtattaatccaactaaactgtgggagctcgacaagactaggctgtgtatcacaggtgcagacttgcagaactaatgctcaccttggttttgtttttgttttgaagaaatgctcatcttgttcctggacatctgaaatactacagtttttttttcgcaaacgcgtaaaaaaattacacgtcatcatattagaagagagcaagattttaatatacaacgtaacaggccatggagacatttgccaggggaatggaagaaaaaaaaaagaacacggaaaggaaacgaaaaaagaactgctaacgaaaaaactgctcctatatagagggaggaaaaaacggtggagccaccctaatgtcccaacaagtcttcaaaacctacggtgccaacaacagaccacaaccagacttcctgaagaatggactccaagaccacaaagaccgagacgaaagagaccacagagactacagttcacaatcagtaaatgatcatatcttgttaaaaggctgcggcattatctacttacattttaacaaatgcaacgcaattatcaccgagacaattgcaacacacgcatgttttcggtagcttatgtattatggattatcacggtgcacttcccaagcttttaaacggtacaccttttgcaaaacctttcttcgttcgtatttcttagagaacttttcaaaattaacttatgaactttacaaaatgcaattccctcgagtaaactcagtttcatttcaccatcc

SEQ ID NO: 30991 - DNA, 1501 bp, Oryza sativa
tcaagttgttcagggaaacacttgtgatatgtatatccacccatcccaccagggttcaagtcctgttgcccatgaatattacagacatactagtgggcattcaatagaatttagtaagatcagggatgtgttgtggattcccgtctctttgagcatgtgttagatggcgcatctgtcattgtgtgagtgtggtgttacgtgtgtagtgttgtgcatgcatttacatctgtcgtgtaatcgcaaaaagatttcaggttgttcaggtgtgtatgtgttcagtgtatctctgaattgatctgtgctgttgctgcatatgctgaagctgacacacatatgttcagtttcagagttcagtctgtttcgagtgttcaatgtatctctgaactgatcactgttgatgctgaatatactacgctgaagacgacactgacattttgactaactgggtgcctataatcagcacggaatacacgaggaaaaacaaaaaatgaagcgccactaatcagttaattaccgtttcaaatgatccatcattagccaatacatgcatgaatttttcgtgcggaatgcccactgctagaactgcgaaacaccctaattctcgctgaatttgtgtgcatgtatatccatccattcatcgttcggctgcctaacagctggaaaaatgactttgtgcatcttgtgagaattgcagctaaagtcaggttagctctgaaagtgctctaccctgcattcttgccaaggttaaattcttccaaccaatacacgctctcgaatcgaaccttatcactcttgtcataaattaagctgcaagaatcagatgattccacagttcagataaccctcaagaaaagaacttcacaagttcagaattcagactgacttaattcaccaggttgccgaaaattcactgcaagtactaatgcagtgcagccgtacgaacctatctgtacggtcgatacgaatttaagcaaaaatccgatccatcattataatctaaatttgagagtctgatcaaacccagatttaaactaatttttaccaggttgctcaaaattcactgcacgtactagtgcagtgcagccgacaaatccatctgtacagttgatacgaatttaaagcaaaattaaatccatctttataatctaaatttgagaatctgatcaaacccagacttaaactaatttttacctgcttgctcaaaattcactgcaaggactagtgcagtgcagccgacaaatacatctgtacagttaatgaaattttaaagcgaaattcaatttaaattcgagagagagaagaagaagaagaagaagaaagacagactaatcatgccaacttgcaagcccaaagacccaatctttccttagaaatttaatttttttttcatctctttcctcgcgttttccctccctttataaccaccaccaccatctcgtctccttcctcccgctcgcttactgctcgactcgtcgccttcctcctcgtggcgagcgatcga

SEQ ID NO: 30992 - DNA, 1501 bp, Oryza sativa
taacagtacaacccactactagcttcaaatcatctatagccaatgtaatagtcaattcatacaatagttgattactacactattaatacatggtcccacatatcatacacatattacgtcttggagttcgtgctacagctggctatagatatgtagtccgctactattttctctctttttttatctctttaaaatatgtttataactggcttatagcctgttattgtagtgaagacgtgctgtgggcccgcacaccatgagccatgacaccgactactgccgtttggtgttttaccgttctgggttttcgctcgcatggtgcccacgtagagacgatagacgaaaagaatttgaaaatgtacttttatttatcatattttgcatttatatacctgtataagattattttataaaaatatatctaatccgtgcggaatggttgcgcgggagcgagggcgaaccgcagactcgagccggtcaagcggaaccgggatgcgcgactgagccggtctcgcatggctacactgcgggatcaagtcggtaccatggcgccgaagcgcgggagcgatggcgtcgggggagcgtggcggtactgcataacggcggcgcggcaccggcgcggtcccgcggttccagcgcgtggtatcgagccagtctccggctccgtgtgttattccgtgttaatcccccaattttttccaactcatctccttcattttccgcgcgcacgcttttcaaactgctaaacggtgtaatttttgcaaaaagtatctatactaaagttgctcagaaaaatcatattaatctattttttaaaaaaattaactaataattaattaatcacgtgctaatgtactgctccgttttccgtgcggacatgtattcacgagttgggaaagggcgtgcgtatggcagcggtagtccgcgcatccgccatgtgggagagaggccggtcccacgcatccaatatgcaggagcgctccggatccgtgtgttattcccctaatatttccaacccatctccttccttttccgcgcgcacgtttttcaaactactaaacggtgtattttttgcaacaaattactcacatattatggaaacgctctattaagagaatccgtttcaatttttgttgtactcatgatgttacactacgtatagatcaaatgttgcagtgaattaaaacatctcgctatttgcttaaacattttttatatatggtaaaacaatacccgattttttgaaaaccatttgtttcatacattgtagcaaaatgttccatgaggtgatttggttgtatttcatttttttaaacgattgaacattttcgatctacttagtgaaataattccgatctacttggtggaatagagcccgattaatcgggcgtccgattcgtagtcgcctcggaaaaactcttatacgtgcaatgcgccggctcttcaacatcagatccgaaaatgcacccttcccgaaaacttttcggcgaaagggggtaac

SEQ ID NO: 30993 - DNA, 1501 bp, Oryza sativa
actatctatgcagatgttagtagtggagagcaaggaggaggggtgataagagaagagaagagaacgtggtgtgcatgaggtttgtagggctaaggcagtggttgtggagggcaaacactgcgtgccaacttttgagctgggggtgtaatatataatgcctttggccttaatgctgtgagctggacatgaacatggatggatgccggtcacaagaaattcggcggttgcaaatggtgatctgatgagatgaccagtgatgcagggcgaggtgaggtgaggtgaggcttaattgcagccaagtcagaaaggagaagtagtaaacgattccctctctagtctctatgctcatttgacattccaggtgaaggttatgtgcatcctaagctaatgtgctgtacttagtgatctaagctagtgcacttatactatattgtaactagcttgttcttaattgcggcaataacagcatacacaattttattacagatgtggtttgtattttgtatttttttaaatgaaaaggtcaaaataatttattttgagctattaccttatggtaagaaaattggatttgttagagtgtaatatatttgggggaagatgtgtcggtgggtaaatgtttaagctgatgaagcgtttctattggtagaaaactattatggacaaaattaaatatatgtggtgagaattggcatgtgggtactgaaccatgtgactccagaactgccaaagccaatggtatttgaacctgtgatgtgaagcctagctagctagctagcccatgcaatgtggatcagtggcctaaagaatcacaggagtaaaccatcagggacagtgatgattctttgggcatttgcttttcataaaggcttccatttgctttggttgttcccctgtgaaatggagatggattttggttgggagcttaactttatctatgtactttgatgccaatgcatgtgtgtgcctttaatcattcttgttgagttgctggtacatgtcttctgaattccatggcttccatcctttcttatcttctggaatagtgacaagtgcactaattgtggctcctatgcaatagaagtgaaaacagggatgtcatgagctcaggaccaccacaggggatttactaggggttgaagtatacagtaaaaatagtttcttttcttaacatttgaactcacaatatgaaattgatcgatgcatgatgcatgaaactcaacaatcaatttaacccgtctccagtaaatttgcacaaccttattaggtgcaaattttgtaaggataggcaggtggtaaacattacagaagccccaaaacaatgaagactgtactttttgatgttaaaccctgcagcacagttttcttgcaaagataagttgaccatcaaacaattaatgggaaaatttaaatcatgccacacaaaatttacaaaatttatgatataccaccctgacccacatgtcattaactcatgtgggtcctatacgtcattgagata

SEQ ID NO: 30994 - DNA, 1501 bp, Oryza sativa
caaggagaaccacatcattggcttcaaacaacggtcagtaactctaaaaattccgcattaggatgatcatgtttacgctaagcactcatgttagtagatcacaaaatctacagtcatgtgtagattgcgcgactattatattgcaaatttctctagtaatagttaaatttcatatgtgacatcaatacagtgccactcattcactagtcataggataattctacctttagacatgaacgagtaaccgtgcacgtgcaatgcacgtagtaacaaatgtaaattaaaactattgtgggagaaaaataagaataacaccaagcaagttatacatgcatggtagcaccaaagaatccatcaccagaataaatatatactgtatataaataagtgaaagtgctaagcctccgcattaatttgcattggatttatactcttatgcccgttaactgggtctttgcgaggaacatggacagaggatcagggcatgtacaatggtctttattagcggtctctctttattgtcatgtaagtatatttggtgatgtggaagagagagaaagaagaaaagagaaagatggttgctacgcatgacaacagcatagaatcgactgttagcatttattaggaaattttttattgcattgagtctaataaaggaaagatgactagtaagaaagtattttggtacattaatgattagagaccgtattgtcttaactattgtaacgtgatagcctctaattaacgtagagaccatatcggtctctacctttgtacttgccctcatacccgcctccgctagacccgatggccaatggggactttccccctccattttagttccatgtgaagaaccaactacaaccgtcatcatctcctaatggtagagtttcctgcgggaaaagagagaatgggaccattatattgacatatctactattgcttctttgccggtactcttcggccacacaactctttttatgcatttccatattgttagaataagtatcgaatatactagttctatttgattatagttagatttggagttgtaaattacaaaatcatgtggttatcatttgccataaccttcttagtttttaaaaccatgataaacctcgcagtaaccgcacggttttcacggtaaccacgtggttatcgcgataaccgacttaccacagggtggcggtaccacgcccaaaatgatttggtgaaccatagtcgtataataggtggtagggggtagagttagattcggccactgtaacccggtgttaacaccaaaatttggtaggtctctttggtggatttggttaaggaaagaaatcgattagtagatgaaagtttatctagataaggccaagttcaaggatgaatcatgaataccatgacaagacatttttatattttcttagtatatcttttaaataggcaggattagtcatttttattttcttgttatgaatttttatctcgtattcgatttgaacttgcacaaatt

SEQ ID NO: 30995 - DNA, 1501 bp, Oryza sativa
tggttgggcccacccgtcagcgaccgcgtggtgggtctcacgacgttgctccctcccgccgccttctcagcggcaagacgtggattcgcctctcacattcgaccacccctcctcctcgtctcctccatcgccgctcgcgctcgctcgctcaccgcgacggaggcgagtggaagagaagcagcaagagggacgtgggatatagacgcgcggaatcccatcaggcggcggcgcggcgcgggccagcgatgaggtggcggcggcggcgtgcggcggcggaggcagccggcgacgagggcgagagggctggtcgaggcacagaagccgtccatcttgatccgacggctgccggctggccctaggcttccgttccgtagtgggcccaaccttttcttcgtgggcccgcccattgaatagtagagggctcttttggcggcccatttagcgttcgcagatatccggcccaaataggattccgcctcttggaagcccagtattcagcccaaaatttgcaagttagttatgtggcccgtatttctagagttgcagtgggcttgctcggccggaccaactttgagataggcctcagcgtgctcgtcttgggcctatttttcactcggttagctgatgctttcgtcttggttgcctcaaaagaaattgactcgacaggccactgcaaacgatgtactagtaccagtaacaataacattgtttctcaccatttttcagtcctttattaattatgcgtttaataggttcgaaaacatgctaacgaaaaacaaagaagttatcgtttgaagttgatgaaaagaactcagtcttaagcctaactgccaagtgccaacgatgtaccagcaatacatgtgccatttttctcaccatttttcattccttgattaattatgcgttattctccagcacctaattaattgcctcacggaagactacagtgtagagattcaaatgtgttttatgcagccagatcatggtgctttggtacagcttcatccccactgttcacctcagatatggccaaagatgcatcatatgcagctagctaccgcgatgatgagtaaaaacgccgcaaacctagctaacgcgtatgcatggtacagattggtacgcaccgaaatctgatgagcgaatcaaacctgccgtgtgccgatattgcctgatgccatcgtcgccggacgatgtcaggtttttctcatgtcaactctgaagtcagttctataaaaaaaaaaaaaactctgaagtcacagtgatagtactaactccataatgcttatatttaagacatacaatatactatgatctgttattcctttaagtatttgtaattccttttgtaacaaaaagactgagttgtcagttttaaaatttgtgcccagtgttagctatttgaaaacaaatgaagtatatattttgatcgtgtatatctacttgtagatatgaagatcgattttttatccgttgaagcacggatctattgagcctttcattt

SEQ ID NO: 30996 - DNA, 1501 bp, Oryza sativa
atgaaagcacataaagtctggggctggtggtctggtgggggttaatgtaagttaagattaccgttcctgtgatgtgactgtggcagcatagtttaattagttcggttagttattatgcttggtccctaacttctttttcttatggatgtgcagagcgatgtgtttgatcaggttattagagagtgcaatgaacacaatacacagtttcagtcattgataaggtaaattgcttcctatcagaaaattgatcatcttcatctagttctgcaataagagttatgatcaattaatcaatttctaggatgtatttcacaggaaaaacagcacagaactatatcaaactaataaaactcttacttgacttcttcaccattacagtttacttaattttgattgcctgatttgcattgtgtttatgacaggaaaatggtggagcagaacttagacattgaaacaaccagaaatgacgaccactatggggcagccgtccatcatctttcgctgcttcgtaacaaaagatgtctcatggcttacatgtacaagactgaaatctcacagctgaacaaactttttactttctatgttttatgctgattttacatgcacgcactaattttgagtatggaactgaaagcactgagttcaatcaggtataaccgagcagaggttattcagagctttagatggaaaatcggcccagtgcttcctcatgaaatacaagaaaagctccatttttctgagaaagagtacttcaagaaccactcagcagccattaaatcatatatgtcagagatggatatagatttaacagtggtacagcatttttctgttttatttactttcttttggatgaaatacagttagcagattttctgtaccacttctataggacatggtgcctcccaaggatccctacatccaggttcgggtgcttgaggacattggtgaagtatctcttggtgaccattccatatcattgacaaagaactcacttcatttcctaaggcgcactgatactgaacaatttatatcacaggtttgctatcttacttttgtgatattctcagtgtgtttattccatctgctaataatgttctatcaaacttacaatagggtcttatggaagagtttctggagtagagatcacatatggtgtacaataggtattactcactaccttacaatatatgtacacgtttcatgatgacagttgacagatgaccagagctagcatgtcctatatcagaaaaggctttgatggtcaattggttactgatgaatatttttcattttacacatataaatagttaaatatcacatttttttaagaaagaaaattcaactatcaccacaacatgcatatattgaatttaccagttctaatagacacctattctgaaacactgtttgtgtttttgatctgatttctcaaaccatacatctctggcctgcagattgtaactgaggatatgactctactacagcatttattcgtcattgc

SEQ ID NO: 30997 - DNA, 1501 bp, Oryza sativa
atctcccttgtcttgcacagtgtgagattggatcagtgaacagtcactgtttttctcataagccattctaattcctatctaggcagtaaatcgccaagtttttagaccacgacatagtttgttgctttccctctgcgttgtatctccacacaatatttcaacactgtccctctccaaaacagagattcaacaggctgtaaaaacttcttaactttttaatgacccactcactcgttatggccacaaaaacgaaaatatgacttgtcaagtcaatgcaatgatctatacacaaacaagaccttaatattataaagacaaccatgtagtttgtcagtgctccacttcttgtcgagtgttatcaacttggaacaaagtacatccacataaacccgctgtctataccctctaaacccaagtcaatgaagacttgacttttgtgcacacgacacgcatggcctgcatttcgttttcaagtgtgtggtgttaggttcagcatgcaagatttatgattttgatacattgtctagaactctagatagcatcacgatgtgcatgatggcatgaacttgatgtactagtgacttctaaaacaacataaggagtaccatgccacatacggagtacaagttttttttttatctgaattgtgcaatagtttaacagagttccttattttctttaatataacaggcactctaaaaatgtgtgacagatatctctgcactatctcttgaactagattcacattcattcagagattactgacctgaaatcaaatgtgctgagaattatacctgattagtgaacccgagacctattcccagtaggatccggttgatgagcagcatgaacacattgacggcggcgccgccgaacaccgagccggcgatgaagacggtgccgccgatcagcatggacgtccggcggccatacctccttgtgacggacgacgcgaagagggtcgcgacgaggccggcgatgtagagtgacgaggtgaacacggtgaggagctcgctgtcgaacgcgcagtagtggctcactctggtgtcctgcttcttctggtacacatccgggaagaatctcttcagaaacgagtccattgaggtcacaccacctgccacaattcatacacgatcgagtacatgagctttcagcatgatctttcctccgtactagtggtagttaagtcacaacatcagtggacagattaagcaggagaacttgaacaatgtttgcgtgatcatccaaactacattacttatctttatctatactctccacacaaaacaagaagcctcgtcttccatctcacacacacacacacacacacacaaaaaaaaaaaaggaatacaaagagtaaagtgttggcaacattgatgagaagctgcattactgctggaagatgagatcttttgagctggaaatgcagcttcttaattcctcatgacaaaaaagcttgcaaaccttttcttgtacgtagactgggcccgagccagccatt

SEQ ID NO: 30998 - DNA, 1501 bp, Oryza sativa
tctaatgggggaactgaactgtgttttggtggttttacagtctatggaccttccaccacttcctggaggtcaagaaccagagacccaagtattaaatcaaccagcactacctccaccgagggaggaggaggaggtagattctatggagtcagatacttctgccgttgcagagagctcttccgcttctgctatcatgccagataatttgcagtcgacctatccagtgattgttccagcttatttctcgccctttttgcaattctcggttcctttctggcaaaatcagaaagatgaagatggtcctgtgcaagaaacacatgagattgtcaagcctgttccagttcattcaaagagcccaatcaacgttgatgagcttgttggcatgtcgaagctcagcataggagagtccaatcaagagacagtgtctacttctctttcattaaatctggtaggaggtcaaaatagacaatcagctttccatgcaaatccaccaacaagggcacaggcatgatctccttctgcacacaactgcatttagatgaatcccaggcaaaataagctttgcctccttgtttttttgtttttattttaagattaaccgttctccgtagtctgtatcatgtgctgtaagttatgctatgtatgaatgtatctgttgtttgtctggcacacatgataaatcactctatgttaacaaaatcagtaatggtagtgctgatcttcgtggttgtactgttgtaaactcttttataagaaaaaaaaatattagttagtcattttgaagggatctcagttcattatgcatctatgctctttcctgatctagattgctcaatggagtgctgatgaatccagcttttcaattctgttagggtctgagctggccattcagttatattctgtactattttgttggagatggattgttattccagcaacccgcgtctagctttatcgtttgcaaattgcaagcattgctataatttcagcatgattatttattcctaattggttcatgtggtttcttacccagcacaacactgatatattcttatgctgcacatgctatattccgaggatttactatgaggttgtacctttcaatcctgattctggaggagatgctccctcttgaattatgcaccaagtgttacatatgtggttggtgacattagtggctgctggccagtctctttcagatattgggctcttttaatccatttgtcatgaattatttggtcatccaggacatcatgccacttttacatctttagcaaaagtcttcatttttgtttctggtgcaggctacaaaagttggcatataccaagaaccccaaaaaaaagggttatctaaagtctgtgtaaaagaaatgattttgctgtctttccctgaagtggagtgactttacctgttgtgaacagcagaaacgtttaatcctgcagaatatggaatagtttttccttttcatctggaatcagaaacaaaatggcacccttgtta

SEQ ID NO: 30999 - DNA, 1501 bp, Oryza sativa
aaaacccaattttttcggaattaaaagttaccctcaaattcgacggatcgcggtctgaccaaagtagatgcgccggtctgactgcctggaagccgtcggtctgaccggtatagatcactcggtctaaccaccaaaacctgtcgccacctcctgtcgccgctgccggtctgatcaccgttgatccgctggtctgaccgccgcactctcaaaatagatcacaactttattacttctctctgtgtttataaagtgcaacaacagcactcctcatgaaaatctcgactaaactcgaaatcctaacttcttcacaattcgatgctctcaaaagcgataccgggaagcctcacactccctctctatttatacatgaggtaggcagcctaaagtcacgaaccaaactcatactagaagtcctaatccacctaggaaatcttctcgtacaagaaacaaactttacaaacaacaatcataccaaatttggactccttccaaattcgactccgcatcccatacgcagacaatacctccatcgtatgccatatggaatcttcaccaaccacgtgcattgaactgtagcctaagtatcccgcatgatatctgaccatcacggacatcgccttatccccaagtcgactcctgatccatcaccggcaatactctcccgaggcatcaagtcacctacacatgaatcaaaccaagaaaccatattccaagaccaagctatctccaacttgactcattatttgcaaacaacagtattacatatgcatagtatctatctagaagccataaacatggaacaatcacggatatccaaacaaacaacctgaaaccaaaactgacacagagtcggccggtcagaccgcgccatgcacataaatccggtctgaccggcaagcacagcccggtttgaccggtcctgacaaaaacagcaacactgttcatcacctgaaaatcaatcatctccaaaaccaataatctcatatgccaattattcatcacaaaataagaataaaaaatactttgattttacaatctcccccttcatgaacacattggcaaactcatcaaaaatgttttgttgtttgaaaaaataaaaacaaaaatagtaaaaagcacacttcgtacaaaagtacacgtcgtgctcaaaatctaaaagaaaacttctctcacttttgaagagaaagaaattctcccttgtccgaaaaacagaaaaacatgctcttctgaaaaacttctcttctcccccttttaacaatgaattcatcaagcatagaaattatattcattaatatttaagagcttagcatacatatagcacatcaagtcatgtgttgtaataaaaagaagatgaacccatctgtaatatagcaagcatgcattaaagtacaatcatgaatcaaatatattacaaataagatcaattcaacaatcaaaatttaagatttcatacgatttataatgcaacatctttacaagcacataggttgaaaaataaaca

SEQ ID NO: 31000 - DNA, 1501 bp, Oryza sativa
caagcctcgatttatgcttgcagaaagagtgagtgcacattttaggtcccatgaaatacatacacgtacatagctatcagcgtgtcctcgtaatacacattcaaatagcatcaataattcctttcccttactctataggaagcataattccttatatagagtataggttgatgcatatataaacgaatcatagcataccacatgacactaacttgataaaggttgtataatctttagactcaacatctactataaagacgcatatttatggacctcgtggatggactccaccatcatattaatattgtctctccaataggatcgataggtaaaaatgtcattagcattattgtcttctaatgtgaaacaaagtgagcgttctacaaaaatatttgacatcctcgtgttggagttcaaatttacaatctcaatgctttagcctatacaaaatcacctatgtagaattgtaatctcaccgacctgcttgagatgccattggtgttaattttctccttttgtttcttccttctcttcttcttcggtttcttttcttctcttcttttttcatcaccgagggcttcccgagatcacctcacgaatcctttctagtgcaagttttagggtttaggcaaagagtacgacatcccttctcctttgcctttcatctctttatataggcgctggtggggctcgagggttatctccaatttggttaggaattagttctactgttcacaaaactaactctccgtctttaggaatcagatacgtgtgatttatcttccttatctagctggcatttagctgataaaatcaaccaaaacctggtattgatagttatagtgagacaaacctctaatcctcaactattcaggatttacgttcacccgtggcacattagggttacatggtacaccaagaagcaacacatttagaatccataaactttttggcgtagaataatccgtgcatttttcatctttagttaacgtctgtttagttacgagtagaagagttaaaccagaccatgacatcgctcaaaagaaaaaaaacaagaaaagaaagaaagaccacgacagtttgacgagctagcagcgagagagagtttgttgggggccgtttgctgtggatcgttcaccagtcaccacacgaaacgatcgaagcagaggctgaggctgaggagagcagccgaaggaaggaagcccaaccgcgtggacggatagaaagaaggcgtgacccacaagccgccgctacttgcctccctcgtctcacgtatatccccttcccccgaatatccgccacgtggacggccctcgcctctctccgaccaccttaaccaatcaccacacagcagttaacccctctcctccccttcctcttctcccccctccctctcctcgtcgtctccaccaccaccatctccgtctccactcgatcgatcgatcgatctccataggtgggggaagggaagctttggaaggtggagggacggaggggggga

SEQ ID NO: 31001 - DNA, 248 bp, Oryza sativa
attagcttgttaatcgataccagtcccaggaaatagtgctggtatcacaggaagacagaatatcacagcaacagaggtctctttattatagagtagaggtacagtcatgttgggctgcggacagatcccgagctcacaactgcattacaaaagggaaacggaagccaggacttggaccaatcaacacagacgcgacttgggaactaggccgaaaccctaaaactcatcgtagctggcttgctcctaga

SEQ ID NO: 31002 - DNA, 588 bp, Oryza sativa
ggctagcgctcggcggtcgcggccaaagcggcaacagggaggagggaggtggatgacgccggcgggagggaaaaaggggaaaagaggaagagaaaagggggcttgtccccttgcctcttcgggaaaaggaggagggagagggggcgtcgcggcagagggaggagggaggctctgcctccgtcccttggaggctagcgcgggagtggtggggccgaggcgatgacaacggcgatgacggcggggcggtttggagcggcgcgacgtcacgggcgacaggcgcgggctggcgcggcagagggtgacggcggcggcgaccatgcggtcggccactcggcacgcgcgcgtgggaaacaatgggcggcgcggctgggcacgcgcgctggctcgcggggccgagcggctgcaggcgcggcagagcagcggggccgggcgacgcggacggcgcagacgacacggctcgggcggggaaccacgcgggcgcgcgcgcgaacgacggcgcgcgggggccgtcttcgcgagcgggaagctcgccagggagaggagaaggagagcgaggggaaggggcgctcggcgcggcgcttgcgcatg

SEQ ID NO: 31003 - DNA, 169 bp, Oryza sativa
gcgcgatttcgccgtgtcggagagcgatctcgcgattcgctcgatctctccctgccaccgtccgaagcttcgctggcgcccccgcgcacgcagcctcccaccacctgcacacctcccaccccacctgcacacgcgggcgttcggcagcttgtcatgcgtgcctactagc

SEQ ID NO: 31004 - DNA, 1501 bp, Oryza sativa
gttcaaagttccagacttctccaaattttcaggacaagatggtgtgtcaacttatgagcacattagccgatttttagcttagtgtggtgaagcatcggctgtggacgctctgagggttaggttgttccagttatctttgtctagatcggctttttcttggttttcctctttgtcgtatgggtcgatcaatagttgggccgatttggagaagcaattccacagctatttctacagtggggttcatgagatgaaattatctgacttgacggtgattaagcagtggcatgatgaacctgtgcacgagtatattcagagattcagggagatgaggaacaaatgcttcagcttgagtttaactgacgcccagttagccgatctggcctttcagggtatgattgctccgattaaggagaaattctcgtctgaagactttgatagcttgtcatatctgatacagaaggtaaccttgcacgagcataggtctgtggaagctaggaaaagctctaagaaggttaatcatgtttgtccttacatatatgggtcggatgatgatgatgaggatgactctgaaatagctgcagccgaatgggtgaggagtaaaaaggtcatatcgtgccaatgggtaaagagttctggaaaagaagagagatatgactttgacataaccaaggccgataagatttttgacttgttacttcgagagaagcagattcaatttcctcccgatcacataattccatcggctgaagaattgggcaagaaaaggtattgcaagtggcacaactctgggtctcatatgactaatgattgcaaggtcttcaggcagcaaatccaagaggctattgaagagggcaaaattaagtttgacgactctaagaggccgatgaaggttgatggcaatccttttcctgttaatatggtgcatacagctggccaaacagccgataggggccgtgtaaggggttttcagatgaattcggctaagattatcaacaaatatcagaggaagtatgacaagcagtagggaagcattataaagcagacgatgatggctttgatcctcattggagttgcgagttttttagattttgttggaatgaaagtatgaggctgccttctattgaagactgtcctgggtgcagtgatattgccgagaattcaagccgatcatatggtaggggtagtcggctaaggcagacaagagttcctgttcatcaaagattgggtccagtgaatcaagatcatgaccaagaggacaatgaaatcaggaaaaatcagtggtgtccttctggtattttcatgaagaatcagaaaagaagggttcaaagattgaggaacagggagcgctttcaggaggttgaacaagaaacaggaaattaaccatcggctgaagaaaccaaagccgaggtaggagtggcgtgttaataatcaggttcctgcagccgatgaggccgcagccgatgaggcaaaaaggttagctaagggaaaagtgtcgtaactg

SEQ ID NO: 31005 - DNA, 1501 bp, Oryza sativa
tgcctgctgcagaacactgatggctcaccgaacgtgatcaagggaagcagagccttcgggcagaaaatgctgctcgccaccaacaacaagctcgctagcaacgccaggcaactgctaagggagtagcccgttggtaacgatcaaatttggtaatatctgtatcggagatgaagattagattgaagcggggtcgaagatgaagattgtcgcggaaacagagtaagaatcggctgaagtccggatcggctacgattggatcggctaagttagagtcagacttggttaggtgatacagccgattccaacaatacgacttggtgtacgacatcgggttgagttgaggtgcttcaagatgattgccacgcatggatagagtcctgggaaggcaattgtatctattaattaggacattttatgtaattttctcagagatatgcttaggcaaaagtctgtcgtaaagacttgtggtatcttagagtttgttagagataatagtcgtgtccggtatggacatatcttgtaattctcgggtataaatagactccgagccctatgtaattaaacacacaatgttcaatacaatttcggcgcatcgccacctttttgctttagttttatttcgacgagttcttacttttgggttgagctgcatcggttttgatcttcaacaagaggtaaaacttgttatgatggcttgtgttatcgggattagtgcttccatctttatgatactctaatcttgtttacgtaattcgtcgagttatcatatatcgtacataatctctggcaatatcattatctaacctacaatcggctaacatctgttagtagagggcagccgattaggttagattttgatgttgatttagattatataagatatccaccactctatgaaacttccaacggcttgattgtctagatattgttcttcttttcatacttaatgctgcatcagttgagtttgatctattaagtcgtgcttagaatatcaatctctagcctgccttctggttgccgattagggtagtatcggagtttcagccgatcttatctgatttaaccatattcgctctatatgcttaagtgacatgttaaatccgccctttctgtcaagatcttattgcatttaagtatattaagcttttgtttgatatattatacttgttttaatatcctgatatagagtagtatcggagtattagccaatacatgctagatctatatgatcggctatgctataaacatatatagtcctgttattaatatatatttcgatccaagtgatttttactatcttggcatggcgaccgatctatcccaatcacttgatttaaatatatatcgatataagaactatatattggtaatatctacagccgatcgagtaggtttagttctttattatctatttatactcgccgatcgattcacatataacatcgactcaaagataaatgatatgtcatcggcacttagccgatcagcaatcatttataga

SEQ ID NO: 31006 - DNA, 1501 bp, Oryza sativa
tgatgcatttccatcctgattaaaatttcctccctgcaacccctgagccatcactttgaactccatgcgccccatcaccttgaaccccatggactacctgagaattgtcaccttgacctcctagagaaccgtctgtagcacctttgtcactcggttgagctgagccgtccggagcttgtttcccgtgttcacctttagaagaactggtcccaggatcatcggcaactacctttactttatacttctgaaccaatgttcccttgcgagtctgcatgaatgagttcaagaactgatcccgtgcctgctgcatcatcgcgtcgaaatctttcttctgatcaggtgtgaatttttctggttcaatgggcacgacgtttccttcattgacgtccgtcaatcccaacttctggatcttttccttaacagtgcctggactagcctgggatggcgacagcggtggtttctcaaccatgaggaagaattgcttgctgacttcttatctgtcccactgggcgtgccaaatgcgtgttgacgtaaaacacgaggcctgggagatctgcttaactccattgcaggtccaaagctcaccttcaggtgtgttagcgtgccagttgatttgatcctgcaatcaacaagaaatagaaacaaagagatcgcagttaaatctataaatgattgctgatcggctaagtgccgatgacatatcatttatctttgagtcgatgttatatgtgaatcgatcggcgagtataaatagataataaagaactaaacctactcgatcggctgtagatattaccaatatatagttcttatatcgatatatatttaaatcaagtgattgggatagatcggtcgccatgccaagatagtaaaaatcacttggatcgaaatatatattaataacaggactatatatgtttatagcatagccgatcatatagatctagcatgtattggctaatactccgatactactctatatcaggatattaaaacaagtataatatatcaaacaaaagcttaatatacttaaatgcaataagatcttgacagaaagggcggatttaacatgtcacttaagcatatagagcgaatatggttaaatcagataagatcggctgaaactccgatactaccctaatcggcaaccagaaggcaggctagagattgatattctaagcacgacttaatagatcaaactcaactgatgcagcattaagtatgaaaagaagaacaatatctagacaatcaagccgttggaagtttcatagagtggtggatatcttatataatctaaatcaacatcaaaatctaacctaatcggctgccctctactaacagatgttagccgattgtaggttagataatgatattgccagagattatgtacgatatatgataactcgacgaattacgtaaacaagattagagtatcataaagatggaagcactaatcccgataacacaagccatcataacaagttttacctcttgttgaaga

SEQ ID NO: 31007 - DNA, 183 bp, Oryza sativa
ttttttattttttgctgactaggatgcaacaccagtaaaaccgggcaaaaatactgccatgggaccttgtttgaacggtttgagtgagtttaggggtacatatttctggttttgtggttaggggaccttaaaaaatctcgctgttaagttgagggaccttcgatgaactttttccttttaaga

SEQ ID NO: 31008 - DNA, 1501 bp, Oryza sativa
agcatgtcatgtacttgccatttcttctgttgatggtacatttttcagtgtcatttaacattcaagtacttccaaattgattccttcctagcttctgaacatacaagactcagagctcatatttccaatttgtttgtataatcaatatttttcagcaccatggatgcatatttagtgttttctgcactccaatatgtaaataaactatatggtgttagatattacgatggtgtttaatatagagcacatgttaataagcaattgtgaggtgggcttatctatgcatattttattaagaatctgttacatggttgccggtgtgctgtatagttcctttattttgatctatatttgtacctaaatggtgcatctggaagtattgtaaatatgagttggattactggcggtgagttggatgtaaatatgttaatatatttgatgttcggcattaattgattttgctcacatgcacagcacagaccatataaaaataaatttttgctaacatgaaattttaaaaattattaaaagcaaatataattacaccgtagcgtttagcacggacatattactagtataagtggtgtaagcaatcatgctccctaatatagcaactagctcgttatatgggatacaccgtacgacatgacttcaagaatgtgattgcttacaccactcatatgaatatgatgttttacatatacatattcccaaagagacaaacttacaaacttttgtatttagaaatcatgaattaattatatttcatcaacattaaaaaatcataatctttaactttaggattaaaaattcatcactgttaaataatattagatgatacttcactgtcatttgatattagatgttatattttctttacagatcacaaaccaaggttaaacgtaaaggattgcatgggttgtgaagtagatttcttcgtttaaaaaattaatggaatgaagtttaaattacaaacatgcaattaatctggagtgcttcggtagggaagtgtgctcaatggatgaggcaattaatctggagggggaacttggggagggaagtgtgtttcaattacagttaatttagttgtgagcaagtaggtgtaaattttgattttatcttctagtgaagcataaggtgacaatatatttggaaaaatgtagctttaggtgataagttttaattattctattatggaatattagtgattatcatttgttggagggataggttcagggccatattactcacccccggatgcacaaagctctagaaatcgtgacaaagctttggacaaagtatataacagagacacaacattccttttacttatattttgtatgttctattgaactacttaggcttgctttagtttccaactttttcttcaaactttcaacttttccatcacatcaaaactttcctacacacaaacttccaacttttccgtcacatcattccaattttaatcaaacttcaaattttgacgtaaactaaacac

SEQ ID NO: 31009 - DNA, 1501 bp, Oryza sativa
tacataacaattatgtttctatgtgaaagaaactaaatactacctccgtttttaatagatgacgccgttaactttttctcacatgtttgaccatttgtcttattcagaaaaattacgtaattataatttattttgttatgagttgttttatcactcatagtactttaagtgtgatttatatcttatacatttgcataaaatatttgaataagacgaatggtaaaacatgtgagaaaaagtcaacggtgtcatctattaaaaaacggagggagtatgtatttggtcattttggtaactgttcgcttaacttgcatggcatgttgactaaaccagaattggcaactggaggggacagttgcagttcagtgcctgacttggctggctgtagctaggtacaagtattcatagtcaactaataaacggaatacatctcctcatgctaattgcaggtccttttcatgaaagaacttactcaagaacgaaatgaaatcaatctgcatatagtcagtagcaactaaatttacattttctgtatgtaattaatcatatattgtttgatggggaaacttagtgtaggattcatgggcaatggctgagttcgacaatatgagggacttataataggtgtctccccaagatgaaaactgagcaaaattttgtagtgcttctgtaattaaaaatgccaactgatctattgattattttttaaaaaaaaaactttcctattgattaattagtggatatattaccttactaacattctctttacctttattatttttgacataatcaatgagaagatatgtcttgacataatcagaaggggctgagatttcatgagcaaacaattagataatattttctcagcccacgttttgtcctattcccatgcttcactgcttgctccactccttttatgacttggcaggtaccatctcatgaggttcgtggtggttttcaattctatttatgtacaggtgatcactttctgagcaataaacatcatgattttcctccgtcaatgttcatgttacttgctgttggtattgctaactagactctgtttaatagaaatttcttctgttgtttagctacctttggtagggttatttcacttctgaaatttattcatttatttaccctatatttgctatttagacaaaatagcatgatctctcttttgtgtcacaagtaatatcccagccgtcaaggtctttgatctgttagtaatccacgtcatggcctatattacatggccacggatcctatgaggtgggctgtattacattgccacacatcctatattacattgccactggcaatgcagcttaacgggatatgggaattaatctgggaatttcactgtaatttacgcatctctgcatgtggatttactgttatgaaagatgcttgtgattttctatactgattcgtttagttgtttctcatatacaagggatagggtgattggggagctgaagctgtgtcaccttctctccag

SEQ ID NO: 31010 - DNA, 1501 bp, Oryza sativa
cacgatcaaaatatatacttcatttgttttcaaatagctaacactgggcacaaattttaaaactgacaactcagtctttttgttacaaaaggaattacaaatacttaaaggaataacagatcatagtatattgtatgtcttaaatataagcattatggagttagtactatcactgtgacttcagagttttttttttttttatagaactgacttcagagttgacatgagaaaaacctgacatcgtccggcgacgatggcatcaggcaatatcggcacacggcaggtttgattcgctcatcagatttcggtgcgtaccaatctgtaccatgcatacgcgttagctaggtttgcggcgtttttactcatcatcgcggtagctagctgcatatgatgcatctttggccatatctgaggtgaacagtggggatgaagctgtaccaaagcaccatgatctggctgcataaaacacatttgaatctctacactgtagtcttccgtgaggcaattaattaggtgctggagaataacgcataattaatcaaggaatgaaaaatggtgagaaaaatggcacatgtattgctggtacatcgttggcacttggcagttaggcttaagactgagttcttttcatcaacttcaaacgataacttctttgtttttcgttagcatgttttcgaacctattaaacgcataattaataaaggactgaaaaatggtgagaaacaatgttattgttactggtactagtacatcgtttgcagtggcctgtcgagtcaatttcttttgaggcaaccaagacgaaagcatcagctaaccgagtgaaaaataggcccaagacgagcacgctgaggcctatctcaaagttggtccggccgagcaagcccactgcaactctagaaatacgggccacataactaacttgcaaattttgggctgaatactgggcttccaagaggcggaatcctatttgggccggatatctgcgaacgctaaatgggccgccaaaagagccctctactattcaatgggcgggcccacgaagaaaaggttgggcccactacggaacggaagcctagggccagccggcagccgtcggatcaagatggacggcttctgtgcctcgaccagccctctcgccctcgtcgccggctgcctccgccgccgcacgccgccgccgccacctcatcgctggcccgcgccgcgccgccgcctgatgggattccgcgcgtctatatcccacgtccctcttgctgcttctcttccactcgcctccgtcgcggtgagcgagcgagcgcgagcggcgatggaggagacgaggaggaggggtggtcgaatgtgagaggcgaatccacgtcttgccgctgagaaggcggcgggagggagcaacgtcgtgagacccaccacgcggtcgctgacgggtgggcccaaccacccggccgccgccactcccgcgcccttatcatctatctgcctcgtcttctccgccccctcaagctgttcg

SEQ ID NO: 31011 - DNA, 1501 bp, Oryza sativa
ttacaacccactaaatctaaaactcgacatgcaatcatgccacaatcaattattacatatcaaagctcatgtaagcatgaacatcatctacaatctactgaattctacaaattaacaagcaagcatatcttatcatcaccactcatatcatttccacaatatttcaaagtatctatttatcatttttataatacttaaaacatatatctatcaatatattcagcatcaaagcacaatatcatttgtttgtttcatgattagtatcgtaaactctgacgtttcattattttttgcattctgcttcttgcaatacaaatcttgatcaacaatctaatattttatctattgaatttatttctctccaaatatatattagtaaaccagtttaatttgttgttaataactaatatcctttttactcctaactcgattgttgaaaaaatatattgaagattgcttcgtaattcccacagcaaagcgcgtgtggaaacacataattaaacaaaaagttgtatccacttgagccgtaggctacaacagacagatagtaaagtctctacatcaaagagcgtctaaaggtatgcatggtccatactcattttatttcaaattgtttatcattctagtaaattttatagcaaataaagagctatggcaaattacattattccccttatttatcagagtacattccaatcatttttcaaagtagtcattaactctgattactaattgtggctgcatatatagggtagggagggaagatcacatttaaagccttgggacatgagagtgactattttagttaaaaaaaatgaattgctaataatatgaaatggagggagtaattgaatatgccttttgggctgccatctgcccattgggctgtgaccatccggtttgagcccattttactgacctgtctccctgggctttgttgcgcgagcacgagccatggccgacgtgggtgggagagctcgagctccgaagatggcaacaatggcggccggcgtcgcactgcacctgcacctacaaggtgacgcggccggccgccggataagcggcgaagctgcccaagttcttctccttgggctgcttctgcttctactggtgagttcagagttcagactccaacttgggtcagatctcgtttccatgactcccatgtacccatgtattctgaatttctgatcctagctcaaaattgtttttttctctttttgtcatttcctgttttgatgaaacatgcgcatcattcaagtattataaatttataattggtgccagccgcaaatttgcggaggttggtacgaataggattgtttttttgtcctcatgtatttgtacttttgtagtcctgttgaatccactagagactgctgcttattgctgaactgccacatattgctgctaggaactcacaaattttcaggagttctactcgataaacttatcagcacattgcacatccagctttgcctctgagtgcttccagggatga

SEQ ID NO: 31012 - DNA, 1501 bp, Oryza sativa
cggttacatttgacaaatttatcagttgttgagaaatggcgaagcagacaagtaccttcagaaagcaattggtacacatcatcactcaaatccatcttccagaggcccaaatcagaaataccgcttgatgcatcctacacagacaatcaccaatcacaactgaaccactcaactgcatcgtagcaaccatcccaaaaaagtaaaatattcgaaaatatgatttttgtctcgaactacaggcagtatgaggatatgacaaaaggctctccaactacatctggctgacagagtcgcgcgtaacctgaacaaattaagcaataatcgaagcacacgccacggttgtcgacgatcccctcacactccaagctatcaccagttcaccacgagcccaagaggcaagcactgaaaaatccttacccctctttccccgagggccgcaccgccatcttcccctccggcgaaagctcgaagaactagtcgccatccccgaacgaacacaccctagtacataccataaccctacccagcaaaaacgcatacaaaatcaaattaaacggggacttcgcgagctggaacgcgagggaagaggagcaggatacttatctacctgcctccggtcggattccgctgcggcgcggagccggctgccggagggcgcctccccggcgtccccgccatctccggcttcgccgccgcccgacggcgacgcgcgcctctttttttcttcttttttgagcccgcgcgtctcttgctctatttcggtgtttcaaatgggccgagataggtgggccttaatgggcctgaatcaaatgcgaactatactgtaatattgtcgatttgggccgaaaattatccatccagtacagtcacctgacaagtaggccctacgcgccgcacttgtctcgcgctgctgtttttttccccctcctcggcggcgattccactgcctcgccgtcgccggagttggagaagaaggcggcggcggcggcggcgcagaaaggtgaggcctctcgaccgaatccctttccccttcccgtcttccgccccgcgcagtcagcagcaacagacgaaggaatgcggtgcgaatgcttgcgagtagagaaatcgatttctggctgccgttcatctgcgcgttttgttgcgcgcgcgcgcgcgcgagggagggagggagatccagtaaatggcgccttgtcccgttgcttgctcgatcctcctgccggccgtgggggtttttgcccccgattggttccgataatttgtcccgtgttgtagatggtgaatcggtgatgaccaagggttaccttagatgataggaaatgattaggagtagcgtatttcctcgtgattactggagctgatacaatgcaggatatttttagcgctgatttgtaacatggcaggattaatataccattgttgtgctgttgatcacaccatatttcccttatgcagggtattttgtattagggatataggcaatgcaaaactgcaagctgcaaag

SEQ ID NO: 31013 - DNA, 1501 bp, Oryza sativa
acatcaaaatagcaaaattcttaatgacagtacctatctcactaatttatctctcgatacaactggagagaaggtgacacagcttcagctccccaatcaccctatcccttgtatatgagaaacaactaaacgaatcagtatagaaaatcacaagcatctttcataacagtaaatccacatgcagagatgcgtaaattacagtgaaattcccagattaattcccatatcccgttaagctgcattgccagtggcaatgtaatataggatgtgtggcaatgtaatacagcccacctcataggatccgtggccatgtaatataggccatgacgtggattactaacagatcaaagaccttgacggctgggatattacttgtgacacaaaagagagatcatgctattttgtctaaatagcaaatatagggtaaataaatgaataaatttcagaagtgaaataaccctaccaaaggtagctaaacaacagaagaaatttctattaaacagagtctagttagcaataccaacagcaagtaacatgaacattgacggaggaaaatcatgatgtttattgctcagaaagtgatcacctgtacataaatagaattgaaaaccaccacgaacctcatgagatggtacctgccaagtcataaaaggagtggagcaagcagtgaagcatgggaataggacaaaacgtgggctgagaaaatattatctaattgtttgctcatgaaatctcagccccttctgattatgtcaagacatatcttctcattgattatgtcaaaaataataaaggtaaagagaatgttagtaaggtaatatatccactaattaatcaataggaaagttttttttttaaaaaataatcaatagatcagttggcatttttaattacagaagcactacaaaattttgctcagttttcatcttggggagacacctattataagtccctcatattgtcgaactcagccattgcccatgaatcctacactaagtttccccatcaaacaatatatgattaattacatacagaaaatgtaaatttagttgctactgactatatgcagattgatttcatttcgttcttgagtaagttctttcatgaaaaggacctgcaattagcatgaggagatgtattccgtttattagttgactatgaatacttgtacctagctacagccagccaagtcaggcactgaactgcaactgtcccctccagttgccaattctggtttagtcaacatgccatgcaagttaagcgaacagttaccaaaatgaccaaatacatactccctccgttttttaatagatgacaccgttgactttttctcacatgttttaccattcgtcttattcaaatattttatgcaaatgtataagatataaatcacacttaaagtactatgagtgataaaacaactcataacaaaataaattataattacgtaatttttctgaataagacaaatggtcaaacatgtgagaaaaagttaacggcg

SEQ ID NO: 31014 - DNA, 1501 bp, Oryza sativa
agtgaggtaatctctccttcaaagaaagaaaatacttatacctactatccatacaaccaaccaaacaaagtctctttcaagccgtatctttggtgcaagcagccaagcagaatctcacgctaacctggctaaaccaatacaaccaaccaaacggttgcatatgtatctacctagccaggccaaactcagccttgatggaagagatgggccaagctaaaacaatgcaagcaaccaaacacaccctgattctgagaagccaacttctgagaatctgaaaaagatatgttttccagtttttgacttctagtttacaactacagctttagaatctagaaaaaacttagactgtttggggagcttctgatttctaagagaagctgcaacagttagaaactcccctaaactggtccatagttttcagtggtcaaaagtgagattatacatgaggttaaacaaataatatactattcattaatacttggagagaacaaggagaggagaaaactaggggaatgagagagtattattagttcgatggttaaaaaaataaataaaaagatgaaatagtaaatagtattaaggaagaaaaatattttttgtgagctaaaattttaaactataattagattttcttttggacaaggagattagagattaatgtttgggaaagactctgctggtatctctcatttacggaggaattgagggtgattggataagataaaaagaaagataatcaaatagacaaataatactactctctatttaagatataatagtacatagaaaaatagggttaggggagtataaaaaaatcttaacatttgtgaataaacataacacacactaggaaaaatgttttactatattagtagacaaagtggataagcctcaggagatatacttgatagtccagtgataaaaagactgtggtttcaaccttaagaatcctcaacacgattataatttctttttaaaaaatatttgaaggggcgtttctctctatatattttttttattttttagcgtaaagccgtaaaacctcaggctgcgagctatgggcaggctcaactgaaggcatggccaggaaccagggtcaaaggagcaacaagtcatgtccggtgggccccacccggccccaaccccgggggacaagtcaatgagtgcccccgctccctccgaacaggaaaagctgctcatcatttgcgctgcgacgctgacgcgtgcgcccattccacgcaaaagaatactcgcagcccatgcatgcacaatactactactactagtattttctttgacttttcctgcaccccacaaaatatcgcttttgatctaatctcctccttaattaccccctctaatcaagctcccctgtctcccccacgctttaaaagcttcctcctcctcctcgccaaccaccaccctcagtccctcacctccatttccatcaagcccaagaacgaactcaccacgctagtgttgagaagtggagagagttgag

SEQ ID NO: 31015 - DNA, 1501 bp, Oryza sativa
tagggtttcatttgcataaacagcatttaataaacatttcagaatttaataaaatagttaagtagtaatttaaacaatattaatccaacgctatacaacataccctgttgcataggcccaaccattctgtacaaccaatcctggctgcacagttctatctccaaaccaggaatataccattccaaaccaggagctaaacaaattattaccagttatagcatcttttattatggtgagaagtgtgagactaatcacgaaagacattgttagacccgcccataaccgcgggcacggctattcgaatagttttactctggccagaggtgtaccactgtacccacaagacacagccccacaacatgtcaccatgtgccttaataccaccacggtacctcggaaaggagctgtgacagtacccctcacacaacacaatccaccacagtgcaccattcctagatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgaccatcaaaaccatgtgctcacaacccaccattatcaagttttagttggcaatttaattaattaaccaatcatgattaaccatcatgagctaccattaaatatccatcattaagtaatagtgaaacattagttatcccaattgtgtgctaatgtttctaagcatggctaagtaattatatctaatatctagctgaaccaatatataaagctcaactagtcaagttataataatccaaggtatcaaggaataaagtaatcaagaacaaaaggactataataaacaataggttaattccacccaatgacattcgagaataaatgcaatagttgaatagaaacaatagctttaaacgggatcaacatgttcaaagggttatttgggatctgtgtgacttgccttgctgcccttggaactcttcaaattcttctcctgcgaaaacgaactctccggaaacgtcggaacctaaacaaaaaagagcaaaaacaccaaaacagcacataaacaagcatgaacagtacatgtggatatttttaacatgtagatctcaattttagaaaaatttagagacttgaaccaactaaatccgagctaagatgaattagttatgaatttttaaagattaaatcggattaaaacacttatgtggattttaattgaattatgacgcaataatgaattatttttgaaaaggaaaaaggggtttattgcgtcagcggctagggtttgcggtggaccgggtgcacggcggcggctcacggaaacgaacggccgagatcgatcctaaccaaaacgaacggccgagatcgaccggtccacggctggaccacgacggacggcaacga

SEQ ID NO: 31016 - DNA, 1501 bp, Oryza sativa
tttaataggacaatggatttttttttatcaggagcattcattaaaagaatgttgtgaacattggtagttctatttttatatgaatgctcctcatttttatgactttttttaaaaaaataaatatgtattttttatttcattatctaacaatattttttgggataaataatgcatcgaacaacaaactcataactataatagtctcatgcgagaagcttttatatttttaataatgtaactcatgaatttctttgttcatccaagagtaaaatggtcatttttatggaaaatagacggtcaactaacggtcaactgacgggaggggtatggaagagatcaaaatcaaattttaggggtatacaaggaagtaagcaaaattcaggggtatagaagggattaggtaaaatttgaggggtatacaagggattttctcttaggaaaatgatgcatatatgtgctatgatcatacaagttctaatgtttattcttataaatctaagacgaatatggacaatccgttgataaaaggtagtgtggcccaaatcatcatacttttagagagttcaaggggtatacaatagatgtttctataaagtgcataactgttccataggtaatatgagcgtggcactttctaggccaataaattcaactgctgctgctaggaaaggtcataatatttctagttctatacatattatgcaacccctgtgctacacgcgtagtccaaaaagggttgcataatatctacataagttggagaaacaagatatggggtgaggctctcttctcattcattcccataggaccaagtgtacaataagtagctccccttctccttatatagccgtatttcatatatggaaaatttagatgtgggcccaataaatgtatatgtgctgggccatcaagggcccaagcccataagtttcctaataaaatggcatgaggcccttcgaccaaatctgccgaaacccgtggcgaagtctatggagcaagaacggcgtgaggcgaagagtcgtacgagtgccttgccaggccagaggcgtctcaggcgaaggatgcaaggcgaagactatctgccgaaggaagacgacttcgccatggctagttcgcccccgcgagggccgaagaagcctttccggcccatcaagcctaggggctatagggccggcgatcgccagacggcccatcagaggcctatgagcccctataacattatgtacccctgtaaatgtccctttcgtaagggtaattatgtaaattcccctgtataacctaaaccctagtagtaagaactcgtaatggggctataaatagtcccctagggccatgtaatgggggggagaaaaagaaagaaattcaagattcaacacacttcgtttccttccaaccactgttgagtaaccacatctttcgacgtatgcagttgtcatttcgacaacagctggcgccgaccgtggggacctccgagtgaaaccactgagagcgaatgccaccg

SEQ ID NO: 31017 - DNA, 1501 bp, Oryza sativa
gccgcgcttagggccgtcggatcaagacggatggcctgcgatgctccacgtagtcgaccagccatcctccgccctcgtcgccgtttccgccaccgttcccggcgagctccgccgcctccttcgccgacgatctggtcttccatggccagcaagggaaattctgtagatctcaggatctctcaaccccccctcgaattcgtccaacccgagtggaaccgctcgctgagaggagagatcaagaggttggtggtggtgctctgctcggcggcgatggtatcctcctcctccccaacctgcttggtccacgccgcctccgatcgattccgcggagatatctatgggctttcctctcgcctccccgcgccgccacggcagcgcacactaggtcatcaacgggcggatcgctgggcgggatcagccgcccccatcgatctcgccatggcggcgaggcgagtcgtcagcaccctcactacgctgcgctgcgccacccacttctcgtctgacgaatctgccgtcatcggttgggattgggatttggtagtgcgattgttggtgttcgtttatgttcagggtgtgccatttcttcagtccttcgatacatggaagttcatgtgtgccaatgaatgtactgttaacagttttgctgcaggtccaatacatgttctctaccacgatgccgcaattcgtgtggatggtgattaagggcaatgctgaattgctgatgcatttcttgtttgaatttcagaaggcgattggagccggtgatcatttgcttggggttttacgtgaataagatgggccaatgtgctttggataacgcccttcagactcagactcttcagtggtaaggacattggttcaaacctatctaatgttttgtaattgatagaactgtccggtttgacaatagatttcaagcattagctcaaatatttatatttctgtagatttctgtagattacattgatctagctggctaatgatttgctcttgcatttcttgtccttgtttgcaacttgcatcctgattattaatttgtccttggtgaagtcttaagtgatgatcgtactgttaaaagtcaaaaactatatgctcatggatcttcccgactgtgccaccactccacggtagtggcacaaaaacacgagttatcatcaatcaaaacacctagtgcaactgagttagtctgcaaagccatgcgcatacatgtgttcctttggtttgatgaagtaatggagtaatcgaagtgttgaatgtgatgaacatctctctgtttaggtctcttgtcagaatgaagatctgttttttccccagcaaaccaacacctaaatggtgctgtgtgccaactgccgtaaggctcatccagtgctcgtcttttttgttacacacactatttcatggtcaacaaaaaccacaacaacaaccagctctcttgcagacgttgttcccagagaagattattttggctcttcttctacataggagtagtacgttgcaggct

SEQ ID NO: 31018 - DNA, 1501 bp, Oryza sativa
tatcttgcttctgttaatcatttccaatgtgatggcactaaggttttggagcaagataactcatttgatgaactcaattggttcgcttccacaaaagcaaaattggaaggagaggcaaaggacagggacgacaagaaaaccgatagaaacacgagcggagctagctttgtcagtctgaaactctggcgctcaagtccacctgttaggacagagcagcaaaaggtgcttgatttatcgtttatttctgatgatacgttcatatcacgttgcatcctccataggaattgcatggctgatctcttctcctgaacttgcctaatttgcctgacagggtggtgttgacaaggggacgcgctacatgcaggaaattgagcttatagaatgtctattcaggcttgctagaacagtattgagatgaaattacctgatggcacaacacttctattttgttgcctaatgtactttgcataggtcgttgagtattttttgcatgaaacctaacaaagaattcagagaagaactactgaatcatctgaccttagtgtagttgacaaacatctggccttgctatatttattgagttttaacttagttcagtcctgacaaaaaaaagaaacatgggagagaactcatgcaatgctggatgcctggatcactggatgtgaaggtgaattgcactgtaataataacctttaaatgttcatggttttctttctcaacatctgaagtgaaaattcagtaaaaacgtactataaatggtggtcacgactcaaaagaaaaacatggttttcatattgttccgttgtcaaatgactgtacatcttatatttgccaacttgtaataaggcattccttttgttccgtatcataaaacactttaactaagtgaaaccaaatttatataaatatatatcaatattttgaaaaggaaacaaacatactattaaaatatatttatactagatttaataaaaatccatttgattgttatacatattattatgttttttctatgtacttatggcatattgaacggatggagtagacgagtagattactgctgcctccagcacgtcctgtattatgcttataatcgattttttttttacattttgaccacataaatttctctctaatgcgaacattcaaatgtgaaatttattttgttttcatcctaaaataaccagcatataactacgaaattcactgttgagaaacgagacaaacgacagcacgcttccttttctgcacctacggtgatcgagcgacgcacgaatctcaacgcgcatcttcgttatccactactgcgtcagtcactccccgcgagctaagctctcctccccatcactccgatggcgctgtccgcggcggcgccggcgaactcctcctgcttccacccgcgcgccggcgccgcagcgcgccctcatctttcaggtcagccgcctcccgctaactcctccccgtttctccgatccccaaacccccaaaaccctaaccctcc

SEQ ID NO: 31019 - DNA, 1501 bp, Oryza sativa
ttttagtttgtgtccgaacacctcatgcgataccctatataataccagatgtgacagacccaaactttacacccctggatcgaaacaccccatatgtcgaggaaatgctaagattgcttcttagaagtgcagtttgtaatttatatctatttaaagtggttctggtgttacatatgaagatctgtcgtacgtctgtatctactcaatataacagctagtcccagctgcaagtatttgtaaagccataacctttcgatgtttacaaaggaaaacactatttttaccaggtgtaaagagtgcagatgcctacatgtacacagcttcgtgaaatccgacacctatgcatgcaattcgatgatccaacctacataatgttcagtccaatgagcttttggagctccggtttttggcttggaaggcgtcaggaaagggaagatcatagtaaagatgaacatcctcactgcatgcctatcagcatctcctattggaaggctggagacggtagtctacattgcaaatagaaggccaggttatgacgcttccaccaactggaacgtaacaatagtcaagaacaccatcattttatagactgatctgttaccagcttgtagtgaaacaagggccaaactcaaaaaacctaatatttgtttgaccgggctcaaaacctagttaatatttagtggttatagatgtgcaagcactattattaatttgtaatagttttgaaaataaatattgtaccttgtatatatattagtatgcacaggttggtatcacaaaagatttagatttgaggataattagttgtatattccattttaattgcctttagacttataatatgttcagttggtatccattgtaatgcatggatttctgatgctaggtatatattgaaaacattattcgaaaaatatgtagcttgtcattcaagcttttatttacactagggtggtagcccacgcatatgcgcgggcatgtgcgtgaaattttattgtgaatgtccatgtgtgggtggttttctataaaaaatattcttttgattcatcataaactaaaaatgaatttatttaacatgctttgtgtaaaatcaaaggtgtttttgattattattctgtaatgaacaattggcattggagattatcggttttgttatttggaatttattctcgaagtggttttgaagataattggatttcacaggtgatatacaggatactgctagatttgtgtccggtcagaccgggctctggtagccggtcagactgttggtatatgcgcggtcagaccggcgcagtccgcggtctgaccggccgacgctatgtcggtttcgatttcgggttgtttctttggatatccgtgattatttcatgattatgacttctagatggatactatacgtatgtaatactgttgtttgctactaatgagtcaagttggagatagcttcgtctcggaatatggtttcagagatcatacaggatacttaggctagagttga

SEQ ID NO: 31020 - DNA, 1501 bp, Oryza sativa
ccgcctgcagaccaacgacggtgaaaatcatccattttcgcaggcggggcaatggcccgcccgcgaaaatccaatgaaaaaataaaaaaaattgcctcgccgccgcaccgggagtcgccgccaccgccctcccccggcctccggtcggatctgggaggggaggggaggggagccgcccatatcgctgccgccgctctgggagccgccaccgccctcccccggcctccctccggccggatctgggaggggagaggagccgcccacgtcgccgccgccctcccccggtcaccctctagccggatctgggaggggaggccagggagccgccgccgccacaccgggtcgccgccgcgtccgcgcgctctgccgccaccgcgtccgcgcgctccgtcgtcgccgccgcctcgtccgcacgcgctgccaccgccgccgccgccggtggagggagagaggggaagggaggggaggggatggggagctgagaatccagtggagggagggagagagagagttgagaagataagtgtggggaaatgagtggtggggaggggttggaggagtagataagtattaaagttttttttattttttttgggtaggtacgatttttgcaggcggatcacataaggtgcgcctgtgaaaatatattgtctgcctgcgaaaattattttcgcaagcgccgcttaagtggtcaacgaacttcaccccaatttatatttttgtaggcggtcatttgactccaagggttatgtctgtctatgaaaaaaagaccgcacatcgggaaaaattctttttccagtagtgggagtagtataacagtatcaaaatttgagggttggaatgacgctgcatatattctgcacttgtccggcatctagaaagattgttggcacttggcagtgattgtgccacatttttacggtcctttgaagatactataactcattgtctcatgcactcacaagtaccagataaacacatcatctatttgtaaaagtttccaataatgataaatcagataatataatttttattgcattatttttttagtctgcaaattaagtggaagatacttcgataaatcagataaaaatgttgcagtgtgttgcacagttctggtttgttaagaacgattactttacacaattaggctgctttcgggagtgaggggtgggaactctcactacctagcacggaaaacggagcagcgattagcgagtgattttaagtatttgctagaattttttcaaaaatggattaatatgattttttaagcaactttcgtatagaatttttttatagcgggtgattaattaagtatttgctaatttttttaaaaatagattaatataattttttaagcaactttcgtatagaatttttttttacaaaaaacgcaccgtttagcagtttgaaaagtgtgcacgtggaaaacgagggagagaagttgggaacaggaggtaacgaaaggctgcgttcggtataggaagtttccaacccc

SEQ ID NO: 31021 - DNA, 1501 bp, Oryza sativa
ttgtcatcagtgacgggtcgtaagttacaacccgtcagagatgagtcatcagtgacggccaggtagttacgacacgtcactgataactcatctgtgacgggtgacaagttttaacccgtcagagatgacttatataccagtcagagatgggttatctgtgacgggtgtttcacccgtcacaggtaattttgtcatcagtgaccactaatcactgaccaagaccaaacccatcaaaggtaagggtttgggcccgtcagagatgacctagtccagcatagtgactgacatttccatccatctcgatgtaaggttttccttttgtatcctcctacaccactactatttatgtaccacgcttggagcacctttatcagcaatgactagtgtcagcctccagtgagatcaaaatgtttcatatatgtttgttcctgactgccatgcatccaaatatcgaaaggtaaaattcatctgagttttgcagtttatgtgcactacctctgaattccccgttgctgcgcactatggtaccatgaaaattttggattgggcgacattgggagatagctagatgcttggcagtcgtgatcatcgaacaaaaacacaaaggatatcaggtcattctgctccacttgaaacacttgggtttccagaaaattcactgttatcagcttatgaatattggagcacagctctcgtattaactgtaatattgttctcttcatgttcacaccatcggttgcactttagccatcaggaacgtaatggataattgaccaacatacactgtacagtcacatactgaatttaaattacacatgcaccattgaaaattaactctgtttttgtgtcaggaaaataagtatgctgaaattagtatacttttgactgatgttaatatcatgaacgattggtttagtttttttaatgcttatacttagggttatcgatcttaattgttagatgttatcttttccttttaaaaataaaagtatatttaacttccatcctctacacaaactaagaatgcatggtaacaccatatcggtagacacaatgattttatttttacaagaaaagaccatgattaaccatggttaggaggagtatctatctcttatggatacatcttaaggccatgcataaatagatggtgtagctagctataagatgtaaacaatccatggccaaaacaaccgatccctttcactcacgtgtaccgcgtctcttatggtcttcaattctctccagcctcgccctttcctctttgcccttccatctgctagcttctaggactgtctatcttcgaacccaatcctaactatcagtaagaaaaagacagtaataacacactaataaaacaaacatagtatcaccaattacaactttagtttgcattcttgctctgtcttaattctcgcttaggtcatctctgatgcggctacatactaaaaacagctcaatcagaacccccccccaccccccacccacccacctctcactg

SEQ ID NO: 31022 - DNA, 1501 bp, Oryza sativa
atagacgtttctttaaagaaactgaaatctcgcagtgatcgacccacctccctctgcatctacattcatccctggtcatgcagaggtgtctctcaggatgctaaggaagggctatactctttgattatcttagtggcttgggaaattttaaagcactggaatgactgcgcctttaacaatcccacacctagtactactttgttttggatgcagtggcaaaggagaatttattatggtgtgatgccgtaggaagagcttttcacgaattcttgggctggtcgatccccacttaggctatgttcggttaatccctaggagagagggattagagggaatttattccactcctattgtggtgtggaactattcctcctcaatcctctccaatcctctttaatcccctctaaataatcccctctaaaccgaacaaggccttaggagattagctcttatgagagttgttgcccatcacttcggcgacccttttatttttgtgttttctgctctgttgtacatactttctcttctctttaatgaaatgaaatgcatagcatttacattttcaagaaaaaaaaatctatagtcatgcaaacctactaattaatttgcacaatatgttcccatcatagatagaagccccagaaaagaaaagcacttgctgcacacacattggactcaaaactgtagctgtatagttactgttaaaagagtacagtagtattactgaagttagaatgaagctagagatttgtaggtcatgcagttactcttgaagagttactggctactttcaattccttatataatttagcgacactcctagctcttttctatctctctgttctttcgtgcaatgaagattttggtactcaactcgcttgcgaaagaaaacaaatattttattgtcttggcttggaaggcctcaggaaaaggctgatcagatcatgcatattaaagataaacatgctggcaagaagccatgaacgctggagtagaaaatacttaataaagaaaatagcaggaaaccagaaaacacctcctaggcaattccgcaattagctgtgtatgaaagcttgctaagttggaatcatctgtagaataaaaaaaatctgtagaataaagagatttattatattatattggcgaacttgaagaaatgaaaaggatatggtagtagcatatttgtttggggggcgctaatgcgcgcgtaagcgccagcaatttcactggcgtgcgctagctggacccctcctgtgggcctttttcttttattcttttggcgctttttaattttctctattcgcactttttttcgccgttcctttcccatttttcttctaatctttcacacatctctttacaaatgtataatttaaagtttttaattttgacttgaaagttttaaaatttgagttgaatttttttaaattttgagttgacagtttataatttgaattgaatgcttttaaacctgggtcgaaagtttttaaatatggcttga

SEQ ID NO: 31023 - DNA, 1501 bp, Oryza sativa
tttctactaagtagatattggaaaaataaaggttttctaatatgttgaattatttttttactaagtgaaaagatgtaatctttgatgcatgggacgtacatttatttcatagttatgagtcataagctcgtagctctttgagttgaccataactacaatcaaatgtttatcggggtcttagaaaacaagcatattatagccaaatcaataaaagaaaagaagtgcaatagaaagagacctttaaacacgttgaatagtatcaacatagattaaaatatataaaaatattaggatcccttatttttaaggcactttttgtcgtgaaccctcatcaatattcttctgcttttcgatatactactttgatcaaatataattattattgtaccatatttaagttatcgtagggtgtacatattttcgatatatttcatagatgttaagacaaaagtaatccgatcgagaagtgagagtagtccatgtgtgccttggcggctcgatgaggcacaagatgcgaatgctcccgaccgtccccgtcgcgtcgcgcgacgagagccgcccgttcggcgcggccgcaactggttcaggcgttttccgccgccccgcctggattccgacttgctctagcctgactgacgtctgcacaagcgcccacgtgttgcctcccgctgttccctctgcatatgcggcgcaggcgcgcggcgcatccgtgccacgtctgcgcacagccacacatcagagcaagtttaatagtatagccaactactagctccaattcatctatagtcaatctaatagctcattcatacaatagttacatattacactattaatacctggtcccacatgtcatacacacgctgcgtcttagagtccgtgctacagctggctacaaatctgtaacccgctgcccttctctctcctcatttatctccttaaaatatgttttcagctggcttatagcctgctattgtacctgctctcaatggtcaatctctcttcttcctctctcctctcctccttctactgctactgctactgttaatctgtgatgacctgaactacgtacaactgggttaatctcaatcaaaatatatactccctctaaaggttgcaaagcgttttaactttagttaaaattaaactgttttatatttaactaaatttatagataaatatagtaatatttataatactaaattagttccatcaaatcaataattaaatatattttcataataaatttgtcttgagttaaaaatattattttctttaattaaatttaaaacaatttgagtttgatcaaagttgaaacggaggagggagtagtttgcactaatttgacacgaacacttatttcacacgtggattgtgcgtttatgctttgattttgcagtgatatttgatatatccggaagctatggctgctgtggctgtaaacgtcacgcgtgcctaacaatctgctgctttttacccgccaagtatcttgttcctccacgct

SEQ ID NO: 31024 - DNA, 1501 bp, Oryza sativa
tatatatgctaccggatccttttatgtattgtactctgatattggagccttcgtgacattttaacaaaaccatggttttaaaactacggctatacaagccttaaatactttcattttaattcaacacaatgtgcagcggatgcttttttgtgcagcggagtatagtacatattaatttctatgggtcaatatttttttgtcaactgcagggacttgtatagcacatgagggctgaggctcgaattacaagtatactcaaatatgaaatggttgttcggtagttggcctcttaatggaccaactccctagatcgagttattttgtatgttctcaatggatgtaatatacagttactttccgtgtaattcaaacatgttaatatgtgatgcttgataaagatctttaataattatttacatttgtgataactgggcaatcttaaactgatattactattttttattataattaaaaatgatgttaccacttatgtgaacatatattgtttatgtgttactggtggaaaaaatatgtgttcctaggatctatggcaacacatgcttttgcgttacaggtcctaaaaagagatgttactagctgaatgattgtaacacgtttttttatcaataggaattgctatgtgctacaagatcatgttgtagcaacgcatactagtttgtgttactgataatgatgtgttactacagccctatcctgcagtagtgttactatacctccaatcatgcttttttaaatgctccccgataacatctataaagtttgcttgccccaacaatcatcccatgtgattgctgtcattgaagtagaaaccttatcataaatgaaaataaaataattgtacaaatcatacgattttacatggaaattgtaatattatttgggcattccagtgtttttattggatttggctgtcctacttggaaccgtttggacactctttctcttaaatgaatatacataacactggtctgcattacctagtttaccatatattaatatcccattgtttcaaagtgtgctataacgtgcctttgacaatgaaaccagtttcatgttgtcatattttagataacgtgtatggttgcattgtttgccagccctatccacatccataccgaatatatggccacatgaccacgtcattgtaggctaaggtgaagccacacactctgatgcttctagcctttgcatcgtcttttctctgcacgatagtaattaaactcctaggatacaacacttctcactaaattcactcatttctgcttctattgaagcgaccgcatcagcttgggagttatcaggaatatatccttctgcatccgccgctgcagaacagcatatcagtgctgccattaccagtaccggttcgactaaacccgttccaggaaaaccaccagtgcgctgtaaaagcaagcaccggcgctgatgacaccacaccagtcccggttcaataaaaaaacccggtactaagagttcattt

SEQ ID NO: 31025 - DNA, 909 bp, Oryza sativa
cgcggagtgtggaggagcgccggcgcgcagagtgaggagacctccggcgccgcggccgctccgccctaaccctcccaccgccgccggacctcacctgccgccatcgttgctgacatgttggatagagagagaagagatgagagagagaagaggaggggatagagagaagagagataggaaagctaacatgtgggccgaaggctatttttgacatttcacacgatttctctctccaattcaaccataaattattatattaatggttgcgatgtccaccagcaaatatcaaacttttgggagtgttttcccccaaaagtcaattcatgccatatcctgtagcaaatttgtcaaatatttaacggagtcgctaacagggctgatttaaagatcacagcagtgtcaaatttgacttagattgatttggagataacctccatcttgtgggagaatcacaaggtttacgtaacaaacttacgaatgatttacaactcaaagcgacaaaattgggagagctaaggtaaagtagaaaacatggctaaaaagtaaaaagtaaaggtaaaagaacttgattggagtgcaaactattcaattgggtatcaagaacaaaattgaccagttgaccaaggaagtaaacatgcaaactagctgatttggactcggtccgatgttcggaccggccccatatggaaggctcaaattctttccaaatatgaccaaactttgccatattttgttcttgatacccaattttattgttaacactaactttagcgcactaatctgaatagttttatttaaaatatagatgggggcagagaacaaagatgttcactcaataagaacaatcaaacacaacacatattgcatttatagttcaatcacataactgcgattgttattgtttacagt

SEQ ID NO: 31026 - DNA, 1501 bp, Oryza sativa
aaccttaacattggataatggccatgggggctacactagaaatccaaaacaaacagaagaaactcgcgaggtagcgtgaccgagaagggaaaccttggtcttggtctcgacgcggacgtcgagcgactggacgcgggtggagagcgtcccggcgacgaactcgccggcgaacgggttgaagaagtggaggcccggctcggcgaggcggaggaagcggccccacttctccaccaccgcgacgctcgcctggtccacgcacccgcacagcaggaagaaggcgctcaccatggctctcacctcaacctcaacctctcctcgtcggcctcgatcgcggcggcggatttggattttggacgcgacgggtggggaattcggcggcggatttggacgcccctcttcttcgtgttctttttgcccttttgacgaggaaacgaacacgatgatgacgtgtcagtgtccgcgtggacttttaggaaaggtaagcggtttagtgatgtttcacggtgaaaaggggccttatgaggcccattgtagaattttctcgaggggatcacggcccgttttaattttccagcattgggccggtatccgggaggatcgaatgtttcggcctaatacagaaacactgtagctatgtgctcatatcctatatatacttatatagtttaaaaagtcatgaaaaatatcaacggtgaacaatcacccctaaggccccaaaccttgttccacaaacggtagcgccgcttgtggcggagctcctcgacctaatattttaatcgccaagaattgatcacgtctagggccaagcagggctgagttaatgtgttcttaacaaaactctttatatcttcaactttttacaatattttgaataagattttaataggaatttggtcctaagcctagggcccaagccctaattgtcccacccttgtctccgcccctgtctaataccattagttttactatattgaatttatgcagtgatgagaagaatacccatatcaataggcattgagagaggaggaaatggatatttgatatatgtttcacatggtttctcttttctattgaatcagaaaatgaatgctctaatgggtgcggtctttagcagcaaaattctatattttgagaatgtattttcctaaaagttacttcatgtggtgtcttatagctaaaatcgtaaagtccaaatatcctataataaaaattgtcttttcagaatgaaccatttttttaaaaaaaaaacaaagaatgaaccatcttgctataagctactattttaattctaagattcacaaacgtaacatggagcatgcatgagggtgctacatttaaggaaaaagtaaaatactatgatttccttcaaaggagtaaattaaagtgttgcatgttgcttgttgtcagtacaagatcaggcaaaaacagttgttgcagtctgaatatttcagccaggcaacatggctgaaatagcttcattttcatatcaaaagtttaccga

SEQ ID NO: 31027 - DNA, 1104 bp, Oryza sativa
  unsure (1)..(1104): unsure at all n locations
ttaggaaaaaaaatatgaattaacagaaatgtgaatagatggagccaaaaaagaaagggtaaaaggaatgcatttcttttgtactaccttccatgagctattggtctccttatctttgtccggatgcagcaagtccttgagtatacctgtgagaagagcagcaagcgatcgattcgcgcggcatcagcgatcagatgatacagacatagatagacacgaggatcagagaagaggtggggggtgggaggagcgagcttacgatcccggcagatgttgcggaagatcttggggtcgtcgcacggggcgccgaagtccgaccccgacatcgacatccctcccccacgcgtagttgatcccctctacctccactcctctcctccntntcnntntnnccccccccccccccccccccccggtttcctctcacccgatttagctggaatgcacctttgtggaggagggagacggagcgtggggggcctctccgcaggaggaaccggggggccgcgattcccgcggggatcgaagagagggcacgaccgcacgacgccatgggagcacgcggcctgcgctgccgctgccatggtggcggtggcgcagagagagagagagagagagttgctgcttcgtcgcatgcacgtcccgccgctcgcggctgccgttgcacttgcagctataattcgtgacatcacgtcgcactcgtcagttttagttttctttttttttagccaattatcctactactaaaattttgatagtttaggatttaacttagtgcggacaaaaaattgatagcaaaccaaagtaccaaacattcctttgatgctactgttaaagctaaaaaaatggtactactttatccttaaaaaaaagcaaatcctagctacaaacctcaatacacatatataactaggtttgagttttttatagaacagagcagataataggtcgtatagcggattaagttatggagacgacttcttgtgagctagagctacaggatttaagaacccaaatgccacaactttactgcagaatgacgcaaaggattcccggtgtctaaccatcagcatttcagtaactcaccagttttttgcagttgag

SEQ ID NO: 31028 - DNA, 1501 bp, Oryza sativa
agttgattttcagccccgagagatgttcaaacacacaaagaatggccttcatgttttttgcttgttaaaaatcatgttcaagaaatattattgtatcgtcggcatattggagaatggacaaaccatcatccactaagtgtggaattacccctctaatttggccatcggctttggctctttcaataagaatggctaacatatcagccactatgttaaaaagaaatggggacattggatccccttgtctcaagcctttgcatgttcggaaattttttcctacattatcattgactctgacacttacagttcctccttcaacctagttagaaatccaattgcaccacgattgtgagaaccctttcattcgtaatgtctgctgaaggaactgccatttaactttgtcataagcctttatgaagtcaattttgaatatgataccatcgatcttctttgtgtgtaactcatggacagtctcatgcaaaatcaccaccccttccatgatatttatatctggcaaaaacctcgtttgggttgggcgaattactttgtgagcaaccgttgtaatcctattggtgccaacttttgtacaaattttaaagctgacattcagtaggcaaataggcctatattgttgaatttgttttgcatcagccttttttggcagtagcacgatgatcccaaagtttaggcaataaaggggtaatgtccctttatgaaattctctgaatagagccatgagatcattcttaacgatctcccaaaagacctgataaaactctacaggaaagccatttggacctggggaggagttatgatccatttgaaaaattgcctctttgacttccttttatgaaaattcagcagtaaggatgttattttccaagtcagacacttgacgaatatcaccagtccatccctctgtcatggatacatgattatgatctggaggaccaaataaacctttataataattggttatatattctttgagattcccatcacccgttattatagtgtcctcttgttccaaccgactgctacttaagtacttatatcctaaaaatatagatgctttaatatggtatgatggacttccattcttttttacggaaaatggattaaaaatcccggcctctacatccatgattgacttccatgctttttcaatttcgattatgaggtaactagtaagaatgtctgatacttggacacataacctaactagaatctgataaaaaaaatgagttgtgcaagggagaaaggaaagaatatggagaatcacagcatggcataaccttaattaaatcagaacgtcgggaccttgctagagagtgatcaaatcaggatcttgctgtcttgtatgttgcgattattctattgtttataatgttaatcttttgattggttttattcttctcttcagtacttgttaacttagggatattttccccagtaaactaacaataaaataacacttaacgtaccagaattatcctatttt

SEQ ID NO: 31029 - DNA, 1501 bp, Oryza sativa
gttgtttcattcatgtgtaggtgtgtcttgatgcatcgggagagagttgccagtgatggatcgggcgtcaactgagaagaagatatcatctaaacggtcaaagatatcatgtgggataattagattaaagaacaatgcatatgtgtcatggttatggataaggcatatcttctacctcacaacttacggaatatatggatacaacatacctctgtatgtacgatatgtttccgtatatgataagaaaatctacaagagattataaaaataatcctcgcaggcaagtgaataacagagtcccactcggtgaggattaggattgtactatatcgtgttgggttcggtatttacgagttctacttggagataaaggtaattcacggtataaatagcgccaacatcaccaccatagcctacaatccggaggacgtgaagtctactcgctaggagatctcgtcaaaaccatctcgacaaggatctcgctggtaatctcgggatcgccggtcttctattgtaatatgtggtttttccgtatcaatctcatataaactggattagggctattaccttatgatgggcctaaatcaatataatccttgccttcctatgtgcttgatattctatcgtgtagatcatcgtaccaacgtaccccaatatcctattcatccggtctacgggtactccccgtcgacaatatggttgatggagattccatgcttcatacgatgggagattgtgtgcatatgacatgagtcatgaaggagtccaaattttggaatactgaattttgaattgggaagagataagatagtttcttgtacgggaaggcttcctagtggactagaacttcttcaacaagttagatacatagttctagagatacatagttctagactgcttacttatctcggttacaaattgagggggttggggttgcactttctaaacacagatagaaacaataaagttaaatctacttttacaaaattattttacttttatttctattttttaccttattttatcctatttctgtttggtcctatgtacacaattaacctgagaagacaacaatgcaaatgttgcagaaacggctccggatgaccaggcctagagctgactggactatacaggccagcatgcatggtgtcaccagtgcacatgccaatgggggttgctagcgcgcgtgcgcgcgccaggaaaggagctggcgcagcgtccctacgtatttcttttgttaccttttttttcaatctcctattttggtgcatttcctttttttctctttttttttctcaatctcctattttgacgccaccgtttccttttttttgttttcttttcagatatttttaattgttagcatgcatatttttgaatgttttgaattttgttatgaaaattttcaaatttaagtaaaaaaatttgaaatttagggtgaaagtttataaatttgagttaaaagttttcgaacctgagttaagttttctaatcttgactt

SEQ ID NO: 31030 - DNA, 1501 bp, Oryza sativa
cccaaaattacgagaaattgtaagcgtggctctatcctttgatgcgagtgggccgataaggcccgtgaattgtttgggctctttctcgaaatttccagccgattgggccgaaacaagtctcccgtcacggttgccacaggccatccagtttgtccgattgggtcccttttgagttttttttgttcacgtccctcaacctcaaaatcggattcaaagatccaaaaacttatgaaaccattgcaaaatgagtcccttaacggtttggatggcgttttcgtgctacgtgatgcttacgtggtgttgttgtcctggtctttaactgacatggcataggttatcgaaggcccaaagcccatcttgatttttaccaaaaaaagatcaaacgaaattacaaatgcaaagtcaaaatcgttcaaaaaaagaattttcgtttataatggtgctgtttgttgatgtaacagaaagtattgcatttgtttcatttttttttgtccgaactttgtctgaaccaaccttgaaatggacgatcacatgagaatgacctcggttacgtcaatagaataaaagtgaccgaggacgaaagaattgcggttgacctgagcagcatttttgacaaagttttgaccctaagttgttatgttgtttcattggcatctgtcagctttgattcttgcctttgagttgagaatcaacccaatatacatgcatggaacggtacgatcgagtattattagtttattacaataccttctaaatttttattttttctttttatttgaaaaggtaaaaaaacacaagcgctcataccacgcacacactcacacatattttttcaactctgatatcgtttgcttcgtgaagcacggatacagcaacttaattactaaacaaacagtgccaggtgtgcagtatttctagacaaagcaaaggcgcatttgtccaaaggaggggagattaattaacttaagctctctggatgatctgttcctgcttcctggacagaattctcttgccgattggaacaacctagctagcatttttcttttaaatttctatcagcattattcgttgtcaaaatcgtcatcttggtttggacgatcaaatgccacttcgcctccttctcgtacctgctaaattcgtgcacacacatggacaaatactaatagttataatttgccgaatgatttgcagcctaatactcgtagattagcttgggaagaaatcaaatgatgtgagctccaggaaatcatcggatttcttccccctcctccaagaaaatcaaagctaccactccgtacatcaagagacactgacatgtgggccctacagagaaaaaaaatctccgcgcgccaagtggccccacgccatcctagcttcctctcctcttgaaatagccgccgctgctcgtctcagttcgactcttcaggtggaagccacaaaacgaacgcgaactcgagcggcgaagaagaagagagagagagataaggcggcggcagcgaga

SEQ ID NO: 31031 - DNA, 1501 bp, Oryza sativa
ccaggccgaccggcgttcgttttcgattttctacgggccgagccatatggaaatggtaatcgaccgaaataaaaatagaaatggtaaaaaatatagaaatgaaaacggaaatggttttgctgttataccgatcgtttccgtatttaccgtattcttgtggaaattaccgtttcttattaatatggtaattaccatattctaaatatgtcaatatttataagccatatctctacttgacccatagcttacagattgattgactcttcaatcaaatctctaacttttatttttgtgcatggctaaaatggagttaatttataatttatatagtataagcttgaatttatgtatgtaaagttaaatatatgtttttatagtttaatattttcgtatttgttaccggtttccgctctgtaccgacctgtttccatccgtattgttccgtttccggttttccgatattttcgatatcgttttcgttttcgactttactgttttcgatttcgtttccgagaaaaatatggttccaaaatggttgaggctgttttccgatcgtttccgaccgttttcatccctaggtatatctagtagtagagatatccctgaatccatatggaacttggctatagctagtaacaattaattatcaggctctaatgaaagaagctacaactcactggattggtaccgatcctctgccaccggcaaggaaacagcaaggtcgccattgtgcctatccaccgtccaaatagattggatggctagaaaataacgccgaattcttttcagcaacttgaaacggcaacattcttcttttccattagcacacttctcgaacggataatcggtgtgttttgtaaaaaaaaagtagatttttttaaaatttatgttagttaataggtaaataatcatgcggtgattatccacacagttttccattttacggggcttatatcttgtttcttttggagtccaaccattcttctccatcgctaggaagagaaaacaagtatagaattgctagttggcgattacgcgccattagcttaagtcgcgtgcattttttttccccaaggctccgtatgcggtccacgtactcactagcagcccatccgattggttttttcctttttcgcgtggcaatagtcttccttttcttttttccccgtcgcgaagccgtgattagatccgataatcgggagaaaattgtgatcagctgcacttctacgtaattagatccgataatcacggtacttcctttttttcacataacattgttttccttttttactaaagatttgaaacctatcaacttgaattttaaaagctttcaacttttcatctcaaatttaaaaaacttttaacctagatttgaaaactttcaacccaggtttgaaaactttcaactcaaatttaaaaattttcaactcaaaaattgaaaactttcaacttttcatctaaaatttaaaaaactttcaagccatatttaaaaactttcgac

SEQ ID NO: 31032 - DNA, 401 bp, Oryza sativa
attgaagtttcttgggtgcgtccgtgtcgaaaattcactctgtgactcgcgcagtgaacttttatcacttaatgccaatattggcctatattagcacacgcggctgcgatatatttcaccggaatgaaaaggttcagaaagcaccaaaacatatttttgggcatactgtagagaattaggtgcgtccgtgtcaaaaaattactccgtgactcacgcggcgaagttttgacaattaatgtcaatattggcctatgttggcacacgtgggtgcaatgtttttcaccggaaaaaaaaacttcaaaaagcagcaaaacatgatttttggacatattggagtatgttgggtgagtccgtgttgaaaaatcactccgtgactcgcgcggcgaacttttgtcaattaa

SEQ ID NO: 31033 - DNA, 1501 bp, Oryza sativa
atcgtatacattcatgtaacacaagttaaacttatcaccatcgaacttgtccaccagtgccccagcagtagaagcgcatcttatcacaattggtggtaaatttagtggaatggatgaacatccacgctaatggttgctgaaagctgaaatgacaatttgcataacatttcagtatttcttctcaagttctccaataagacccctctttaaaaatgtggttttacctgcaaccaaatatggcataccatcacactcaatccaagaatcttacagcaaggcagtcggtaaacttttgatatgaaaatgaagctatttcagccatgttgcctggctgaaatattcagactgcaacaactgtttttgcctgatcttgtactgacaacaagcaacatgcaacactttaatttactcctttgaaggaaatcatagtattttactttttccttaaatgtagcaccctcatgcatgctccatgttacgtttgtgaatcttagaattaaaatagtagcttatagcaagatggttcattctttgttttttttttaaaaaaatggttcattctgaaaagacaatttttattataggatatttggactttacgattttagctataagacaccacatgaagtaacttttaggaaaatacattctcaaaatatagaattttgctgctaaagaccgcacccattagagcattcattttctgattcaatagaaaagagaaaccatgtgaaacatatatcaaatatccatttcctcctctctcaatgcctattgatatgggtattcttctcatcactgcataaattcaatatagtaaaactaatggtattagacaggggcggagacaagggtgggacaattagggcttgggccctaggcttaggaccaaattcctattaaaatcttattcaaaatattgtaaaaagttgaagatataaagagttttgttaagaacacattaactcagccctgcttggccctagacgtgatcaattcttggcgattaaaatattaggtcgaggagctccgccacaagcggcgctaccgtttgtggaacaaggtttggggccttaggggtgattgttcaccgttgatatttttcatgactttttaaactatataagtatatataggatatgagcacatagctacagtgtttctgtattaggccgaaacattcgatcctcccggataccggcccaatgctggaaaattaaaacgggccgtgatcccctcgagaaaattctacaatgggcctcataaggccccttttcaccgtgaaacatcactaaaccgcttacctttcctaaaagtccacgcggacactgacacgtcatcatcgtgttcgtttcctcgtcaaaagggcaaaaagaacacgaagaagaggggcgtccaaatccgccgccgaattccccacccgtcgcgtccaaaatccaaatccgccgccgcgatcgaggccgacgaggagaggttgaggttgaggtgagagccatggtga

SEQ ID NO: 31034 - DNA, 1501 bp, Oryza sativa
gcctttgtcgcttccggattcacctaggcatgagaggggactgcccgccgccttttgagaagtgggggtgaaacctgaggtgtggtgtgcttggttagagagagttatgctaagggtcctgtcacggcctctttccggtatgtcgtactggcatgtcggcacacaggtatgtcggcctctttccggtatgtggtactggcatgtgtcgtggggctgtgtcttgtgggtacagttgtacacctttgatcagagtaaaactattcgaatagtcgtgcccgcggttatgggtgatcaaccagattcaccgtgattagtctcatcctaacttagcttaatggatcatattagttcaggttgtggtttgggcatgtctcaacgtggtgtagcgttgagcagtgaatgggttaaataatggttaattactacaactgttttaccgctttcaactactatttacaaatgttggctttatgcaaatgaactcctttagtcctctttggttatattccttgcatcatacgctccgttccggtatgacttcctgagtacagtgggtagtactcagtcttgctctatcttccctccccccctccccccagacttctagtatgcttccgatggtggcttttctgaggactagccttcatccatgccatcgaggatgcctgtcgaatggtgttccccactgctatccaagtcaaggcttagctccagttatccttttaatttccgctgcatttatgtaagacttttataatgtttgtaagacatggatctgtatgtcaacattgtcgtttgtgtaccctggccggtcctggacaagagttttaatgcacattctgcttggaattctatttgggaatttctgggtgtgacaagttggtattgaagccgaccgtgaccgtaggacaagccaaatggaaaccctaagagacctccgaatcttttcatttgcatatgttctttgcaattggatttgttttgggaaaattgggatttgttcctcagttcatgggaaaaatcttgatcgctcattcaattgaaatttgttcaaataagatcggttagggttttagtaaaacttattttggatttatttgacagtcagttggaatttaatgggaggtatggattaggttctaactagggatatgggttgcaggcttgggttataacatgaatagactttggactaggaattgcttagccatgcttagttcaactagcacacttttggggaaaaatcctattgaaatatagactgcaggttctaatggtaatgttggattagtaccaccgctttggtgttggttaattaaaatgaatcacatggtggactgtgggtgcatggttttgctagtcgcacccatggtaattaaggaccggttctcgggaaaccctagaagaattcctcgtacttaccacaagccagcgtgggcaacggctaggcttgtagtgtagcttttctctagctgacgcatccaggcaagggtgggcgtga

SEQ ID NO: 31035 - DNA, 862 bp, Oryza sativa
tggtttcagatttaataaatgccaatatatttgtagaagaatgtgtttgtttttattgtgagaatttctgctaatgaaaaacatttaaagttggctctgtatgcaaataatgatcatatatatttcagttgttttcacttttatctatatggtaggtcagagctggagtacagtataattttgactaaactataccgagtgttaaataatcaatatgatgttatcagctatataaaaatatcaaaataaaattgaatgtacatactgagatatataaaaaggtaaccatagatgtctgctcatggtcacgcaaggcgtgacttaaatggctagtctaaacttgattcatggacccggcacttaatattatgaattttttctctctttgtttaaattctcgttcttcagcttcgaaacaggtaaaataaccagtctctcaactcccagaacggtaaaactcgtccacttcaaaaaaaataaatagggggaacggtaaaactcttaaagccttgaatggtaggacatcgtacgggaaactacaatgaaacaaacaagctaggaagagaaaaatatacttcccgatcaaaagcatactatcacgaattcgaaaactttggagaaattcaaatttgaaatgaacaaaccataaaaaaaatcctacaaatacgattatattgatagtaaaaattttcaaaaagaaatattgaatttacccatcgtttttgaatggaacagatgggaacaatatgtgaaaatgagaaaaaaatgcctaatgggctgacgactcaataagcccaaaacacacgcgagtccaaagcatcacagcacgagccgtcgcggcgtctccggccgccgccgcagc

SEQ ID NO: 31036 - DNA, 467 bp, Oryza sativa
tgaatgcgaaaacagttgtaataattagtcaatattaatcatccactgtccaacgctacaccacgttgtaacaggcccaaccatccacctgtactatccaatttcaatagactaaactaggatgagacaaatcacggtgaatctggttgaccgcccataaccgcgggcacggctattcgaatagttttactctgatcagaggtgtacaactgtacccacaagacacagccctacgacacgtttccatgcgccgacatgccaccacgacataccggaaagaggccgtgacaggaccattcgcataaccccctctagccaagcacaccacacctcaggtttcacccccgtccccagcgggcgacgggcagtccctgctcgtgcctaggtgaatccggaagccgcataggccgtcgcagggcccatccaaactccatcacgcccacccttgcctggatgcgtcagctaga

SEQ ID NO: 31037 - DNA, 1501 bp, Oryza sativa
attttagttagttttaaattcctatatgaactctatcctctacttctaatattccttatttttaattccgaatttcagttatttcctaattatatttctatatggactctagtctcctcttttagtatcccttattttttaattccgaatttcacttatttcctaattgtatttctatatggactctagtctcctcttctaatattccttattttttaatttcgaatttcaactatttctaaattgtatttctatatgactctaccttttctttttctccgattaatgtgagaatttctaggccatgagagcgaacgtggaggctcctttttctatttctttaataatataatagatatttatattttttaaagaaataaaataaatggttaaacgttatgcgaaaactcaacgacatattatattttgggatgaaaagatgacatactatcattagtcatgacattagtacctgattgttgcagtctgatagcttatttatcattaatcatggcaagtccggtttttctctactacctgatgttcatgacaagtccctgttggctgttgcaatcattgtagttgtgccagatgggataatatattagcagtttgctaatgacagagtagtgacgttgttttcatacatagagaaatccctagggaacatggcaccctgccggctcccttcgcaacttggtgacaccgaccgcacaagtttcagctgtcaccatctcttgggccgcatgttggcggagaaaggcagcccagccgtcttctagttgaaactaaaaggcccagcacaactcatcccgcacggtttcgctgatgaatcgttgcgggttgccgctttggacaccgcctaggcgcctactccacgcgccgtcggattcctgcccggaactagctcgatctcactcgttgtcgctggtgacttgtgccggcttggctaagatcaagtttagtagagccactcctagcttaaaatcatctataattaatttaatagccaatacatataatagttatatgcaaatatacaccacactattgatatataatttctcatgttatatacacattacgttttatgttttatatatgtatgtatatagttgatttatagtatactattgtataacctgctctgctcgatctcatctcggtgatcccatacttggcacgtacacgtgccctcttgatgacataaacaaagagcagacagcttgtgtgcgcttgtctaggtagaaaaaaagggatccgatcgatccgaagagcatggtgaaaagcacgctattaccagtaccaccactgttcgtttcgtttgttgggtttcggtcatcgccccacacatgtcgcgcatgcatggttgtcgccgcgacacgtgccggcgcgcgcacctccctctccgcaccttaactccttcgctctccgcccacttccccatcacgcgcgagcgctgccatcctctcctcctagctaggtcgatcgacgtcgagaa

SEQ ID NO: 31038 - DNA, 222 bp, Oryza sativa
acgcccttgattgacagcctgcttgtacagtagttcatcagaattgtatacaggccacttcaattcacttcctttcaggtctttttccatctttcaggtctcttccctacacagatcttaccaacaggttaacactgacatatctccatgtcttctgtcttggatcaagttttctttcagaactttaaagtgcagacccgtcagttattgtatccccaaaga

SEQ ID NO: 31039 - DNA, 1501 bp, Oryza sativa
ctcaagggggtgtgcgccctaggccaaccctaggacatctctaatcatatttattctttagtcgtcatcatttagagtcgggttttgcttagattattctatcgagaacagtttcgccgctaaatcggtttgtaagaccccaactagtgagcttaatcattcatctgcaattttggttgtattctatcttgttcttgtttgtgttcttcgattggcaaacagggattagccttctcagtgaggtcatccgcgtttcgatacgggtgataaccagaggagacatggtgttgcgattgcggggctcaagagcgtgttcgatcaagatgccggatcgatttgtgtcgcgagtccgcccaaattattggttatcagaacctttcgaaagatcgggaaccctagtccacatcatcgcctcaaccgaatcttctagacttggcttaattcctcgcgagttagactgttttggcaggtctggttgaaggccctcgtggcatgcctccaacaatgtccatcaatgcaacagccattaaaaggcagagtggtatacatttttcataatccacatcaatgcaagtatattttacacatactcaactaacatcaatatgtttttctaatacttcacaacgcagttttctacagagttcatagcaaaacagatggacgctgcaacttaacaacaggatggaaatctttcatggaggagaatagcataagcattggagctatctgcatattccacttttatattaggaagcgcttagaagcagtggtttatattgtctcagaagagtagctgtaatatacctatgccagctttaggaacaatgccttttgagttgtccatgaaaccagcctactgatgctatctccatatgcactgcttttgtgtaacagtgcctagagacaatagaccatatatggcacaatcaggctacctaatacgtgtagccgattttgctctagggcctaccatgtaaaaactatctatgatcagtttataaaccatcgaccagtacttactatgctatttactaatgacggtaccatgttccattatatgcaactctacaccacaacctaccaattctgtactagcaaggctcatgttaccattcacaattatgtggtttaagtatttagaaatttcccttcccaaatctaaaaatatatcgccctcttaatgatgcaccctttactccggctagggcacgggaaaggcacgcctaatggtctagtggatttataaaacctttccggaagagaattttttttgtttttaatttttttattaaaatatttacaaaactaattttgtgtttgaaaattttacaaaactagtcgcccgccgcccttggggccctcccaaagggtggtttttgtgacgtggcacacggccgttaggtcattcctaacggccggctatggggggcgtgccattttgcaggcggcccccttgccgcccttacggagggcggttttgctctgttcgggggccgcc

SEQ ID NO: 31040 - DNA, 1501 bp, Oryza sativa
tgctctcacgattttggaacaaaaaaactatttgtccgtttcacaatgtaagtcattttagttttttccatatttatattggtgctaatgaatctagatagatatatatgtctagattcatcaacatcaatataaatatggaaaatgttagaatgacttacattgtgaaacggagggagtaattaaggttccgaaaatgctatacgtccaaccgacgcgtacgaccagcgcacgactacgtcattggccgtccgccgtccgtaacttctgcaacgatcgctaattcaattgggcttgcgccgtgtatttcgccgttgagtcgtacgctggtcggacgtatagcagcgttgttaaggttcatacattgactttttgaaatgtgggctgttagctagctgtttgctaattataccacgcgtgccataataatacactcaatgatttaataaaattgtgctaattaagggcttaaggctcactgatgatctgcatcttaattactaagcagggccatgtgcgatatgttgactccgataagcattcggttactgagatcaccgccagatcgaggcatgcatgcatgcgatggcagctgatcatagagcatggccaaaattcggaagatggtcatgaagataatgtgttacaccctcgctaattagcttgatggaaacctagctaattagtgtttgccgtggaaattttctaagatactccctttattttaaattgatctatatatagttttttaggttattcctaaattatcattatatttatgtgcattcattaagcctattcgttggagtatttgtgcattaatattggagtaaatggacattgatacatgtatccatgcacacaagtatttataacccacatgcaatatcttgatttgctattgaatagaaaataatgggatggtgtatgcatcgagcttgtttttagagtaaatatagtatgagagagttattagtttttcttggttttggtgtacctatgaaatatgtagatcaatttagaatggagggagggagtaatgtgttacacactcgccgagcgaggattaattgatttgctaggtagttagacggcttgactgccatgttgtcagcttatttactaaatcattcaattaattagttgctcaaaaatacatttcccaaaaaaaacttattccattgtatagtaagaccacttatttcattattttattattttctaaaaatatctaatttatccctataatgaaatatgtaatccacagaaataatccagtcaccaatccattttaaatttatagacttcgatgtaacctatttcttagatcaactatgtacaagatagaaggctagaaacttttgagataatatagcttatcaaaaaaaaacagagagaaagctagcaataatactgtcgacgtttgatgtcgcggttctggtatttacatagtatgaggatcgttgttagtaggatatatgcgagactgaggtaaacgaga

SEQ ID NO: 31041 - DNA, 1501 bp, Oryza sativa
cggtccacggtgccgccccggccgcggtggaccgtgtccaccgtgcgtctccccctttgacccgctgacgtgtggggcccgcgtgtcggcaccggccgccccttgctgacgtcagcgatcatcttttcctttgagaaattaaataataattgcgcaataaatcaataataattctagaaattcatttaaatggctcaaaacttctaaaattcatatctaattcatatgaactccgaattgggccattcaacttgcaaaattcatctaaaattgagctctacatgtttgtttactttttatgtactgtttccttggtttttactagggtttttcctcgttttgcgtgcctgcgtgtagttcgcgtcgtttcggaagttcgcggtcgcgaggatcagagttcagaaggttgtagtgaagaagcaaggcaagtcacacattccccttgagcatgttgatcccaatttataaatgttttaccgtttgcaaataaacatgcatgtcttgctaattacatgggatccgagtattacctatctgctcgcttgtgccaatgtttacttgatatctgtcctttgtcaaccttgtgtgataaatcaactagctcatggtacttatgtgacctagctagaactatatgcttagccatgcttaattaccactagctcagttgatgggataattacagtattagacctttttagtatcagaatgagctgcatgctcgagacatctgaccatgcttcgtggtcttaattatccaactaaaatacaactgaatggtgggctgtgggtgcatggttttgctagtcgcatccatggcaattaaggaccggttcgcgggatgccctggaagaacttatcgtacttaccacaagccagcgtgggcaacggctgggcttgtagtgtagctttcgtctagccgacgcatcctggcaagggtgggcgtgatggagtttggatgggccctgcgacggtctatgcggcttccggattcacctaggcacgagaggggactgcccgctgccttgcgaggagtgggggtgaaacctgaggtgtggtgtgcttggttagagggagttatgcaaagggtcctgtcatgggctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggttgaccagattcaccgtgattagtcccaccttaataaatcgactcaatgcactgtagatcagtggtgatttaatgttactttaattactcaacagttttactgttttgctaaataaaatgttttacaaccgcctttatgcaaatagccacaaaccgtccctttgttccccttgcacgtctgcatcattggtgtggcttgctgagtacggtggttgtactcagccttgctattattcccccttttcagaagtgtagtgcttctgagctga

SEQ ID NO: 31042 - DNA, 450 bp, Oryza sativa
  unsure (1)..(450): unsure at all n locations
cgtggcccnnnggtgggatcaactgactggacagcagcncatcataagatctggtcgtataagagttctcgccgtgcgtattaaccaagccgtgtaatcggaaattgagttttccaacttcacagctgggggctaggatcagtgcttgttcaaccaaggcaggtcaagggtccaagagccttgtcctccgagaacgattctccgacgacaaggctgggggctagggagagtgtatgactctacaaactgactgatcaaagtcggtaagagagaagacgctcatatataaaacattggtcggtaaatttaattcatttttagttttccatacaaattataacatgtcaccatttgagcgtttgctcgggggctatttctatttgatattcttttctgagtattgatttctggaaaattctattcgacattgtggaaaactccatgtctcta

SEQ ID NO: 31043 - DNA, 1501 bp, Oryza sativa
gacctgccaggaacttttcctgcttctctgcgtcagttcggacatcctccggtgcatatcgcgcgaggcgattgaactcatggagatactccgtcactgtcctgttgccctggtggagtgcccggaattccctcttcttttgtgccacgaccccatctggcacctgcgccttcctgaagctgcgacagaactccgcccaagtgacttccatgcctggcggacgtatggccatgtgattgtcccaccaagctgacacgggaccttggagctggcgaaagcgaccttctcctgatcattacactgcaggagattcagcttcttttctatagcatggagccagtcattcgcctccatggggttggtggtgctggagaaagtgggtggcctgacgcgtagaaactccggcagtttggactgagggggagggggaccaaactgctgctgatgctgttcggcgtgctactgcatcctctggtgcatctgctggtgctggtgctgcatctgctgcatcatggctgccatcatctgagtctgatgtgccattacttgggctagcgtcggattctcggggagtagtgggggaccattgccggaatcactgttgggatgcacaccatcagtgcgctcttcgccgttgctgccctcgcctgttgtgcgggtgccattccaggtgtagaccatctggaggaagagcagacggggaaacggagaaaaacagatactcaggaactaagctttattatatagaaatttaaactgcaattgttctgatctgatttaaaacacttaaacagcaagcaacaatccttattaagacagccatatcataggaacatgatatcgaccgtcgactgacccacaagcgagcaacctaaacacgcaaactaacaagcaaaagctaaacagtcgataaactaatggaaagcgagcctaatgctcggaacggctcctgcggtcggtggagtcgaaggcgtcgtcctgctcgtcaccaggtccctctgagcgactcctggagcctggcagatatgtctcgccgctgcccggctctgagccactggagctactgctgccgcggtcgtggctgccattgggagtagcaggcaaccaacccccattgccactggcggggcccctgacggctgatgctggcgtgaaggagagagcggatgcaggagctgacacgggaacaggagctggaactggcgctggagctgcaggagctgcgggaactactggcggaggtgggttcctgggcgcaagctggatgcgcacgggtgccgttgtcgacttgcggggcgtagtgcggatccggactcctcctggcgcgggtagaccctttaattgagcattctcctccagccggggaacacaaacgacaatgttgacatacagatccacgtcttacaaacatcataaaagtcttacataaatgcagcggaaaacgaaagataacaggagctaagccttgacttgaactgcagcgggaacaccactccacagg

SEQ ID NO: 31044 - DNA, 1501 bp, Oryza sativa
agttaagaatttagagtctagccaagtgtaatacacgtcccggtgctcaataaccgcgagcacggctattcgaatagatttggtttactcacactgcagtggatgtacactttacccgcactcagcgactgcccaacacatgagcctcgtcccaacacatgagacgcgtcacggcaaagcctttcgataacctcgcattggcagtacccgctccacgaacttacttcctcatgcactcaggcatccatgtttctagcagtgagaggagttctggcgctcccggggaagaagtctcacacacacattaagttctctctcacactctcatggtagtcctacaaatggcgacactgatgtagggcacgccttgcggccctacctcaacggctgccccaccgtaccgcacctgcctcactcaggggtgaaccatctatgaagggatactgcctccactcggctatctaatccgctaggtctatacccattcgagaagtacggttgtacgggggtcgtttcaagcttaacttcatggctcagtccttaattgacaggggacggtactagccttttcaagataccacccaaatcctccgtccgccccagtcgaaaactgttgtttagttttatttctcctttcacaaatcatgtcatcaatatcatggcaatgtggtgctcatgtctccacatgccgcatctcaattaccttcccaaaggtaattgcccaagcatatagcatttgataaatatgagtatgcatgattctagaatagcatttctaagcaattgtcataattgactagggactcatacgtaatcgtggttacaaggattttaagggtaaacaataatcaaggcatggcgtaatcacaagtaggatgtttatcattgcttgcaattttatttgtaaacaaaacaattttgcaattgggatcaacatgttcaaggaatagtgatgacttgcctgctcaggatagtccttattcttgatacaatcttgatcaaccttcacctcctagaagttgcatacattgcctcacgactaaccgatatacaatgtctacaatacacgagaaaaaccaatattcaaacaacaatcaaatatgcacaacaaaatgtacttgttggtcgtacctagggttgctcgtactattattgtttgctaggggattccaatcatgctaagggctaaagtttcttaatctttctgttgtcatggtggtttatggggagctagccgacatagtataaatgagatacacatttggctaatatgtggtttagtctagctaatggctatggaaggattatggctacacatgcatctatctaaataaaatggtcatatatatactagaggttctgttgtcgtcggatggatttgggatcaagcaattaatcacagggaaccatttgtattattattttattgatggaggcttttctttaattatgaaaatattttacttgtcacaataaattataaaaggttaataattatcca

SEQ ID NO: 31045 - DNA, 1501 bp, Oryza sativa
cgtgacgttcagccctcgagacgccaacagagatttggactgccacgttctcgccactgctgcgctcctgcgaggaacgtgctaccaaactatgacgcgcgaacctcgtgttaggtgaggccgcgtgatgggcggagcgacgggatagagtctgcattggacctgcgatgctgtccggcccccacacggcacacccccactcccacaagccaccgcgggtacctcacccaactccggtaagagaacaaaaggggcagcaacagcgagatgggggaagaggggcctacctttccagccgccgctaaccggagaaagaagagaagacaaaagatggaggagaggcacatagccttgcaggcctcgtcggcacgagccgccgccggattccgaggggcgaagctcagcagcggcgtaggcccaagccaccgtggggacctcgtagcccgtgcactacgccactaccccgatctggtcggcggtcaccccgatctactcatcgccacaggtgtcggcgatggggaggggagggagaggtgtcgtcaacagggagggaggggagaagaaccggtgatggagagggaagggagaggtgccatcttgttaatagagaaatagaaagggctaaaatagaaaatatgaggggctaaaacaaaaaaacgaagccacacatagagacccatgcattgtgggagacaattttttttaaggtgtggttttagcccatggcacgtgaggcaggccaaattcttctggcacactgtgaacgccctgagcatacggtatgatcattataaatgatctcttgtgtcagtgcctgcatgtatgtactactttcgcaagatctataattcttagagcatgatcaataataaggtaatttagctccaattatgtccaactcatctataacttactttgcagcttgtacacgcaacatctagttgtattgttgggtcctatatgcttcacatcactattaaaaaattgcagcatcgatcctatgttgcaatttttgcatagcagcatttctctcactctctcacgtccaacgtttttatctagagatgcgtgttgcagcccgatgataaaattgtcgtccgctcgcgccagctcatgcatgttctctctctttagctcttttccctatatcaccattgctatctacgtggacttagtgtcgcctgactaatgtacctgctcttaagaaaactacgaagacccttgctcttaagcaaaccatgcatggttaggcaccgtaaaacttcgccaccgctaatcgattaacttcgccaccgcgcagagcgcttgcttggctagagccaaacaaaatagggaagttctaaattaaataacatgccgaaagtaaaggggaatcagaggaaaaattaactatgtgtagtatagcttcaatagggcaggctagctagtagcttagcttcagcatacacatgcatgcacacccgctgtgaacgaaggagcgagcgagcgacgatgggttctt

SEQ ID NO: 31046 - DNA, 630 bp, Oryza sativa
agttcaaaaagcagcaaaaaatgattttttttgacatattggagtgtattgggtgcatccgtatcgaaaaatcactccatgactcgcgcggcaaacttttgtcagttaatgccaatattgtcctatatgggcacacgtgggtgcgatgtttttcaccggaatgaaaaacttcaaaaagcaccaaacttgattttttgacatattggagtgtattgggtgcgtccgtgtcgaaaaatcactccgtgactcgcgtggcgaacttttgttaattaacgccaatactgtcctatattggcacacgttggtgcgatgtttttcaccggaattaaaaagttcaaaaagcagcaaaacatgattttttgacatattggagtgtattggcttcgtccgtgtcaaaaaatcactacgtgactcgcgcggtgaacttttgtcaattaatgccaatattggcatatattgacacacgtggatgcgttgtttttgaccggaatgaataagttcaaaagcaccaaaacatgatttttggacatatttgagtgtattgggtgcgtccgtgtcgataaatcactccgtgattcgcgcggcgaacttttgtcaattaatgccaatattgtcctgtattggcacagg

SEQ ID NO: 31047 - DNA, 1501 bp, Oryza sativa
ggtgcatccgtatcgaaaaatcactccatgactcgcgcggcaaacttttgtcagttaatgccaatattgtcctatatgggcacacgtgggtgcgatgtttttcaccggaatgaaaaacttcaaaaagcaccaaacttgattttttgacatattggagtgtattgggtgcgtccgtgtcgaaaaatcactccgtgactcgcgtggcgaacttttgttaattaacgccaatactgtcctatattggcacacgttggtgcgatgtttttcaccggaattaaaaagttcaaaaagcagcaaaacatgattttttgacatattggagtgtattggcttcgtccgtgtcaaaaaatcactacgtgactcgcgcggtgaacttttgtcaattaatgccaatattggcatatattgacacacgtggatgcgttgtttttgaccggaatgaataagttcaaaagcaccaaaacatgatttttggacatatttgagtgtattgggtgcgtccgtgtcgataaatcactccgtgattcgcgcggcgaacttttgtcaattaatgccaatattgtcctgtattggcacaggtgggtgtgatgtttttgacgggaatgaaaatgttcaaaaagcaccaaaacatgatttttggatatattggagtgtattgggtgcgttcgtggcaaaacaatcacttcgtgattcgcgcgccaatattggcaaacttgggtgcgatgtttttgaccagaatgaaaaagttcataaagcaccaaaacatgatttttggacatattggagtatatcgggtgcgttcgtggcaaaaacatcacttcgtgattcgcgcaccaatattggcacacgtgggtgcgatgtttttgaccagaataaaaagttcaaaaatcatcaaaacatgattttgggacatatttgagtgtattggttgcgtgattttgggaaatattcgaaaaatcactctgtgactcgtgcggcgaacttttgtcaattaatgccaatattgtcctagattggcccacgtgggtgcgatgtttttgaccggaatgaaaaattcaaaaagcaccaaaatatgattttaggaaatattggagcgtattgggtgcgttcgttgcataaaatcactctgtgactcgcgcgacgaacttttgtcaattaatgtcaatattcgcctatattggcacacgtgggtgcgatgttttcgaccgaaagacaaagttcgaaaatcaccgaatcaagatttttggacatattggagtgtattgggtgcgttggtggcgaaaaaaaacttcgtgattcgcgtggcgaacttttgtcaattaatgccaaaattggcacatgtgggtgtgatgtttttcactggaatgaaaaagttaaaaaagcacccaaacatgagttttggacatattggagtgtgttgggtgcgtgcgtgtcgaaaaaccactccgggactcacacggcgatcttttgtcaactaatgccaatattgtcctgcattagc

SEQ ID NO: 31048 - DNA, 1501 bp, Oryza sativa
ctgcttggacgctgtaatagcatcttcggctttggcatactcgttggctttttcaaacatttgcttgaccgtcttgggaggtttgcatccgaacttgccgactaggtcctcgtggcgaatgcctttagtaaaggcagcaatgatgacgtcgtcggtgatgtcggagatcttgttgcgttgctcggagaagcgccggatgtaatcttgaagggatcctctagacttctgaacgacgttgtagagatcaaactgtgtgccggggcgttcaaaggtgccctggaagttggcgatgaagtgatcacgaagttctgcccatgatccgattgtgccacggggtagtccgtggagccaggatcgggcggaatccgctagagccacaggcagatagtttgccatggccttgctgtctcctcctgctgcgcggattgcgagaccatagacggtgagccaagactcagggttggtggtgccatcatatttctcaattccagtcggcttaaagccggctggccaatccactcgacgcagatcgcttgtgaaggcagcaactccgtccacatcgttgtcgtaacgatctggtgaatggtggcctcttgctggacggcgctagttgatggtgtcgcgaagatcgatggggcgccttcgatgtggggagtgtggtcgttcaactcgacgctccctataccgttcgggaggtgaacgaacagaccgttcatcatgtcctctgctcctgtgactagatccggcactggcaatgctgaggcatggctggtgatagtcttgagatcgaagatgagggactcggctaccagtcaaggtgcgggtgcttgcggagttggctggacccgaggaagcgatcatggtcttcgtctggttcaagatgttgacaacatgatcagcttggttgagtgcgtcttccttgaggagggtgtcgaggagagtgattgctgcaaccgcgttctgctggggggtgcgaaagaccgctgttccgtcgacgtcttgttgcccaatgagctctctcgctcgcctcccggattccaaggtgcgttgccgtcgatcttcagcctcctttgcaatccgttcgcgatcttgttgctcacgctatagtcgttctcgctcctgtcgctgtcgctcttcctccagtcggcgacgttcagcttcttgccgtgcgcgatcttggtccgcttctcgggctcggcgctgttcctccgtttcgttgtcagccatgaatacaccgaagaagaggggcgtgtagttatcctcatagctgtcgtcgaagttgtcgaggtcgtcgtggtcgtcgtagtcgaggatctcggttggtcgagaactgacgccgggggagctgaggtagccatccaaatcttccgtcgagactgtcccaagaagttggagtataacgccaacctccctggatctagactggatcagggccgatgccggagctcgcctagatctctgagtgggagatgttttgactgtgaagacggcgtccaagtca

SEQ ID NO: 31049 - DNA, 534 bp, Oryza sativa
agctcatcaggacttacatagcgataaaataatgagaaattagatacatactaataataataataagagcattaataccttgcaacccatattcctgagttaggacctaatgcattcctcccatcaaaccctagactgacctaatttgacaaatctcacttaaacgagcgaccaagatttttcccttgaaccacaagaacagatcccaattttcccggaacaaatccaattgcaaagaacatatgcaatgaaaaggattcagagggctcttaggttttttcccatttggcttgtcctacggtcaaggttggctctgataccaagttgtcacgcccagaaattcccgaatagaattccaagcagaatgtgcattaaaatccccatccaggaccggccggggggtacacaaacgacaaagttgacatacagatccacgtcttacaaaaattataaaagtcttacataaatgtagcggaaaaataaaagataactggagctaagccttgacttggactgcagcgggaacaccagtcc

SEQ ID NO: 31050 - DNA, 1501 bp, Oryza sativa
catccgcttcttgcgccattcgcggctgaacaggggaggggagggggagggtcgccgatctccatccggcgagcaaggggatcctggtgagcatccgcatcctctttctgatgattcatctctctctctctctctctcaccggggatgcttctgtcttggaatttgcttgcctaaaccctagcttctcttgtagatctggaggaagctcttctcttagttccagagcctttaaccttaataaaagtaacagtttgagtttgtttgttgttcccccaaaagtttgggggggttcaactgaacccccatgtcccaagttggatctgccccctgttatttcactcatttcactaatttgtttacatacagtggaataatgtagcatttatttttgttatgcaccgttgtagatctgatgagaattcgtaatgcttaaaattgcctgaatagatataacgattaattcttgttttcaaggaagtttcaccatctatggtgataatgtcattctgttattacagaggtcaatgtgttgtagataataagtgacataggttgtatcatttatttcttctatgctcaaggtcctgaactgttgtgcatgtttcatttgttgccccccgagtcatattatttggcgcgggatacttcagtactttggatcaaataatcgtgatgggaaggagtacatgcaaatctaacaacgtggattggctgtgtaacattacaaaatgtccgggaaccccgatcatacgaacaactaattcaatacaatgtggttaaaggaagttatattggcagaggcgtatcaaatatgaacgttgtgcagagagatcgacatatctattaaaaaaatgaatggattgaaggatggtaagaagattcatgcgtacctttcacttgccacacctgaatcaccaagcacccaatgaaatcaactcgaggatcttcaggtgtgtgtgcatagcacaaacctaaatagaacagagggacgaaagccaataagaaaaataaaaaaaatagtaagaaaaaggggtcgccagttcagttcacaagatcaaagcagggtcttacccttgattctgccaccggtgatgtctttcctcaaagccttcacacagaagaagaggaagaggaaggagtctagcctctggagactggagtagtggatgggttagtgattaaaagagcaaacgaactgcctcactgctcctggtgatagggaacgtgaccaaataatcggggagatgctccttaattttctcaacaatctttcaaatagcgggcacatagttgtgagcataaagctcacaccacgtccctgcagatccaaaattatgcttcgagctccggatgcaaaagcaaaattttggcaaccgcagctcgaaggggcatttgtttacacggattttcgctcgtgtcctaaatataatttgttaaattataaattgatgtattatctcaaatatagtgcgtacaatatatatataataatcaataaga

SEQ ID NO: 31051 - DNA, 802 bp, Oryza sativa
tttgtcacagttcctttccaaggtaccgtggtggtactgaggcgcatggtgacatgttgtgggattgtgtcttgtgggtacagtggtacacctctgattagagtaaaactattcgaatagctgtgcccgcggttatgggtgagttgagcaatgttttttgtgattagtcccacattattcattaatggtaattgtgctaatcaatttgactcctggtttggaatggtatattcctggtatggaggttggattagtacaaccggggttggttgttcagatgaggttgggcctatgcaacacgggtgtgttgtatggtgtttatctaatactgattaattattcaactgttgaactattctcttaaatatttattaaatgctgtttacacaaatgagctttattatgccatcctttgttattctgtgcacttgcatatttgctgtgtggcttgttaaatatgtcatatgctcattcttgcaatattcattcatcagaagaggagttcttcagtgaaggtgatgatctggaggactaggcttggtccgggttaagttgcctgtggagtggaatcgccatagctgttccgtagtttgctttagtttatttttccgctgcgtagaatgttattgtttgagaggaactatctacctctgtaatgatttattaattgcgaatattaaatagttgtttatttgtactctattatcaatttgttattgtgtgcctcggctgattcctggacgagggtttaacacacatgtaagcgtttggaattttggatagaaattccgggcgtgacaat

SEQ ID NO: 31052 - DNA, 1501 bp, Oryza sativa
tcaagatctcagggagatttcaagcagcactttttcttcaggcatgcagctgagggcaccaaccaaacaagcccttaaccttacgtcccgacccaagcattcgttgtagatatcctgaaacacgaggttcggacttcggacctgttttaaacttttcgaccgttggacacattttaaacttatcggccattagttataaatatatggtcttatatcacgttactccctcaaatattgaaaatatgttgatttggatacattttaaacttctcaacctttggacacattttgaacttctcgaccgttagttataaatatctggtatgtacgagagcaatggttttaatttttaaaacacaccgttttgcacaagttccaaactcccaaaccgcctaacaaagtgctccatccggtcttaaaaacaaaggtcatgtttcctgcacaaaaatgttacaccctatcacatctgtcggagatataggcccgggggtatgtggagtaaaggagagctacttccctttccagccacacggctccgcgagctggtcccacccacatacctcgtgagtcactaaggcgaaggggagagcctcgggggtcgacgacatcccctcgggggtgacgtcaccccctcgggctctcccgtcgttttaccccgaggccctctctcggggggaagtgtgagaggggagtccaggctgggcggccataaatgtgcagcgccccaaccgtccctcgctgcattcaatgcggcgggggcagacgtgcggtgcgcccgaccgacccctgtcagtcggatgcgaccggtctgtgaccagtctattgccggtcacggccgattggacgggcggtcgtgcccccacgtcgcctctgtctccgcggagtggcggtaggtacgccccatcacatccggacggcgtttgatgcagggcttgccgcaagtcttccctcgtttatgagggaatgacagggctgccccccgtgtcaggcgggagacggcgctgggccccactcaaggaccgaccgatgcttagcttccaacaaaaggcacgggttgaaacccggtcgcagtagggagaaaggccccctcccctccctccgatggagggggagggtagagacggcgcatatggtatccccttaagctataaaaggaggaccttgcccaccaaaaagagggggagcgagggaaaccttttaaaattcactgataatcccaaacgtaggagtagggtattacgctccagagcggcctgaacctaggtaatccatttgtgtgctagctaatcggggatcggagggacgaacacgcgacttcggagagacgagtctctgcccccggccgaactcacgaaaggggggtcacgcgactccccgcgatcgggggtcttccctcgacagctggcacgccaagtagggggcagttgcgcgtttgagaagaagtcgcttccttccgtcccaggtcggaccaggccctagaccgccatggtcgaggtcctgg

SEQ ID NO: 31053 - DNA, 1501 bp, Oryza sativa
tgatcctacccctttgtcttctctagatggccgaccacccacccaaccaccacggagaaggcatggatgattttgtggcagagttggctcgcatgaccctggtggtgggctacctgttaacaaccgaatttggtaacatcagcatcatgaaagaagattagatcgaagcaaaattggaggcggagatcgagttcggaaacagggcaggaatcgctggagtccaaatcggctacgattaggatcggctgggtctgagtcagactaggtaagccgatacagctgattccgacaatgcagcttgatgtatgatatcgggttggattgaggtgcttcaaggtgattgccgcacatggatagagtcctgagaaggcaattgtatctattaattagggtgttttatgtaatctccttagagatacgattgggcaaaagtctgccacaaagacttatgctatcttagagtttgctagagatagtagtcgtgtccgttatgtacatatcttgtaattcagagtatcataaagctgcatcggtttcgatcttcaacaagaggtaaaacttgttatgacgacttgtgttctcgggattagtgcttccatctttatgatactctgatctcgtttatgtaattcgtcgagttatcatatatcttacataatctccggcaatactgctatctaatctacaatcggctaacatctgtctgtagaaggcagccgattaggttagatatcgatgttgacttagattgtataaggtatctaccactctatgaaacttctagcggcttgattgtctagatattgttcttcttttcatacttaatgctgcatcagttgagtttgatctattaagtcgtgcttagaatatcaatctctagcctgccttctggttgccgattagggtagcatcggagtttcagtcgaccttatctgatttaactatatttgctctatatgcttcattgacatgttaaatctgcccattatgtcaagatattgctgtatctaagtatcttaggcctttgtttgatatattatacctgttttaatatcctgatatagagtagtatcagagtattagccgatacatgctagatctatctgatcggctatgctataaacatatatagccctgttattaatatatacttcgatctaagtgatttataatgtcttggcatggcggccgatctatcccaatcacttgatttaagtatatatcgatataagaactatatattggaaatatctacagccgatcgaatagatttggttctttattgtctatttacaactgccgatcaattcacatatgacatcggctcaaagataaatgatatgtcatcggcacctagccgatcggctatcatttatagatttaaccgcggtttctttgcctttatttcttgttaattacaggataaaatcaactggcatgctagtacacccgaaggcgagctttggacctgcactggagttaagcagatctcccaggcctc

SEQ ID NO: 31054 - DNA, 1501 bp, Oryza sativa
cacggcatcggttaggttcgacctgttaagtattgtcttgaaatgtgttatctagctctttctttgaatgctaatatagatagcatcagggtttcagccgatcttacctgatttagccgtcttgttcccctacttggttctggatcgtctaaatctgccctttatatcaagatctcatccgtttaaagtatattaagcttcctatcagtctgctagtttccctgcttggtagattgatctcggttttgtatatttcacctgtgctaatatctaggtataaggtggtatcggactactagctgatacatgttaggtttgccctatcggctatgctgcgagcatacataatccctactgtggggcacatttagatactgagtgatttatactgtctcggcataatgtccgatctatcccaatcactcgatctaagcacgttccattggatggattacgtatcatctacagccgatcgagtaggcctaataatctctaagttttatctacctttgctgatctgatgcaagttatatcagcttgcctttgctgatctatcgttgatggatttaactctttgtcttttttctatcttgttggttgcaggatcaaaccagctggcacgctcagaacccaaaggcaatctctttggacctgcactagagttaagcagatctcttaggccagtgcgtgttttttgcgtcaacagaggtgtacaactttacccacaagacacgattccacacatgttaccatgccctgaagtaccgccacgatactacaaaggtggaaatcgtgacaaaacccgccgtacaaccctccctaaccaaacatacccacctcaggtttcaccccctccttgtgccaagttgggcagtcccttctcgcgcctaggtaaatccagctacagcagagaccaatatcaaggtccgaactgcaccatcgcctctacctttgccatggtatgtcagctaggttaagttatactgtagatttagcctggagtcaacatatggtaacggtcggaaaacgtcaagtgcgattttcactcggagtcgacatatggcaaatccgaaacattaccaaatatttcagaattggggggcatatgttaacaaccaaatttggtaatatcagtgttgggaaataagattagatcaaagcggaatccaagacgaagatcgttacggaaacagagcaagaatcggctatgatccaaattggctacagacaggattggcagagttcgagtcgaacagggttagccgatacagccgattctaacaatatggctcggtatacgtcatcaggttgaattaatgtgcttcatatggattgccacacgtggattgagtcctaagaaggcaattgtatctattaattaggatattttatgtaatttccttagagataagtgtgggcaaaagtctgccgcaaagacttatggtatcttagagtttgttagagatgagagtcgtgtccgacaaggacatattttgtaatc

SEQ ID NO: 31055 - DNA, 1501 bp, Oryza sativa
tcggcgcctcctccacgcgggggagagggcggccaagattcggccgccttccgcttccccttcgggtcacttgccgggtcgtctccgggtttgcggcccgagccgggcgcccgtgagtcgccaccaccgctagcgccccctcggccaggccggcccctgccggcgccgacgaccgacattacggccaagatgctctcccggtcgcggtcgcagcagagggggaggatcccatccgggatcagtgtttgctcggcggagtccaggcccagcacccgccgaatcaccatcttggcgtcctcctcgccccagtcccagcgctcgcccgcatgcgtgcgcatggggtcgttggggccggtgtactcccacgcgccacgggatcgttcctggagaggggcgatacggcggcgaaagtagtcgccgaagaccattgcccctgtgaggccccagcttcgcaggcccctgagacgatcccacaccgcgtcatattcctcgcccagctccgaagccgccagccatgcggcggatctctcgggaggaccggcgggaactcgaagtcgtgggtgatccggcagcgcggtgtagaaccagtctttcttccagtcctcccatttcttgcggaggtggctctcgatgtactgccccgccgtgcctggtcggggctggaagtaacatccccccaccaccgcaccctgtagcagctgcgggacgaagaaggcctggaacaaccgcattgtcgatcgcaccccgatgaacatctcgcacaggtgcgcaaagatgctcagtgtcatcacggcgttgggcgcgagatgcaaggcatggatttcgtagaaatccagaacctcgtggaaaaatcgggagaaaggcggaatcaatcccgccatggcgaaggacaagaggtgcacggaccgctccggatatcgcggccgcggccatgactcccccgccctcacgacggcgccgtccggcatgattttgcgggggaggctaaggtgtctgtctgccgagatgcgggaagaaggcagcactgtgtcgcttttgtcttgagccatggtggccggcggggcagtggcggaaggcgtggcgcgcaaagctgcgtggagtggcgagagtgttagggttcgagaagcgagaggacgagtcggcggttggcgaaaggaaggaggagaggtccctgcctccactcccttttaatcctcgcctcatccgcgctcgcctcctcgtttcgtgccctcaaaattgcccccacgtccgcagttgtctctccgtttcccgcgcccgttcaccatgtcgcccgtcgtgtccgcgtcccacctttagtgcgcctatcagcagcgcactcgaggtggaatgcgcaacggttatgagcacaagctgagtgaaccgtcaccacaaccgccgtaggaatagcgggcgaagtaatcgaggcgtggtctaaccaattccccgattatcgcgtcccaagcatcctcgtctttagcgcgatcaaaggcgaccgaaccgc

SEQ ID NO: 31056 - DNA, 1501 bp, Oryza sativa
atcaagatctcagggagatttcaagcagcactttttcttcaggcatgcagctgagggcaccaaccaaacaagcccttaaccttacgtcccgacccaagcattcgttgtagatatcctgaaacacgaggttcggacttcggacctgttttaaacttttcgaccgttggacacattttaaacttatcggccattagttataaatatatggtcttatatcacgttactccctcaaatattgaaaatatgttgatttggatacattttaaacttctcaacctttggacacattttgaacttctcgaccgttagttataaatatctggtatgtacgagagcaatggttttaatttttaaaacacaccgttttgcacaagttccaaactcccaaaccgcctaacaaagtgctccatccggtcttaaaaacaaaggtcatgtttcctgcacaaaaatgttacaccctatcacatctgtcggagatataggcccgggggtatgtggagtaaaggagagctacttccctttccagccacacggctccgcgagctggtcccacccacatacctcgtgagtcactagggcgaaggggagagcctcgggggtcgacgacatcccctcgggggtgacgtcaccccctcgggctctcccgtcgttttaccccgaggccctccctcggggggaagtgtgagaggggagtccaggctgggcggccataaatgtgcagcgccccaaccgtccctcgctgcattcaatgcggcgggggcagacgtgcggcgcgcccgaccgacccctgtcagtcggatgcgaccggtctgtgaccagtctattgccggtcacggccgattggacgggcggtcgtgcccccacgtcgcctctgtctccgcggagtggcggtaggtacgccccatcacatccggacggcgtttgatgcagggctgccgcaagtcttccctcgtttatgagggaatgacagggctgccccccgtgtcaggcgggagacggcgctgggccccactcaaggaccgaccgatgcttagcttccaacaaaaggcacgggttgaaacccggtcgcagtagggagaagggccccctcccctccctccgatggagggggagggtagagacggcgcatatggtatccccttaagctataaaaggaggaccttgcccaccaaaaagagggggagcgagggaaaccttttaaaattcactgataatcccaaacgtaggagtagggtattacgctccagagcggcctgaacctaggtaatccatttgtgtgctagctaatcggggatcggagggacgaacacgcgacttcggagagacgagtctctgcccccggccgaactcacgaaaggggggtcacgcgactccccgcgatcgggggtcttccctcgacagctggcacgccaagtagggggcagttgcgcgtttgagaagaagtcgcttccttccgtcccaggtcggaccaggccctagaccgccatggtcgaggtcctgg

SEQ ID NO: 31057 - DNA, 1501 bp, Oryza sativa
gctaactgattttcttttttaccttagaataacaaagtgttctcaggcacaaagaacaacatacaagaaatagaatggtcatattcgacaagaatatcaaattgatactttcttcccttcctcctaattctatccaaattgttcgtcacaactgatcctctctgtgaaatgacaatcagtggtcactggtccagcatattggttccaaataggttcatatttctatcattcccaaggcattaagaaatattgaacaataaattcaggctactacaggtatccacaactccaattttacaaccatccgcagcgatgtaaattcgcaccactcattcgcatgttgagcaatggcaagcccttgccatctgtacatatatgcaacaaatccatggtctcctatacaaaaccctaattccaagagagagagagagagagaggcgcaaaagagacagggaacagtgtgtaagacctaacctggcgctctatggagcggagctcctcctggagcttggcgcgcttgctcatcagggcggagagcatcgccgtggggttcgcggccgccgcccccgagggtgcggagcccgacgctgccttgtgcaatgcccctcctccgcctcccgagtccatggtcagggtttctagggttcgagttcgtggtttgcctgtttgggcgttcgttctgttttggctcggagacagttcactgttgtggagacgacttagcccctcctctccaatagtccgatcggtcctcttagccaaggtaaccagtatcaagatactatgtaggatcctttctcttcttggtttgatccttctcgatcggtttgattccttctaatggagaaagcttcctgtttgctgccacctgagctgtcaaatgcacatgtgaaaatgtttagcaatcaatgcatacatacccatgagtatcacacagaaaaggttaatagagtatttagcagaatttttttctgttgagggatgaatttcactccaaataacattattggaatacatttctgcctataatctaagatgcacatgttttatgagcgatttgatcatgaccacaaacatgagataatgtccataccctagttagttgcccgtgcattacaatgggaaaagagcatttggctatgtactccttcccatcacgattatttgatccaaagtactgaagtatcccgcgccaaataatatgactcggggggcaacaaatgaaacatgcacaacagttcaggaccttgagcatagaagaaataaatgatacaacctatgtcacttattatctacaacacattgacctctgtaataacagaatgacattatcaccatagatggtgaaacttccttgaaaacaagaattaatcgttatatctattcaggcaattttaagcattaggaattctcatcagatctacaacggtgcataacaaaaataaatgctacattattccactgtatgtaaacaaattagtgaaatgagtgaaataacagg

SEQ ID NO: 31058 - DNA, 733 bp, Oryza sativa
gaaaacgtaataacccaaccacgacgacatgaaaaaaagaaagacagataaaacggtcgaataactaaaacaacttgttactactatttgaaatttgaacaactgtaacggcccaaaaactggggagtggattctaatccctcgagggatatcccctcgtatacctttttcttccaaattcgatacaaatagttatgaaaaattctgaaaaaaattaacaatgtagagtataatgatacctactagtccaccaaaattcatgttcaaattcgatctacacatcgagaaacaaaagaagacaaatttagatataaacagtacgctactattcatacgctgaatttgtctttttatatctcgacgtgtgagttgagtttggaattaagattttgtagagttgtatatatgtgttgtatgaatgttgtcaaattttttcagtatttttcataaccgtttagatggtttttgagcaaacgagggaacatcctcgagggattagaatattttccccaaaaactggaaataatcgaaagagtcgtcgccattttctctcttctcctcctccgctcctctgagtcctctcctctccggctctcccctcctctgtcgggaagggaaggatccaagccctcgccctgctccgcctctgatccccgccggccgccgccgccctcgcaaccctcgcagcagcagcaggaggaggagggttcaggtggtggttgccgtcggccga

SEQ ID NO: 31059 - DNA, 1140 bp, Oryza sativa
caattaatgccaatattggcatatattggcacacgtgggtgcgattttttacaccgcaatgaaaaagttcaaaaagcaccaaaacatgatttttggacatattggagtttactgggtgcgtttgtggtaaaaaatcacttcgtgattcgcgcggcgaacttttgtcaattaatgccaatattggcacaggtgggtgcgatgtttttcaccggaatgaaaaagttcaaaaaccaccaaaacatgatttttggacatatttgagtgttttgggtgcattcgtgggaaaaaattacttcgtgattcgcgcgacgaactttcatcaatttctgccaatattggcacacgtgggtgcgatgttttagaccggaatgaaaaagttcaaaaagaaccaaaacatgatttttggacatattggagtgtattaggtgcgttcgtgacaaaaaatcagttcgttattcgcacggcgaaattttgtcaattactgccaatattggcacaggtgggtgcgatatttttcaccggaattaaaaagttctaaaagtactaaaacatgatttttggacatattggagtgtgttgggtgcattcgtggcaaaaaatcacatcgtgattcgcgcggcgaacttttatcaattactgccaatattggcacatgtgggtgcgatgttttagacaagaatgaaaaagctcaaaatgcaccaaaacatgatttttggacatattggagtgtattgggtgcgttcgtggccaaaaataacttcgtgattcacgcggcgaacttttgtcaattaatgctaatattggcttatattggcacaggtttgtgcgatgttttagaccggaatgaaaatgttcaaaaagcaccaaaacatgaattttggacatatttgagtgttttgggtgcattcgtgggaaaaaataacttcgtgattcgcgcgacgaacttttatcaattactgccaatattggcacacgtgggtgcaatgttttagaccggaattaaaaagttcaaaaagcaccaaaacatgatttttggacatattggagtgtattgggtgcgttcgtggcaaaaaatcacttcgtgattcacgcggcgaacttttgtcaattactgccagtattgggatatattggcacaca

SEQ ID NO: 31060 - DNA, 1501 bp, Oryza sativa
agattgaaaaagtttaaaaagcaccaaaacatgatttttggacatattggagtgtgttgggtgcattcgtggctaaaaatcacttcatgatttgcgcggcgaacttttgtcatttaatgccaatatttgcatatattggcacacgtgggtgcgatgttttagaccggaacgaaaaagttcaaaaagcaccaaaacatgatttttggacatagtgtagtgtgttgggtgcattcgtggcaaaaaatcacttcgtgattcgcgcggcgaagttttgtcaattaatgtcaatattggcacaggtgggtgcgatgtttttcaccggaatgaaaaagttcaaaaagcaccaaaacatgatttttggacatatctgagtgttttgggtgctttcgtggcaaaaaatcacttcgtgattcgcgcggcgaacttttgtcaattaatgctagtattggcatatattggcacatgtcggtgcgatgtttcagactggaatgaaaatgttcaaaaagcaccaaaacatgatttttggacatatttgagtgttttgggtgcattcgtggcaaaaaatcacttcgtgattcgtgcggcgaacttttgtcaattaatggattcttttgtcaattcgaaaaatctctcaattcatcttcctctactcatgttaatggattcttttgctgtgtccttcggttcggccaatgagtacgaaccatggaatcatgttcttgccatgttcctaggcttggccatcatgagtacaagccaaaggaatttttcctctttgttgtgtcctttgtctcagccagcgcgtatgagacaaggaagttcgtttcatttgatggcttttaacatgatttcacacttttttctatggtccggccagatgagtacgggcctaggagtggtttccatgcaaactcttttcatgtcatcctaccataccctctgatttggtcccgttagcggatacaagcccaggcgagattctcgctctcaggttcagtcctctacgagcggatacaaatcacggatacaaacacaaattttgcataattcaccataaattaaacaagcacttgctttggtcacgcttcatggcttcaagccgtgctagtagtgataaaggcatagtgataaataaaattaattgagcatactaattagcacacttatttgctagttttgacatatgttcagccatatttctctaacaagaattaaaataaaatggcgttcattttctttccgtggtcagagctaggaaatagatgtacgcatgcatatattttctccttccatctgttcatctacaaaatgatggataaatcatgaactgcgccgagttatgatggtcggccataaaattaaccaacactcacttcggttacgcttcacggcttcgagccatgctagtagtaatacaagtggagtgaaaattataatctcaaaatcatccgcatacatatatttgcttaaaacaatgtatactcgctacaccatatataaa

SEQ ID NO: 31061 - DNA, 1501 bp, Oryza sativa
  unsure (1)..(1501): unsure at all n locations
tcgatcgcgcggagtcgcgtgacccccctttcgtgagttcggccgggggcagagactcgtctctccgaagtcgcgtgtccgtccctccgatccccggttagctagcacacaaatggattacccaggttcaggctgctctggagcgtaataccctatatcagtgaattttaaaaggtttccctcgctccccctctttttggtgggcaaggtcctccttttatagcttaaggggataccacatacgccgtctctaccctccccctccatcggagggaggggagggggcccttctccctactgcgaccgggtttcaacccgtgccttttgctggaagctaagcatcggtcggtccttgagtggggcccagcgccgtctcccgcctgacacggggggcagccctgtcattccctcataaacgagggaggacttgcggcagccctgcatcgaacgccgtccggatgtgatggggcgtacctaccgccactccgcggagacagaggcgacgtgggggcacgaccgcccgtccaatcggccgtgaccggcaatagactggtcacagaccggtcgcatccgactgataggggtcggtcgggcgcgccgcacgtctgcccccgccgcattgaatgcagcgagggacggttggggcgctgcacatttatggccggccagcctggactcccctctcacacttccccccgaagggagggcctcggggtaaaacgacgggagagcccgagggggtgacggttcaccccccgagggggatgttcggtcgcacccgccgagngctcttcccccttcgccctagtgactcacgaggtatgtgggtgggaccagctcgcggagccgcgtggctggaaagggaagtagctctcctttactccacatacccccaggcccatatctccgacagtagcccccggcgccatgtcagacgcgggcttcctgggaccggtctgacatggtgcctcacgacctccccagctgggattgtggacccggcggggagtttaaaggagtattgccgagcggccagattggcgggctagccatagcggcggttcggtcgcctttgatcgcgctaaagacgaggatgcttgggacgcgataatcggggaattggttagaccacgcctcgattacttcgcccgctattcctacggcggttgtggtgacggttcactcagcttgtgctcataaccgttgcgcattccacctcgagtgcgctgctgataggcgcactaaaggtgggacgcggacacgacgggcgacatggtgaacgggcgcgggaaacggagagacaactgcggacgtgggggcaattttgagggcacgaaacgaggaggcgagcgcggatgaggcgaggattaaaagggagtggaggcagggacctctcctccttcctttcgccaaccgccgactcgtcctctcgcttctcgaaccctaacactctcgccactccacgcagctttgcgcgccacgccttccgccactgccccgc

SEQ ID NO: 31062 - DNA, 1501 bp, Oryza sativa
ttggacgaagatccatcgtgaagcaaattactgccagaaacttgaacaacatttcgtctaggaaaatccagacagtcaaaaactaatttcctcacaggaagaacggaaggccgattaggatcaagaatggaatccttgatggtgtcaaaaacttttttaatcagtacagctgctctagaccgagtaggttcagaggaaaacacattagcaaacgagaccccaggtcgaatgacaccatttgagatgggttttgattttctaccaactttagtccaagaattttcctcttcaagaacccatagtgtgtactcacggtaccaatcaggacctccattcctccataagtgaaaatgaagcttgaagaacttattttggaaagatttcaaggagtacatccagagacctaccttcctatctgacaccaaaaactataacaggaattttggagatgtcgaacccgaaaatcattggatttccccgaagacagcaattgagggcaatagccatagaatccatagaaagccggaaggagaaatgtgaaaaacaaaccaccaaatggaaagcggatgagggagagcgggaaaaattaaccggtgatcggagacgagaccaaatctgggaggcaaaatccaatcccagtgagaaatcccacttgtccgcgaaggagagatcccccatggaggccagatcgccattaggccgcctcacaatcgcctccgcaaaagaaggtcctcaccatcgttcgtcagtccatattgcattttcattctccttcaatcgttggtactctacttctatttcaaaatcaattatcttttcgccatgacaactatatttattgctcagggcaatacaaggaggtgcggattcactttgtggatccacaatatcaaaggcggtagccacctagcagcgatctctacaaccacactttggatactcataccatttaggtaaatctaatggattgttcctacagtctaagcttgcaatttgtacccgatgttcgtactctatccaagcctaaatgaaatgtgtggttgttggcggctattaaatgtcgattctataccaccaacatctaccagataataaaacatccaacatagagataggtgtttaatctcacatatttcacaagtgttagtgtatatttgtatgcaggtgttaaaccccgaagttgggaggaaatctagaagtgaaaagaaacatgtatccatacgaggatgggttgtgaacttcatcaaaatatcaaagactcaccccaaaactccgagaaatggagagtcaggggagtccacaagccgaaggccagccccggatggcccagcccaggttcgctcctctgatcaccgttgatctggttcggctaaactccctggttcggccaaactcctctgatcaccgttgatcctagggtttggcgtggacgctccagatgctctcctcatgacggttgcggggcagttcggacatttccccttctcacaaccgtcataac

SEQ ID NO: 31063 - DNA, 1501 bp, Oryza sativa
aaaaataaactaaagcaaactacggaacagctatggcgattccactccacaggcaacttaacccggaccaagcctagtcctccagatcatcaccttcactgaagaactcctcttctgatgaatgaatattgcaagaatgagcatatgacatatttaacaagccacacagcaaatatgcaagtgcacagaataacaaaggatggcataataaagctcatttgtgtaaacagcatttaataaatatttaagagaatagttcaacagttgaataattaatcagtattagataaacaccatacaacacacccgtgttgcataggcccaacctcatctgaacaaccaaccccggttgtactaatccaacctccataccaggaatataccattccaaaccaggagtcaaattgattagcacaattaccattaatgaataatgtgggactaatcacaaaaaacattgctcaactcacccataaccgcgggcacagctattcgaatagttttactctaatcagaggtgtaccactgtacccacaagacacaatcccacaacatgtcaccatgcgcctcagtaccaccacggtaccttggaaaggaactgtgacaatacccctcgcacaacacaactcaccacagtgcaccgttcctggattataatctccccctcaaaaccagaggcaatggactccccagcgaccccaatggacttctcaccgcttcacagtctagcacactataatgagtcatgctatacaaaagataaagccgttgcccacgctggcttgtggttggcacggtaaatgtttcacaacagtagctcgcgaaccggtccttaattgtcatgagcacaaccatcaaaaccatatgctcacaacccaccttatgcaggttttaattattaattaattaacataacataacacgattaaccatcgtgagctaccattaaatataaccataattaataataatataatatagttttatgtataatcccatttgtcggtgacatgggaccgggggtatcgtgactagaggtttgggcagccgcggtcacccacgtggcctgaccccctcgggggggtcgggcccgagggtgacgtggccacccctccctctgtctccccgaggggtcgggccgctcccgttttggccccgagggctggggtgccctgaccccttgtgatttggtgccacttgtatgggttaggtgagcacagcggggctcacctaaccgcatttattgcgggttggaggagtgcgccgcgccgcatttaatgcagcgcagcgcaggcttatccggtccgtgaccggtcgcagtgtgtgactggtcacaggccggtcagatcgcgggttagggggcgacaggcggcctgtcgcacgcctcgccccgtcccgtcggaatgatgagagcctgttggcactcgtccctagccggggccggcgtggtaactcctggagttagcacgtcagtcccggctagattcatgctaggcttcat

SEQ ID NO: 31064 - DNA, 1501 bp, Oryza sativa
ggggctactataataataatggagtgtgatttttatcaattcaatttgcttatttggtttattattgccttgcttgattttttgacttagtccatgaggactgaaagtttttaatagcttttgtgggttttaggctcaataaggcttgacaaaggcttttaagaaatcagaagctaagtatgaaacactgagcacggcataaatttatcagtattgtacaaattgtgcctccatcactcatcatcaaaatcattgatacatcaatcagtgtcagtcttttcatcatcagaactgtcaggaccagtcggtcgaagatcggtgtcctggaatctctctactacatcaactgctattttgtcagcggctttctgcgcatcgttgatgagatcgagagtggcttctttgctcgtcccgtctgcaaagccatcaatggcgtcaatatcgatctttgggtacagggatttggtcatcgccagcgccagacttgctcacatactcccggcttccttgatgttcttgaagtatgtatccggagcgactcttagcttgtcgaagatctcggaagcgtcgaatctactcggaccgttgttattaaagaacattgcttggacgagtggagtagcggcgttggcaacttcgtccctggccccttcaagcattttgattttgccgaccaggacgtcgaacagagcttgtgatttgatcttgcggtctacatcaacagaattgtcacgcccggaatttctatccaaaattccaaacgcttacatgtgtgttaaaccctcgtccaggaatcagccgaggcacacaataacaaattgataatagagtacaaataaacaactatttaatattcgcaattaataaatcattacagaggtagatagttcctctcaaacaataacattctacgcagcggaaaaataaactaaagcaaactacggaacagctatggcgattccactccacaggcaacttaacccggaccaagcctagtcctccagatcatcaccttcactgaagaactcctcttctgatgaatgaatattgcaagaatgagcatatgacatatttaacaagccacacagcaaatatgcaagtgcacagaataacaaaggatggcataataaagctcatttgtgtaaacagcatttaataaatatttaagagaatagttcaacagttgaataattaatcagtattagataaacaccatacaacacacccgtgttgcataggcccaacctcatctgaacaaccaaccccggttgtactaatccaacctccataccaggaatataccattccaaaccaggagtcaaattgattagcacaattaccattaatgaataatgtgggactaatcacaaaaaacattgctcaactcacccataaccgcgggcacagctattcgaatagttttactctaatcagaggtgtaccactgtacccacaagacacaatcccacaacatgtcaccatgcgcctcagtaccaccacg

SEQ ID NO: 31065 - DNA, 1501 bp, Oryza sativa
ggtgatgaagacctccctcctttgatggttcaccttcaagaacctacgcaacagcataacgatcacatggatatgcagccagatgctccaccacaacatgatcagccctgggggaattgggatcagcaaggggagaataaccctgaaaatactggaaactcaggaataagtgctggccccaaccaaaatttggccatgtctattttggagaatgaagcttcccctgtgttctttgtgctagattctgttcagggcaaaatccaagaagtagtccttaggaatcaggttctaaggcaactgtcaaattgaattcaggggcctccaactgttctgttggttcatgcccctttcattagcttggtgctcccaagaagaaatgttgcttttgattctttgccgctagtttatcactcttcacagttgcccctggtggtcgttcaacctttgggccatgatgaggatatggaccatgacatgggctctcccctgggccatgatgagatctttgatgttcaacccttggcaatttcagagccactagaccaggcccagcccaagagcccaccaagaatcggaccagtgcctctcctgttagaacccccaagagcatcagttaagaagagagatggcaagactgtcatgtttgatcctgacaggaggcagagttctcggttgagatcttcaagtcaagagctcactcaacctgaccctagaatgggcatagggaagccgaggggaaagtctgccaaaaaactgaaagagctggtaggtatctcaaacattttaactggcaatagttctttatcggcttctgattttcattctgatttagatgaagaatgtttctctacatctgattcctctccttctgactgttcaatatctttactcgtgtcattagtaccatttccctggatcaagtagtctggtactcacgattacattgctgaaatatcaagtgcgcatacaaagattgtctagcacgaattattacatcataggcccgcaggcatagtctagaacataggaccgaacggtccggaatacattcaaaagcagaaatagataaggcagcggaatttaggcagcggccacaccattgccacaagcaatgaccgtaactaagacctacggagcgttgtcatcctccgcatcctcctgaagataagcatagggatcctcctcgacttcattgccatccactgattaaattttgtaacagcaagagtgagtaccaaccgtacccagcaagccaccacaacaacaatgcatatgatagaggtattcaaagtatggctattggtttatttgcgtaaagctaatttctcaatccttttcacaagtctaagacctagcattgactagtcaagttttaattccagtatttattacacagcaacggttctgttcaccatccattgtcttccgaaagatggcttcccgctactggccgtcatggttttctgggttttatcccttctcgcctctcgagaagttgctc

SEQ ID NO: 31066 - DNA, 1501 bp, Oryza sativa
gctgcgaccatagccacacgatataagcaattatgtggacatcgatgtcgaaacaagatttcggcaattctaaaaaggggtggctatcaagctggaaaagtggatgggtttggagacaagaaatttttatacaggttcaggccttcttattcaagaagtaataccctactcctgtccggggatgattccgccgagtgtattattgatcgtatgatctgggagaaaatcgtgtcccaagaaagacccggacccctccttatataggggaaggggtccgtattacaaaatacagtccatatccctaacagaatacgggattacagataaaatacaatcgtaaccgactaagaccccgggtactttcttgacgtacaagttaagaaacaaacccgagttcccataaagatattctatctatattcgataccttgtatcctacctaactataactgtcatgtagatatggggtatccataatctccacagtagcccccgagacctttgcagtcgacgaaattgtcttcttaaagcaaaaaacaataatccgagtgttttaattcttcctgctccagcctgccgagttttaaaatcaaagactgtaaagggcgaaaataaaacatggtgcatcgaatagatgcacctaattaggtgtagcccccgactatgtggttagttaaaaaactaaacatgtagtcaagaaccaagtggtttcacaaccaaacatcatatagcaaagcatacgcggcgttcaataaaatatccagccgactgctttttagctttaatatatcaagaatgataatatgaaaaagcccgagtgataaacactcaaaaggttcatgaataaacatatttgacgagaatccgagtaaaaacgcttaagatcatccatcaaatatgataagaatcatggcagttaacaagtctaatagcctaggctatgaccctcaccataaaaatgagcatataacatgccaagagaatgaccattagaaaactagtcatctcgaatcaacccaaacagcttttgcagcttaaaaaagcttacaaaaatagtataacacttttctgtcgggtgcctttttatttgcatcgtagtaattccaaagaattaaaaggattttaacagcatcgggtcactccattgtgagcacaaattgccaaagcaataatgcccaagtccctagggatcacaacgggccacgctgataataatattgggctgaagtactatgtaggcccaggcccattagcactcccgataccctagcgaaataaacgccgaagtcaaagcgtcgtttcgtcttccccgccgagaccctcgccactttccccatttcttgctacagtgcagaacttcaccggcgaaactagggttcaccaatccgcttcaatccatcctcaaaaactccacgaaatccttctacgcaaccaccacaccgattccccacccccttccagccatatcccgaactaaattaagccatccagttcatatcca

SEQ ID NO: 31067 - DNA, 1501 bp, Oryza sativa
cttgccatctgaacatatatgcaacaaatccatggtctcctatacaaaaccctaattccaagagagagagagagagaggcgcaaaagagacagggaacagtgtgtaagacctaacctggcgctctatggagcggagctcctcctggagcttggcgcgcttgctcatcagggcggagagcatcgccgtggggttcgcggccgccgcccccgagggtgcagagcccgacgctgccttgtgcgatgcccctcctccgcctcccgagtccatggtcagggtttctagggttcgagttcgtggtttgcctgtttgggcgttcgttctgttttggctcggagacagttcactgttgtggagacgacttagcccctcctctccaatagtacgatcggtcctcttagccaaggtaaccagtatcaagatactatgtaggatcctttctcttcttggtttgatccttctcgatcggtttgattccttctaatggagaaagcttcctgtttgctgccacctgagctgtcaaatgcacatgtgaaaatgtttagcaatcaatgcatacatacccatgagtatcacacagaaaaggttaatagagtatttagcagaatttttttctgttgagggatgaatttcactccaaataacattattggaatacatttctgcctataatctaagatgcacatgttttatgagcgatttgatcatgaccacaaacatgagataatgtccataccctagttagttgcccgtgcattacaatgggaaaagagcatttggctatgtactccttcccatcacgattatttgatccaaagtactgaagtatcccgcgccaaataatatgactcggggggcaacaaatgaaacatgcacaacagttcaggaccttgagcatagaagaaataaatgatacaacctatgtcacttattatctacaacacattgacctctgtaataacagaatgacattatcaccatagatggtgaaacttccttgaaaacaagaattaatcgttatatctattcaggcaattttaagcattacgaattctcatcagatctacaacggtgcataacaaaaataaatgctacattattccactgtatgtaaacaaattagtgaaatgagtgaaataacagggggcagatccaacttgggacatgggggttcagttgaaccccccaaacttttgggggaacaacaaacaaactcaaactgttacttgtattaaggttaaaggctctggaactaagagaagagcttcttccagatctacaagagaagctagggtttaggcaagcaaattccaagacagaagcatccactctagtgttgtagtcattccaatcggcagagtctataggcattttaacacccttcgaagacatattttgagccatgcctgtcatccactcactcacaccaatacttttttcaatgccaacatatatcataggttgaaaatttgagatgcttcattttgactagagtttacaagc

SEQ ID NO: 31068 - DNA, 1501 bp, Oryza sativa
gtatttctatatggactctgctttttctttctatatggactctagtctcctcttctaatattccttagtttttaattccgaatttcagctatttctaaattgtatttctatatggactctgctttttcttttttctccgattaacatgggaatttctagcccatgaaagtgaacgtgatgcctcttttttctattcctttaataatataatagattaaaaatttgaagaaaaagttaaagaactaaaccaggccttactctagtcaatggctgggataacgcacctgatctagcatgtactcccagacggcaagattgcacgcccaggattacgattctatgcatcggctacaaaaaaaaaagttgtggacgatactgatcgccggatcccaagattcaaatcgatctggtggcatcggctggtgctgacctgctgatgcaatcgccggccctgccaccgaaccagtaccaacggctcaatccaatccgggcccacctgtcatacaaatatccacgacaactctcccaacaaaatcatttttttcaaaccgcccctggcccaccacccagatgtgtttgacccggggctccaagcctccaaactctcgatccgaacagcgcccacccaataggaccacgccacgtcaccgcctacggtgttcgctgctcgatcggacatccctgccgtccgtcacgcgcatcaagattcgcgcgtggttcgccgcacgcttcagccacacccctcctcgtgatgggattccccttccgcaccgagaagaatttgaaatcctggtcgcttgaaaaagagccgttgcctcctctttcatcgttttccccaccacgcacacaccacctgctcccgtccacgccacggcgcggggactctcaccgacacgtgggacccacccgcgcgtggggcccacgcgtcagcctcgctcaccaccaacggtagtgcggggcccacctccccccaccccccgaattcgaaaaaaaacccaccaccattcgtgctgccgcttgcgtgttgttattactccttggatcgactcggccagcataaatgccccgcctttaatggcttccccgatctgatgcttccgccctccgcttctcgcctcgccgccgccgctgccgagaataccgccgctgcggcgctccacgtcgtcgccgtcgccgcgaggccacgtcggtaggcaggtactcccccgtgttcttctccccgctctctgttgttaggctcgtgttgcgtcgcgatcgatttgatgaggtgtttgtggctccgatccgttggtttctgtacgggtgaggtgaggtggatttttatgattgattttgtggtaggtgttgtattggtgattttttgttgcgggggatcgagcggatcggatgctgaagaacgggggagaaaagtgttggttttaagtagagattgtttgggatttgaagggagttgctacgagcgatggggacggagaaaggtggagcaaagattggtggcggc

SEQ ID NO: 31069 - DNA, 1501 bp, Oryza sativa
  unsure (1)..(1501): unsure at all n locations
actggttttcataaaccgagaccttgcagtttcacgaaatccgattgattttcgtgaaattccatcggttttgtgaaccccgttgtacacctaggacggtagatagtctataactattcttgcactatttgaaaatttgatgtacggtaaaagaataacggttttgaattttttaaaagaactggtttatgtttcttaggatagtgagtctatatgcaagataagttcgttacgattttaggtcattttgtaaatccgaagacatcatttactacttactgtagaacagtacaacaagaaaaaaatatcttcaaaacataaaaatattatggaaccggaagggcgctacgcatcagatgtcctgagatttgcattatatgttaaaaaatgttgcaatgtttcattgctcgaaaaaaatgtttcaacatgaattgttttatgatgtttcatctttcactgaagaatgtttcaccgctttaacgaaaatgtttcaatcaaatgtaacactcaagaacggtaacaacaacaacaaaaacacattatgtgcaacatccaatattgatttaaaaaacatttagaaaagacatattgcaacatcgcaaaaacactgtatgcaacaatgctcgctagctcgacctcgtccgagcgccgccaccggagcctaggcacagtggaggcgtgcttcgcccctacctcccctcgggccgccgcaccgccgcgcttctctgctccggcaccgccaccgcctcgtcgctccgcgtccgcccgcttcttgtcgttgctagcacacacatggggagataagagagaaaaatgaatggttggaaataaagattagattgactgccggagaaagaagatagagagagtagttaggtgggacccactaggttagcgtccgattttttatcatatgccggacgtacgagttaaagcattttcggaagaataccagtactaccgctctagacatgtactccctccgtttcaggtcataagatgttttaactttggtcaaagtcaaaccgcttcaagtttgcccaagtttatataaaaaaatagtaatatttttgacttgagatattataaaattatatgtaattattaattaaaaaaactaatttagtaatgtaaatattattatatttatctataaacgtagataaatttaaagcagtttgtgttggactattcttatagcttgaaacggagctgagtatcttaccactgttgtaaatttgttgtgaaccttgtgatgccctcgctggactgttccttggatcaaagacgtggcggcagtaggcacaccgcccaagttggattagttggagcagtaaatactatacaccccatccaaggaggcgtagcggctgacccacccccccnnntnnnnannatnccatacatttcaccgcccctgccttctcctcttctctctctctctccnntcataacccctcccatcccatctccctccaccttcccaaatcccaaccctcnt

SEQ ID NO: 31070 - DNA, 976 bp, Oryza sativa
ggttatttcaaccgggactaaaggtagccatctttaatcccgaatttgccatcccggttgcataaccgggacaataagagcttcccaaccggcggcaaagatcacttgtgcagcaatggcatgatatcctcattgttcggacgtcatcttctcccaacttaattcccaatccatcaccggcaatactctcttgagatatcaagacatatctacacattagtaaacaagaaaccatatctgagcatagttcttccacaactaccttgactcaacattagcaaaccacactattacacaagcatagaaatcatccagaagttataaacacgagataatcacaagtatccaaagaaacaacccgaaaccaactccaagcatgagcataccagtcagaccatttgactggtcggtctaaccgcacactacacgctggtctgactgacctacaccacctagtctgactagtccaacatagttagcaccacttcgtcgaatatccgtgaaatataaaaaccagtaatctcacatatcaattgttcatcacaaaatatataataataaaaaacactttgatttcacaagagtatcgcggagaataaaagatacaggtgaaagtgtttgggcccctgaaatttgtccaatgttctttacacagtaccttttttctccttgataacagatgtttacgatccgactttctaagcgcaaagttcacacacaagaacagctgacaaacacattacgagcagacgactaatttgagtcatcggagtggtaatggcgcggtggcacgagctcaatctcttcagcgctgctggagccttgagacggcgtacgtgccctccctaatcagccggggagaatgttgctagtccatcagcaccaagctctgacctccctaatcagccgctgctcgatcgtcagtgcgctctgaacgacgagtcagagacggaatatataccgaattactagtaga

SEQ ID NO: 31071 - DNA, 1501 bp, Oryza sativa
ggagaagagaggggaggggaggtcacataggggttaggggggtgttggccctccctggcccctacggtggcttcgccactgtccgtatatagatgttgcagattggttctctctacattagtattctttcttaaagtatgcctgcgtgcaagtacatcacacattcagttctttccagtaatttgtcggatttgtatatgtatggtcggtattgttttctttggtaacatgtcatgcttgattttttttttcctaaagaaggccccataatttatgtgttgtttcaattgccttcagatttatttcatgtaagaaacatgtcccatttttatcaacggcatcttcctgtgatgttatcaatgttggaacctccttgttctcatattaataacagggcttcgcggctgttttaatcgatctccatgcctagttcggtctgtactgtggttggctttggtgcagacatgcagtgcgcccacaatataccatatcgcattctcaattgtagtgtactaattaataatgctgcatgttgtctccattttatttcttggaaaaatacaggttccaatgtattgattttgctaaagatctctagatgtgtaacaaactagagtcattcaaattcaggattttgattatatatgatgccggatggcacaatacctcatgctgagtttccttgtgacatgagcatcagtgagtgggtgcatcacccaaggccaacaagttgcacaccacatgcatcctatcaatagtttgccaccatacaagagtcaagcatacaagagggagtgaatggtaggaacatcgaaaatcaaatttcaagttcaaactcaaatacattctcaccaaatctcaagttcaaactcaaattcatttaggagtaataaaaaagacaaattttaggtgaatagtgtcacgcccggaatttctatccaaaattccaaacgcttatatgtgtgttaaaccctcgtccaggaatcaaccgaggcacacaatgacaaattaataatagagtacaaataaatgactatttaatattcgtaaataaaaattattacagaggtagatagttcctctcaaagaataacattctacgcagcggaaagaaaaactataactacggaacagctatggcgactccactccacaggcatcttaaccaagaacaagcctaatcctccagatcatcaccttcactgagatactcctcttctgatgaatgaatattgcaagaatgagcatatgacatactcaacaagtcacacagcaaatatgcaagtgcacaggataacaaaggatggcataacatagctcatttgcagaaacaacatttaataaatatttaagagaatagtgaaaacagttgaataattaatcaatattaaataacaccatacaacacacccatgttgcatgggcccaaccatatttgaacaaccaaccccagttgaacaaactaaacctccaaaccaggaattaaccattccaaaccagg

SEQ ID NO: 31072 - DNA, 1501 bp, Oryza sativa
gaaaaaaatatgtcatgacctacttaccgtcctctccattagcttattttcatttcgatatgaattattgacgccctttttaagtgtttccatatcttctctcttactgcacaataattctttcaacttttacgtgcctctaactatactactgtaaaagtggaatcctcttctttccatctccttcttcaatcatcttccatcctctcttctttttcgtagcatatacttcctccgtttcacaatgtaagtcattctagcatttttcacgtttatattgatgttaatgaattcatattcattatgagagtagaaaatgctaaaatgacttacattgtgaaacggagggagtacactatatgagtatcatacgttaaagcatgcccatctttaattatataggtttgacccgttataacgcacaggatgtgcttagaaaagctcggacgctgcacatataaatcataaaaaccagaaatttcatggaaggaaacatccacagtggactcatgtctttatacgcgccaacttggccactggacgacaatggcactgcaaccgcttagccgtgtagactgcgcgtcaagtcgtcggtgactgattctcagaaattgcgaccaaactgacaggatctgattgagatttcaagaccgagaggcattatacctgccttgctgcctctctgaacctctcatccttcatcgtcagggcaaggcgtagtatcaccagctcatctgctgttacagacgggctcttgatctgcagctcaggttagattgatttgtactgaatcttgctttgtatcttttggtttggtgcttttatgtctatgtttgatggaaaattcttggcattgtggggcttgtgggttttaatgcttgcaaaaatcgaagatttgacgtggttttcccctcagtggcatctacttgcctagtttaaacctcaccggatgaacacaacaacaaaatccagccacggtttcaaccgtttagacggatgcagtagaggatacctcttgatttcatctccgaaatttcaacttaaaatacatcttgtagaaagaaaaacattaaagacaaatatcgtcaaaaagtagagggtaaagtgagccattttcaatatcgtcaaagagtagagacaaacaacttactgtgaatgaagctattcctgctaaagtgtgtgtgcattcttctggtgttcttgacctcatatttatgtccacatctcattaaaaaacttcaaactgaagatagtaaatcacagagaacatagctgttttaaagcgtcaaaaacaaatggattaagtcctgatattattgaggaaagccaatttgaaacattactccaacagaaaccagtgtccaggtgccttcagcaagacaagataaatgtgagaaaataatctgaaagcacaccggcttgtcactaattttgcataaaaaagaaaaatgataagatgcatacttcagtggattttgaatccacgtcattagaaaaacta

SEQ ID NO: 31073 - DNA, 985 bp, Oryza sativa
tttcagacctcaaaagctacgcacaccctccgatgatcattagtgaatcggatcgttgcatctgagccgtccatcttccgctctttcctattcatgtctgaattcctatgcttcttcagcagttcagagtttcagacttctgacaatacccacccttaagtatcatgtcttcatggtttgaaagcatgaaaaaccttggtgatgaacaaagcatcctcctatgtatccgcctctggtggaagattttcccattgaatcttccattgaatgacaggggtgttgtttcgaggtatcagacgcctctcttagcagagcaataggcactgtgaggatattgccatttgtatcaatcaagggcaaccctggttctggtatagcttttgctccggtatggcacttcagatggctcacatggaagacgggatggatttgagagtgttcagcaagaagtaacttatgagcctgcgagctaattttgtcaatcactataaatggaccatagtaacgagaatgaagtttaaatgagctgtgcaggcctaatgcattgtgtctataaggctgcactttgagataggccatgtccccaacttgtaatgttctttcacttcgtttgacatctgcaaaatacttcgtaaaagcttgagctttatctagaccggcctttactgaatcaattaatgcagctcttgcttgcgctctgtttctgaagccttccaacaaaattggctggtatgagtgcttcacccaccattggtggtttttgaccataaagagcttgataagtagatatgttcaaagatgtatgaaaagtagtattataccagcactcaacctgatcaaggtagagaatgctatttctttggttttgtaactgttagacatcgcaaataggttttcagccactgattcacacgctcagattgaccatctgattgaggatgatatgcactactgagatgtagttggactccagcttccttcaagt

SEQ ID NO: 31074 - DNA, 1501 bp, Oryza sativa
gtagattcttgtaaaggtttgagagttgatgcatatttgttattacataactggttcataataatgagatcgggtatttcaaatcatttacttgggaggtattttttttgttttccttttttacatatgccgtacatgcatacagaaatatctaattatgagactccctgatggtagactttcagaaatattttaataaactaaattactttctggaccttgattcacttgctccctagtgtttgagctgctgcctgctggtgcttttcacatagttattgaatttgatcatattggttacaattgctcattaaaaaagtgaactgatgtgaccttgattcacatgtgatgcgatcttttatttcttcattagctgaactgcctaaacaattttatttcttaatgactataggtattttttgtctctgcttcagcaattcgatatttttgtctggattactttcttgtcattagtagtatggaccttgtcagtcaaagatatgtctggtgataatattattcaaacaggaggattatgagttaagaatcatgttgtgctagctaagattttagatagtttttctaatgacgtggattcaaaatccactgaagtatgcatcttatcatttttcttttttatgcaaaattagtgacaagccggtgtgctttcagattattttctcacatttatcttgtcttgctgaaggcacctggacactggtttctgttggagtaatgtttcaaattggctttcctcaataatatcaggacttaatccatttgtttttgacgctttaaaacagctatgttctctgtgatttactatcttcagtttgaagttttttaatgagatgtggacataaatatgaggtcaagaacaccagaagaatgcacacacactttagcaggaatagcttcattcacagtaagttgtttgtctctactctttgacgatattgaaaatggctcactttaccctctactttttgacgatatttgtctttaatgtttttctttctacaagatgtattttaagttgaaatttcggagatgaaatcaagaggtatcctctactgcatccgtctaaacggttgaaaccgtggctggattttgttgttgtgttcatccggtgaggtttaaactaggcaagtagatgccactgaggggaaaaccacgtcaaatcttcgatttttgcaagcattaaaacccacaagccccacaatgccaagaattttccatcaaacatagacataaaagcaccaaaccaaaagatacaaagcaagattcagtacaaatcaatctaacctgagctgcagatcaagagcccgtctgtaacagcagatgagctggtgatactacgccttgccctgacgatgaaggatgagaggttcagagaggcagcaaggcaggtataatgcctctcggtcttgaaatctcaatcagatcctgtcagtttggtcgcaatttctgagaatcagtcaccgacgacttgacgcgcagt

SEQ ID NO: 31075 - DNA, 1501 bp, Oryza sativa
cttacattatttaatggagggaatacctttcaaatataaacgctcacgcatatacgtgggccaccttcctagttatatataaaacacaagcatgaatccatatatgaatatattcaaaatctaaaacatcttataatatgaaacataagtagtttctaaagaacagcttgcaaaacaattcccttgtagaaagatgaaaagactgaaagcattgagtacaccagaataagtcatctgccaaagaaagcataggtgattgccaaggaccatcaagcctggaagactgggacgtagtagctaggcctcgcagcgtaacaaagaaaatgaaaactgtgaataaatggcacataaaaacgcaaaaccatccgtgacagtaagtgatgcagatactgtaaactaaacagttctcagtggagtcttcacaattgagcccgtttcctaattctatcttaatataaagttatcccccactaactctttaagcttaacatacaaagatgtcgcatcatcatccactaacaatcatcacatttaaacatcatgcaaacatgctatatctttatagtttttataatttaagagtttttcaaatacaaatatgtgaaattatcatccaacatgattcacataatgtttcaatatatatctttattatattttatgatatcctctatacttatatggttcatcctcacttagttagtgcttaaatgattaatctatggtccaaattatctttctccctttttcctctaattaagtcatatcacatcaattgtttttagcctttaaataattaatctacggtctaaactatctccctacttttcttcttccataaagtcataccaccttactttttacgtttgaatcaccattctacatactatttaaatttaaattatcataaaccacattaatttacttaatctgatattatctagctatcttacacgttattttttttatttttatcatactaaattcccgcagcaatgcgcggggtttcagctagtattttctacttatagacctgtaggaaaaaaacattaaagaaatggacccttttgaacagtgccacatgccatttggctgtatgttcatagaatcgcactccatataagcagcctggtcgatgcagccactaaaatcccacaaaataaggaacacagcgccaaatcttgcagtgccattctattcatgcttatggttcattatagaaaagttttatcaggagttaatttataattttttttttgttgaaactaccctcacgcaacagagtaggaacagaggggatcaaaataaaaaactcaagcatgtagggaatgaactgaaactataggctcaacatgatgaactgaaaactgactggaacataggtttttcttttcataaacttgttgctaattacatgaatcgatcctctgggctgtgctagtttactttagtttgttactacattatgtaatacagtatattcacctttgttcagctgaca

SEQ ID NO: 31076 - DNA, 774 bp, Oryza sativa
gtcaaaatgtcttataacatgaaacggagggactattagacaactttactctaaagataaatgccaaactgtttcatacatttaccgatgtgagaaaacagttgacaggtaaaatggaagccattctattcaggtggtgttacaaataatagacttagtgaaatactccatctatttcacgttataaaacgttttggcccctccatcccttgttagaatcactaacattcatatgatttgtacacatatatctattattaacttattataaatatttttatttgtctatcatttttttttaaaccggtgaacctattatttttggacaaccatatatatcttttgttaagaaaacaaaaacctcggaagacctctctatttttctcagcacaacacacgtgcgcgtatttgccttatgcacgcatgacaaggcaccgtacctaaagtagcttgggtgatcacgacgctgcaatgtgaagacatcaaatcatcaatggataattattgtttttttaataacataaaaacaaatcgaagatgtgatgtagagagaagagtcaagcaccgcgagttatatataattaatttatatttatatgtatataaacagggtaaagctagaacaaaaattaccctatgtcatatacatatatattacacagataatattctaattacattacatgtgttaactaagaacttgttttggcgaaaaaaaattagaccatgtgtcttatgcacgagggagaagcaacgtgttgttgttactaggga

SEQ ID NO: 31077 - DNA, 299 bp, Oryza sativa
aatcctctcctctcaaacataccctagtggattaggactatttgcatgagttggatttgtggcttttgggcagccacctctaggtataaatagaagaggagttgagttgtctcggaattgattttgtaagagatgtgttgagagaaaacttagggtttagcttagattttgagtttagtcaaaagttgagagaagaatgttgttgctgcattttgataccacaattaaaaatataaatttgatatattttcagagagttctttaatttgtgtttttctcgggctcgatggccacacagc

SEQ ID NO: 31078 - DNA, 478 bp, Oryza sativa
ttcaccaatcacgcatattgttctttaacctaaggatcccgcacactactggagaagtgatctttgtcgggttagccaaaaaccacattagtcccggtttgaataggaaccgggactaaaaatcattttttgtcccggtttagaacttcaatgatttttagttccgggactaaagatcatatatttaatcccagttgtttatatcaaccgggagaaaagatcaaaaaaacgcgcgcgccagagcaatctagaaaaattgaggagaggatgcgcgcgggggaggatactcgcacggttatagagggaaaaaaaatctatctcctccttatcttcttctcctctcctctcctctcctcttcttatcttcttctcctctcctctcctctcccttccagccctctcctccccctcctcccctcctccctctctgcccgagcccggctcggccggcaccctcctccctctctgcctctccaga

SEQ ID NO: 31079 - DNA, 1501 bp, Oryza sativa
cacgcaggcctcaccggaagctttcttctctgtgtacaacaaaaggctgatgattttgggaatttttggggaatgctacaatactaaaaaacttgggctaaaattactggaagtagatgttatcatgaacttcatttggtgaatttttgagatttttctcatgtatagttttccaatgaaaattcaaaaatcttggtttgcatatacattatacatcgaagggcaaaatagtctttgcacagtatctaactgagtacaagtgacagagtagtgacggtgatggcatttctgggacaaaatgactcgtacgatggcatttcctggaagttgcgttcgtcgatggcatttcttggattagggtgcttgtgaatggcatttcatggattttctctttaaaatgttgtttttctttttgtttttgtttgtagatggccggcagcgtcacccgtcgtggcttggacatgactggcttcatcttggagctgcggggcatgtgcgtggtcctggggtatccacatggagtggactaccaggccaggccgctcccggagcaggagggtgacgatgcagagccccacgctgcttgggaggttactgcagtgatcctctctggctctcccgagcggacttcgctggcagtcaccgcgggtggagattctttccccgccgcttgccagaacgccgctctcctcgccatcggcacccttcaccagcgctacccggacgagttgcagcactcgccctaccgctaccaccctcgtcgcggaggagcccgcgactacgccaccttccgggatgctagctcggaggatgacgctaccatcgtgcacctggcgcgcatggtggaggcgtacgacgcggctcgtatcgacttccatcagatggtgcgccgtgggatggtcgagaacaacttgaagatcctggagctgcgtcaggagaacctgcagctcaagaaggacctagacgcggtggaggcgcagctgcatcagctcaagatcgcccagggagaggtctgctgccccaagcgtcgccgcgtctgccgcagccagaagatcaccgcccgcaagagcacctccaggcccgagcttgttcgtcagtccctggcgtggacctgcttcgtcgagacccctcgtgccgagcccgcgcccgtggttccccaggagggggaagcctccggcgttggtagcacggaggatgcgctgttgctcaccttccgtcctggcccgtcgcagcggtagacgagcagttagtaggctggcgcgtgtgttctttctcgtttgtcttcttgttgggttgtgtggggcatggttatgccggtgtgtggcataactgtgtcggagcctgtctttattttatttgcctaagcaacttgaactttaatgaacccatttaatagcagtaataaattcaagaattatggtagtcgtgggtggttagttttaattgttagctctctctgtttgctggtctgtgtggggttttcagatggtgatgaccagga

SEQ ID NO: 31080 - DNA, 1501 bp, Oryza sativa
ttcttggtcgtcgtcttcgtccaccttttggtatgctcgattttttaaaaaaaattatgactctttttgtaaaacttatttcataaatagaccctccaaaaatctaattatggatatggactctactcggtgccggtgagcttggcatcgaggtttcatgcacccacgctggagaccttggcatcgagttagagggggagggggagagagtgtcgatgttgtagatcacgactatggtatttgcaaagtttggggatcattcgtaccagggtataagcgagactaaggtaaaatagacggagacaaggattttcatgtaggttcaggctccttatttaacaggtaatagccctactcctgctaattgaaaccagtgttgctcttattcatcagaatcacacaagtacaatatttgggataactctaatcatcgtcaacacggcggcatgaaccaccacacgttgtcgacaacagggtagtcctcctcctctaatatgaactgggcgatatcagagatagcgctagatccctcttgttagcctctgtggcaccagattggatctgtttaggtttatctcttatgttgatgtctggcggcatgtattgatgtatattctgactgttgcctgtctatttagactcggcttgtcttggtccgtctccccctcttcttttaggggtcttgtatttataaccatagatgtccccttatccaaatagaactagaaagataaatatggatacgatccgaatagtccttgtagtttccatatagaactctgcttctccttccttatctggaataccttccatatgcaagatttgatttcatataagacttggtatatggtgggtcccgttgagcttaacccaacactattgggtatgccttacccataaaactgacagggggtaggcgccatgcttcttggtgcggacaccgagttgtcccgagatggcatgggatggcatgagtgtacagcgagcaccaagagtctgagacaccatggaatggcacgtgtttggcaacttttttgacaagtagacaaacacgatcgagacacctaaacgccttgcggtgattgtagtgtcgccaaccacctcaatctagcaaaagctagaccaagatgggttttgataaactaaaccggctagcggagccgatttagatagaacaatagataactatccgtctcgtgggtaaacggaaggtttacgggacaaacctacaaaggatttcgcactctcgtagtgaagacagacgatttatggcacaaatcgacaaagatggatgaactagactagaactagattgaaatattgaaaaagcgatttaattggctaagttggattgtgtgtagattgtatgctcaattgaaccggccttgtcccttatataggggttgatcttgcctcctacaggtcctcctccacgtcgaactcgggatagaattcaaaggaaacccgaaatatagcctcctgagtaaggaatcctgagaca

SEQ ID NO: 31081 - DNA, 260 bp, Oryza sativa
tttggttttcactcaaattgctgatgaggtagtcaagatagagaaggaaatcaagcaagttgtagaactcaaggataagtggttgccgctatgcccatttgtttctcacccactcactgagatggagagacagaggtcccaagacatcttcccggaacttgtcaaagatgaagatcttgtgggtattgaggacaataggagactgctgacagaatggctatattatgatgagttggacaataaggtgataacggtgtcag

SEQ ID NO: 31082 - DNA, 922 bp, Oryza sativa
cactgttcagacttggataataatggtccactgtgagaaaagaaataatggtactcatgcaccgtgtccatagagtaattcttttaccacaagcatctatgatctcataaaacgttttatgagaagttaatggcatctcataagatacaactcagcaaataaatgacaagctttatttgatttgcttgtgggcacagagtaggattccaaatcagaatggcaaacagtatcatatatgaaggccagtgctaagttatattttattaattgacttggaacattttttttttgacaccttactttggagttcggaaatcggctacgagattttctggacaaactatgctttcggaagagctctcctgcttggctcagtaaaagaaacattgctataatgttatacatcatgaagtacagctattctgtatgtagttgtttactttaatttgagtatgcatttattacatttcaccaacatacatgtgtttagttcctgaaattggggagaagtttagggaaagttggtagtttggaaaaaaagttgggagtttatgtgtgtaggaaagttttggatgtgatgtgatgtgatggaaagttgggagttggggggaagtttggtgtgaactaaacacaccctatacagcttcagctgaagcaacttgtgggctgaacatagttcatacatattcaaagaaaataactggttcatcaacaagacagtgagcagaaagactatacattagacaagcaagtttagcagcattacctggaacattagactaacaactatgaagaacaaaaaaatgatccgtagaacagaacacacaacaaatacactgccatactgagtagtgatttatatgcttgctcacctgctggaagaccagagaacagggctggagcgcaggtgctgtacggtcaa

SEQ ID NO: 31083 - DNA, 1211 bp, Oryza sativa
aaagagttgagagtgctaaaacaacttgtatttactttaaaaatcagaaagagtaataatctagttagttgcagtttctttaaaccaatagttgcatttacgatcaactgaaattaatcttgccatgtaaattgcaagctgcttatgctgtcgctgatgattaatccgtatggcttctgttttcttttatttttaaacaaatgcttagccggattatgtgtatgtgtacctttttctttatatttctctatccaattttgtccaatactgctacagttgggccttgctttagtactcctcccaggaaaaacttagcagatcttacagctcctaagaaaaggttttcgcacccatatcccaactgaacaccaacgcgctatttgcatctaaagttgtaagcatttcatgtcttagaagtagttggacgactcagccaccaacctagcattgatgactagaaaacagctttgaccttaagtagctactagttcaaatcttttgttttttcaaaacctgttttcatgctcagtttggctcttctttctcaagagaaataaccctgtttctatatcagtgactataaaaatcagggtttgtgtgaatacaaagcggttagaaaacatattggaggagtggttttgcagtgctcttactctctaactgatcaactgtgaaactttgttcattgagatcttttacagtacttggaaggtacctccttaaccaattgatacccatcattaattcatttttttcgataacttctaactgggctcactcctggcctctgcatgaaatgcacacagctacaaaacaggatctaactagactctcaacacaaaactaagaaattagtgactatcaagccgaagactagatcgccacccatgctctagggtaaaaaactcatgtaccacctgatccaaacaacgcgataccaccacaatacctgaagacccggtttgtggaggatagacctggtgcgtagccacctggtgactaaagcaataacctgcaaaggagaagataccatcttattatcaaaaattgccccgtttcagcttagccaaatggaccaacaaatagctgttgcacccatcaaaagcagatttctcatatccttaggaacacatgtaaaccaacgcccaaacatatgattaaaattttgaggatgttgtaagttataagccatatgaatcacggatcaaacc

SEQ ID NO: 31084 - DNA, 643 bp, Oryza sativa
  unsure (1)..(643): unsure at all n locations
tgattcgagttcgnnnnnnnnnnnnnnnnnnnatatcatgatgtatgaagatatatatgtccagtcctcagtcctatatccgtctctgtctccctctcaagaaagcaggtggctaggcttatggtagctgtgctgaggtgaggtaatggttgtatagccgtatcacgatggtattatcgagtttcagggtgctatcatagagatagcatcatgctcgtttatagaggtattattgcgttttacattgctatcatggtacattggttttatcaccatataacctgatattgtgatactacagtgtgtcatataactccactccggtgtgtcatggtaacttggctttcagttctagatttggaactctctacttttctgtgtgtttagttgattacagtgtaatagcggtgtatagtttccatgagttatatactcatgttatcttccaaacaaacaacaaactatagactatgcagacaactaaattaacgcagtaaaataattcagtgtgaggcctacggattggacaattacagtacagtgaaaacagaggctgtgcttgcttggcccatggttgttatttgttcatacggagtggatttttactaatgtccattcccttttgttgtttcatgttattagg

SEQ ID NO: 31085 - DNA, 1501 bp, Oryza sativa
tcaaattgaatgggatggttaattcaagtttttccattatctttatctaagtgtcagaatctacattggatatatagcagattgttcaaaaccttatcgacatatgctagtatcgttacatcggctttttggctatcggttctttatcatcaattatctatgttgtcagttatagaatcaaactgactgacacgcccgcactggagttaagcaaatttctcaggcccttgtgtgtcacgacgaattttcacatcaactgcttgatatcataacgagccagactaagccgagctgagccagcttggcatccaccttgagttacagtgtgtagcttagtatactcaagttatatttgtttcccagatcaagctagcacacaaagtaaacatgataactacatcacgatcacgattttattaataaataataaacaaatagtataaattttagttgtgacttatgaccaggttttataattttactagaaatatcgttagtgtgtcgtggatgccctgcgcattgtaatatagcacgatccgattaatctctacttttgggcttgatctggtttttgcgaacaaatttacaaagaaattgaaaaaaaaaaagcaggtattgagaatgagatcggggacctcttggcttatgcagagaccatgagttttctgaatggttctattaacttgatgctcctccgcaaccataagatttcgcatctaattttgattatctgtcttatttaattttttttaattagtatttttattattatgagatataaaacatgaatagtacatgtaacttatgtttttaattttttttatttttttaaataaaacggatgatcagagttgtgcacggaaaattatgaatgaacttacagatagaattatagggagtggttaatataatcgttttgacattaatgaaagcttcctttatactaaaaggaaaaaaaacgagtcaaccccgatgcacaaggggatcgaataggaggataagcccgtcgagtagccagaaatcgcagatggaggcagctattttgagcggtttgttgaaaatactcgcgtcgaggatgctctctctggtagatcagaagtacaatctgtacaagggattcaaaggcgacgcagaatttctgttgaaggagctccgcatgatcgccggagccattgacgagcagctcttgcggacggtgagccgtggaagcgtgctgctgctgtccatcgaagagcttcgcgacctggctcgcgacatagaggactgcgtagatcgcatcatgtatcagaaaactcgggatcagcaagcttctcttttcagtatcaattccgtcacgggaacgtcgaagcttcagttggccaaagagatgaagaagctgaggaagagagcagacgaagcgaaagagcggcgagaaagatacacggtggtcgtcggtcatcagtcctcccctgtcagctcggatgagcaacgctgctccggtgcatctgacgggagaaacctc

SEQ ID NO: 31086 - DNA, 555 bp, Oryza sativa
ataagtgcaatgaggaaggaaagacttagccacgtcagcctccctaatttaggccgtataggcagccatcgagtgtaccagctgccgatcttatcctccacgctatcctggcttatccccaagctaaggacactcacagtgcaagctactctatgagtgtctctggcccttttgaaactcaaaattcggtccaatcgtgctatacatacgaccttagtgtacgactccattctgactcatacatccaatgcaccccgtactaccatcagggcatagggccatgggtacatattaatctacggtggagatgcatcgttgtacgcctcggtcggacgaggtagtcgtatgtgtagcattattcaattcggtccaaggcctcccatgccacagtgcacgtgacctcctttgtgtagcttgagttagggcgagcaacagttaaggctacacagcccacaatgcaactgcctagggtatcccagcccaaagagtaaaatcacacaattgccctcgcccggatgcatcgacgctcccttctcccagtcgaccgcgccacca

SEQ ID NO: 31087 - DNA, 350 bp, Oryza sativa
atcatggcgaacatgattgaagcactcgggtttggagtaatctagttcgagagaagattatctttccgactgtgaaggtctcaggggctactgtggagattatgggtaccccatacccacacggcatggttatccgactagttataggggataacttatatatatgaaatatgtaacacatcatgacttgggtattacgtttccctgtatattatggaacggcctaaagtcctgctttgataagattgtaaagtagatttaggaaaccgataccgtagtggttaaggtttctatcttgtaatcctgccccccgtcctatataaagtgggcaggaagccctctagggggca

SEQ ID NO: 31088 - DNA, 990 bp, Oryza sativa
ggggcgcgggcgcgtcctctcccgtcggccgtgccggcgaggccgccttcgggcgcgctctcgcggctgccaggtgggcccggccgtcagccgcccgcgcccgcgggtgcggctgacgcgtgggacccacggcgccggccgccgccagccgcgtgctcccggtccaccgtggaccgagaggctgacgcgtgggccccactcccgtggacccggtccgcgcgccctctctcccggctgacgcaataattcgattttaaattaaaatttaaatgaagaaattcgtaaatatccatttaaagagcatataaacttcaaatggccataacttggccatttgaactcggaattggaccgttcaagtctctaattttttccttaagaagtcaagaacccatttttgtgctttgtttctgctgttatgtggaatttgttagagtttaagccttttcttttccgttggtcgtgtagacgctgcagcttcggaagatccgctcttcgtggaagtcgaagccgacgtttgggaagacgagcaaggcaagacacatcatcttgatcatattgaatcccagtttataaaattatgttgatttaaattattgcattatcgctttatttaaattcccgcgttatcactgttttatttagccatgcctatttacctttgttatgaccatattattattgttattgttattattattaccttgttcaccctagaacaaacaaaaccccaactagtggacactctactcatagtaccactagtataattttaggtagatgcttcgcaagttaattaggcaacattaggtggttttataactatagactttgggaaatattcatatcacctggacactctggaattgttggtttattgtggaattggattcacaccgctccctctattcaaaagtccccaaaatggttttaggctgggctcggggtgcatggttttgatggtagcacctcggccatataaggaccggt

SEQ ID NO: 31089 - DNA, 364 bp, Oryza sativa
tccgtccgtgatgtgtcgaatcagatgccaaaccaggaatttaactacgagcttttcttgtgctagcttagctcatctaccaactacataagaagagtcggcggtgtatattttttctaagaggagattgatacgtgctaacttacaggcagcatatatattcaactattttacttgcaaaagttaaaaatgatttaagttaggacacatgtaaagcccacatcctgccttgctggtgtcatgtttctgataaagacgtgagcacggagggaggatgcgaagaggtcgttgcaatttgcaaatggttggattgcatcgatatatctggcccccatctgctaatgcaagtgaacgcttctgcagg

SEQ ID NO: 31090 - DNA, 169 bp, Oryza sativa
ttctcccatcagctaacatagcgtaaacatgctctagaattttcaggtacagttgatcttgaaaggaagaacgaagcaacaaaaacacacttgcacaaatatccaagatcagaataagtattagaaagtttcgcaaaaaagaataaatattagagagctacaaaacatt

SEQ ID NO: 31091 - DNA, 1501 bp, Oryza sativa
aagactccggattggtggtaccgtcatacttctctattctagtcagcttaaagctggccggccaatccactcgacgcaggtcgttggtgaaggcggcgactccatccacgtcgtcgtcgcagcgatccggtgaatggcggtgacctcgtgctgcacggcgctgaatgatcgtgttgcgaagatcgacgggacgtcggcgtggcggcgagcgaggccgttcaactcttcgctccctgtgtcgctcgggaggcgagtgaacagatcgctcgttgtggcccctgctcctgcgattggatcctgcgccggcgatgctgaggcttggctggtggtaatcctgagatcgaagatggggaacccggctgccagtcggcgtgcggacgctttcggagttaaccgggatcgtagctgcgatcatggtcttggtctggtttaagatgttgacgacgtgatcggattgattgagttcgttttccttaagaagggtgtcgagaagggtgatcgcggcgatagcgttctgttgtggggtgcggaagaccggtgtcccctcaacgttttgctggccaatgagatcttgtgctcgtcgccatgcatccaaggctcgctgttgtcggtcttcggcctcctttgcagcccgctcgcgttcttgttgctcacaccgcagccgttcttgttcttgtacttgacgctcctcttccagtcggcgtcgctcggcttcttgctgtacgcgtcgtgcttcggcttctcgggcttggcgttgttcttccgtctcgttgtcggccatgaagacgccgaagtagagaggggtatagttgtcttccaagctttcgtcgaagtcgtctaggtcgtggttgtcgtggcggtagccgaattcgtcgtactccacgatctcagttggacgcgagtcgacgccgggggagctgaagtagccttccaattgatccgttgaaactgtgccgagtggctggagtatgacgccgacttccctggagctaggcgggatcggtgttaaagccgacttccgcctaggcctacggggagaagacgccgttgtggtgaaaacggccgccaaatcgtcggggagtttcatcaggatcggtgggtaggccccatcgtcttgatctggtggtgttggagaagatgggatctcgtccgagtggtttgaagccgactcgatcgagatgtacttggggtagatcttggccgagtttggaattccgaacggggctgagacctggttctttcccgactggttcgaatccgagtcgaggaaagagatcttgccgaagttgttggtgatgaagtcgaggctgccgaaccgaaacgcctgtccgggagggaagacgaagtcgtcgatgccagagacggaacccatcgcactgatcggcgaaaaacttgacgcaacccctacctggcgcgccaactgtcgaaacaagatttcggcaatactaaaagggggtggctatcaaggtagaaaagtggatgggtttggagacaaggaatt

SEQ ID NO: 31092 - DNA, 1501 bp, Oryza sativa
ttgatgacttcggttgacacgatattcacctccgttctcctaagatcaggtgtcgaaacaagatttcggcaatactaaaagggggtggctatcaagttagaaaagtggatgggtttggagacaaagaattttatacaggttcaggccttcttattcaataagtaataccctactcctgtccggggatgaatccgccgagtgtgttattgattatatgatattggaggaaatcgtgtcccaagaaggacccagacccctccttatataggagaaggggtccgtattacaaaatacagtccatatccctaacggaacatgaggttacagataaaatacaatcgtaaccgactaagaccccgggtactttcttgacgtacaagttaagaaataaacccgagttcctataaagatattttatctatattcggtaccctatatccaacctaactataactgccatgtagatatggggtatccataatctccacagtagcccccgagtcctttgcagtcgacgaaatagccttctcaagaataatccgagtgctttaattcttgctactccagcctgccgagtgatataatcgaagactgtgaagggcgaaaataaaacatggtgcatcgaatagatgcacataattaggtgtagcccccgactatatgattagttaaaaaactaaacatgtagtcaagaaccaaatggtttcacaaccaaacatcatatagccaagcatgtacggctttcaataaacatccagccgactgcttttcagccttattatatcaagaataaagagcccgagtgaatgatactcaaagggtccacaaataggtatatttgacaagaatccgagtaaaaactctttaaaatgatccatcaaatattataaaaaattatggtaattaacaagtctaatagcctaagctatgactttcaccataatcaaagcaagcatataacatgctaagagaatgactattaaaaaacgagccatctcaaatcaacccaaacagctttgtagcctaaaaaggcttgcaaaagtagtataacacttttttgtcgggcacctttttatttgcatcgtagtaattccaaagaattatctaaccgcgagaaaaaggattttgacaacatcgggtcacaccattgtgagcacaaattgccaaagcaaaaaatgcctaagtccctagggatcacaacgggccacgctgttaatgatattgggctgaagtactgtacaggcctaggcccattagcaccttcgatacccttaacaaaacaccgaagtctaagtgacgcttcgtcttccccgccggaactctcaccatttcccccactccttgctacagtacagagctgcgtcggcgaaactagggttcgtcaatccgccccaatccattcccaaaaatccacaaaatttctccgcgcacccaccgctccgattccgcatccctccccagccattcctcgaaccaaatcaacccattcaggtcgaatcga

SEQ ID NO: 31093 - DNA, 1210 bp, Oryza sativa
aattggtaattaaaacttgtcaatggtgggttgtgagcatatggttttgaaggtcgtgctcatgacaattaaggaccggttcgcgagctactgttgtaaaacatttatcgtgccaaccacaagccagcgtgggcaacggctttatcttttgtatagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcctttccgaggtaccgtggtggtactgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgctataactggtaataatttgcttagctcctggtttggagttagatctgtacagccgggtatggttgttcaggatggttgggcctgtgcagcatgggtgtgctgtttagtgttgattaaaatcgatgattaattactctactgttttacttatcttaaatctttgctaaatgctgcttttgcaaataagcctatattatgccatcctttggaatccttgtgcacttgcatattttgctgtgtggcttgttgagtatgtcatatgctcattcttgcaataatcatcaaacctcagttgaagataaaggatccagaaggagaagacgtttggtttataccccagttgagctgcctgtgggagtggagctgaagccatcgctagaccgttaattccgctgctgtttttcttttcttttgtaagtatgtaacgttattattatgatggatttgtatattaaattgtcagtttgtgtacctcggctggttcctggacgaggattttatgcacaaattagttcggaaattactagtgaatttccgggcgtgacaaaccaccactggtctgatcggtggcacccacccggtctgactggcctcacaatgccaacaaaaccgttcactaatatctgaatatactattcactgtattttcaataaacacttatgtcagggttacgggttaggcataccatttacccttcgatatacgttacatatcggta

SEQ ID NO: 31094 - DNA, 1501 bp, Oryza sativa
atcaagagaaagcacgtctaaaataccaacgatcatgtacgggcaagtctgaaaactaaagaagggcaaaaccgtcttttctcccgctagttaacaccgtcaagtataaaaactaacggaagtgctacatagggaaggaaaattttagaagtgactatattgggaacttttgaagtttgggtgctatagagggaagagcaacttttttttatgctagatagggaattttctctaaaactattcgaatagccgtgcccgcggttatgggcgggtcgaacaatgtctttcgtgattagtcccacacctctcatcatagtaataaatgctttaattggtaataatttgattagctcctggtttggaatggaatattcctggtttggagatagaactgtgcagccgggatggttgttcagaatggttgggcctatacaacagggtatgttgtatagtgttggattaatattgtttaattattactcaactgttttattaaattctcaaatgtttgctaaatgctgtttttgcaaatggaaccctattatgccatcctttgttatcctgtgcacttgcatatttgctgcgtggcttgctgagtatgtcatatactcaccttgcaatcattcatcagaggaagagttcttcaatgaggctgatggtgtggaggattaggtgtactcttggtcaagctgcctgtggagtggagccgtctgcgccgtttattttttttccgctgcttagatctttattgaataagaggaactatctacctctataatgacattttattcgcttattaattagagtaataattgtactctattatcaatttgttattgtgtgcctcggctgattcctggacgagggttcacacacatgtaagcgtttggaattttggatagaaattccgggcgtgacagtgtcaacactttcaaagatatttgagccttggaggcgaaatcacaacactttcagaagagataactaaactgaaacgtttggagacacctgatgtggagattatggataccccatatctacatggcagttatagttaggttggatatagggtaccgaatatagataaaatatctttataggaactcgggtttgtttcttaacttgtatgtcaagaaagtacccggggtcttagttggttacgattgtattttatctgtaacctcatgttccgttagggatatggactatattttgttatacggaccccttctcctatataaggaggggtccgggtccttcttgagacacgatttcctccaagatcatataatcaataacacactcggcggattcatccccggacagaagtagggtattacttcttgaataagaaggcctgaacctgtataaaattccttgtctccaaacccatccacttttctaccttgatagccacccccttttagtattgccgaaatcttgtttcgacagttggcgcgccaggtaggggttgcgtcaagtttttcgccgatcagtgcga

SEQ ID NO: 31095 - DNA, 752 bp, Oryza sativa
actaagtcggttgattattttttaaaaaaatcaaagttatagaaagaattgttacttgatgtagtgatttatttttttattaaataaaataattttaatgcctggaacacacgtacatatcgtcgttatgagccgtagctctttacgtcgaccatgatcctcaaatacttatctgagtagaagaaaacaagacagttgtaacaaaattaataaaagaagaaccaataacttttaaaaatggtactataggactttaattacttcggaatttatgattgaaatataaaagcgtgagatccctaatttttagagcaattacaatagcaaagtataagtcagctataaacacatataaagggaacgatagaagaaaaacggattacagatttatagcacatactttaaaacgttgtatgtataagaggtgagcctagatattattagtgggcagcatatacctatagggttactgtaaatgatttagatgacttttgggctcacctcacagtacactctcgttaattgtcgagcgagtagcatggagtagcgagcgcaaaagtagaaaagacgttggaaaatggagctgccgtaattaagaaggatgtcctattcccgtacgatgaggttgcgagtctcttgcgaaatccgaaattttgtctcagagatttgaagtgtgtcggtcgtgtcggaacagggtttaaggagaaatgggcttgggtggcttaagctgctggtgtgtgctccctccaaga

SEQ ID NO: 31096 - DNA, 1501 bp, Oryza sativa
gagttgcttcaccaagtgccttcttcagctggcacacctcttcatcctctttctgccggtttattattatgccttcaggccgcaagtcatcattccaccacttgactaggatgggagggcgagagtcttcagctgctcttatccgaggaatttcttcttcatcgccgaccagtggtcctgatgcatccacggatgaaagtcaaataatcaattgaagttactcggatcagcatggtttaaggcaaggtgttacctgtgataattcccgaacgagggcgagtagattcctgtgctttagccggggatccaggccttgggtcgctaccagcgtctggcccttgagagctatcagcctgagcttcgacttccgggatttcttggcctggccctgtttccgactagtttccagtcgggggctcctgacaggcttcggtttcagcctcggccgactggtttccagtcgggggttggtcacccgggtctacattgtcggttgtcggctagttatcactcggatggccttcgacagtcggcccagtttctttggaggaactcgtctccgtgttagccggattagagtcctttctagatggatctatgtcggatggtttcctacaagtttttgttatcagtattactttcatactgggagcgcatcaaaacaaggaaaggcgttaaatggttcgtacctggaggattttctaatctttggcatggggcgactagacgttttcttctttggagcagcatgcttcggcggttttctgggtgattcttcatctccagatttcttgccattgtcgccttcgtcgtcgctcagcactaattttctcttgcgggaatctgattgcccggctggattggaggttttaggctgaggttcggacctaatcttcggtcccccactcccctgaacggtctgatgacgaggagatcggcgctgagcaattggggggtcggacttcaccaaagcaaactcctggacaggatacccgccactgtcagttgattcaacaggaagacaagactatattttgagcaaagttggaaaattttgatacataccggtggaggtggattgaatgcgttatatggtacgactggcagcagatgcgtatagctgacgacaatggcgttagagaagattttgtacatcctctccttcatgatcttaaaatccagggagtctgagtcttcgtgatttggatcatgtttgccatcaaattcaaaagccgtgcgggatctctctttgattggagctagccgacttttgatgaaatgccgagtgatctgctccccttgcaaaccttgctctttgagcttcagcatatgttccatcagttctacagcttgggcagcttcatctcccatgggcagcgaattccatgtgtcttggtagaccggaggaagacaggagtactcggggagtgcaggctcagggttttgaacatagaatcagttggcatgccagcctttgtttgaagttttgaagggcatagag

SEQ ID NO: 31097 - DNA, 198 bp, Oryza sativa
  unsure (1)..(198): unsure at all n locations
tggtactagccagctagatagcttgcatgcatcaatggctgcttctgcatggcgatcaagattgagccaccctgtgtgttgcgttgcgtgtgcttgcaggatgagatatcgacggcgagctcnnnnnnnnnnnnnnnnnnnnnnnnnnngcgagcgctgcaagctgcaggaacaacgtctgcagaaacaataagaaga

SEQ ID NO: 31098 - DNA, 456 bp, Oryza sativa
tagctcattcattcatacaatagttagctacaagcatatactataccattaatatatggtcccacctctcatacacatataatatattagagtctgtgctgtaactggctataaatttgtagcccgttttccttctctcttcttctttttacgtgtgcttatagccgatttgtagcctgctagtctagtcgctcttattaagctaagaatagattgtttgctcacgttaacatagcaacatctggaagtggaagacacgcggaagatggtgagaaactgtgatataatcactactcgagagttgtagagagagaattttcgagaacatatactgtatataggtggctgacgtgtgggccccgatcagcagaagagggggcttttatttatttaattaattattttctctcatctcgtcttctccgcaaccttggatcgatctcactcgcctctctc

SEQ ID NO: 31099 - DNA, 1501 bp, Oryza sativa
ttatggctaaaaatcctcctgttttacatttgacgatttgaatattccgatcgatctccatagttttaaaagaacttccttatttgatgggtacttcttgttagataccagtatgtacttacacatgatttaatgacaatttgcatgatgcacgcagttgaatgcttctccccctcctacgtaaattggaacgggcagactttggtccaacaactcacatttgactttctcacaacgatctatcttctgtagactgcgtacttcgtcgccagccaatgtgagtgtcatacatttcaatgcttcttaacacgtagcagtaccgcacaataactttgcatatgccccacaaagtaacaaatgtctccaaacatttatgtgagtaattatagtttaatataatataaccttattgttgtcactacatttgaactctataaaaatgcaatgggaattggggagtgaggattggacataaaataaaagtccaatacccaacttcataaatattctgcaactcagtaattgtatgcatacactgtaaaatcataaaaaaatgcaaaaagaaacaattaatcacatcatccatatcaagttagaccatataaattaaagttgctttgacttttctcttattcaaattcatttaaatttgactgaatttgcaaaaaaaaaatatagcaacattttcaacacaaaacaaatatactatcaaaatgtattcaatgttatatttaataaaactaatttggtattataactgttgctaattattctataaaatttaataaaataaaaagtaatatgaatcagagagagtaaattacagtaacctgcatatgatttattttcccctaacctgcgcggagaaaattgtcgtgtagccaacccggggtgctccttgcaaaataggcgccccctatttgtaccataccaccgcgctacgcgtccccatcccatcccccctccctccccttcttctgctctttcccctctcccccacttctctcgtcttcctcttcgactcttgcagtttagtccactccattcccaccaaaattcctctctactcccaaattccccccacccctcccggcgaattccccccctccgccgctcgattcggcgctcgaatccgccgtctccgccgccaattcgctcggtccggcggttcgctgatccactctctcgtttttttgttttttttttaccttcttacgcggcgattcggggtgtatgagctcggtttcgcggcgggttggttgatttgctccgccgcgtcggagggcggcggcgcggggaagaggggggcatgtgggtttcgctggtctggatccgtgggtgcgtgggcgtcacgttcgtcgactacttgggcgggagggaagccgagtagatccttttacgcggtgtgccggggagggaggtggtggttgaggttgaggttgacgaggggttctagggtttcgggggcggggggccatggaggctgcccgggtcggggcgc

SEQ ID NO: 31100 - DNA, 267 bp, Oryza sativa
aggaggagcaagatatttttacccctgatgaggctctgacgagaacttaaccatcctcttctcaaattttgccccaaaattgagcaatctccaaaaaccaacaaaattactacccaatttgttgcactggatcaccaccggaacactaaatgaatggtggtggtttgggaggaaagacggcacctttagctcggaatcacgcaagaggaacactaagatgagccctaacccgttccaataagagaatatcaccatatcagatcaaga

SEQ ID NO: 31101 - DNA, 590 bp, Oryza sativa
aaaaaaaagacaccctggtttccgtgcccaatatttaaccgttcgttttatttaaaaaaattataaaaaaaattaaaaagacaagtcacgtataaaatattaattatgttttatcatctaacaacaatgaaaatacgaattataaaaaaatttcatataagacggactattaaagttggatacggaaacccagggtttgtctttttttgagacggagggagtatatcacatgataaatatgctgcaaataaaatactagtagtacgtttttaagggaaaatatactgcgtatttcctgaacaccacatactgcaactactactactttcttttatttatagctacttatattattccaattccgaacagtgatacccattaggagcatagcgaaatcacctgatattccaaatttcccagagtcagtactacgtggcaaatttttaaaacacaaatgaataattgattttttgtatttcagagaataacacaggaggttccaaaaattgtagagggattgagatagatgatgacagagagggtcggacaataaatctgatgcagatggatggaatcaactcaagactgag

SEQ ID NO: 31102 - DNA, 1501 bp, Oryza sativa
ctagtataatggagaaatattgctgtttaggcacatcgaaaatgtgttgttagtatgcacattggatgtgcttatgctgcaacatatataaaccgtttatattgaaatgataacttgggaacaaaaattgctggaccctgtcgtgtcacgcccccagggtactcacccaaggaaatcatatgcacatttttggggaacaatttgtcaaagtcaggacaactttttcaggtcttgctagcaattaccgacactgatttactcctacatgtcactcaccttgcaccatgaaacccaaatgtgaggtagtgtcatcatggaagagatgcaaagataaagctgcccaagaacaagaatagtatcaactgatatcatatcaagcactacaacaagaagcatgtctccatagagaaggatctctatgctcacctacaacatatatgatggctaagatgcctaagcatcattctgcctacccagctcataaacagtcatatacagattacagacagactcacaaaacatctatccttcttctcccctatgaaaattcactcaaatcatctagtatgcatctgtacacagctgaatcaagtagaacaagttgttcatcatcagtagcagcagcagcagcaagaagaaggcctacactttctccttgacatatgcaaaggtgaatatccagacaaggcacaggacccagccggatgacagcgcggcggcggcggcgccggtgaggctcgtcgggttactgtcggagccgtacatcgagttcccgccggggctgttggcgttgagcaccgtcgaccccgatccgccgcccaccgccggtcccatcggcgtcactccggcgcctccggtgccgcccaccgccggtcccatcggcgtcacgccgacgccgaccccggcgccggcgcccgcgccgccgcccaccggcactgtccccgtcacccccgggctgtatcccgcgccgtagctgcaaacgtttaaatcctgatcaggatcaatgcatcgcagtaactagcacgatattatcggcctcatcgtttggcttattcaacggcatatttacaaacgaaaaatattttataaataaaattgttatatacatgttcttagcgatataaaaacaaatgtagaaaaataaacttccatgaaaaaccttaaatcagttttaaatttaatgttaaaatttaaatttttgctcataagcataagcataagtgagggatcaaagcttaccctgctgatgatgcctgaaacaagcaagttcctgaacctgcaagaatcattcagtgtgattctgtcagtgatgcacgctaacgcgagtaattatacgaagtttagtggggttaattaatactcccttcgtttgtttcatattataagacgttccattactcatattcatataaatattaatgaatacatatatatgtctaaattcattaacatataaatgaatgtggacaatgctataaagtcttataatataaaacagacg

SEQ ID NO: 31103 - DNA, 251 bp, Oryza sativa
ttagagtgttagccagtgagtcatcttgttactatttctaagtcccacatcaactctttgataaataaatgtttgtcgataattatacacaagttgattttagtcgattgcagcaaaagcttcattgtttatctaactatttgaatctatttgtatctgacttctagccaatctatttctacaacaaccttacaacctagagtgccctcaacatcgtctatcttcaaagatcaaaggtgttcaacgctagg

SEQ ID NO: 31104 - DNA, 1172 bp, Oryza sativa
atatgtaactgcattacatctgaactgtaactaggctgtaacagctttcatgcttgaatttcttcaaaaaaattcagtactcatgcagcagcattaaatattttcccctattataacaagttctaaattatgttacaaataatataaacatgcagggtctgatgggttacagtctgaaaaatcaggggatatgcaatcggagagatatgaaagtgacaaaattttgtccagagaaataagaagcaagaaaacattgaaaggtcagttatcatgctcacctagcattatgcaccataaaatgatcttggcagacaatataatctagcataaaattatatacaacaaattagagattgtagcgttgataaattttcaaggactatatatctatagttagttacagtgagaaataacaaaagttacatatgtaactacaatacatatagactgtaactgggctaaaactgcaagcatgcttgaatttcttcaaaaaataaagaatttcttcagaaaaggagtcactttgtcacaatggactgaagattttcctcaagtgaaaatcatcttcagacagtggtgtttaacaaagcacaacaattagattagagcctaggataaaaaaaacagagcattgtggtccaaacggtcatatctccagttgtgtacaaatttgcccatatattaaattttgtacataatttgcacatatctcaaacttccgtgcacatatattaaaatcactcgacaacaagatgtgacaagttagctgatgcagaagggaatggaccagacagggtgttgttgttgagcctcccgattaaatttcacagcaaatgagttaactgactaacaagctccacacataattaacatgggaacaatattgggatgggacgatgggtcattcagaataaagaagaaaaaaaatcatacagatatttcaggcatgtgaatacctccaggcacccaagtgaccttggttttgctaccattgaaatgcattagatcaacattagactgaaaccctccaaattatttttcagtttgctgaagtatgagattttaaaaagctcatgtcgactgaaactgtgcaatagcctgctccaagattcaaaaaatactgacaattcaaatagatttacgagcgtgctatcccctgttcccaattcaga

SEQ ID NO: 31105 - DNA, 262 bp, Oryza sativa
agggcgaattcgagctcggtacccgttatcctacttttctatgcgttatttgtgctggcctctttaccgggcaaccgtgtgggataaatgtttcatgccattatcgatggcgatatgatgatgctgaccccccaccactatcatattatcgatggcgaagtggccatgtgcttgtgttttgaatggccaaagacattaattaagtaagaagccgatgctaattaagaaagttttaggaagcaccttaagcactctgtcagaa

SEQ ID NO: 31106 - DNA, 1501 bp, Oryza sativa
aacaacatgaccacagttaacttattcagaaatattcagtgaacttattattcagaaatattcagcgaacttattattcaaaggaataaaccggcaactgatggaaccagttaactgctagctagctacctcctgattctagtagcaagatagatgtaacagaatatattctgctgacatgtgctgattcccatttgccttaaactcttcaaggttaagccatatcagcagctgttctcatctggtccaatgaaaaaactttgtctgaagaaggatacagaaacagatttctgaagagagatgtgcaaacatacttgcaccttttgcccatatgatttccagagatgagatgaggatctttcaagtgcacatggcatgagtgagtgaccaaggccagccttttggcatggtcatgcttactgtccttctgcaacagctggtccaaaagctcaatgttgctattgttctcaacttgtcatagtactacatttttttttcttcttccttcttgttgaattaaaggtggctctccttcagaatgtttgagagtttgtattgcagattatggccatgcatagatcagtgcaagaactagatcaggatcatgtgcgatagtcatcggagaagaaagcacctttatctctgaacctaaaacttttgtcaaagcatttttttgtgttggcaagaagcaatgctattggttactagtgttcagccacgtcacacgcattgccttctgtttgcacactttttttcctgaatgcaaaatgacatctcagacttcagatttcagaagcatggcgaatgggttagcaaacaaaaaatttgacaccattttctcctgaaaatgttttctccttcagagctgctgctgttcagctgttcagggttaaaaatgatcccagtgaaatttttttctcttgaatgcaaggatagagaatgcatttaacttcatctgctcaaatcccagacatattttctccacaggaaaaaaggatatatgcacttcaattctgtattcaaagtaaaaaagagcatgcattgtatttaaaacaattattatccactttgccacttttcccctattgcatatgctttttccactttgcagcagacaacctttgtttccctcctccttaagttccattgccctcctttctcctactcttccttccacactgcccaatttccatctccatttccttcatcagaggttgttctgctcagtcagaggcatcctttgccaaaaacatttatctgcttcaatggcaacttcttggtctgttgctttcactatcttcttctcctgtattctcctgcttgaaaccatctcttcttcaggtcagtatcccatattttgttttctgaaatcatagatcatgatcagcataatctccatctattgatgcaattagcatgcacctaagtgtcaagagcatgtgtcagattgtcacagtagaacaagaatcgatatgaatctctatcgaagtatttatacctc

SEQ ID NO: 31107 - DNA, 250 bp, Oryza sativa
gaacgcacgcacgcacgcgtgaccgcctgagcgcggaagtgtcgacatgcacactatgtacacctcctactctctcggctacttgcgcgacagcgtccacggcccgccgctccgcaaacttggggcttatttggattgctacgatgccaatttttttttggtagtgtcacttgttaccaatataagccaacattcgaattctggttaagattgttctaaattaatgtgaaatctaatatgggcattacta

SEQ ID NO: 31108 - DNA, 315 bp, Oryza sativa
ttatattttgatgaaaaatcacaaattacttttatgatatgtctaaattacttttagattttactaagttacttcttagatatataaaagtaaattcagtaaaacttaaaagtaatttacatatattatagaagtaacttagaacaaaacgaaggtaactttagcatgtcatttgaagtaaatccgttgtagagataaaaacaagactctatctagaaattaaattaaccagcacaaattatggaattaactgaaataataataaaagtaatcacctcagagcattatgaatgtataggaagtattttaatcaaa

SEQ ID NO: 31109 - DNA, 1501 bp, Oryza sativa
tcctcctagcttggctcgcctctgctccgcttcgcctttgctccgacccggtcggcctcgccgccgtcgccgccgccaccgcatcacgcgcgcgcgcgcgcgacggcgcgagcgcacgggtgaggtgagagaggggtagtagagcagcagccgcccccgaccgcccacgcccgggccgggtggtggagcacaccgtggcatgattgggtccatggcctcctgaccccgcctccctctcctcctcctctgctccccttttgctgctgttgctgcttcctactctcactctgcttctgctgctcaatccacctgctcctctccttctcttctctctcccgagcggccgagaagaggcgaggggagaagggaggacttgattcttgcttgttgctgatccattctttcttgctctgctctgctcttgtgtggtgtggtgagcaatctgtgctggctcttctcctttcctgctctgctgattcttcgtttctttcttttctttttctttttttctgacgagcttggctggtagctgttcttgcagtgtgtccaggcttgccgcattaaaggagaggtggtttttgttgaccctgtttagcagcagcagcagcagcagcgaccaagatccgtctcgtcggggaagatgaggagatctgcatctgtatgcttccaatccctctttagctttgggataatgaggttgtgctctgctgacactgtagctttcttgatctctctgggggagatggatgccggtttggagggtggtagcagggttttggtgggatccaatcatccaagcacacacattgcagtttctgttccttccttctttagtgagtgagtagtggattggggattggggctggtgatctagctacaggctattacaacacaccattttgggggcttcttctgcggtggcatgggcactggatagattggtgttggtgctatgatgattttgtttggcattgggtagcattggcgcgtgtttgatctgttttgtgctaaggttgtgttgagcactggcattgggaggaactagaggccagatgttcatgctgcttgcgtttttcctgccacttgattgaaatgttcttttgggatcataatatcatgtgcttggctgaacagtgaacacttttgttgagactcgtcatgattagttgcgtttctttgatccaaaaaattgtttttccatgtagcaacttcagaggatacatggacacattgtttagctaaatatttggactttctagtttattcatgtaaaatattttttttgataggaaaaatacatgagactaccctaaattgtgcttgattggtgtttctgacacaagtagagacaagtttattcagatctatgaagaattatgctctcaaagatgcataattctggacaatttgcatcacttgtgttcatagatggaagtattcatgcttaatctgtttagtgttgatgctaatatgtgatggatactgatactgttctatttga

SEQ ID NO: 31110 - DNA, 1501 bp, Oryza sativa
ataattactatggtaataaaaaaaggaatataggaaatatgtaatatatatcaaagcaaatcaacacagatatcttcaataaacatacattagaaatacaacctagtatactatacacgtacgtatacaacttgggatataaaagcatccacattatataattcatgcggggtgttaggtgtggggtacatgtcaaataaagtaaccaatgagaatcgctgcattgtgtaaaccaatcatacaagtatcatcctagatacctacataactctctccaacttacaagttgcacattggatatgacatgtgggctacgcatgttctctccacttgaatatggctctatggctagtgttggatctattgatgagactagttggagaaaatgttgcaatatgtagggcggctccatatttctctctcacctctagtacccctccaaatgcaacaatgcaaatgctctaatgactatatggaaaaaaatatgaagacgtacatgcgcaagatagatgcctatgtttcaaagcgtagctagttacatcgcaccataataaaccaatcatcccttgccaattggacgtatgacaggtgcccacataaagtagcatatcatgcaaaaacattcatgtgttgcttgcagaagtgacatggatgccacgtgactaagagcattgcggtgttcaatgtgaagggggttatataagagacaaaatgggattggaccgactctatacactatgggacttgttccagccgttttcaaccttgaaccgaatacaaccatagtaccttgctttaaaggggagagagagagagagagaagactcatctatcagaggttgtcgcatccatcatgaactcgttgtcgccatccatagtgggtctatccataggacctttgctactcctatacgatgcaaaaattgtcacatgatactattctcactgtagggcccaccaatagggcctatggaccaaatactggccatgctctaagcacatcatatcacggaaaacactcatatctttccggagtagacctcaattgccacgtatatcatcatgtcagaccttcggtgtctcgtataaagcatgacttttatgagaccttttacagtgtttgcggcgtaattagatatacttagaggtggggcaatatgaactattgatcaagagagggacaaagtacagaataaaattataataatgtgatggcagtggagtaattaactagtaaaatatggacatttcatatgaattgaatactaggctccattgattggtattgttgtacgtattggtattgatgcaataaaaaagcgtgaatcatggataatccgttgatttagcgattgattcggtctgtactgagggaaaaaaatcaaagatcatgtctcctttcttctctactttcacttcattattgttataggatttgaactggttcaccaaaggagacaaagggagaagcaccgatatggttgagggtttgaagaggaga

SEQ ID NO: 31111 - DNA, 1501 bp, Oryza sativa
ggagatataacttcttgattttttatagacgatagttaagaggtaagaacaaatttattttaggatatatttggaactctatgaatcaacttattttatgatggggaaattaactgatatcaatcatacgctgtccctctttcaaattcaccacttttgtattttctgaaaaacattacaaatatttttgtttatcatagtctatcttaattcgttgtaaaacgtgaaaccatgataatagttaacattgtcggttatttgaaaatgaagggaatgctagttcgagttggatgtaaattagtttaatgggtaagctatcttaaattaaaatagacgctctaaacgtgattcgtgtgtattgttctggtttgatttgtttcgcacttaccaccaaacttagattatactatccgacacatctgccattggatgctccctctttatcatgtcttttgatgaaaaaaaaggagcacaatccctctctttttacctactcctttttctttcgacgattctgcattctacacttggcagaaaatatatgttatttaactcttttaacattactaacattactttcgacggccatgttttgcacgttaataatggtatattatactaacttgaaacggtgctatgctctgtttaaaactgaagttgctttcggctcgaaagagatgctagaataaaaaaagataaggggggaaaacgttagtacaatgtactcccttcgtttcaaaataattttatttttcatccacactacatatgccaatacaaaacaaaaaaaaacccactttattaaatctcaatgcaattattctctactttatctattcacaatacaattatttcatatattttaaaattctaatacaatgattacttaaaaataaacttatttaggaacaaatggaggagtaattttatttatggaatggagggaatattattttttaaggggaaaaaagggagaagttaggatttaggtgggacccacatgttagctcggttggactaagtcaacgtgccgccttagtaaaaatcgctctcaaaaccgtcccatcaagaaattcaaattataccaatttaaatagttgggatcaacatatccgttatcgatacgaatcagtgtagacctatattaagggaatcaaagtggacttattcgttaattcaatgggccaactaaaagtaattatggccatttgcagaagcggaaggtggaggcccatttatagcattgcacggaaaaggcccaagttaggtactatagcccattccgaagtctatcgctatccacttcgtccccgcgtcgcgtggcccgaagcgagggagcggaggctgctcgccgcgccgcgccgcgccgccgcgcttggtcatctccgccgccgccggccgtcgccatgggcatcaaggtatatgcatatatagcacgctcttatcaccgaagcgctcgatgtgacgtcactctcgctgactctcctctgcctgcgcgcgt

SEQ ID NO: 31112 - DNA, 431 bp, Oryza sativa
attcctgcagcccagtgagatgtttttttggtaattgagacggataatatttctaacctctgcatttaatattattttggaatgatttgcaattacaccctccagttaaaaacatttggcattggaaaaactaaactcagtttagcttacaccttacgtcaaattagtttgactgaagagagaatttaatgatgtcaataactgaatcgaaatggcatgcccagctgggagcgagatcgaccgatcgatatatatatccatcgctttctccagtggagcatcaaaaaggctagcatacacatgctgtacatgcatgatgcagcatggctatctgatctgtgtctgtcggtctaagactcttagtgtctatccatctacatctaactgaaatcgcctacgttgcatgcatccatggctgtgtcctgtgtagt

SEQ ID NO: 31113 - DNA, 248 bp, Oryza sativa
acaccaggaaagttaagcagcctcaaccagtttcctgctcgttctggcaccttgacaaaatttcagattatagccaaaaggtgatcaaattcttcatggtcaccgttcaacactcaagcgagaaccagtgctaaatgtgagaaagctcaagcattcaacttgattttacaaggcaaaaggctgaactacaataatagcataggctcaacgcatttcaagaaatcactaattcttcatgaagctgtaga

SEQ ID NO: 31114 - DNA, 491 bp, Oryza sativa
atgtaacgaccctcattgtttaatgccacttaaatagttataatttttttttaaaaaataaaagatatattaacatgtgatatatcacttagcaaatatacaagtttgtccgaggtatgggcctgagggtatgcggagtgaggggaatttaccttcccatcctgccacgtggtcctacagcttggccctacccccacacctcgcgaatcgcagaagcagccaggggacctcggggtgccacgtcatgcccctcgagccctcgcgccgttttgccccgagtcccccgcccggctgccatgtggaggggggagcaagcggagaagggacccatgttgtaccgctatcaatgcgtgcggcgccccaactgcccctcgccgcattaaatgcggtaggggcagacgtgcggtgccgcccgactgacgcgcgtcagtcagaaatgaccggtctgtgaccggcctgtcgccggtcgcatctgactggacgggcgacca

SEQ ID NO: 31115 - DNA, 1362 bp, Oryza sativa
ataaattatatatttaggtgcttcagctaatgtgcacaaaacttttttttccaaattaatgctgcagaaaattaattgtgttgtcaattactgcacaaaatgtcaaataaaaagtagtactcctacattggtataaggagaaagcataaataatactactgaatccattccaaaatataggtacctttctagtagttcaatgggagtacaaattagtactagtagtatgctaaaaaggaacctgaaaatgaacaaggattaatttttcttctctcaaaaaaattctactagccatttaattctaagatttttttttgtggaataatggatgacaccattatcaaatctaggcaactcttctccaatatgagttgcttttcttttttagcaccatatatatgtatacttccatttttaatttggtatgttcggttcagtagtcactttcattggctgctcgtcagcttatcagctgcgcaaccacaatttaaaatctaaattaatcttttcattgttttcaatttttcagtattggcttttaaaccactaaaagcagatgttaagtcacaccctaaaatcctttatagttaatttgtttatttttctacttatggttataagccatagctcaaccaatcatgcaaattctcgtgagatttgaaactcactcgctaattagctactctctctattccatttaagtgtagttgtgagtttgtttttttaacgttttaccatctgtcttatttgaaactttttatgattagtatttttgttattattagattataaaatataaataataattactcttagttaatctgactaccctagaaagtgtaaccaaggtgtggggactgatcagaccccacatatatataggagccagctaaggtagctaggagggtgcaaaggagctacataagggcaaacttggaaatgataatggccaagggagcagtagtatatatgcaaagtaaagggtgtgtcctggaatatacttcttttcccttgcaaaaaagaaaaaaagaaatgaaagtgagtacacacattccctttccccctcccttgagttttttgcagccctttgtaaagggcagaaataaggaaggaagcatggatgtgacgggtgcagtggtactactgtcttctattatctcctttaccctcgtctccatctagttgtactactatagccagctacagtagtaaagagagaacaacttggtagtaagaacaaattacacatgacatacaaatgaacaatacaaaatttgtatctcactgcatcgactttttccggccctgtctgtctagctccagccagaaacaattgtataggagtacgtgtgtgtgtagaca

SEQ ID NO: 31116 - DNA, 656 bp, Oryza sativa
ggcggggtctcccctccctccctccctcgcagatctggccagaggagggaggggggaggccggcggcggcgacgacgacgacggcggcagcggcggctcccctcccctcccctctcagatccggccgggggaggggggcggcggcgagtcgcgtggcggcggcggtgcggcgatttttttttttgttcgtttttttgcattttcgcaggagggccgttgccccgactgcgaaaatcatcgatttttacagtcgttgtgttgcaggcgaacctccctcccgtctgcgaaaattagttttggccgcttgggaaaattggttttctagtagtgactcctaatgtggttccttttgggaagaatagctaatatggtccctgaagtttcgcttcgggctcagtttagtccttgaggtttcaaaacgtccaaataagtcctccaaattaatcatttgggttaacatagtccttggtcccacaaaaataccacataagcatgccaagtcattcttgcatgcaacaatacaaatgaaatgaccattctacccttaccatataaaaaagaaagaaaaggaaaaaaaaaggaaacaacaggaaggaagaaaaaaaaggccggcccattactccactgtttgttttctccgtctaaaccctgatagg

SEQ ID NO: 31117 - DNA, 241 bp, Oryza sativa
gaaacaagtagtagatagacaaaacaaattcaacataatttaagcacaattggattttttttttcttcctctgtatgttcatgcacatgaaccataagaccaaatccaattttcttagtagagcaaaaagatgaagaagaacgcacttgctccacataaggccatagtgtgcaccaacaggccatagtttgaccgttcgtcattgtcaagtctgtcgagtactcgaggtcgacaacagcta

SEQ ID NO: 31118 - DNA, 1247 bp, Oryza sativa
ttaacatctgcttttagtggtttaaaagccaatactgaaaaattgaaaacaatgaaaagattaatttagattttaaattgtggttgcgcagctgataagctgacgagcagccaatgaaagtgactactgaaccgaacataccaaattaaaaatggaagtatacatatatatggtgctaaaaaagaaaagcaactcatattggagaagagttgcctagatttgataatggtgtcatccattattccacaaaaaaaaatcttagaattaaatggctagtagaatttttttgagagaagaaaaattaatccttgttcattttcaggttcctttttagcatactactagtactaatttgtactcccattgaactactagaaaggtacctatattttggaatggattcagtagtattatttatgctttctccttataccaatgtaggagtactactttttatttgacattttgtgcagtaattgacaacacaattaattttctgcagcattaatttggaaaaaaaagttttgtgcacattagctgaagcacctaaatatataatttatgttctcaggattcactggaaatgttatcgctgcaagccctagagggtggtgtctccagcagaaaaggaggcagattgggaggaggatggtggggattagggaagcacacttgtaaatatatatctgtcactgtccaaagctaggtttgatgatagggaaaaaaaacacaaatataattaatcttcgaaaaaaacgcagatattatatacaaatgcaatagcattgactttgtgtatgcgcatgcaccgaatcggaagcgtatgcatcgcacttctcagaaaggtccaaacaaagtcacgtacaaattattcctactcccatgccttttcattgaaaggaacacatgccaaagagaagagactgaattgaagccatccatccatatctatccctaattcccttgcagttgcgtgagaaatacataaacatgcatgggttagtaattaatcctagatgaatctatctatcgtcagtgattaacttaagtttactgatggattggcatctcggattctgataaggtttttaagtgattttcagatgtcacttggttactttccaagattgtttaaagttgtcgacacaactgtagccaaaggtcttattgtactgtaccccatgatatgctagatcttccttaggtcatatgtcttgtcctcgaaatcttgctgccattcctacagg

SEQ ID NO: 31119 - DNA, 1501 bp, Oryza sativa
agtcaaatttattactaaaatataataatatttctaatacaaaacaaaaactgagaatgtatcaaaaatgtattcaatgttatatttctgccacactagtattcaattcaacaaatgggccggattgcgtgcagaggtaacaatattaataaattagggataaaaaaaatactactccgtcctaaacaaagacaaaccctagctacgaacctggatacgcatatgtccaggtttatagttaggattgggttttttttggacggatggggtatattttaaaaataaatttagcaaatatagtgatttaataagtgttgcagtaaatgaaacttgtaataattgggctgggctttcaatatgaataggcccaatattctatgccatagcaatagattggccaatttcaaaactgttgatttgttgtttccaatttcaaaatgatctactcggccacccatgcccaaattaaatcatgtttttttttattaaaacataaaacatagtgcgaacaataatgtttatatatacatgtgcacgctttaatgctttatctctataatcatgtctgagagattaagtcgacgacacatagattatcacatgtgtttcattattgacgggtagttgcctactatttaaaaaataattagccgtaaatatgagcatatgtttaagtctggtacttgaacttgggttccactagaatctaactagagctacgccagtttgcaaactaaatcatgttatcacttgatcattagagtatcagactataatgatttcctgtgtggttgatcttagcctctagtaaacaggaccgatttgtttacagaagtcacaatatacagtttgaatgctttgtatcgtcgtcatcatcagtgaaggctacacgcctccaaacacaaaaacatggccacacacagagagacagagtgagacctcgcactcacactcacactcacactcacgacgaggcaggcagaaacagacgatgacctgagctagtgagagtgatgggtggggcccacacgggggagaaaaagaataggaatcctagtcagccgtggggcccacgagaacgatggccacccattagagcacccacaatggtaaagtaaagtgctctctataaaacatgtacatctcagcaatatactagattaatagtaaaccatctcaatagtatgtctacatgggtatgtatagctctctaatggattgcctcgtttttctctagactatttccaggttagtgttagatcttatcatatcttatcattctctgtatggatatgcacggatgcatgttggttcggatagatagaggataggactctaatcccttgtaattaggatcaccgaaccaacacatctgcacgcatatatatctgtaaactcagcgcgtttttgcatatagtgaatcaacacgaaaccctgcgtccaccgtgacgctttcctgcatacacctgagttttatatggtatcagagcctcaaagtccg

SEQ ID NO: 31120 - DNA, 1501 bp, Oryza sativa
ttcatgggtattcagatgtatacccaagatttttggaaaaaaaaaaggtatatatactatatagttcatataggtattaaaaaaataaaaagaaaacttaaactgcttatattgggccttgtttccccatttcttctctattgggccaaaattttccactcccctccctctttcctctctacctgtggtctaattgggccacatctcagcccatttgcaattttcccccaattccccacccgcctggcgccttggccacccaaacctgcaaaccctagaccacaacacagcagtacagcacggcgacgggaggaggcgtgcggcggcgtgacgtgcggcggccggcgggggctgcgtgcagcgtgcggcggccggcggcgggagccgtggcggcgtgtggcgcggccgcggcgtgcaacggcgcgggcgcggcggcggcgacggcgaccggtgaggcggtgagccgccaaggccaaggcgccaagcccgtgaccggcaggcgcaccgtgaccgacgggcgacggcgtgccgcgtgcggcagccggcgcggcagcctgcaggggcccaggaggcagccaggcaggaggctgctccaggccgtcagccgagcaggagcaggcgctgcacagctgcagcctgcaagtcggcgtccgccgttccgcgccgaggcccgaggcagccggcggctgcgcgctgccgctgcggccgtgcggcatcctgctcgccggcgactgcctgacctgcaaattccggataagcacattagcacagtgagtgactaaactccggacaacgggacaagcacaaaaattcattgatttagacatttagtattttagtgtagttgcttgcttgcttgcttgcttgatttagacatttagtttgtaggattgtagttgactagttgcctatttgagtatttgagtaattgagtatattggacactggacagtagttcatagttcataccatattagcaaatttgtagtatttgaatgattgtttggttacattcattgaaagagaattctttttgcaagctaaggacaaggacatcatcaattatttccaaaatatcaagcgtcgaaaagttaatatctaaattgtaagttttcttcctaacttattattctctatcatttttgtattccatattttgacactttgatatgtttggtattagtatttctataagttaaacaatttctagtgatgatcaattctatcactgtgtgaactaatgatcaattttattctatacgctctaaattataattattagtgtatcataatatacaagcctattttttggctttttggtgtatggacatttttttaccccttcccatttcgaatacccaagtttaaaaagctgggcccgccactgtaactatgaacttttggcaaattccatgtgaaatgttcatggtatgttgttagcctgtgatttatctgtacctgtttcgctgtcctgtactgtactttcagcgacacctgctag

SEQ ID NO: 31121 - DNA, 233 bp, Oryza sativa
aaaattcctcccaaatccacatacaatgtgtcattccataggaatttcatatgatttggaaaacttcaatcctttgaatcaaatggtcaaataggaaaattttctataagatttaaattctataaaattcctttataaatcctttgattcaaaggcgccctacgacaaaagcttttctgcatctcctcagaaacagtgctcccaccaagcctgtctctctaccgacagaaaga

SEQ ID NO: 31122 - DNA, 297 bp, Oryza sativa
tatcccgtatctaaacaaagacgagagcctattactgcggtcgagttaatttgctttgttttatacacccgatcgagtagctagtgggtaggctgtgtttgtaaccccatgttcccatcccctctccctcgtttaccacgcgcatatttttcaaactactaaatggtgtgtttttttgcaaaaagtttctatatgaaagttgctttaaaaaattaaattaatccattttttttaaaaaaatagctaatacttaattaatcacgtgctaatgaatcgctccgttttccgtgcacgagg

SEQ ID NO: 31123 - DNA, 537 bp, Oryza sativa
aatatactatggagcatagtacactaatatatatttgtgtagtacgcactgtacgtggtagggctcgatctccctgaacaaaattacttcgttaaatgtcgtgcacaaatataatcggcacatgctacacatgtatgcacatcgtttggtgtggagatgctagatgtatataaagcaggctaacattaatttgaaaagattttctataaaatggatagttgcctaggcatttcacagcttatatatgtttacatttatagttataaattaattcttttttagatgaaaatttaacaagagcttcaacctcttagaaattttcctttgagtccatctctcttatccgattcttgcatttttcctgcggtccaatcaaactatcatttttatgtttttttttattttacaattacattcatgtcagaatatcgtgtttttcctatttctccgtttttccatttctacgatccgaaggggccttgactccttgagaatcgtacatatagagctgttccatatacttccatgtcttgtagt

SEQ ID NO: 31124 - DNA, 1501 bp, Oryza sativa
ccaggatcacgcgggatggacccggcccaccggctctctctctcccctccccgcccgcgcgcgcgtcttgggccgccttcttgggccggccggcccattaagcttggacgagccgccccattctctcgggccgcgccctagccgcccgagggaagtctaatttccctccctccttcttttcttttcttttctttttcaaaaaggatttaaataaatccttttcctttagaccaaaaatccaataatcttagaaattcaatatcttcccaatcgtaagtccgtttgactccgttcaacttccaaaattcctcaaatctcgagatctatctaatggcacgcttagaggtcaataatagggctttattttcgccgtttgctgagttgtcccgtttcgcgtgtagtttcggagcccgaagacccgcagtgcgaggatttcgaggatcaagctcaagatctcgagtgaggcaagccacctttgaacatcttgagcctatatttgaacttaattatgttgcttaaaaaatattatgcattgataggattacacttaatctgcttgtcccgtttgcaaggcagattgacggacctacctaacttgttgcatttgacccttccattgtaattgttatatcatgttcccttgtaaccacctagttgcgcctcggtaatcgtgcactctgtacgagtatcgacggtcgccttcaaacttaaaatctgagaaacatcttgggtaaaacttgggttttacaaaagacttggaaaacccgacacctgggtcggtgcttgcgaacctaaatgaatttccaaaatcgcggaccggggaacgtaccgggtgtacggtttcccgctcttgcacttaaggaccgtttccttgaaatttcatccgaacataagacaagtacgaccacatgggtggaatgggacacccctggctgagtaactagcttatcgggggagccatgatgctaagagacatgtggattcgccggggtggtgtcggggaggacccctgggcttcctggcacagtatggtctggaacctaatctggtgttggtctgggacccctctcgttggtatatggtgaacctgtgtcggctttcgaaatgccttgtcattaaagccttaaggtctctagtcgtggccgttctgcacgggctggatgatccgggttagtaatgtcgtgtgggtaaagtgtaccccctctgcagaggttattaaactgttcgaacagccgtgcccacggtcatgggcggatatgaggtgattcctagcgtagttttgtttgactactgctttgtgaaatttgctgttgtggaatgggtttgatgtttggaaaatctgcggctgatgggatcagccaggcccgggtggccgtttgaaagctgttggccgggtgccaaccttgatcgattcaaaagactgatacattgcacatactccgaccggatgagacgcactgtctcatccgtgtcgtttgagaagcactcacttagttgtttc

SEQ ID NO: 31125 - DNA, 1501 bp, Oryza sativa
ttaagcggcaccaaggcccaaggaagcagaatggttccgctttcatgaagagttgtcctcgagatgtccgagaacaacaaatttctccgatcattcacaataaatggtcgcaaagcaaacaaccctagcaaaaaaaaaaaaaaaggttggtggaagggacatgtggcttcttgttggcgcgagccatttgctacggggatctttggttcatacttcattggtcaccgacactatgacactagtccctccgtctcattataaaccatgagttttcgcgtctaaatttgatcgtctatcttatttgaaatttttttataattagtatttttgttattataagatgataaaatatgaatagtactttactcgtgacttatatttttaatttttttttaaataagacggacgatcaaagttgggtgtgggaaaccatggctgcacttaaaatgggatggagggagtatatacctaaatatataaggtggttgtataaatatatgtgatccactagattagaaaatacgaataatctagcttaattctactactaataaaagatgatatgctaccaataccatcataaaacaccgtagtatttaattgtgaggactagaatattgctagatgataagtgtttctttttcaacaatggaatatgcaatatgtgagttctcatataattactactacattttttttcaagcaactagcaccattacatacatgctactagatgtgtttttgcctaccacacagttcttacaaccatccgcttcttctcaaccaagagatgaaattctatatcgaccataaaaacgaaaacagataagagcttgaacacaccccaattttcataaaatcccatgaccacaatcctcaacaataaacggaacagataaacccaataaaaaaccgtataataaaaatcgaaagaatccaaaactcccaagcccaaacgacaaacctcaggccgggaagcatccaaaccctaactcgatcaccaccgctcgtttcccttccatccatccatccatcgccgtcacgtgtcctcttccgccttcctcctcgcccctcgctggctgaatccccccaacccgcagtccgcaccaactcccgcaaaaaaaaagaaaaaaagaaaaaaaaaagagataagaattattttctttactaataaaagaggcggcgcctttcgattcgattctcgaatccgaattttactacgaccaggttgccgccgccgccgccaccgccgccgacgagctgggcgccgccatggcgctgctccccatccgcgcgcggctctccgcgctggacgacgacgacgacgacgccgccaccgtctcctcctcgcgctcctcctccgccgccacgtcgccgtcccgctcgccctcgccgctcgtcccgcgcgcctcggtcctcggggcaccgcgcgtcgcggcgcagctctcgtccaccgaggacgacaacggcggcggcgaggatgaggtgttcgacgaatcca

SEQ ID NO: 31126 - DNA, 1501 bp, Oryza sativa
aaggtacaattatccatttcttttcccgttcctgtggtgagtaggatctgaagagtgtggttagatgcctagatcatacagttcatagttcactagttttccattttgtatcctgctacaaaataatcagttatcttgcacattgaatcagttgtttgatggaacagggtacttgaaagttactgatggtgggcactgttttctcaactcaaatcaattagttactgtttttcctgatatgctttaatgcctagatatcggcagagctattggaggctagccttttctggttgatcgtaaagtaaatgagtaattgcatattcgaggaagctgatatatgacatggttgatatttttatgtttgtgactctttccatcttcagtgttgctattgacaaagtatgtcccagccccaggtatacttgtaatttttttccccaacagacttagcattggttccttaaggctttgctcagttaatccctcttagaaggggattgaaggggaattagaggggatttgttccacacctattgaggtgtggaattaatcccctccaatcccttcctcttcggtattaaccgaacaagccctagaaaaacaatttgcacctgtacatgtatgccagaagaaatcacttggttgagttcttgcctactgaaagctgatgtcatgaattcagtgctatgacatcctaaattgcctgtatcttgtatgacaattttcaccactggagtcactgatcgtgattatttttctacatattactgtagcaaaatatacaccaccatgtgctcaaagtcattattctggtccatacgatgagttacagctcacagcaatcacatgaagttaggggggctcctcaaatggtttggtactttggttagcagttagctatagttcacagctgatgacgaaatggctacataggtgggtagcaaaggcagcataaatgtgtagccttgtgggaaatgaaagcagcaaaagctttaaaaatactagttaaaatgcaacttcattccagagaaaatcacatctgagtttcctgtagcatcatgtgcgaccaaattgctgctgtgctaataaaatagtacatattttttatacttaatttgtaaattcgatcaacaactaaactgtagatgcaccacgttgcagcaatgcatatatgtggatttttgggtgcaagtctactgtagcacggattgaggccttgctttctaagcacactaaattaagccaaatcatcatcaccaccacacaaaattcatgaaagacacatttttttcgagaaactgaggaagtgaggagctgacctataaatatgcaagcacagacaccaattgcagttgcaacagagctgtcaccaccctttcatctgacgcttgtgcacaggagttttgcagctcactggacatgtgcaagcactagaaatttataagtgttcattttatacaggattccatctatctggtgcaagtctgcagtaactagcaaa

SEQ ID NO: 31127 - DNA, 1501 bp, Oryza sativa
tcctgtttactagaggctaagatcaaccacacaggaaatcattatagtctgatactctaatgatcaagtgataacatgatttagtttgcaaactggcgtagctctagttagattctagtggaacccaagttcaagtaccagacttaaacatatgctcatatttacggctaattattttttaaatagtaggcaactacccgtcaataatgaaacacatgtgataatctatgtgtcgtcgacttaatctctcagacatgattatagagataaagcattaaagcgtgcacatgtatatataaacattattgttcgcactatgttttatgttttaataaaaaaaaacatgatttaatttgggcatgggtggccgagtagatcattttgaaattggaaacaacaaatcaacagttttgaaattggccaatctattgctatggcatagaatattgggcctattcatattgaaagcccagcccaattattacaagtttcatttactgcaacacttattaaatcactatatttgctaaatttatttttaaaatataccccatccgtccaaaaaaaacccaatcctaactataaacctggacatatgcgtatccaggttcgtagctagggtttgtctttgtttaggacggagtagtattttttttatccctaatttattaatattgttacctctgcacgcaatccggcccatttgttgaattgaatactagtgtggcagaaatataacattgaatacatttttgatacattctcagtttttgttttgtattagaaatattattatattttagtaataaatttgactaacaaaaaattacaccgattttaataattttgggggtcaagatatctgtattgtggttaagggatacaaatcagacttggccactagttaagggagtcaaagtgacttactccactgaagctcctctgcaacaatccggcccatttgtatggcagaaaagctaggcccacttgaatctggtagattcctcctggttggttgctgggctcgccgccgtcttcctctccctcgccggagtatagtagtacaaggccgatgcaacactgacgtggccatcaatttgatcccgtcacgtctccgccctcttctcctcgcttcttctcgccgccgcgcccgcgcgctgctgctcttcgcttcttctcggcttccctccgatctgagagagcaagcatagcaggagatcgggagacctgtgttgcgcgccatggcggcgatggtggtgggagcgttgaggaggggaacggccaccgccggggggagctcgcggtccttcgcccgatcgctccctagacctgtaagcttcttcttccccttgtgcattcgattcgattaataagcggttggtggaggaatgtttcgagacgatttctcctttcgatttcatcggattcgtcgcttttgcgctcccacgattggctccgactgtgcctaaccgcgtacttgctctcatgccctgatgatgct

SEQ ID NO: 31128 - DNA, 1501 bp, Oryza sativa
aaaaaaaaattatatagtttgcatgtaaatcgtgagacaaatcttttgagcctaattacgccatgatttgacaatgtggtgttacagtaaacatttgctaataatggattaaatagtcttaatagtttcgtctcgcagtttaggcggaatatgtaatttattttgttattagtctacatttaatactttaaatgtgtgtccgtatacttaaaaaaatttggcacacgaactaaacactacctatgatttgcaggtatgattttttgagggggaagatagcggaagctccactacgccacaagtgcatccaacaagttttcaagtttgagtcagatttggtcccttttgaggagatagatgaaaggcccaattcagattttaaatgggtttgcaagccctgatgatgtcgacaaattcaattagctagttcatgcttacttttttttattctctcaaatccatccgtttagaaattaaagcatttttagacaagggctcctagtattccagtgttggtttgactctagttttgacattggcaaattttgatggggagacatggataattggtgactgctcgatgcctgcaaattaaatttatgcccatgtgaggcaatatatattgacatggccaaaattatgaacttatgatgcagcaaaactattgataaaacattttgtttgatatactgttatatttttttcctaggcagtcaatacacgtagtctataggtacataaaccgcatatacacacacacaaaccattatttttttagagtacctatgcatttttcgaaagatttttatgagtatcacgcaatttttaatctttggattaaaattcgatagacacagtaaaaggcaaaaagcaactaagaaacactataatggacactaaattaccatatcttcaagaaaaagactaaatccaatacaaatttcaaaacttacatgtaaagatttaaaaattacgttgtagcttaaaaaacaaaagttacaatgtaagtttcataaattacactgtaacttacaagaaaatgcactgtaacttacaagaaaatgcactgtaagtttaagtgagaaaatcgagtgaaagataagaaaaaaaattttcgagtaagatatagccaaaatcgattttttttcctcgaatcaaagggggaacggagaataaaatttcgatccctcttaaccatgggcccatgggatgcagcctgcagtaaccttcgtgagcaagaaaccatgggctttctggccttttcttagtgggcttcataacgcgagccccatgccggaatacgatccggcccatgggccaatgggagtccgtttcgtcttcgtcttcgtcgtcgtcgtcttcttttcttgcaagaaagaaaaggcggagcaggagcagcaacgagaaaaggcggaggcggcggcgcaaccgacaaggaaaagcaaagcgagagcaggaaaacctcgccggcggcgacaccaccaccaccagcaggcaggga

SEQ ID NO: 31129 - DNA, 1501 bp, Oryza sativa
attgcaaggccccactgttgcctacaccaaaacgaacgcaaaaattcattccgacagccaaagcaaatcctccctcccaaaagccagtgatcaacaaactaacgctataattcaaccctgcgcatcatcaattccacctagatccactccacgcatttcccaaccccccatccaaccgagacaaatcgcgtcacctgctggtagaggccgtagaggaggagggcgacgtcgttctggaagcgggagatggcggacgaggaggtggccccgccggccccgaatccggcgtaggccgccgcggcgtagaaacggtcggggtaggcgagtccggagctcgccatggccgcgcgcccgcaacgcaagccctagatctctccccgcccacccactcggatgagatctcgcgcccactgcccgcgaggcggagagcactagcgttcgcccctcctcctcctcctcctcctcgccgcggcggaaatggaaatctgcagcgattggagacgagagaattcgagatctgggaggcttcgctcgctcgaccgacgctcgcttcgcgggcgatgaatgatggatggctttaacgctcgttctccgaggtggcgcgggggtgtccacgtgtcggtgacatggtgggggcgagtgacgtggtaggagagtcgtcgcggtcgccacgacgacggttaatatgaaccgggtctacggcgcgggtcaccgtcaccgtgaaccgcgtctagtctacgtagaggagggtaggcgcgggtgctggagtaacgaacgtgtgggaagaactaggaaggttgtcgtggtgttggtgggagatccatcctcattcctcgcaccgcggtaccactagcaaaaaaagcgctaggcggctttatacactgcaaatactgtattcaaatatgctaaaggtctcaaacaaaacaaacttctctgtgtttgatgattgcaagctgatgtgggatgggtttggtacaatttctattgagcactgtaatagaaactccaatcaggtggctcatgaattggccaggttagcgtttaggacaaaaaaattttgtacttgggtcgatgaatcccctggctgtgttctgaaccatctggtaaacgatgtaacaattttatcctatcaataaagctagccgaatggcattccccaaaaaaaaaaacttctcacgtacttcatccgtcccaaaatataagcatttttagcatagtgttaggtcaaacatttttaactttaactattaatagaaaaaaagttaaagagatcaataatgtaatattgttactagatttttcattaaacaaattatcataatatgcaattctttttatttaaaacatcttatttttatatatattgttggtcaaattagcatctcgaagactgtgtcgaagtctaaaaatgcttatattttcggcgggggagtataatttacactttacattactcaggtttgatagtgctagatttttaggttaattagatccatgttat

SEQ ID NO: 31130 - DNA, 1501 bp, Oryza sativa
tcgtctccctctaccacgtccgtccgattactacatcttatactacttgtgtgtaaataaatctacattttacttgtgtttgttattaacccctaaaattatcaggggatctcaaactctcaatcccgtctcagtattccgagtgtcacggccgccccagatcgagatgagccgtcaaattaacaaacacggctcagccaccttttctccgataataattcgcattagccaatctttgctcttcatcttaatcatagcaagatcaggccgtttaattgtttgtaacacgcgccctctatatcctatacactgcgggtttctgtaatcgcctgataacgtcatacacagacaaataattaatgagtgctcccccatcagaatccgttgtggtctagctggttaggatactcggctctcacccgagagacccgggttcgagtcccggcaacggaattttttttgttttatctttttggagaattggagtattttatccctgtgttcttttgaaaaaaaagtacgaaatacccctgaactatcgtagtcgaccgaattatctctctgaactagaaaaccaaatattgatcaccctaaacttttagtaccagaagaattacccccctcaactcaatctagagctgttttgtcctacgctgcatccgcgtggcaatccagtcagtatttttcattaaaaaaaaagtgggacccacatgtcatacctactcttcacttattcagctattcccaatctctctctcgcgtggccgcaggcgcgcacgggcacggcggtgtgcggcggcgacgacgcgaaacgaggaggggaaccggcaggagctcgtcgccatgcgcgacgccagccgcggtggccgcagagaccaggccacgctcatcgccgccgacgtggcgttcttcttctcggcaacgccgtggccgtccgcctcgtgaagcacctcggtgccaaggtggtggtctccgtcgaccgcggctgcgaccgctccgacctcaccttcgcggcgcggaggggcaggcgggggcgcgaggtgaggcggcggcgcgagacgagggagcggcagacggcggcgcgcgggccgggcagtgggcagcggcgtgagacggtgtctcagggctcacccagtccatgacggtggagccgctggcccacgacgccgtcgacgaggccacggaggacgaccgacgacgaggaggagctcgccttggccagctgccggcctctccccttcttcctcctctcgccgccggcttgtcagtcttcagaataacttttgcattgaaggtatcatcacataagactctaagactgtttgcattactggtgtgctttgctaaagtatgaatgaaaagaactttaaccgtcggcactcactttaaccagaattagcacaacatatggaggacgagataatcagataggaaaactctcacttcttttactaaatccatcactctgcccttcgacctcgcaagaatcacgcgtggctac

SEQ ID NO: 31131 - DNA, 1199 bp, Oryza sativa
ttggaagcttctgaattctgattcgcaatatatccattttatattcttattctttctcatcctttatgacttcaacagagggtgctggataaacaacagcacttggaatagacgaatggtacatccaactgctaccaaagtgctccaatattcttcatctacgcaaatttccacggtattcaaagtgctccaatattcttcatctacgcaaaattccacggtattcaaaacagatgatgtactctgtattctttgattctttcaattgttgccatatattcccctgccactttgtaggaacctggcatgcagatcttacttgggagttgggagcatatgccagccttcaaagttgaacactagatctgttctcttgttaagaggcatccttgccttgatgtacagctacagtgacgggcaacaaattggctggatatcctgttcttcatgtctatgtcagccttcaaatgcagtgggcatctcttctgtacgtggagccttggggagttggaatgctataagtagagtgctagcttcaacaccattcatcaggagccttcaagccttcactgttttgaggtgagcaactctctcgttgtgctctccattgtttggctttattttggtattattgtccctttttgtttttgcagaggacgttgtgtcctattattggttctatcttgaacagttgtgagatgatgatacttgattgaactttaaaaatacacttaaacttagctaatgtcagaatatgccctctcagtaaaaacaatggtggatttgatttacatcgtctatatcacatgctcacaccaaattctaaccacaaaaatattttgctggggttgtcaggactcaaagccaagagtgtcctgccaaaagctcagccctgtaaatatatttcctaccacagcctcccgagtttctcggggaaaaaaaaacgattatatgcccctggaaacaatataacatgactgtgaatcgctgaagttcaggtctggcagcttcagtttgattggttctgtacttgaaatccgtgttacttgttttaccaggcatgttgcagagtcccttccaatttttgctcttgagatcatattgtcattctataagttcctcatgtaatttcaggctctcaaattggtgtgatttcatttagaaatcaccctttcagctttgatcatcaagaatggagg

SEQ ID NO: 31132 - DNA, 1501 bp, Oryza sativa
caagacgtgtgtgatccattcaacgtttacggtgatgaaatcattgggagaaaagggagcatcaaccttggaacaacatgacaacatgctggttttcactgaataagaaaatcttatgtcaggtatagatcggtgatcagaatggatccgataattattaagagctttcggtttctctggggctgaaaattcggacggcatgttgcatgctcccctttctcctatcgttttgtgccgcaaaagcggaggtctgatggacgtcgctgggccgatccaaaccgtccaaacactgtgcccacaacgtgacaagcaaaaaaacagaacaaaagccactcgcttaccaacaaaacaaacaacaaaaattttgtcccactacctcaacgttcacaaaattcaaactggtcagaacatgaaccccgtcgcaaatcactggaaatttcatcgaatcctaccaaaacgaaccggctcgaattttgagttcggtgtgcatttgcgagctgctggctcaccgaagccggaattaagcaggcgaccggtgctagaattacgttcataaaagtattcaatacttcccaaaatataaatatttttaaagtagtgctaaatcaaatatttttaacttttgttattaatagtaaaaaaaataaaaatgatcaatcatataaaattgatgttagtagatttatcattgaacaaactataatatgcaactctttttatttaaaaatcttaattatggtggttaaagtagcacatcaaagattatgttaaagttgaataatattatattttgagacggatggagtaccaatttagcagtgcgctaccagatggattccaattcagaattcttcactgtaaaatggagtactaatctcgcggtcgctgcatttgactcgcgtgctgattgagagatgattcgagcaaaaagtacacaaagcggacgcaagtcgcaagattgattgcaagaaagaaaagcatcgcgaatttgcggagcaagcaacggcctcctctggttataaagccagcagccgccatcgcccagaggtttacacggccacgagcacgagcacgagcaccacctcccccttccactccaccacgcaacgcgcgacctcagctcagctgcgcgtccgcggattcggggttatgggcatcgatcgtgcccactcccccgccatcgccgccgccgccgcgatttaagcaatccaaacgagcgagcgagcaaatcttgtcgaacaccagatcccccaagctcaatcattcaatcaaccgtgtgagtcgttcttgattcgattttcgagatggattcacggatgctgctgatgctgatgcagctgctcggctccccgacatcgctcgccgttctcctcctctccttcttccaaggtcagtcacttccattgctgggttactatctactggagctcgcgatttggagcttgacttgattctttcttggggtttgggggattcgattcctcttcctccgcgcgcgcag

SEQ ID NO: 31133 - DNA, 171 bp, Oryza sativa
tcctgcagcccttgcaaaaacttgcaggccgattgccgccttgcagttgccaaaacttctttgtaaggggatgtagttgcagaaacttgcgatcagtaacaccgtcgtcggagttcatccaccctgcagccctccacgtccttccacaccggccaagaacgccggccgcca

SEQ ID NO: 31134 - DNA, 600 bp, Oryza sativa
cggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaagaaatccgattaattggatcggcagctagaacagttaataataaggcgagaaaaatcctcgccgcacgcggagagccgaatcgtgaaagaaaaatgcagcgagcacgtaactccatgggttggaaacgataacgaggtgaagaaacgcgtatactatcttctcaacgataacgagatgcaacgatagtcaagcatgtcaggatatcaggactggagctttgggcatgccgcttccgtagcggccaagcctaccagggtgtgtttagttctagggtgtaaaaattcaaaagtatacagacacacatttgaagtattaaacgtagactaaaaacaaaacaaattacagattccgcatgtaaactataatatcattattagccgattggtttctactggattatattgttatttattacgttatca

SEQ ID NO: 31135 - DNA, 1501 bp, Oryza sativa; identical to SEQ ID NO: 29551

SEQ ID NO: 31136 - DNA, 1501 bp, Oryza sativa
gagaacgggagaacaaattttgcggaaggtctgtttgtaatataaatttttaaaaggatcaaattgtagaatgtttaggctatgttatttacttattttctttgatttcaaacttcaactttctcttttttagcatgtttttaaactgttaaaatgatactcttttaaaagcattctatatagaagttgtataaaaataattaaataaatttattttccaagcttataatggtcggtatttaatttctcatttcacatacgccaaaaggatgagttaagaaatcgcctagataattgtacaaattccaaaataatagcttttttctccgtctacaccaaccacacatatgaaatacttcatccattttacattataagactttctaacattgcccacatttatatagatgttaatgaatctaaacatatatatgtctagatgttaaaacttctctagatattttgctctgccgtctctcccttgggatgcaagcggatttggataacactaaccattgaccccatcatgtatctccttcttctctttgttcgataaacaattcaagtgctttattttgttgcaaagtaaaagtacccttttttaatactataagtcaacaggtcgagccacttgtgtataattctttgcttcaagacaaaataggtcggctagctatggatacacatacacgaacccgtgtgcataagtcaacttgcatcgatcagcatgtgcagttgtgcacacacataagcacacgtttgattaatcaatcgataattatagattaatgctcaactaggagatagtaccatctaccatctcacatgtgtagacagccatgcatgagccacgatgccactagctccctttcactccccaagatatttccaggaaaaaaaaacttactggttatactatgctctcatatatgctagccagtcatttttaaatacaaatttgttttacttaaaatagcctattacgtcaatactggcgatccaataataatagcgatgacatacattttccatcgaaccggtacttgttttgcttgatggcacaaaccgggtttacgctgagaatggcagatctatgtgtaagttgtgaggtcggctaaccccacaactttttcactattgccctttgaatcttaatttttcctataaatccattcaaatttacataaatgaccatactaaaataataataattgatcccatatagtaaatttcctgactccgccactgagtttacatacatgcttgcatagcatgcaacaagcgctcagggacggagctacttgtggggcagcttaggccctgtttgttttagtttgagattattgtaatctagattattgagccaaattactataagctggattataataagttgatatagaataagctgttagttgtttgtttctctagattattagctgtttgttagatgttagctatctaataattaaaaaaagcacatttagagtggattaccaga

SEQ ID NO: 31137 - DNA, 369 bp, Oryza sativa
cccaaatctgcttattttacatcacttgtactgtgcctattgtaaacctgacaaaagcaaaagatagatggtggaacactgccaaaagcatacatatctattgaaaacctgacaaaaagcaagagctagctgttggagcactgataaaagcaaaagcaaaatagagctgttgtaaactaaataaactagttgttggaatctagccattggaatgtatcatctacaaataggtgatgtggttcagcaggaccagtcatcctcatttccttcaacttcatcccaacagctttcctcccactttcaaacaaaagtccagcgagtcaccaaaccaatctagtcagtcagatgattctagctctagtgacaatc

SEQ ID NO: 31138 - DNA, 1501 bp, Oryza sativa
aaaaagatttgacgttaaggactacgcacaactgcaccagatctgctccctgctaagcagcatgtctgcttatttgcgaaagaaaaaatatatatgtatgccgctatgttggactactgaccatgtttgaaacttgaaagatggaaaattcagagataaataaccatcatgcgagctgatgcaataaagaatagtatttcagtatttggttagactaatcaatcagacttgacatccaaacaaaaaagcatgaaaagatttccatacgctaattgggcaattggcaatgcaaactgaagttggaatcgggactaggaacttaggaagtatggaatgccatgagaaacttctgcatagacatatctaagtctgggtagtctacagatgaaagtgacatattgattgatatgagttttcttaacaaattacctgcatatataaagcactgctgactcgaatccattgtcgacaaggcctggagggtttacctcaagatgggcagttcctctcaaacaggttgcctaccaaacattgcagagtcatacatcacaaataatgccaggatattacacaataaaggaactgcagaactaagtgtatagtgacaagtcaacagcaatacaataggaacaaatgtgtacctttcttcccagatcaagtgccagtgaactgagggcacatgaaaatgactggaatcaggcaactgttctcagccacaattcattgggcttcatccaggatggtttcatggtaaatggacacaagcaggagacttcagatacgaatatcagagattgactgcgattcattatgacattgtcaagtagcacgagctttcccatgttaaggtagaatcattcttgttttgaccttgaatatggacaggattgctgaaacaaaagagacagttatgaacacggagccaattaaaagggttcacacaaaaataatgtcatgtagtgaaagctttcaaatgcaaataattttctgttcaacaatcttgttggcaagatcccatgctgaaatatccgcatcagtgcatgtagaccacacacactacttcatatacaacccaatttatccgtcaagcatgcatttcaggcatatatatctatcacgattactcaatttctttttcgccgggcattactcaatttctattactagatacctaatcaagtttttctttttataattgaatctgctatagcccaggcacttgacttcatgtaacctcctaaggaatagagatcgagaggaaaaatgcatcatcaataaataactgcaagtgaatgcagcccaaggttgatgaatgtaaaaaaaataaaaagaaaaatctttccaccagatgtcagcaggaagaaaatgagtatagtgtaggatacttcacagttcacatgcatttagttggtaaatgaggatactgtagaataagcacagttaatgtgatttctttgcatgtctcttttcacatttccttacttttgtaccttgactcttc

SEQ ID NO: 31139 - DNA, 209 bp, Oryza sativa
tttttgtagttaaattccattgaaatcaattggtattgttgtatggctaatactgtccatcacaactgttgtcttgttacatttatcagttgaagctacatgtgaccaaattctttgtagaaaaatagctgtatgatagatgtcagtgcagattttgcctttatctccgtgctgcctcatgttcttaatattctccctgctcttacagg

SEQ ID NO: 31140 - DNA, 1501 bp, Oryza sativa; identical to SEQ ID NO: 29550

SEQ ID NO: 31141 - DNA, 1007 bp, Oryza sativa
gccaacagatcgtctttaataggacgcacggattaaaattgtaagaaaacttaaagtgttgtgaagcatttgggtacctagttgagtttgttttttccaatacgatgttcactgctaaaagttttatagtttattaaattttatcgagatgactctctatgctgcttggcatatttagaaacagcgtaatggagtaatcagcgaagtggagtaaccttttgatgctaaagtagctaaagtaggtttgatagctacttggagacgtcttttgaaggaagatcttttgaaaataaagacaaaagctagagaaatgagaaatcacgtagaagcatggcttacccttttgtattttttttcctgtcttgtacataagcttctttgcttttaatatattaactacgtgtaatttatctcctgcagtagtttcgtcaaaaaatgaaaaagaaaatgcagtgttgctgccgctacttccaagttccaactcaccagccaaagactgcaccaacaaaggcatgaattgagaaaacgtttcaaagatgtctcttttttttttcaatgaacttcgtaattttccaaacaatttcattgtttcgtatgatagccatttccaagacaaatcttttgtcaaccattagaattttataagttcctttaatttatttgcaacttattattttcttttgtgtctttctatttgacgtatgcagctcattgtctcaaggacacgtagtcacgtccgtttcacatacaaaactgccgtatattttttacgaatatttttttatgatgaatttggtattacgaaaaaaaccgctatatcctttgtagatcaaatgatcaagttccagtataaccaccatataagacatgcggcacattgtatatataatacttatatataggcttgccaagtgtcctagcaattaattgtttgctggtaatactaaccttttggagcttttaattatacaagaatctcaccgaacttgtcaaaaagggaggtttac

SEQ ID NO: 31142 - DNA, 1116 bp, Oryza sativa
ctccatatgaaacttttatatggtttgccaatacatatgggcataagcaaagctggattacgggctgttcttttttttttcttatgccttgcactaccaaaatgtcatttttggtagggtagagttagaaacgaaacagagttattcatgagactccaaacaaaattgctgatttgttaccctcctaaaataatccaaaatgaacctacataagttcaccaaaaggagtcttcgtatctcatcttttcgtttatacttatacttatcagtcaaaatttgaatttttaatcttgaatttgatttgaacctgattttgaggttttttttatggaagtttatttttcagcctttacttttattagatcaccaaaaacatgtatataaaagttttattcataaattatttttcatttgtaattatgccgttttgcttatttccacgatgatgggccgtttgtaagagaagttcaccaaagaggctgacctgtgggacccaaacggaaccgacctgccatgcccatgctggctgcgtttacatcctaaactgaggtcaggtagattcggggtgctggactgccgttccaaagctgaaacacggaaacggttacctctgttcgcctcgtccttttcctcttttactgaaaccatcccagcccaccaccaccgcgtgtgtgcgcttcgcttgcttaacgttcacccacgccacgccgccaccgcctcgcttttccttctccaccatttctccttgtctcccaccaccacttccccccttctccgatccctcctcccatggacgccgccaaggataccaccgccgccgccgccgaccaaaaccctacccccaaccctcccaccgccgcagctccacccgatgactccgcggcggcggcggcggcggggagacggcccttcaccagcctcacccaggaggaggccgacctcgccctcgcccgcgtcctccaggagcaggtaaaagccgtacgccgccgcctcgggatctcgctgcttcaccacggtcgggggggtttggcttatccgtgtttttttttttttttttttttgtcggcgcaggagcgggcgtacatgatgctcagcgcgcaccacggcggcgactac

SEQ ID NO: 31143 - DNA, 1501 bp, Oryza sativa
tgatgtgaagaattgctagcacattgcttgactcgctcagcaatactttctggatcggtgagtccttatccttccctttttttttgctgcttctttatgttagcttccctgcatattgatctagattggttctgaaagatattacacgtggtaatacaggagttcttattcacattctggacagttaatccttatccaacatctctatcaaaaccatgtaactcttggtcactggctgggtaggacaaacacaaaaaaacaataagtaaatcttttcaggatgattagcctgacttttatgatgtgcaagagaagttgtacggacagtggccagcaatttcatagttaaatgaaaaatgaatagtttggtatgatataggtatgactttacgtatgccagcacatgaatggcattgatttcttctttctttattgttttatgttgatgaagagtcaaggtacaaaagtaaggaaatgtgaaaagagacatgcaaagaaatcacattaactgtgcttattctacagtatcctcatttaccaactaaatgcatgtgaactgtgaagtatcctacactatactcattttcttcctgctgacatctggtggaaagatttttctttttattttttttacattcatcaaccttgggctgcattcacttgcagttatttattgatgatgcatttttcctctcgatctctattccttaggaggttacatgaagtcaagtgcctgggctatagcagattcaattataaaaagaaaaacttgattaggtatctagtaatagaaattgagtaatgcccggcgaaaaagaaattgagtaatcgtgatagatatatatgcctgaaatgcatgcttgacggataaattgggttgtatatgaagtagtgtgtgtggtctacatgcactgatgcggatatttcagcatgggatcttgccaacaagattgttgaacagaaaattatttgcatttgaaagctttcactacatgacattatttttgtgtgaacccttttaattggctccgtgttcataactgtctcttttgtttcagcaatcctgtccatattcaaggtcaaaacaagaatgattctaccttaacatgggaaagctcgtgctacttgacaatgtcataatgaatcgcagtcaatctctgatattcgtatctgaagtctcctgcttgtgtccatttaccatgaaaccatcctggatgaagcccaatgaattgtggctgagaacagttgcctgattccagtcattttcatgtgccctcagttcactggcacttgatctgggaagaaaggtacacatttgttcctattgtattgctgttgacttgtcactatacacttagttctgcagttcctttattgtgtaatatcctggcattatttgtgatgtatgactctgcaatgtttggtaggcaacctgtttgagaggaactgcccatcttgaggtaaaccctccaggccttgtcgacaatggattcgagtcagc

SEQ ID NO: 31144 - DNA, 993 bp, Oryza sativa
tcttgttaatttgggaaaaattatcaatcctccaagtgaattttccataaagctcagaaggccttggccctaataaaagaaaatgaaaacaacaaggactgaagcacaaatatgaggaaatcagtaaatattagaaggttcaattatcacaaacattaatccagtagaatcctcaaacaggtaatgcattaattatatcacttctcaacaccgtagttcccaaagctggattttgactaggaggtctaggcgggagggtgccatcaagtgccaaagcatctgccttttattagacttactagttgaactagctgtcatgagatgttgtatagccattgaattttatttaaaaactgctgtaaaattatcgagaggttattgtaacagggtaatatagaaacaccttgctaataaatatgcatttgttgtagcacatagaagcgacgtaatgcagaaccctatttacaattatggaatgtgatggagtgttggcgggtcggaggaacccccccccccccaacacacacacacacacacacaaaaaaaaaatcagaagcatgggaagatatttgattcctatggctgtacatactagataactgaaaagaacaatatttttcatggttcttccacaatgatacattaggtatttaggccggctgggcaataaccactagtatggaaagatcttaaaggtaatgcattaagcagaaacaggaaataggaaagcgaattaaagaacgaaccacaatcatcatcatcactgtccgagtaagctggagaagttgatggtgttccattctcaacttgctcgctcgatctccattctgctaaagattccccagaatgactttgctgatcgcttggcaactcttcagttgacgaggatctaccatcccctgtatagtcctcaatcaaagtaccagccatgaatcaatcttcagggaaatgcagctcagctatccgcctcaccctttttgcttctataatagt

SEQ ID NO: 31145 - DNA, 1501 bp, Oryza sativa
tctccggtggattctgtgggtgcaggctgcgtccgactctgggcgtctggccccccggttgatgggaggattcggattctttgcattatttccttcctgccccccacggtttgtttggcgcgcgcacgctgattccgcccgccgtctctctctgtcgctgctctccaagtccgacatgacccgcgcgccgcggccgaccaccaccttcactcgctccttgcaagttgctgtagctctcggacagctcgccccatcagcacaaaagtcagctactactaaacttctactactactggtttcttccttttttgatagggagaagtttagcaggccgggccgcacttcgttcacgcgggctggtgatataggaccgaacaagtatggttgtattgtaccaaatgtcactcttcagagccactgcattgttcagtcaggcccaacagatagcacaagtatgttaagtgcaccgttaaaatgggctattttagttttttttttttgcctttgcttcgaataagttacaacagattattacagagtttattggtcaaaacgactgcgttttttcataaataaatacagtctaatgaaagcaagaaaattaactggaaataggctaaattttgagatgacaacctactgctaagggcttattcgtttcaaaggaattgcaaaggaaaagcataggaataggaatgtgttttaaaataccatatcataggaatgcaccataggaaaactttaggaaagttttccattcctccatatttgaaggaaaagcataggaaaaaataatccactctaacctaatgtttgcattcctttggttggtttgctcaaccaacataggaaaaatttctgtgtttttcaatccataggtttgcacatgtattcctatagtattcttacattttttatattcctacgttttgaaaatcctgtgaaccgaacgagccctaaatctttatctatagtcgacgaaaatctacatataatcggatatcgcgcactgcgcacatcgaactgaagcggacgatgctacaaaaagtgtcaacgagaagtaggtgaacttcacagcacgttacaattcgttgcggtaacagtatatgctacaccgttcaaacgtgctcatctgcacctgcctgttctgtctaggacaacgaaatttctttccaagacagtgcggtcttctagaagatgctacagtaagtgccaacaaaaatgttgccatccaaacatcaaagtatggaacttatagaaaaaaaattgaaaatatacttttatttttcatattttgcatttatatacatgtctgagattaatttgcaaaaatatacccaatccacatgatggttgcgtgagagcgccggtcccgcaggccggggatgcgataccgcaccggtcccgcaggataggcgaacggcaccacgggttgtttgcgtcacggtgcggacccgccgagctagagcgctcccgcatattggatgcacgggaccgccgc

SEQ ID NO: 31146 - DNA, 1501 bp, Oryza sativa
acagcaacataggaccatgtatactctctctatcccataaaaaacaaacttaaatacgggacgtgacataaatatcaactgtgtcacatttccgtattatgtttttttatgaagaaagtgtatattaatgagaagctagtagccatgagcggaagatttttgtatatagtcgataacatatgtacataggaccatactctctccatcgaccatactctccgtttcaaaaaaaaataaatctaatagagaatattatacaggtgtgtcatatctgtatgggacgaaagaaagtatatactattgagaagttagtagccgcgcgtggatgctttttgttgtcgtcgtcgtcgtctttcggcaatgaaaatctcgatgtaccgtacataaagatgtgtatatccgggcagatcggaaggtgacatgtcatggtcatatcaaccgagatggcattcaacaaatcaactaagttgttgacaatcttaattacgtacgtccaatgttgacagagagagggagacgtacgtccttcaccgtcccactaacaatgttcttaactaaattaaccaacagaaaagatacaaattaaaatggcaggccagcatgggcgcttgatcactttccggttcatcggaataatctccgagctgagatgaaaccggtggctgcagggaagaagacgacgggttgcttctaatgaaaaaaaggcatatagatatataagtatactttacatcgtactacgtatatccctcattcgaagccaaaaccgccatgtagtacggttggcgccaacaggtagtaagcacacactaagcacatttggtggtagaaacaagtatagaaacagtcgatcgatatattccccaatttgggaggatatgcaaaactaagctgcccaatcaggcaagcacgtacgcttataaagactactcctaccttaattagtagtagtagtagtaggagtattagtaaagtgaaagcacttaggacacacgcatcaacgcacagtggtcatagccgtagtggtagtggtggtactatagtagtagtagctagaaggctcatgcaggggaggggaggagagaagcaactcaaatgaaagactacctagagatttgaagtccttccaaatatttttaagaaaaaattataaacatgtaagagattgaacacgagatttcgaggttaaaacaacacaatcttttatctctatacttgagtgtatctcagtgtgttctactttcatcggtctctttgtttttttccaaaatggattaaaactcggtctctaaatccaaatcgaatatactcagcaaaccaaatcaaatggagtatggttgtgtttagttcacaccaaaactaaaattttggttgaaattggaacgacgtgatggaaaaattgaaaatttatgtgtataagaaagttttgatgtgatagaaaagttggaagtttgaagaattatttggaactaaacacggcgtatatatatatatatatata

SEQ ID NO: 31147 - DNA, 918 bp, Oryza sativa
cccctcggggagacaaagagaagggcggccgtatcacctcgggcccgaccccccccccccgagggtgttaggccacgtgggtgatcgtgtctgcctcaagtctctaagtcatgatactcccggtcccatgtcaccgacaagtataatcgttgaacacgtatataacaatataaaaattggtgcaaggacgctttaggataaagttaggctttgtgttggttgtaagagcgtttttttggcgatctcttctgtgttcctttgttagtctagcggtggtcggtcacgcttagcggcggctggtacggtgataggcttctctggttctcccggacctgtgtgttggtgctgtcggtatgtgggtggtggtattttttttatcctggttacgaccttatatggttgtaatcttataattttttcatgctctatcaaaattttttcatgctctatcaacagaacatcgcaccgtatcatgcgagtggttaaaaaaaatctcttccatatcacataccttgtcaaaaactaaatgaaaaaaaaagaaacaatcagagacccttagcaagttggcatatactacagtacagtataaaaatagtataaaccactaaacctcactttgattatcgtaatctaccgtgatccgagctgaaacggaaggaaatccacagcgttagccacgcgggcagactggtgcaccaacccaacccgacccgatacggccttaactgctcttcacctcctccgtctcctccccaactagaacccccacgcactcacgcgcactgcacgccgcaacacaacgcgctcgcctcgcctcgccccgatcggtggtggtgctcgccgtcgccgggcggcgctagggtggccggagaggctccggagagtaggaggaggaggaggagccggagatgagggggt

SEQ ID NO: 31148 - DNA, 1501 bp, Oryza sativa
gagacaggggaagacgagctctggcagcgacgcaattcgacggcgtgcgcatggcgacggtgtgactcgtcgctgcttggctacactcacgagagacggcggcaaacctgacaaatgcagtttcatattccacatttgcggcgcacgtaaaaaacacaatatctcattttagtttggaatactaacatacaccacaacacctagattattctcatatgtcggtgctataggctgttgtccatgcaagcaaattttagtttccagagactgccatagcagcaccttgaaggtgctagaagtggccacagaacctcatgcacctgtgtgcgtgcccgacaacgcaattggtgcatgctgagagcccttggtcggctaacgatgccaccaaggagggagaggccggacctgaaccaccgcatcgaaagacaaatctacccttctaaatttttgtactgcaaaccaattaattagaagatcaaatcaatctgcactgttaaatcatttatactggcagtgtataccatcagtatgttgtaccggaaaagttctctcggtcttattgcttatccccaccctctcatcccctaatctcaaatcccttcaccactgttgctatatatctcagtgaactctagtagctgcggagagccttcaatcaatgtctctctttcgctttagcttcttcttttctcccttttttcgtttcttttcttttctttctttctttctatttttctttttggtttcttcaaggctctataccgtaaatgtgtacgtactagtttttaaaaaacaagtcaccggagggaagaggtttctcacctgaatatatctttcaaatcacgtacaagaggaattctaatcaattataggagatttgacgatggattcacaagtaattcagcgatgccaagctccatcaggattggccaaacgaacttgtttttgttaattaaagcgaaccagcacaatcaccactaccacacaaccatcgtccacaaactaggtcctatcgccagaagacaaaacattgttgacggatcagggcgaagatgtggctgcttgatttggggaggggagtggcaagggattagagatctcgaatcggcaatcgattggtgcaatgatttggctaagggacacaaagcgttatttgtaaatgagtatttatttgaaccaaatatatttatatagtgaatatagtgtgcttcgataaatagaagtgtccagtggtagtgacataattgttttagtgtcacatatgtccaatgccgcatagttagagcgtcacatagtaaattttgacttatgatatattatttcacatacatttataatagagtaaatttcagaaaactacaactttagtaacaaaactatcagtttgctacaacattagcgacatgttttagtttgctgtaacaatagcgtgaaaaattattccaaaactgcaacttttacgttatatgctgctacagttgtcacctatatgtactgtagc

SEQ ID NO: 31149 - DNA, 915 bp, Oryza sativa
tagtgcccatggttaatttggcataattctagaacctgcttgaccataacatgagatttggctttcaattggtatcaattcaaacccactcacttaaaatgctaccctaccaaaatattggtagtttcaaatatgcctaagttttggcactaccaatattttggtagggcactaaaccaaataagccctaccctcaattttcttggatccgtttgtctcaaataagcccagtgataaattcgcatttcctaccacattctgaatccgtcttcttttaaaattacttttttataaatactcttttcgtctcattttaagtacagctgtgagtttctgtgtccaatgtttgaccgtcaatcttataattagtattttttattgctattaaatgataaaaatgaatagtactttatgtgtaacttattttatttatttttttataaattttttaaataagatgaatggttaaatgttggacacggaaacccacaactgcactgacaatggaagggagagagtagtaatgtttttctctatcgtattagagcacccacaatggttatctataggctctctacgagagatccatgtcagcatattttcctacttggaagagattaaatgaagagagagagagcaaagctatctactaacctggagatagtctatagagaaaaacgaggcaatggattagagagctatagatacctatgtatagatatactattgaggtggtatactattaatctagtctattgctgagatgtacatattttatagatagcaccttactttaccattgcgggtgctctcagagaaaaataacagttaaaataggaatataaaaatataaaagaaatccaacccgtaaacagataacggtcgggttacccgctccaggctccattccccccg

SEQ ID NO: 31150 - DNA, 1501 bp, Oryza sativa
  unsure (1)..(1501): unsure at all n locations
ccgatcctgtggcagcacatcttgctctcttgacacatgcgaagtggactccttaagtctctgaacacgcagcctgctatatgcgtcaatgttcagatgtgagaccaagaagagctctacctcagcgacaaaccgctccgtttggccaaggaggaacggcctggcagcttccatgagcaagctcttgaattcttccctcctcttctctggtggagccatcttcgaggcatgccccttctcttgccttttcatgaaagactcgatcacaccatggatgtggtagataatagcgtcaacattttcatcctgcaaaacccagtattacaatacattgcagcaagcaacacgatagcagcacgacgattatataacatcgtagaataatcacaaattctcaactctctacgacacttgaaagaataatagaaaccatcatcatgctcccaagtcatgtgcacttgagtgcgtaaatcaaatccaatttgtactaaactataagagtaggtattattcccaagtgtgtgtttcagctatgatccatgagtaatgggtaaaatgagattgtcagataatgcagataagaagagaagccctaattacacacagataagaagataatgcaagtgcgacccttttaagctatggaataaccgtgtgacaatatgcagtactgtatgtatgtacccgtgtaagagcctgtatttcctgtcttagccaggtttgaagccaaatgttcttgcgaagatacttgcgttgcttccagaattgctgaacgctggaagtattgcctataatatctgttcagttgagcacacgtcagtcatataacactagattcatagatagatatctggaacaggttctaaaagtgtgagcacggacataactaanaaccaacactatacctcgtatactatagaattgggtaatcaagtcgtgtgcatctgaaagatgtctgcacgaggaggaaaatgagcttaatatacttattgaaacatgtaacaacaatatttaatgtacaatgagaagagtggcatgcaaatggtctccatcgcagaaataaaagaaaaatgtctgctcgttaacattaactacaaaaagcgcagcactgcacaaccagatggagggaaggagataactggacctttttctggggtcctgatttatgtagtgccgctcaaatgattcaccattaaaaccatgtataatagacacattcacggtctgcaaatgtcacaagggacatataatcaggattcaggacctcagggcacagtctcaggtgaacaaaaaatttgccgggcggtgaacaaaaaaggggtcaaatttatagatatagttgactgcatcatcaatagataaatgtagcagcaccaaaaagtaatggctggtatggtgtgttctccacatttaagctttcctagaaaaacacccaaagctagcaaattaaacaatattcaatagtggcgtttcatcacgttcaaaagcgtttttttcaatc

SEQ ID NO: 31151 - DNA, 1342 bp, Oryza sativa
tcattgcgaatcatcccgcagtttttatactaccttttaactgcatctcatggtgctgctcaaactaattgatgtcatgcattcgctgcaatgaattttttttgtcccaagtaactttcaatacaatggtctaatttcctccaacgccatcaaggacattggggagaaaaggcatgcctgccaaaggcacacaactacgaaacctacagaagaacgaaagatcacagcgtgcaaaattatacaatcattctactgatggtagtagttgtcacttgtcagcatggaaactcactcaatcagcgtagaacctgatgtggttctcagcattcaggaccacaaaatcagtatcaattgcaattatacatttgtttttttttcccacaaccatatcagcatataactgtccaccggcagcgatttagtttggatcgttagcttaagcatcacatggctccaattcccctgaataaaatcaaaagcctgcaccacaaacaggagtgcgcacgcaatcgagtggcaatcggcaagccgcaagcgcagccgtaccaaaaaccctaaaccctagccaaatatcaccaaacaaatcctagctcaccaaatccctcgcggattatgcgcgacactaactggtaaatcacacgcaaaccgaccaaaaatagcgcacaaaaccctaccgagaagttcaaactcgagctcacgcccaaaaaaaaatagaagtacaaagggggatctcacagcgctgtggcccgtggccggggttgccggcatcggcgagggagtcgaagcggtcgcggttggaggcgagcacggaggtgctgcggccgaggaggcggccgcgcgagcgcatcacgccctgggagacgatgtggggtacgggtagcgcgcgcccgccgcggccaccgccccgatcgtcctcgtccatggcgtcctcctcctcctcctcgtcgcggtcgtagtcgacgaactccacgtcctccgccgccgccgccattgggatgggagtgggagacagcgaggaggaggaggagagcgtgtactgtttgcgccgcggaggtggcgacgtccgacgtggtggttttataggcggtaacgacggattagcgcgtgattacgagggcggagagtcggtaattaaggagggagatttgcgtaatgatcccttgagatttcgttaattaactcgaagcgaactagtgctaggctgctggcttagatgtgggcccactggtcggatcagcccatccgtctgatctctgatcggtaacggacggtccagatcgcatctagttcgcacccggggggcttctccggacagagatggcggcggcggcgacctctccct

SEQ ID NO: 31152 - DNA, 531 bp, Oryza sativa
aattattgcgagggatataattttcagcgccgcatgaaatctaatgctactgagtatagtagtacaactctcggttactcaatcatgaatatatatatatatatatatatatatatatatatatatatatatatatatatatatattaaaaaaagaacatgaatattgtagtcgatcgtcttcctgtcgcctctctcccctcctgcgtaaattacaggcagtccagttctgaagattcagtgcacaaccagatcgagccagaagcatatgctaatttcctgactgacccaaccacaatctcagctttaattttgtacaccggatattatccttggagtttatttactcctttatgtttctagtacgtacactgctatcctgcactgcatataattaacaccagcgtgcattatttatcagtgatctaggtctacgatatttttacgttgccagtactgtgccatgcatcaataatctaggtttacgacatttaatactgtcttttcatcagtgctcatccgatcattcgat

SEQ ID NO: 31153 - DNA, 1501 bp, Oryza sativa
atctctatgttgcctctagggcatatcactaattaacacatgcctacttcgaggtgagggcaatggcgaagctatattgtgtttggagagtgcacatgaacccccaaattcctaatctcacttaaaaacactaaaaacactagagtgtatattgttgtattgaaattttctaggttttcaatagtagtgtacccctttgttttgatgctagcttggcccctgggtgagcgcccccaaaaaaatcgagggcccggcctgtgcagccgtcgtgttgctcatggctagctatcgacggccctgtgcagataaagaaaattattggtaataatagctagagtcaggccaatagggataatggtttcttgggttatgaatacaggccaatagggataatggcctgtgtcagatttagctcgaattaaaatactcccgcgtgatacttgcttaaatattaaaatcgtccacatagtcatcaattgatcaattcatcatcatatatagtcccatatgatgatctcgatcgtacgtgacgatactttgaactggtccacttgatcaacagccgatgaggtattcttccttatgtaaaagtacactatcgaagttacttagtactattactttgctacctctgcattaaaataatttcgttaacgcaccacgctcccagggaacgtttctaaactctcgagtgggcatcccctcgatctttgcattctatccaaatagttataaaaaaataaaaattttgataagatagattgatatgttatatataatttgactatggggtatttagatatagaggtgtaaagttttggcgtgtcacatcgggtattatatagggtgtcgcatgaggtgttttgacactaattaaaaaaactaattacaaaatccatcagtaaaccatgaatgtttactgtagcaccacattgtcaaatcatgaaattaggcttaaaagattcatctcgcaaattagtcacaatttgtataattaattattttttagtctatgtttaatactttatgtaggtgttcaacgttcgatgcgacgggtgtaaaatttttatgtgggaactaatcagggcctatatgtatatgttaactagctagagttccatttatcccttttgttataacttgtagaagttgaacttgtacgtatttaaagtgattaaatcacatattaatctatcctcttaatatttttataactatttagatgacatgttacaatcaatggaaatataagacatttaccaaaggtactcacaatttatgttagatttacatattatctatttgatcaaataatgttgtgcaataattgactcgtattttcctttccagagatgctatcatagcttaagaatacatctggtaaatagatgaactacaaggctaatgtaatattatttcaagaccttcctcaactatttttgaaggttaccacgtcatcttgaaccctcaacatgtagatattcaaacccagtgagttttt

SEQ ID NO: 31154 - DNA, 1501 bp, Oryza sativa
agataatgagaagttcttagccggcagtcagaacacgataattctttttatctgaaaacagtctcctaccaatttccacatgcgatttacttgggatgctattgattgctcctggatgtagctgcagaatacctgaagaagaataattcattatggaaaaacattatcgctgcaaatatatctttgaccattttcttgaaattctgcttgaccacctactagcttcataaatatatttcatgattaaaacttaactactccctctgtttcaggttataagacgttttgactttagtcaaagtcaaactgttttaagtttgaccaactttgtaaaaaaagtagtaacattttcaacccaagacaaatttattatgaaaatatattcaattattgatttgatgaaactaatttagtattataaatattactatatttgtctataaacttagtcaaacttgaaacagtttaactttgaccaatgtcaaaacatcttataacctgaaacggaggtagtaacatattctagttgagcatctaggctacgatgatgcaaaacattagaaaatctttcttattgtttcataattctaaataaatactaaaatgatttcctattttggagttgttaactatcatggctaagtacaacaacattctatattggtgcatttcatcagatattcagacactttttatagtataagcagaagatatccaagaatggaggatgtagaacagaattgatctaaatttgaaaagcaggtcaagtttgatattcacttggttgctatacaaattggtaaaggcacatgtatgtcctaatttactatggagtattaaaacatcacagtcatgaaagaatgatatattcaacagaaaataaaatcaatttcatcaagcataccaactgtcccaacagtatcaattgatcctgattccaaaacgtgtttctcaactgctaatgccaactcagctgccgccagtccagcatcatttctgtaaaaagtttctttacccatgtaaatatgtggtggggacctttcaaaataatgtaaaccacatggatgaagaatgaatggaaatgctaaccttgcaggcatgagcactgctccagcatggcccccattcccttcaaactccaccttaatacttgcaggagcagcaatagcagtgacaacgccaattttgatacctgttgtaagaacacacatgagtataagaagaacaattttccataaacttattaattaactcacaatccaaccttctttttccaaaatggggccctgttcaatgtgcaattctacaaaagcaaaatagtcgtctttcttcaaaaacacattatgtagctcctcaggatgcatcttgtagccagcagagtctgcagcatcaaaaaatgacacattctgattgtcaactgtttctttgagggatcgagccagttcttcactccctgccattaggcggctgcacattttccagaagtgaaaagataataacc

SEQ ID NO: 31155 - DNA, 185 bp, Oryza sativa
gtctaccatgcgtcgcgatactggaaagtacccgaatagaggctgtgacaataccctctgcataacacaactcaccacagtgcaccattcctggatcataatcacccccttataaaacaaggcatggactccccagtgacccccgtgggcttatctccgccacttctcagtctggtgctccgcaa

SEQ ID NO: 31156 - DNA, 429 bp, Oryza sativa
cattagttttgttaaaaaaattataaaaatgtataagatataaatcatgtttaaaatactttgagcgataaaacaacttataaaaaaaataaattatattacataaattttttgaataagatgaatggtcaattatatgattaaaaatcaacggcgtcatttattaaaatgaggttgtatatactcttcctctattttatattataagtcgttgatttttttcagtcaaacctcgttaagtttgattaagtttatagaaaatagatggagggagtactgtagtagacagtgcagcacgtggatgtgtattttttatatgctggagaatttaattaccaaaaccatgtgtatatagcatatgattgatatctttatcattatctaaaaaaaatgattgatatctttatattcttgcgacacctttgcagg

SEQ ID NO: 31157 - DNA, 1501 bp, Oryza sativa
gagacaaggtctgtgctgagggtgccaagcttattgttatcacattaaagttcatagttttgttaacctatagaaatttgaatcatctcaaaataagttatatttgattttatatggattttacaagtttaggtgttttgctgttaaaaagtaaaggcttttagtattatcttttacattttcagattttaaacttatggggtccacctgtcggtctcatgccaatatgcaaaaaggcccctagggtttcaggaaatcaaaccgcagtcctatgcctgttctgtgtgtcatgagcttttgcataaaggaccctacattaacctaaattcttgtgaggaggtccctggttcgagctgaagcagatcaagccatggctgagctcgatttcaagtttgccagcggcaaacggtggctcgtttgagggtgcgaccaaaagacaaaatgaagatcatgctattgcgattccattcctctacttttatcggtcagtggacatcggagtaacgccggcggcgagtccgagcggcggctgtgcttaggctgctattgcttgttgagttggtgctcgattctaagtgaatgaaatgcatgaatgcaatcctatgggctcaagggtgctcaccgaaccttgaacgagacgcgggaaagtctggactgcggcaacggtgaagaagatggtccggcgacggtgtagagctccgggaagacggcaacggctcgatccactcatcgaattgacatgcatgtgttttcatggggttagtgaggtcccagggatggtgtatacgcgaagaatcggacaatggttcaccggaggaggcgaaatcgacaatggcgacggcgaccggaggtgaagaagacggtagccgatctccgcactcgtagtaccatccttctagattcttgaaggaaaatggagaggaggtcgaggcgaaaacgctggcgcgacagcttggcccggcttggtccagataagcgggaacggcaatgatgtcgctgcggcggtgcacagagcgcgctctagagcgaccatgacatggcagcgttcccgctgctgtagaagatgaaatggaatgggataaaaaccaaagttgttcggcatggtgagatgagaatggaacgagtatgagttagagatggagagggctcgacgacggttggcgatgtccctcttcttggcggccggcgacgaaagagaggtggagagggagagctggagcttcctccctcggttggatcggcactgggatggtgggtgaagagtggcgacgcagctgggtggaggtgaagctttggttcggcactgccacgtcgaggccacgcgtcgacgccgtccagtgccggtcggcgccctcagtctctctctctcggctgtcactgtgttggatggaggagaaatagaatatggacagagaagaagtgactcagagaggcttccaggtgggtccagggcgaagggaacaaggctggagtgagagaggtgggtagaagatggggtgtt

SEQ ID NO: 31158 - DNA, 853 bp, Oryza sativa
ttttttttaatctgaaatattcaacacctcacgtgtttattagctccatctttgttttacgggaacattttgcctccatagacactgagaaatacatcatggctacatttttttcccctctaattcacaggccatatattaccagtgacctttatgtaccattcttgcacatccagacataataggtttccagaataactaaaaagaacattgaagtaaggtagaacaatgtcatatcctggcaaaatttagcttcaaatgtattatttatcaatataccaaaaagggacaagccagaagattagtaattaagcactgaaaatcaccattcgttctatattttttgtttcgtgtctgcctcttactttgggagttgagtttgaaactttcccaaactgtacatccctatcatatatattttcgcatatacttgagaatttttaaaaccttttaaaggcaggatacataagagacactctgcaggatgtgatcaacaaagccagattgtgaaaagaaagatctatgagtgcacttaaaaatgcttttctatggaattctaacatcaatatgtagcagaatacttgcatatgaaatttcaacatgtaattagtggatggttcaaggaataacaaaataaagaaaacaaataagctaagttctctggcagtgaccatgttcgctgctgtgccatttgcatgttttctctttgctgcacatgccttataactcacatggtgtaatgaaagtaatatatagttctcccaccatatgtttctgtccaattggttttcaaagttggatgcatgcaatagttggaattgttctagtcctatgatatattgtggtcacttca

SEQ ID NO: 31159 - DNA, 893 bp, Oryza sativa
ttgatttgtggggattaatagtgggaaagcttggcctgatgcggtggggggtttggttgttcatttcaaattatagcttgtgcgggttgttgtatagtctgctatgagaaaatctttttttctgcatgatcagggttgatttgatgcgcattgctacccagtgtttcgatctaggaagggtttttgtagggtgttgacaatttaggtgttcaggatttgacttggatcgttgacaatgttcggttatgtctagcatctctgattttcttcatgctggcttgcgagctcgttgatatcaatgatttctggtgttcttttactgttactttctggttcaagtgctggtggttgaagaagatttatggtgttctttactttgttactctctgcttctaatgctagtggatggagtgaattacttaatttgtagtaaggagctatgattttttttctgcactgtcatttttttctgattatctcattggataccaagtgttgcactattgccaaagtaagttcgtattcaatgcaagtaaatgagtgcccagtgtcatgccggcttgttaacattatactcgttatcctgcatagacatgcacagggttgatttcctagaacgcttagagctttttgtttgatgcaaatggattcatttacagtttccaaaatgtgttttatttgctttcagaatatctgatctcacgttgaccttatgtagctcagcacttctgcacataattatataattatttgcattgattatcgctatgcacaacattggaagctaaagttactttgtaatatatgcttcttgatctgtgaattggttcctctgcttgtatcgtttttgtttatcatgcttgtgtctccaaccttatgtacattattcgtct

SEQ ID NO: 31160 - DNA, 553 bp, Oryza sativa
tgcgtacgtgtgttcataggggtgagtgcgcgtgcgtagcgaggcgcctgtggtgacttcgtcaatctctccaggatttgagtgcgcgtgcgtagcgaggcgcctgtggtgacttcgtcaatctctccaggatttgctcataggggtaggggttcataggggtgagtgcgcgtgcgttatgagtgtctgcgttgtactgtgtaattctcaaaaaaaaaatccaatgaactttgacaaatgagtgtctgcgttgtactatgtaattctcaaaaaaaaaaatccaatgaactttgacaaattttcttcaaaattgataagcaaccaacctattatcatgataacttgtgcattccaaaattttcaattttccaacctggttgaaaaatatgcggattgtgatcacgaggaatgtgacgagtacttcctaataccgttgactagtcaacttgcgagtcaacactccaccacgactcgcacggtctccctcgcctttttccttccaattactacgcagcacacacaccccgcttcgcccgcgaggcgttcgacggaa

SEQ ID NO: 31161 - DNA, 1501 bp, Oryza sativa
cgcggcttgaaggaaagaggccgatccgaatcgaactctatttccacgaacttccaaaacgatttagccgatgtttccaaaggagaaaaggtagaggagatcccggagattgtttcccctcaatcaattcggccggagaaggaaaggagcggccggatttggaaggaaacggcgacggcggcgcgctagggtttcaggcggcagcggcggctcgaggaagacgaacctgacaggtggggcccacctgtcagcggctgagagagagagaggagagcggcggcttggcggactgggccggctgggccgagggaaagagagagaagggttttgggccggctttcggcccaaagccaaaagaagactttttaaaacctttttcaattaaattatttcttaaatgcaattccatttattaaaaatacttccttagctcaaataaatcccagaaaaatctaggaattatagaattaagcaaagtatttaatgaaattttatctggcccctttttatattgagatttagcaaattaaaattagatcttctcttttaggcttttaaaatcatttctaataattccttttaaacaacaatttataagttaaggatttttaaacaagaaaagctcttaacaattatacttagatcattaatgatcaaataattactgaactgttctttgtattatttaagaattgagctctgaaaaatccgagaaaatttcagagagttgacttaaccatggagaatttaataaaaattaaatccatccatgctttagatttaagaaaattttatttcccacattttacttcacttgaaaattaaagatcatttaatataaattctattaataatttattaaataatttataaatcctgaaacgaaaatcaggatgtgacagatctacccccctacaaagaatctcgtcccgagattcggaacggctagaaagaaaaagggaataggtaaactgcagtctatcttattccataactccgataattattctaaggctttaaagaaaactactgctgccttgaaactggtggctgagttgtaacacttgaagacacaactcttgaagacgcaactggcactgcattggctcctgtgacaacaatgttgttgacctgaccttgcggctgctgatgcttcggcttcggacactctcttgcaaagtggcccggcttgtagcagttgaaacatacctgctgctcccttctactactgttattcacttgagactgatcctgctgaactggcaccggctgattagcttgctcgatgttaacttcattgctttcattagtctctgatttgatctcaccaccgatattcaactgttgcgactgtccttgaccagcggaagaaggttcaccaatttggagtggcttgatacgctgtctctggctactaccttgtgcctcctggaatacagtcatttttcttttacggttatccatcctgttcttcttgtcttcaagtcgaattgctttgtca

SEQ ID NO: 31162 - DNA, 1501 bp, Oryza sativa
aacagaaaatcacaccacaaggtttagctttgttttttttcgttttctttttttggctttgcttgctgcagcttcttaaagaacagagatgatcgccactaacccatggagactattccggtagttgacatatcttcagatttgatttggttgaaaattatatatatggctctacattcccgcatcctcccaaactacaaccttgtagtatttcatttcattaccttgtttatcttgtttatgctaaagtaaatgacctgccgacatagccattttctatttagttcaaatcttcagtataatatttgtttgaaactttctgtagaagtttctgataggattgcacacgatcaaactccaaattcagagtctatgttatatatatatgccggatataaacaaaacggaaggttaaacagagaggacaccatgaatgtaagccatatgatgtaccgagtaagatagtaagagtcaatttaagtttacctgcatatagcatgatttgtatatgatttgttagtgagagttgttgacagattaagtcgtcctgcatctcagttgattatgaaggtaagctaacattaggccaagtctgtaaaattactttaaatttcatgcattaaatttgacggactaattggccatgaaatttttttttctaaagattgattacttaattaacacaataaatttatattttcagaaataaacttcataaatatcttagaataagtgatctaaacaataaagaagcttttttttataaatatatatttagaagcgtagaacaaataatccataggaaaaatcttgaaaaaaagctttgaacaaactggtcacaaatagctcggaaaaagtgatctcctaacaccagttggttctgagatttaagacaagacaaggctaagctaggtgtttgctgtaaagttactctaaaatttgcacgctctaaaattgttttcaagttaagatccactatttggtttattgagaatttgagatagatagttatgatgtggtgctgagtgagtgttgacaaaaatttgtatctttagcaaacaaaagcagtagtgaacctaccagaatggttcaaaatcttaatttttttagacatagtgttcatagtttataaatgtctcagcctgcaagacagaaatatagtattactttctttgttctttaaaaggcaaaatcattaagaattctctgcaagtcaaaacatcaggagatgacgagactgatcaagttttgttttcttctaacaatgtttcagcctccattattcatttttctctcagaagtcaatccatcagaatactagcaataaatcaatgcaatgctgtgcactacctacatttgtcaacgtttgtaaggccaaaatgctacctatataaatgtcatggagttttgacccaacacaacacacacaagctaatcatctctttctctaatcagtccatcacctgagctgagcagcaaagcatctgagttgcagtgttca

SEQ ID NO: 31163 - DNA, 1501 bp, Oryza sativa
ttgtccacctgtaaggttggggatggaaagacttgtctgttttgggatgatttctggaataataaagtcaggtcagtaatgtacccaaggattcactcttatgctgtttctttgaaggattcagtgagtttaacctcttccaagagtatttcgcagcgttttaatctccctctgtctgagcaagccttccatgagtatgatacaatgtctgcagctgatcctttagatcaattatctgatgagaatgatgtctggtattatgtttggggaaatggtttgttctcttccaagaaaatatatgacattaatttcatgcatatacatgcgcctagttatctagcttggatgtggaagagtaagtgcgctatgaaggttaaagtttttggatggctcctgttaattgatcgactcaatacttatgacatgcttgacagaaggcattgccctcccaataattcagatctaacttgtgtcctttgctcaaactgtgcaagagaaaccacctttcatctatttttttaatgtccttttagtgctgattgctgggcacagtttggaattgtctgggatatttctcttgccttcacagatatgctgcatcaagcaatgaattcttataggtctacgcactttgtggagaaaattctttatgcagcctggaatatttggaaacagaggaacttcctgatttttcagaatttaacaccctcaatttcttcttggaaagctctctttaagagtgatctttcccttttagtttttagattaaatgtttctgagagacagtcccttttgaattggttatatcttttgtaatttattttctataataaagctatttaactgtgggggctttccctatagtgccttccctaaaaaaacaatatttataaaagtataatattttaaattaaaagagttgcgcattacgatagtttgtttaatgataaatatagtagcattaattttacatgattgatttttttttattaatagttaaatttaaaaaactttaacttatcactgtgctaaaaatatttatattttggaacggaggggtaagtaaatataagcataagcgaaaagataaaagcccattggtctgttgagggcataatgttgtcattacgacatttggctcttgacacatcatgctgaaaacgaccaacaaacaagccttgccacaactctttcgttcatcggttagcttgtcatgcgtcacccgggatcacgttcaacgtagggagccgtgtctatcattctcacgtacgatccatttgatccagtcttcacgttcgtcttctagattcgactcgactcaatgactcatccccaccactccaccagtcatcacacgctctcgtgtcctgatgccgcctcacatgcgattccttcaccaatcaccctcacaactctgcgttcttttcagaggttcggatggactgattattctcacgtaaaatggaaaatacgattaccatataattaaggggctgctata

SEQ ID NO: 31164 - DNA, 1501 bp, Oryza sativa
attatgaacctaacaaatagcttgttcttttgaacaagtggtctgaacaatattgatgcagaaaagtttttggagaaataagaccttttaaaaattatccgcaaataattccccaataataaaaagagatatctgatgcagtacaagtgtacaaacaacaccataaatggcacactaaattctattgggggcaaacttgtgggagggtatgaattatgatccactcaatataatgcagagggttggtgtgaggtgtaatctcctggtctgatgttaagagggacatcaatctggtgttttgaaccactaatccagtactagcaatttacactttattcttgctcactgtgtctgtgggcctctcaatctcatcatcacatactctcatctgatgtgaaagcaaaccacacaattatcaagcactttcctctcatctttgtatcttaaaaaactgtcatagataatgcatgccacccacatcttttcctgccatctcccatttcttttcacacatgattggtttttgggactaacaaaagagtgcagtacagcaatccatgctgttttttttctattcacatctcaagaaagatgttcctgcactccaaataatccagtgtcatttgtctttgcccaacttccaaacaaaattttagtattatactccaacctaaaccttacttgtctgctagtactaagtttaccactaaaattcaccattcttgggaaagtaaaccatgccaagaatcaatctgaattctgaattctgaaggagaagcaaagaaagaaacatgagttggccttggccatccatgatccatctggaacagtgaagctgcagtgtgaaggtggagtgaaaatggggacgggtgtgagtgtccttgcagcaaaggacacaaaaacccacgcctgcttgctctcggttaacacacaacagtaaggacaaggcattggattcggttaaccactagtggtagtactaccactctgctgctctgctagggcagcgtgtaccggaatgtacccgatgtggtagctacgagtagctgctgtgagctgaaagcaagcaatttatacttcgttcgttcacttcatcagttcatctccttgattcgtactaggacacaaggattgcttcttggagctcttcttcttctttgtgttgttgcggtggtggtggtttttcgaggtgaaatcttgcttcttgtgttgtgttatcagtaatctgtattatttcgagctgccattttgctgttgtgttgttcttcccaattagtagtagagatcttttctgttcttttaattttctggatgcgaaaaccccggatttttgttggtcctttcaaacctttttcgttctcccaatttcgcgtccatgcaatgcagttggcgttcggagtaatattcttcctttgtcagatttgtgttcttgatctcgcgcagaaaattttcttttcaggagaagaaaaatcttcgaggtgcgtgtgaagaatcggatgtg

SEQ ID NO: 31165 - DNA, 1501 bp, Oryza sativa
ttatattaacaaagttcctcatgctgatcgccctagagggtctttttggtggaaagatgttctacaatttgcagacattttcaggggattgtccacctgtaaggttggggatggaaagacttgtctgttttgggatgatttctggaataataaagtcaggtcagtaatgtacccaaggattcactcttatgctgtttctttgaaggattcagtgagtttaacctcttccaagagtatttcgcagcgttttaatctccctctgtctgagcaagccttccatgagtatgatacaatgtctgcagctgatcctttagatcaattatctgatgagaatgatgtctggtattatgtttggggaaatggtttgttctcttccaagaaaatatatgacattaatttcatgcatatacatgcgcctagttatctagcttggatgtggaagagtaagtgcgctatgaaggttaaagtttttggatggctcctgttaattgatcgactcaatacttatgacatgcttgacagaaggcattgccctcccaataattcagatctaacttgtgtcctttgctcaaactgtgcaagagaaaccacctttcatctatttttttaatgtccttttagtgctgattgctgggcacagtttggaattgtctgggatatttctcttgccttcacagatatgctgcatcaagcaatgaattcttataggtctacgcactttgtggagaaaattctttatgcagcctggaatatttggaaacagaggaacttcctgatttttcagaatttaacaccctcaatttcttcttggaaagctctctttaagagtgatctttcccttttagtttttagattaaatgtttctgagagacagtcccttttgaattggttatatcttttgtaatttattttctataataaagctatttaactgtgggggctttccctatagtgccttccctaaaaaaacaatatttataaaagtataatattttaaattaaaagagttgcgcattacgatagtttgtttaatgataaatatagtagcattaattttacatgattgatttttttttattaatagttaaatttaaaaaactttaacttatcactgtgctaaaaatatttatattttggaacggaggggtaagtaaatataagcataagcgaaaagataaaagcccattggtctgttgagggcataatgttgtcattacgacatttggctcttgacacatcatgctgaaaacgaccaacaaacaagccttgccacaactctttcgttcatcggttagcttgtcatgcgtcacccgggatcacgttcaacgtagggagccgtgtctatcattctcacgtacgatccatttgatccagtcttcacgttcgtcttctagattcgactcgactcaatgactcatccccaccactccaccagtcatcacacgctctcgtgtcctgatgccgcctcacatgcgattccttcaccaatcaccctcacaac

SEQ ID NO: 31166 - DNA, 949 bp, Oryza sativa
gctgcttttgcaaatgagcctaatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcttggtgaggacttagtgcctcttaagtaagtatttatcgttttagttaatttgatgaatctgtatattaaattgtcaatttgtgtacctcggctgattcctggacgaggatttcatgcacaaataagttcggaaattactagtgaatttcgggcgtgacaagttggtatcagagccatctcgactgtaggataagccaaatggtcaaaccttaaggactaattttccgaaaacatgatttgtgaaaattttcctttcttccttctctagaattctctataaatcattttatcatcctctcccctcctgctttcaacttgagtagttctaagacattgaaacttgaagacgccaatgtggtcaacttatggaggttaagtcaagtggatcgatgaataagaaggtgatggtcgatctgaagtgccaagtggtcaagaaggaatgaagtttggatcctaccttagaacctatgccgccaaagtgtctttgaagaatagttagtaggatagaacgtttgttgtttgctttgtgtgtaggtatggttgcattcccatcattggagtagttcattgatgagtgtgtaactatactaggttgcttgcttaatcaacttgaacaatataatggtctacacacatcagatcagtggtaacctggttaaggtcttatctttagtgtaacacctctccttctatcttctctaatctgcaacgga

SEQ ID NO: 31167 - DNA, 1501 bp, Oryza sativa
ttaacgtgtattcatagtcaaatttattttttacgttacaacttatagaaattaaatttgatcttgcatgattgtggagtgatttaccatataataatctatcttgttaatttttttaatttttttcataaccatttagatggcgtgcaaataacgaggggtgtctccttgagagtttagaatatatgtatgtatgtctgtttgtttcacagtcgaaacccacagatccaaacactttatatatgcagagcgtgccatgcaatatttcattaggaaattaatattacctacattaaggtgctaagctgtttatacatgggaaatatatgtctagtgccattgtgcaaacatatactctatcatgggtgctaattaatttgcttactcgtcacatgagccgttggatgagattttggaacatatatatagtgcatgatgtatgcaacgctgcaatcatcctgcatcacggtcttgagataacaggcaaaatacttttgtagaaaacgatgaatactgctgcgccaggtagggcacacgctgctactgcctgcagctgcatgcatgagatcttaattggttgttgttttggaatgaatgttttgcatgttgtacagtgcgcagtgtgttttttttttccccactgtttgcctttggttttcctgtgctaactgtgttcgccctctttctcaggaaagggatcacacacatggcatccttctaaatcttcctaggcccgagctggagagggattgatggcagctcttggctcctcttgcttcccttttattaaaaggacatgcctctctccactgtccatgatcatcccctgggcccttgtaaattgcccctccaacagcagatcctccggcccctaggcagccacactactctcctctccacatctctatcttccttatatgcaatatccctgatacagttgtttgtactgcctgaagctacaccaatataattcccagatctcctcagctaagctatagcttctctcccatctctttcctcctcctcctctctgatatgtctactatctacatgagccagctacctgctactctccctctaatggagggggatcaggatcaggggctctacccagccttccatagagcaaaggaccctcctatcttgttccctttcatgatcgacagcgccgtcgagcaccaagggcaaatctatggagatcagggcttgaggaggcagcaggttttgggtgaatccaatcaacaggtgaggggatcgatcacatacatgtgtagaacaagctagctacttatacacatgtagatcagtgcttctttcttagtatatatgctgcttgccctaataattttagcttatactcctcttctttttctcttttttttgctcttgcagttcaatgatcacatgatgatgggcggatcagatgtcttcctcacaccgtctccgttccgaccaaccatccaaagcatcggcagcgacatgatccagcgatcatcttatg

SEQ ID NO: 31168 - DNA, 1501 bp, Oryza sativa
gtctttttggtggaaagatgttctacaatttgcagacattttcaggggattgtccacctgtaaggttggggatggaaagacttgtctgttttgggatgatttctggaataataaagtcaggtcagtaatgtacccaaggattcactcttatgctgtttctttgaaggattcagtgagtttaacctcttccaagagtatttcgcagcgttttaatctccctctgtctgagcaagccttccatgagtatgatacaatgtctgcagctgatcctttagatcaattatctgatgagaatgatgtctggtattatgtttggggaaatggtttgttctcttccaagaaaatatatgacattaatttcatgcatatacatgcgcctagttatctagcttggatgtggaagagtaagtgcgctatgaaggttaaagtttttggatggctcctgttaattgatcgactcaatacttatgacatgcttgacagaaggcattgccctcccaataattcagatctaacttgtgtcctttgctcaaactgtgcaagagaaaccacctttcatctatttttttaatgtccttttagtgctgattgctgggcacagtttggaattgtctgggatatttctcttgccttcacagatatgctgcatcaagcaatgaattcttataggtctacgcactttgtggagaaaattctttatgcagcctggaatatttggaaacagaggaacttcctgatttttcagaatttaacaccctcaatttcttcttggaaagctctctttaagagtgatctttcccttttagtttttagattaaatgtttctgagagacagtcccttttgaattggttatatcttttgtaatttattttctataataaagctatttaactgtgggggctttccctatagtgccttccctaaaaaaacaatatttataaaagtataatattttaaattaaaagagttgcgcattacgatagtttgtttaatgataaatatagtagcattaattttacatgattgatttttttttattaatagttaaatttaaaaaactttaacttatcactgtgctaaaaatatttatattttggaacggaggggtaagtaaatataagcataagcgaaaagataaaagcccattggtctgttgagggcataatgttgtcattacgacatttggctcttgacacatcatgctgaaaacgaccaacaaacaagccttgccacaactctttcgttcatcggttagcttgtcatgcgtcacccgggatcacgttcaacgtagggagccgtgtctatcattctcacgtacgatccatttgatccagtcttcacgttcgtcttctagattcgactcgactcaatgactcatccccaccactccaccagtcatcacacgctctcgtgtcctgatgccgcctcacatgcgattccttcaccaatcaccctcacaactctgcgttcttttcagaggttcggatggactgattattc

SEQ ID NO: 31169 - DNA, 1501 bp, Oryza sativa
acagggcatcttctcttttcagtgtgttggtgctggcatctgttcctcctcctcctgtcctccgacgtcaaattattccggttcttctcttaactgctaatccttcttaacaagttcagagaacatccaattctcaggtttagcttttctcctgggtgtttcttttctcttgtcttgatgatggctagtgtgtacaaggataagagcgcacaaattcttgattacgaatgagtataagattggaatgtctccaaaagcctgaaaagaaatatctcgtcacctgggatttgggtgctgcaagaatcacttgtgcagtcaggcaagaattttgctatggataaggggaaattatgctcagattattgccccgggatcggtactctaagttagaacctgagacatctttgttactctgaagaaacaatttttcctgacttgcaagtagtaacagccagcattgtctgaattgttggttttcttttctttcgctgtcgtgaaactgcgcaaaacaaagatttgcaatgacaggaagaaatgatgtaaaaaaaaaaactacaactaggagcaaattcagatttctgatgccagtttatagtgctggtgtagcaaggattcagtgttgatatacatgtgcaaattcagatttctcttttacacgcataaatattttacaggccagtgttgcagttcagaaatatactagagatcaaaacctgaacttttcaatctgaataaaatctgaaccgttctgtcagctttgctttgatcctttctcactgaaacagcgagcatctgatctttccctgaataaccgtcattctgaactttctgtcgaactgttcatgatgatatttggtttacaagattaagcaaggaatttggttctgagagtagaaccatcccttcatcaatcagcagcataacaaaaagagacgaaaaagagtaagcctatgtaataataatgcaaggaggtgaaattatggagcacaaagaacattgcaaagcagggttatatagctactacacctagtggcattgagactgaagctttatcctgagtctcattttcttctttatcaaaagacagaggccacttaccaaccagagaggcctttttcgtcaggaaccaagatgaacaagaatagtgttatgctgcaggcttccaaagtctgatctgatgagttcagtgcagcagctgcagcacaaaaatggttgcagattcacagggtaagtcagattacaggatgtattgcacatccagtgcttgatgcagatgaagcttgagagagctgagctgagaagtgtaggatgctctcattcttagcacatgacaatttgcaaagcatattcgactaggtggaattaatatggacataagaatatggctatactaggctactagctcatgagattgaataaaagtcagtgacaggttctctgaaggtcagatattttgagtgctgtcaaagcatataacattgcagtactacagattattgtt

SEQ ID NO: 31170 - DNA, 475 bp, Oryza sativa
ccaccacgtcggacaaaaccggggtcaaaaccattaaaggacatactgtgaccggttttaattaattaagggacactggatatctggtttagcggtttaaggatgttttttaactcgatgacaagtccaaggaccttcggtgtatgttttcctagaaataacgaaaaatgtccatttcgattctctcaactatgactcaatgtgattcgtatccatcaggtgaagtaaattgtctccttcaactatcatttttttcggaatggtaaagttattgccgatgttttatatataagaagaagatgtctcgttttaaaaagaaaatgggaccaaaccttataatacacaattaattaaagaaaactaagtgaaaaccacgactacaataaaccctccaagaagcctgaagcctaaactactacggcaacgaagcaagaccaaccaagcacaacactcaacaattctacttaacacaagg

SEQ ID NO: 31171 - DNA, 1501 bp, Oryza sativa
tcgccgaacaattttagggttttgagcgagtggccaaactcggtaattttgagcagaagggatagggaagaaatgaattcggggagagccgagtcgaatagacgagatggctcaggttcaactctagtgttcaatcggtctgaggaaaagaagatgttatgacaaatgaaaggctttcggagattcgattagcttcaccgaaacgcttaacaaatcagtcggagaggaaagacgacaaggaaggatgtcgattggagaacatcctttaggtggatcggtttaatcgcggtattccaacgattcaaggaaatgatggggtattgcaattgtacatgagagttgagaggacagagaagggattttaccctgacgggcgattctggaagaactattgagttcgagtaattccagacgctagaacaatcggttcgggaggatccgattgagaaggaggatcgaactatggaatttgattccggaggaaaggtacgacaaggatttgaattcacaaggatgaattaaccgagatccttggcataaacaattaaatgcacacaaataacacaaatcccattgtgcaggtcggctaggcctttcaaggaggaaaactagacttttccgtgaattcttttgaaataaactctttttagattttagttcgtaaatagagttttgctagtaaattccttctagtatttatttgtaaaataattgccaaacacttatagtttcaaaatagggttttcagaagttaactaatattagcccgcatttgtaaaaatagttttctcagagaaatatctctcaaagtatgttttctaaatatttagtatttgtttttatttatgaaacaaataccccaaataggttttacttcatagaatgggttttcagaaagacaaatggcatttgcaaacattttctaaattaatatatttcataatcatggttcttttagcaaataatatttgaatcaaaaatagattttgtttctagatttccgtcctcgtggtccaagcgtaacccaaaaatgggagatagaatccaattaagaccagcatgatggattttggaaaagatttttgattaacacgaaattttgatttcgcaaatcaggacagaaattttcagggtgttacatagatcaactgaattccttatgattaagataaccttcccatttactttaggatatatcgtatttgcgtactatataatataacccaggatataaggtacttcctccgtttcacaatgtaagtcattttagcatttctcacatttacattgatgctaatgaatttagatatatctctagattcattagcatcaatataaatgtggaaaatgctaaaatgacttatattgtgaaacggagggagtatgattcattcataacctgacaattactccgtgtaatctccctctaaaatttatttttgggaataatataggactgtttggtgatgctcttagcgatctcgtggcaagtgtccaagtg

SEQ ID NO: 31172 - DNA, 758 bp, Oryza sativa
tacaaagtcttttacctgttcaatgaggcattgctatacatgttgagtttctcaaagaaagcaagtgtataaaaggtaaacctatccacaacagaaacaccaatctgccacaaataaatagatcaggtatcacccagtgataagacaaaaaaagttccaaataatatatgagacaattgtaaatggaaggcatgttctcacgtctgaatcaagatgatgagaataagagttttcacccttcatgctgctaccaatcgttaaaacaccaggtgattgaagctgcagatatttaatatgtcaagtacagctgtagatatagttttcatatgcagaaaaatgttgaccatgataaaggaaataactaaattgatcatacaaaattgtctatatcaggtcttagtgcttttacttatttatatatctgcttggaaaatagttttggtctgttacctacagaatacttgctagatggtcactttaccttttttttttatttctgtaagacagtgtatgggtttctaggaaacctttcttgccatattatttctattactttgtaatatattccagtggagcattcccctagtgttctaaaaaatgatgtgaaacactatcaattgataaattagtgtatcaaaatgtagtaagtggaaactggaaagtccacattcgtccaactgctctgcacaaatacagcatggagtctttggaattttttattgtctaatgctccctccggaaacaagtacttgttgtat

SEQ ID NO: 31173 - DNA, 1501 bp, Oryza sativa
aggcgccccgaccccttgtgggttttgcgccgcgtatatggggtaggtgagcatagcggggctcacctaaccacatttattgcggtttggacgagcgcgtcacgccgcatgtaacgcagtgcagcacgctcgtttatccggtctgtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacactgatcatgtcgtcagcagacagccatgttcccacgtcgcgcctgcttccggcggaagtggaggtaggtatgggctgtcccatcagaaggtcattcggacgacaaccatacaagtctccgtctgtttatgaaaagagaggataagtccccacaaaaaagagagagatggtgcatgtggtatccccttgaggtataaaaggaggaccttgcccacttagaagggggaggattgattttcggatccagaacgatcagagagggagagagtaagagctctctggttctccagctattttgtagcttcttcatacatagatccacaaaaacacaggagtagggtattacgcttctcagcggcccgaacctgtatacatcgcccgtgtcttgtgtgtttccattctcgcgaaccttccacacacagactaggagcttagaatctcacccagggcccccggccgaaccggcaaaggggggcctgcgcggtctcccggtgaggagccccacgctccgtcacaactaatttgcgagacgaatctataagtgacaatgtagtgctacagtaaacatgtgctaatgacggattaattagacttaatatattcgtctcgcggtttaccgacgtattctgtaattatttttttattagtacccgaacaccatatgtgattccctatataatatccgatgtgacatgctaaaactttacaccgctgaatctattggtagtaaaatgaccagagtagaaacatctctactaagtttttaccatttcgagcatgccacgtggcaccccagcagagcacctcacacccacagctccagctatataagcacctcccagccacactacctctccccccaatcttggttgagagggcaactaatactactagtatagtgtatattgccacgctaattactaattagcgtgaaataaaccaggtaacattttcttgattagcaactcaaccatgaaccatgatgagttattagcagggtgattatttttgaaagattagtttgttaattgagtgtgaatttgttggtgtctcaaaggagaagcagggtagggaggaaga

SEQ ID NO: 31174 - DNA, 1501 bp, Oryza sativa
cacatcaaccacacaccacagtccacttccaaactgcacactctgcctcaagaatgtcacatcgcaaactgggacttcaggtgacattacctggagctctgcacgcatctgcaaatttttctgcacatcaatccaccacatgcaagcagtcgagtatatggataaccacatcagaagagattatgatatgtaacccaccaattgaagcaacccgtcgtgcaagttagagggcccagtagagatgatcttggtggtgtttgcacttgccacgatgcctggaaacaactctctccagcggttctgcataaagaacatgtttaagatatgcaggcaaaccatgatactaattaaatatgcagcacatagtagttgcatacatacagcatccaaaaggcttttgacgaggtcaacacagctaccattgacaatggcagtgtccctggtgacggccactttgaagtcaacaggtttttgtccaatcgtcctggattttgcaaggtattcctggtagttaagtgattcgactcccagaatatccatgtgtgggagccagaaggcccattctccttttttttgacaagaagagactcattctccttcattagactaaagaactcttccattgcacggttcgccagatcaagaagtacgtttttttccgtatagccatcatttgcattggcagatagattgtgcaagatgggaaaattggcaccagagacggctggagcaggctgcaaaactgatgatggcatggcagatacgggcatgagcacagcattgctactaagattggagcctgaagctacaaaaccacttgagctggggagcaaggatgacactgcctgaggaatgagattacttgtaacgccatgattacccttgttgagcattggattctcccaatgacggcaatctatatggaacaaagggaggtcacaagcgcggcatgttgagttcttcatcctatttctcaactctgcattctccttctttagctcctcattctccttctgcagtagtttgcgctcctcattgttcttgaatttctacatcaagaagataaatgatttactcagggagcaatttattttgaaaacagagaagtttatacacaatataccttcatctttgtcctgcagttctggaaccaatatttgatttgggtctcagtcatgtttagttccttggccaacttcttcaagtcatttctatcagggttcggacatgattgaaatgcactgggacgaaacagcaaacaaactaattatattaaatcacgtctcttatattttgagacagtacataacaggctgattttgctaactgcactgcgtaccgattaagcgtttctttttgttgcatggtgaggagttggtatcttcttggcttctttctggtacaagtgtccattctgttttctccctgtgagaggccatttcttttgtcctgattgctactcccaagtaggactagaaggttcgcagtatggggctcctgc

SEQ ID NO: 31175 - DNA, 858 bp, Oryza sativa
atgttttttttaactcgatgacaagttcagggacctttggtgtactttttccttattgttaatcgaagaaagtttacagcccacgtatctgctatatatgggccgggcttagtactgagcccaaattagtcgtctagtcgtcggtgaattcaacaccccacgctagacggccgccatggccttctcctcctcgcctcctcggtgactccgcccgccgccgctggctgccggcgcagcgccaccctacaagtcaccgccccaccgcgagaggagggcgggcatggccttgccctgctcctatggctcccactgcgccgccctgcccttccccgccgtggtctccagggcggcctcctcgccgccaccgcgctcccgggggagaaggcccagcctaccacccgccggatgcttccacgccgcgccaagggacgccgctctggtgtccggctccgctgctggtggcgtgagcaggaggaggtttggtgccccgtgaatctcctagtatacctagtttctttcgaatgcctaatttattgctccaaatgggaaggaagaaaccgtgtcagtgtcgttgtttcgattgtattagttgatgatgtatttctggtttatgatttgatttaaccggtcttgctggtcattcggttgaattcatcagcacgaacaatccacaaatggctttgttttgctcaaagagttgttctgtacaaactttagaactctcaaagcttcactgttttttgggaagcagcaaactgaatttgaacctgatgtgtagtagaattgtggcattctactagaaaattgtgttgcctgcttgccactgattgttctgactatgtggttgtattcaacagg

SEQ ID NO: 31176 - DNA, 1197 bp, Oryza sativa
gagcgactgcccgcgggcagagtggccctgcccgcgcggcgccacggggaacggcgacggggacgacgccgagaaccggacgagctccgcgatctcggccggcgtggccgggtggagcaccgcctccggcgcggccgccacgatgcggccgaagtccgacgacgccctcgccgtcgtgtcgcggtcgacgcggagcttcgaggcgacactgtgcgcgaagagatcgccgggaagcccaccggagacgacgacggacaggcagctcgccatgaccatgaacgcgatcgacaccttgcagccatctctccgaaatgcaatcggattagcgaactgaacactgcaactcggacgctttgcagttgatcagttcaggtgatgaaccgagaaagagacgattagagcttgtgtgagttaggtcaaaactccaagacatttatagatggccttagaaacgttgacaaatgtaggtagtgcagagcattgcgttgatttcttgctagtattctgaaataaatgtattgacttctgacagaaaataataataatggtggctgaaacattgttaagaaaaaacaaatcttgatcatcagtctcgtcatctcctggtgttggactcacaaaaaattctaaagagttaattgttcttttaaggccaaaaagtataaaggcccgaagtattatccatttttgcctcgcaggctgagccagaaatatataaactatgaacagaatggctaaaaagcttcagtgcttttgtttactaaagatacaacattttgtcaaccctcagcgccacatcgtagctatacatctcaattaataaaaccaattactgaatcttaacttgaaaactattgtagtgagtgagaattttagagtaattttacaggaaacacttagccttatcttatcaactggcgttaggagactaattaatctgtcaaattcagagagtgaattttagagtaattttgccgaaaacacatggcctaatattagcttaccttactaatcagctgacatatatacaagactaattaatttgtcaacaactctcacaaacaaatcatgatataggcaggtaaacttaaattgactcttaatttcttatactacattataagggttacattcatggtggcctcactgtttgaccttccggttttgtttatgccctgcaagtataggagtaactga

SEQ ID NO: 31177 - DNA, 1501 bp, Oryza sativa
aaaaaaagcttaattacatggacctacacatggattcccctttagagcacttgcatttgtacactgtcaaaagagggatggcccaccgctcagtgacagcgagcagtgctgataattcagtcattcttttttttatatatgtgtcctactgagatataaagttgccatctgattcttctcttccagtagcatctcctatctctagatgctcagagaagctgatccttggaaagggaaaaaaaaaagaaaagttctacgctttgtttcagctagaagtcatagctgctcatgtgctcatggacggtcagggtaattttaacacttctgtttctaaataaaagtcgtcttaaaatgcaaggagttcaagtattgactatgttttatgcagtaaaacaggagtaagtgatatatagaaaagaggttaaaaggatttaattaactaagcttatagctttatcttcaaaaatcaaccgctagtaagtttatagtggtaacactaggatttttagataatgaaatcttattgaactcagttaaaatattctgaagatggtaagacaagtttaactagtcgatgagatgattaagattaacagtagctaataacagaatgagattaaagaacaaaatgagattaaagaaaaaaaaaactatacctggagtggcgagaggcgcgactggtagaactggtcggcggtgaggaacccggcctggcgcgccagcttcttgcaggtgtcggagacgacgaggcacgccttgatccgctcccaccgcgccgggtcgtcggagacgtagccccggagccacatggagaagccatcgaggtggtactcgtcgtaggcgcggccgagcaccgggtaggcgccggagccgcgggtgacggcgaaggcgaagacgaggagcgcgatgagcagcgcgatgagcgacgccatggcgaagaggtagaacgcgaggaggcggcggcggttccagtaggcgccgacgaagccggcgagggcggcaaggaggatgaggccccccaggatggccaccggccaccgcgccaggcgggcgcactcctccccctgcgccgacgcgaaccacacgcccgaggcgatcaccgggacggcgcagatcagcgccatcagcgtcacgcacgccgtgatgttgttgctcaccgccatggcggccgacgcagctggagctcgagctcgctctgctgctgctgctgccgcgcgctcgtgtcgtgtcgtgtcgtgcgcgcgtgtgggggtgggtttggcataataaaaggaggagatttggatctttggggggaaaggtggcggggactggcaggtgggcccggggatgtggggcagtggcaggtgtgagcgtgggattggctggacggttgacagcgtggcggctttgctctccgtccccgtcggcgacgatgataaatctgaactctgtgtacttgcttttctgccaggttgaagttttttctcttcttttttttttatcttctctctcagcgaat

SEQ ID NO: 31178 - DNA, 1501 bp, Oryza sativa
tagatgatcacctacacgtgaacctactcctctccgggcccacaagtcatccacacacaatctcctactctccaaccatctcctgaaatcccccattttcttcatcatcaatcaaggctgatcagatcagaaatgaagatatttttcgtccagaaacctcaaagctggagtgactagtgagcactttaggccctgtttaaatcccacccaaaactttacacattatcccatcaaatatttgaacacctgtatgaagtattaaatatagtctcaaaaataactaattgtatagattgcaacttgtcggtgacatgggaccgggagtatcatgacttagagacttgaggcagacacgatcacccacgtggcctaaccccctcgggggggggggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtctgtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacactgatcatgtcgtcagcagacagccatgttcccacgtcgcgcctgcttccggcggaagtggaggtaggtatgggctgtcccatcagaaggtcattcggacggcaaccatacaagtctccgtctgtttatgaaaagagaggataagtccccacaaaaaagagagagatggtgcatgtggtatccccttgaggtataaaaggaggaccttgcccacttagaagggggaggattgattttcggatccagaacgatcagagagggagagagtaagagctctctggttctccagctcttttgtagcttcttcatacatagatccacaaaaacacaggagtagggtattacgcttctcagcggcccgaacctgtatacatcgcccgtgtcttgtgtgtttccattctcgcgaaccttccacacacagactaggagcttagaatctcacccagggcccccggccgaaccggcaaaggggggcctgcgcggtctcccggtgaggagccccacgctccgtcatctggcgcgccaggtaggggcttctgcgtgtgttcttctaagctctcgcactctttcgtgtgcgccaagcttttcctgttcagcccaa

SEQ ID NO: 31179 - DNA, 1501 bp, Oryza sativa
ttcgattccagctttccaggaaacaaattaaaggatcggtttgtaactaaagttaattagctgaaattagaggatcaatgaactgtaacactccgaacatgatgtttaagatcttagaagtacactatacgtcagtaatacaagttatatttttcttccatttctacgagaactcttaccaatttgagtgatattcgtgcattgcaaacggagcttttgacttgttgaactgaaagatgattgattgctgagttcttcaggtgctataatataagagccttgagaaattgagttgatagttgaaagatgcatgattgagtaatatccctccgggaaaagaatgatattagtcttactggtgatcaatacagatttcttctactatgtactagtaatttgacttctaaatatgctagtctgttaatctgtttaagttgtccgttcatcttgtttcatgtaaaatcccccatgcttcacactccagaaattcagataacactcccactactttttaacacacaataaatcaataattagtgccataggtgacaaaatacataaagcaaaaacacagaagcaaatcaacaaacacagacaagagacctagaattctcaaaaatctggaacagatcacaccctggaatgctggaacattcacctctggaatctggatccttcaagagacaccaacaactagtctaccagtatcctagatgatcacctacacgtgaacctactcctctccgggcccacaagtcatccacacacaatctcctactctccaaccatctcctgaaatcccccattttcttcatcatcaatcaaggctgatcagatcagaaatgaagatatttttcgtccagaaacctcaaagctggagtgactagtgagcactttaggccctgtttaaatcccacccaaaactttacacattatcccatcaaatatttgaacacctgtatgaagtattaaatatagtctcaaaaataactaattgtatagattgcaacttgtcggtgacatgggaccgggagtatcatgacttagagacttgaggcagacacgatcacccacgtggcctaaccccctcgggggggggggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtctgtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatataccagg

SEQ ID NO: 31180 - DNA, 1501 bp, Oryza sativa
ggtctgaactatgaaggcttaaaccccacagaaacgaaaaaaaaagaaaatacagtaataaactcttcagttctcaagtcttctcattgaaagagtaaaccctgaagtctgaactgaacatgcaatttccttctagttagttgatcctgacaggtcaagtctgaaccgaagcttcagtttctatcatcctcttcttccccaggttgctgatcctgtcaagcaacgccacgagctagtcaatcaatggccagggattagaataatcgatgactaggttccagtactgtaccaatcaattctctactgaattccaaattctcaatacaggacgcttagggtgtgtttagttgacgttaaaattggaagtttggttgaaattggaacgatgtgatgaaaagattagaagtttatgtgtaggaaagttttgatgtaatgaaaaagttgaaagtttgaagaaaaaatttggaactaaactcggcctaaactgtaatttttttctctccatttgtaatttactggggtgtcattgtcctgcttaccaaaccaactttccaagctggtgtgttttttttttctttgccgcttgtcgccgtcgcatttgagctccacaagtcgtccgtgcgaggtttcaaacgtcaaagtcctcttcacattgtcctgcatatatcttttatattccaagaaatctaaactcaatcaagaaccgaattttaaaacccctttatctttttcggggaaagaaaacctttaattctttacttctaaaaccctgttcagccccaccgtttagcctttacattaccaacataagctaaactttaaaattaaatttaaacttagagttaattttaggttttttctcatgtttatttttaagtatttgcttttgtatcactaagaaaatataactaattatttaatcgttaataagctgttccgctaatacccaaacactaaaatcaaattggcaacttggcatgtactccttaaaaagtagaaattgatatttgtgaaaattatataatctgaaattatagtattatgtgaaaaaagaccggacaccatactccttagacaataactgtccaacggcatctgctctcactgactcactcatctctagaagaagcaaacaaacaccaactactcctccatctatctgtaccggattatcctaatcgcgtttactaaactccgctaaaatctcttgtattcccacaaaatttccccaaaattttttactaaaacttttttctcaagatagaaaaaactatatatccttttggtttgcaaaggttttactaggttatttgcccccctcttctagaacgcatccagaattcgtggactctgcgacccaactcacacggcgaagcacacagaattttttttcccaaatccatttattttcctctcttctctctctcgaatcgaatcgaatcgcctcgcctcctttgttgaattgaatccaagctcgattcgccgccgccgcacgccgcca

SEQ ID NO: 31181 - DNA, 1501 bp, Oryza sativa
ctgctgctgctgctgctgatgcatttcttgcttcgccgtcgccgtctccggctgcatcaaccgcacattatgcatctccgtcctgccatagatcgatcgatcgatcggttcgtcaaaacaaaatcgtaagaatgctcgccgtcgtcgttgtgaaatttgcacgtactgataggcgtcggtggcgaggcggaggctgaggaagacgacggagtcgtgacgcacgccgtagtccgcgagcgtgcggtggtcgtcgtcgaggcaccggccggcgaagaacagccgctgcatggccaccgcgatgcgctcccgggccatgaccatgcccttgacctgcgccaccgtcgtcgtggcgccgtccacgtcgagcgccacccggtccccgcgcagcgtgcgcaccatgatcctcatcgtccccgacaacgtacacaccgagctcaccctcagctcaggcgacaggtctcatccggattcccgtgcgagaaaagatagcgaggaagaggaagaagttgttaggttgagatgagaaaaataatggagatctagcgcgaagaagaagggattggctggcatggcaatggcatgcatgcacgatggctacgagagggaataaagcggtttggatcgatgatgatgacgacctttgggcgccaacgtgaaggaaagtattttcttcttcggagcgctgacctgtgtacccaactgtccatgcagttcaggcgttggaagatctgggccgagacagctaatgggctgcttgtgggcaatgtcagaacctggcctggcccagggatggcctgtgcaacccaatggaaaagaacaaaagttttaatcagctttcaacaattcgtagggttaaaatgatctttttatagcactgaacggagtgctgttaatgaaaatctaatgacgatgatatttatggaacaaagacgattgtacaatgacatttttaggaatatatgttcatcgatggcatttcttgaatttggatgtttatcggtggtattttctggattttctcatatgataaagttgtgtttttgagcttttgactctcaaattattctctaggttgtacaactatagattcacaaactatgggcaggaatttataatgtttaaaatagttggagatcattcaaaaagggcatgcggactagtatagttgttggaaaaaaaatgcagatgacaaaaaattgtggcaaggggcattatggtttgatattcccttttggatatacggattgaatgcaacataaagatcaagtgaactgaatgcacaatcacatggacctcgcaggcgacgcatggcgtttagccgctcgccatccggtcgattcaatacgcgcctgcagagttgttcagcttgccggaaatggcgacgagcatggtaaagtcgcgggaaagcattcaggcgcatcaccaacctccttgacctcccccacctacaaaaatggccgccattgccaacctcgagctcagcactcacacacacactcac

SEQ ID NO: 31182 - DNA, 1501 bp, Oryza sativa
ccctatcttttctatatgaaataatattctttagtctctaatgacgcaaatataaccacttgtatgtagttaattgattgattgctttatcaagtatgtttaatgagacttacgaccttgttgatatgatggcatcaatcggaaatcactgtagggagattctcgactcttctttttttgttttgttattactacgtttctatctcttctcgtacgtatgtccatgaacttaaaatcttgtgtgactttagttagacccagtttaaatgggactaaaacttttaagtcactatcacatcggatatttggacactaattataaatattaaacatagactattaataaaatccatctataatcttggaccaattcgcgagacgaatctattgagcccaattaatccatgattaggttatgtgatgctacagtaaatattctttaattatagattaattaggtttaaaaaaattgtctcgcaaattagctttcattgatgtaattagttttgtaaatagtctatatttaatactctaaattagtatgtaaatacagagactaaagttaagcctatggatccaaacaccaccttaattgacatgcttagtttgttcttatttatctctatttcaacacggttgcgtgatgttcatgtcacggtaaaaataaaataaaataaaaacgatagtgaaatactaggggatgagtagtgattgggcgacagagacgacgagagatgacagctcagatacaaaaatgaaggatcatttgttctgtgtggtcctgtttgaaatgcgagaaaacttttcattcaagtatagtttgaactttgattcatgaatttcgtgggaatattcttctattccaacagtactaaaacaactagtatattgttctaatgaactactaataccaacatgaccccaaggtcaactggagagagtaagatcaaacccacggatttacgtatgaacataaatcggcagcagtcaaaatagcaacaaaaccaatctaagctaaaacaaaaaaaaaagtaaagtaaaacgatagcaaaggatgcatggtcattttcaagatactccatgaccaatttgaacatgttttgccaatcaagctctagtcaccatcagtccatcacccaccaccactcagcccattcaacgagcaacagctcgagctaaaatcgttcgagctgcctatatattttgtaataagtccaaacaatctattagaaaataaatattaatttataagtaaaattttatatatgtatctatagcgacttaaaagtcaatgttaaaacaaattatattgaaaatatcttaaaactaacttaaaatttaaatttaaaaatttaaattttgactttttgctttggtttatcgggtgaactgatgggggctcttcgtccccagtggctgaaatattaagctagctcgctcgctcgcttgccgagttagctaagctacctcaagtcttgtcgattaggctagcagctagaga

SEQ ID NO: 31183 - DNA, 312 bp, Oryza sativa
tgattcattattatttaatgatggtttaatgatggttcacgatggttaatcgtgatcggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtataacatgattcattgcggagcaccagactgagaagtggcggagataagcccacgggggtcactggggagtccatgccttgttttataagg

SEQ ID NO: 31184 - DNA, 1501 bp, Oryza sativa
accagaaagtgaaatccatcactgcgttttttttccttgagtgcctttcttcttagagtaactgttcttgtttgtgctctgtaaaatttgtatatctgattttccatatggtcttgacttcggagataacgtttacattctgtttaaagtgcatcagttcacacaaataattgtttgtgttggtatactaagggcccttttggtgcagattttcagaccttacttttacgagaaccattagaatcccagcaaaacggacaatatagccacatgttacagactatttataacttgctgttgaatgtgctcgtaaacaaatcgaaatttactgttcggcttttgatacaccttgactctcaatttattgggcttaggcgacatgaaagaaaagatctattgggcccagattgatttaagaaagcccatttaggccactggtccgcgtcaacttgcccccaaatctgggcatccgcgtcagcgctgcgcctgcgccgctgccctcctagcccgaaacagcgcagccacgcacgcgtggaatttctagggttcaaatcaaatccaacctcaccttgtcctcctctcctagtctcctcccctccccgttccccaacaagcaaccctaatccatccatggcggttaatacttcgcgcgcatagatactaatcccatccgcgcgcggcctcaacatctcaacctccggccagcctcgcaatcctgctgctatctcgggtaagaggattttattattatttttttgggggggattcaatcgatccggcattgcgttctgcgagtttttccccatttctgggtgggggaatcccgaaattgttgcggtctgaggctgaggatttttttttttggcggtggcagcggcggggaggaggtgatgagatcttcgggagcgcgtctcgcccggtcctaagatgcttgccggcggaggaagcagagttagcggcggcggcggcggcttcaacctcgcctcctacaagtacaaggaccccctcctcggacgcggcggccggagcttcctgttcggcaacacctggttcctcctctccacctacccggcgcgcctcctccacacagcggaccgccgcgcccccgccgccttcttcgcagccatcaaccggactccctgcgtgcgcacgcactgcacggggcagagcttgctgcagaggggcattgttatggctgcctgcggctatgcgtttcgacgagctgagctgggcgccgccaagcgccaacctgagaaggattcatctgtagggacccgaatctcatgcgtcgtggccatggggtcggctggcagcacgccgaggccagaggtctcgtttaggcatagaggggtggagtactgcaagaaggtcggcgtgagcttgaagtgccgcgagccgtggggacctagcagagcattttggaccaatgcgattgggccaagttacaagttgagcttctcggttgaaccatggcttcgggatttcagcacgtcttgtgtgg

SEQ ID NO: 31185 - DNA, 257 bp, Oryza sativa
ctactgttgacagaaaacacgaggcctgggagatctgcttaactccagtgcaggttcaaagctcgtcttcagatgtatgactccagtgcaggttcaaagctcgtcttcagatgtatgaacgtgccagttgatttgatcctgcaatcaacaagaaaaacacctacttataaaaagaatttttaaaaagtggcccccacatgtcattcctccctctttaccccctccgtctctcatatcgtcttctcgtgtgcaacagg

SEQ ID NO: 31186 - DNA, 259 bp, Oryza sativa
gaattcgagctcggtacccactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggca

SEQ ID NO: 31187 - DNA, 1501 bp, Oryza sativa
ctggtttcgtgctgacctggggggagttgcacgaattgcgaggcatgaagtgggccgttcataggcctgtacgtgggccctcgattagccatgttggccaggcccgttctaagttcaacgctaactcgctaaccattttttttctttttttttgatttgttatttcacttgcgccagatttttggctattgtctttcactttttcgtccgttggattttgcatcattatttgtgttcttatatattcaacttgcgtcaaaattagatccttacaattctctctagatttacaatttttgacatgttttttttattttaaatgggttatatctattggttaaaagttctgcaagatttgaagatataaatctatcgaaagattaatagttagttttttttcactttgtacaagcattttttactcatagaaatgactactaccctcttgattttcagataagtttgaccattcatcttattaaaaaatatataattattatttattttattatgacatgatatattattaaatattttttaagcctgacttattttttatattaaaaaattaaataagataaatagttaaatatttataaaaaaattaatgacataatatattaaaaaacggaggtagtgtatgcaagaattttccgtcatacttcctgttcggataagaccacaaccatttctcaccctgaaagtaagggaagaagaaatcaacgccgaaaatcactgtcataattaatttgagaactagaatatctttatgaaaaaaagagagagttaagcaccgaaagattcaacagaaaaaaatcaagtcaaaggcgaagcggaggaaacttgcaaacaaaacacatggcacccttgcatccgtcgcgctcgtgaacgccatcacccatcagtttcctcgtccttgcctcgcatagtcgcagctcttctctctctcgctcgctcgctcgatccgagcaaggtaaccgcagctgcaagcgtgcggttcttgcggatctcgcgcgggctcggctctgcgaggaggagctcatcccccactgtcccaatatgaggtcagttcttgattctgtcttgtaaaggtgatttcctgttggatttcaggtccactcctatagtgcgggggccaattggttggtatcgctcgttcgccgcatctgaaaaatgcgtggttggcgctccaggagtaaattagtaggctgtctggatgagttgatggtgttgattccccctcctaattagaccaatggacagttttcgttgttgtttgtttctggttttaggcgttttttcgctgaatgagttggtcctagataagatgggggttggggttcttctctgaccactgcctctgagtggatcagaatcttttgctgatgaaagcaaatgcagatgtgtccttgaacaatgcgtttaggtgtccaatattcagggaatattcttgctcatgcttgggagtccggcttggatttggaaagatcaaatcgtgtag

SEQ ID NO: 31188 - DNA, 933 bp, Oryza sativa
tcattttttttttaccgtaggtaatgataaatatggtaattgccttccttttcaactgtatgtcgattggaacgtttgcctttcgataatgacatggttgtcctacaacgactcaatgattcaatgaactatagttactttagacgacatagaaaaaccaatcaaatttatgtttttgaattaatataatcccaagccgtcagattatcaaacagctgctagatgagacaaagtctatcagtactgtgggcttacgtacttgggtgtaactaactaaactaagccgattgatctggtacgacatgctgccatatcgatggttcagattttggttagaattaattagcttaattgcatcggcacggacccaatcattgcgacatttatgtaacacaagatttctctccgtggcgtgcatgtgtcgtcactctcaatgtgtgtccatgtgattgatgtgtacatgacgatcgatgagcaattaagcgttgatcttggaaggccatcaacttaaggacatgttattttcctcttaatggattaataattcaccggcacactttgtaaactctcaaacagtacatgattctttcttttttttaaaaaaaactttaaccttatagatgaatttgttaaaacattaatttaagtccactttgtaacttaattaattcatttatctcttcagataattagagattgagatatatttgatagtgcagtgacaataagtatacggttttaattctgaggtccgtccctccaaatttctttatttttaatcttcatacaattatcacaaatcatatatctgaataaaagaacaccacccttaaattataaatcaaggtgggcacagccacgccattgtcgtgttcccgatgaggttggcgtatatacgtcatcgggtttgatcggtcggttgcgattgcatca

SEQ ID NO: 31189 - DNA, 1501 bp, Oryza sativa
tcggttgtgccagtggatcatttctaggcggagtaattgcagaccgtctgtcaaaatactatcctgattcagctcgcatcatgtgtgctcagtttagcgccttcatgggtatccctttctcttggatcctccttacagtcattcctcagtcagtcgactactggtctgcttttgctgtcactctcttcttgatggggattaccatcagctggtgcgctacttgcgcaaacaaccccatgtttgcggaggtagtccctcccaagcaccgcacgatgatctatgccttcgaccgcgcgttcgagggttcatttgcctccctggctgctcctgctgttggcatggtcactgagaagatctatggctacaacgcaaagaccgtcaatctggaaaatggatcggtagcaggggcgtatgcactctcgagggggctattgacaatgatgattgttccttttggcctgtgcttcttgttctacagcccactgtactttgtgttcaagcgcgatcgagaaaatgttagaagattgcctagtgtcaaggagcaggagctaatatgattatcaaatgcttgctcgtaaggggtgataggggtttagtgaccaacagttactacaagtatctgattttcggcaccaactgaaaatttatgttcagagttgaaatgttgcagttgagtaatacagtttccactttcttcaggcagataagaaaaccacagaaacacacgatgaattgttgtataattattatatcaagagtcaagagggaagcaaaacattgtctgtcattttcttctaacttttttgtagataaacggaaagcttttaatctttctgcttacttggctagggaattttcttgtaaacctgaactttacaaagataatcatccgttctagacattgctgacattactttctggcacacaggttatatacattcattatctacaaacaagttacattcattcatcagtactagaaccaatttgacattgtttattgtttatatttttttttgtttattgtttatacttttctagtgctgtatgtgcaaagactgagcagaaggcattcagccattttgcatgaaatagctccagcaagctgttctaatttccatgtctgttatctggaatattccgtcatctgcagttctatattcagtccaacctcagtatcaaccttttcaaactatactaatttgtgtagccgtgtaagagaagaaataaaggaaaggaataagaaaaaaaatctattaacttattaaagtaatagaaaaaaagccttcacgttcgctctcacagtttagaaattctcattttaatcggagaaaaataaaaacaaagtccatatagaaatacaattttaaaatagctaaaatttgaaattaaaaataagaaatattgaaacagaagactagagtccataccggtataaaatttagaaccaataaaaattcggaattaaaaaataagaaaaaaaataaaagtagaggttaga

SEQ ID NO: 31190 - DNA, 1501 bp, Oryza sativa
attctaagctcctagtctgtgtgtggaaggttcgcgagaatggaaacacacaagacacgggcgatgtatacaggttcgggccgctgagaagcgtaataccctactcctgtgtttttgtggatctatgtatgaagaagctacaaaatagctggagaaccagagagctcttactctctccctctctgatcgttctggatccgaaaatcaatcctcccccttctaagtgggcaaggtcctccttttatacctcaaggggataccacatgcaccatctctctcttttttgtggggacttatcctctcttttcataaacagacggagacttgtatggttgtcgtccgaatgaccttctgatgggacagcccatacctacctccacttccgccggaagcaggcgcgacgtgggaacatggctgtctgctgacgacatgatcagtgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctccggctagggacgagtgcttggaggctctcatcctgacgggatggggcgaggcgtgcgtcagaccgcctgtcgccacctaacccacgatctgatcggtctgtgactggtcacagaccggataaacgagcgtgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgagacgggagcggtccgacccctcggggagacaaagagaagggcggccgtatcaccctcgggcccgacccccccccaagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacatggtggggccggtctaaaaatcgggacaagccggttcgtttttcctggagatatggtgatggcgctttggtcggcgagcgtaattaacgcgcgcacgagatgttccatctcgactgccacagccgcatatccacctcatgcaccgcaaacgggggaatgagattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgccctaccttcgccacacgcgctcgctcttaaacatctcttcctccggcgtca

SEQ ID NO: 31191 - DNA, 1501 bp, Oryza sativa
ccaccggactctctctcctccctcccgcgcgcgcgcgcttgggccgtcttgggccggccggcccgttaagctcggccgagccgctccatttaccttgggccgcgccctagccgcccgaggaaaagtctaatttccatccctctgttctttcttttcttttctttttcaaaaaggatttaattaaatccttttcctttagaccaaaaatccaataatcttagaaattcaatatcttcccaaccgtaattccgtttgactccgttcaacttctaaaatttcccaaatctcgagatctatatagtggcacgcttaaaggtctttaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattgtattgcttgcgaaatattatgcattgataggatcacacttaatctgttgtcccgtctgcaaggcagattggcagacctacctaatttgttgcatttgatccttcctttgttaattgttataccatgtccccttgtaaaaacccagttgcacctcgatattcgtgcactctgtgcgagtatcgacggtcgccttcaaacttaaaatctgagaaacaacttgggtaaaactggagttttacaaaagacttggaaaacccgacacctgggtcggtgcttgcgaactaaatgaatttccaaaaccgcggaccggggaacgtaccgggtgtacggtttcccgctctcgcacttaaggaccgattccttggaatttcatccaaacataagacaagtacgaccacatgggtagaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactattcgaacagccgtgcccacggtcatgggcggatgtgaggtaattcctagcgtagttttgtctgactactgcttgtgaaattgctgttgtgaaactgggttcgatgtttgaaaaatcagcagctgacgggatcagctaggcccgggtggccgtttgaaaagttgttggcccgggtggccgtttgaaaagctgttggccgggtgccaaccctgtttcaagatctaaagactgatacattgcacatactccgaccggacgagacgcactgtctcatccgtgtcgtttgagaagcactcacttagacttttt

SEQ ID NO: 31192 - DNA, 1501 bp, Oryza sativa
aggcgctgacgaaggagtagcggccgaatggcgagcaacagccgccgctcgccgcgccctccgccttgacgacacggagccggtggtagcagcgccagaggtcttggtggcggaggaccacccaccagcacctaggcgctgccgtgccgtcatgaccaagttggccacgtcgtccagccaacgttgggctggagactccgggtcagggacaatgggcggatgacgtaggagcgcgcccgcagcttggagcgcgccctggggcgtgctgccgtcgccgtagacgaggaggcgacgctccccatctcgccgcccttccccatcacccgtggatgtcgaagtcgcggatccttcgaccctctcgagcgcctcttcccgcctaggactttggcgtggagggggcggtggagtacgagctcgacggcgtgggtttggctccccgtcgtcaccgctaacactcggagagaggttgtgcgcctttgcttgttcagccattgggctgaacaggaaaagcttggcgcacacgaaagagtgcgagagcttagaagaacacacgcagaagcccctacctggcgcgccagatgacggagcgtggggctcctcaccgggagaccgcgcaggcccccctttgccggttcggccgggggccctgggtgagattctaagctcctagtctgtgtgtggaaggttcgcgagaatggaaacacacaagacacgggcgatgtatacaggttcgggccgctgagaagcgtaataccctactcctgtgtttttgtggatctatgtatgaagaagctacaaaagagctggagaaccagagagctcttactctctccctctctgatcgttctggatccgaaaatcaatcctcccccttctaagtgggcaaggtcctccttttatacctcaaggggataccacatgcaccatctctctcttttttgtggggacttatcctctcttttcataaacagacggagacttgtatggttgccgtccgaatgaccttctgatgggacagcccatacctacctccacttccgccggaagcaggcgcgacgtgggaacatggctgtctgctgacgacatgatcagtgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctccggctagggacgagtgcttggaggctctcatcctgacgggatggggcgaggcgtgcgtcagaccgcctgtcgccacctaacccacgatctgatcggtctgtgactggtcacagaccggataaacgagcgcgctgcactgcgttacatgcggcgtgacgcgctcgtccaaaccgcaataaatgtggttaggtgagccccgctatgctcacctaccccatatacgcggcgcaaaacccacaagg

SEQ ID NO: 31193 - DNA, 340 bp, Oryza sativa
tcctgcaccccctgtggttagtgcaactcaactgtatagaattatgtttgtactacagctaaatgtggttagtgcgacacaaccgtataggattatgtttatactacagcttgctgctatagataatgtaggttttcatgttttgtgctttggtagactggtagtcgtatacaatgtgagtctgtttgtggaaatgttgcagcataggcacctatctaacctgttccatagaaaggtatgaatgatgttgtgtgcaaagtgcatatgcatataacagcttcatgatggatggttgaatttaatgtgtttaaccttctgcctattctgttctgtccttaga

SEQ ID NO: 31194 - DNA, 1501 bp, Oryza sativa
caacttttttttaattattacttgctgcagtcggtggcggcgccgacggggatggcgagtccgagcttgcagagcgccgggaggcgccgcgcgcggtcggggagcacgccgaacgacggcccggactgctccaggcacctgcacagcgcgcgccgcgcctccgccgtgcccgccatcccgcgcagcgccctcgcgccgccgcagcaccgatcgccggccgcgccgcgccgcccagcaggaacggcccgcacggcgccagcgcgctcaccgcgtcgccgcacgacaccgtcgccgcgcccccggcgcccgccgccaccaccacgacagccacaaacaccgcgatccccaccgccgtcacgccgcggctgcgacgagcgctcgccatcgtgcgctcgcggtgacggccgatcgattgaacaaacgcgttgcgtgtgagtgtgtgtgtgagtgctgagctcgaggttggcaatggcggccatttttgtaggtgggggaggtcaaggaggttggtgatgcgcctgaatgctttcccgcgactttaccatgctcgtcgccatttccggcaagctgaacaactctgcaggcgcgtattgaatcgaccggatggcgagcggctaaacgccatgcgtcgcctgcgaggtccatgtgattgtgcattcagttcacttgatctttatgttgcattcaatccgtatatccaaaagggaatatcaaaccataatgccccttgccacaattttttgtcatctgcattttttttccaacaactatactagtccgcatgccctttttgaatgatctccaactattttaaacattataaattcctgcccatagtttgtgaatctatagttgtacaacctagagaataatttgagagtcaaaagctcaaaaacacaactttatcatatgagaaaatccagaaaataccaccgataaacatccaaattcaagaaatgccatcgatgaacatatattcctaaaaatgtcattgtacaatcgtctttgttccataaatatcatcgtcattagattttcattaacagcactccgttcagtgctataaaaagatcattttaaccctacgaattgttgaaagctgattaaaacttttgttcttttccattgggttgcacaggccatccctgggccaggccaggttctgacattgcccacaagcagcccattagctgtctcggcccagatcttccaacgcctgaactgcatggacagttgggtacacaggtcagcgctccgaagaagaaaatactttccttcacgttggcgcccaaaggtcgtcatcatcatcgatccaaaccgctttattccctctcgtagccatcgtgcatgcatgccattgccatgccagccaatcccttcttcttcgcgctagatctccattatttttctcatctcaacctaacaacttcttcctcttcctcgctatcttttctcgcacgggaatccggatgagacctgtcgcctgagctgagggtgagct

SEQ ID NO: 31195 - DNA, 1501 bp, Oryza sativa
gattatgtttatactacagcttgctgctatagataatgtaggttttcatgttttgtgctttggtagactggtagtcgtatacaatgtgagtctgtttgtggaaatgttgcagcataggcacctatctaacctgttccatagaaaggtatgaatgatgttgtgtgcaaagtgcatatgcatataacagcttcatgatggatggttgaatttaatgtgtttaaccttctgcctattctgttctgtccttagatgttgcatataatcttggtcatggctgatgtcccaatagagtactttctagcttggaatcatgcatgctcacaggtgcacgccacttatatatccatctgatgactgatgagctgcacagctgattgtttagtaagcagcacatgacaatatgacatcagaacctgtcgtctcacaaatctgaagattaatgtttagcttcttgcttctagtgagagattacttggtctgtggccttctgtcaagtgccttgtgcatgtatgcatagtgagatgactgactgatacatctgtgattctgtgtacatgttgatgatggatgtaggctgcgtcgacgctggaaatggacgggctgagtgtactgtgtgcacagaagacggcggacgtcgtcaagaagcgcaccgtggaggaggtcaaggcgctgctcggcatcgccgacgtcggcatgacgccggaggaggagctcaagctccagcacgacaacgatgccatcctctgcctccgttaactacccgatctgccgatcatcatcatcatcatcgctacttttgtcgctgaagcattttgattccatctcgcctactatatatgatgtactttgaggtggtattgggttctctacgtctagatactagatatacagttttagcttgatgcacactggtagtagcaattctgagagaagtttggagtaattctgagagaagttttgccaggtgctcctgtgaacagtactaattgagagaaactattatagtgtatcatattaccatcgaagaacatgagttaattggtcataaaatcattgtgcatttcgaatactagcaaggttatatatgtcttactccatatccattagcaaggttattccgtcccaaaataagtgcagttttgtattggttatgtttaacatttgatagttcatcttattcaaaaaaaattatgattaattttttattgttattagatgataaaacatgaatagtgattatttttttataaattttataaataagacggacggttaaacgttggatacggatattcatggctgcacttattttggaagggtggtagtagtaatcaaggtgataataatgactagtaattcttgtcgagagatactcaattccaatgtcatcacgccgttcgaaaatttaaattctataaaactactcaagtttcttcgtgcaaaattttttacaatgtttatgtgaaatgttattatcacaagacgataatcttgagaatac

SEQ ID NO: 31196 - DNA, 1501 bp, Oryza sativa
gcctgatttctctgttcagacagatgtttatgtttctaatctgatttctctgtacaggctgcgattgttctcggcatggaagatctcaaggatgaatgctacaataggatgctgcaagatcatcagatgggaccacagcaagtgaagctgtttttgcagaatgtgctgggacacccgtgaacggttccgcaaatggcatttttcctagttatcattagcagatcatcaccctggtctatacctagctagtgaagtatatactgcctatgtttcaggataggttaagtcttaagtacatacatggctagaactctgttaagccgactgcgtgcctgcgtgcactttatcaggtctagatgtgagagctacttgagttgtttggtgctaaggccgattcgaattgctcttatcaattcagaattcacaagcttaccagctctaccatgctattctgctttacttctgtttggatacatacagctttggttttctgaggtgttggaaatgtctgataataggtgaggccttctataatcatgctatgtcttttgctgctgttgtagaaatatggtgcactgctgcataggaattatgcctgtttgcattgtcatttgccagtgattcaaaaatttgcttttatctcaatacgagaatgtgattgaagccctcttctggtagaggatgatcgtgtggatattttctttcctgttgtaaattggctggttattttgaatattttatttttttgatcgcctggtggatctctgctgcgatgatgtgggcgcgctgataatgaaaagtattaattatgtaacctgggaatcagaatttgtgttgctctttcattttgttgatctgcttgaaatggatgtattcgggattgtatgaacctctggcttttgctcatttcattaatgaaatgggagggctctgcccctctttcccaattttgctggatgaaatggatgtacagaaattatcctgatatcttgattccacatctgtatgtttcaattttgcttctcaaatcactgatgatctctttggtttctggtgatgtacgagacactactattctatggaagcagcagccgactgatggagcaattctggttggctgatcctggcaaagggacagtctcaggggatcaaataaaacctattttatgaaccgtcaaaatatttggctgcagtgagatggttattgaatgaaatggaacaagtctatactatgcttatgctgttgtattctactctgttgctccatgatgtgtattctattctgctgtctgagcaaacatgtcctgaactctcttacaatttttgtgtgcctgaccactgaataagaactgacaatagattgcattgtcacttttggaaccttaaattgaggaagaataataaatggatttttttattcattttgcttaacaaaaccatgagttgtctactatctagtgatgtgcaagtcttgtggaaaatgtgtttgtggcattacagt

SEQ ID NO: 31197 - DNA, 605 bp, Oryza sativa
gagaagtggcggagataagcccacgggggtcactggggagtccatgccttgttttataagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtcccacacctcccacaataattatggatgttatacctggtaataatttgcttagctcctggtttggagttagatctgtacagccgggtatggttgttcaggatggttgggcctgtgcagcatgggtgtgctgttcagtgttgattaaaatttctgattaactactccactgttttatttcacttaaatgttttgctaaatgctgcttttgcaaatgaggctatattatgccatcctttggtatccttgtgcacttgcatatttgctgtgtggcttgctgagtatgtcatatgctcaccttgcaataatcaatcaacctcagt

SEQ ID NO: 31198 - DNA, 615 bp, Oryza sativa
ttgggtgaataattatttttttatatttttaataatattattgactagattgccacataatcagattaatgccacatgtacaccagctaggaccaaaacccctcttaggttgaggggtgtaactcatcgggtttgaaagattttgaggcacaaaatctttggtatttgaattgaggggattgtcgacgtgggatacccctagaccggataaatagggtattggggtacgttggtacgaggatctacacgatacgacgtcaagcaaacaagaatatagagattatgctggttcaggcccctcgtaatgtaatagccccaatctagtttatatgagattgatatggaaaaccacagagtacaaagagaacagatgaattcggtgttaccagcgagatccttgtcgagatgattcgacgagatctcgggtgagtaggttttgcgtcctccagctccgtagactatggtggatgtgttggcgctatgattcgatgatctaaaccccttagggggtgtgccttttataccgtgaattacctcagtctccaagtagaactctgagacaacgaataaacccaatcctctccgagtaggactctagtaatcacttgcccatga

SEQ ID NO: 31199 - DNA, 1501 bp, Oryza sativa
taccggagaatatattcaatacccttcctgttcgggagaaaaaattggtagaaataacttatcggagcaatttgggacttcgaagtagacaaatagatagataaaaaaactatgatgaataatcaaaaataacatcaaactcaccaacagatgttcatgtaatgttccacatgttttcacgtaaatcttcattgtagttcgtaaagcaatgtctcggtgcttcttcgtttgtacttatatttcaccggtaattaggaatgcagtttttataggcgatatataccgagaacaaaatggatatccttaaaaaaacaaatggaactgatagatctcgatataaaaagtcacctaataaatctatctattatattattaaaacagctttaaaaggagacatcacgttcgctgtgggagctagaaattctcatattaatcggagaaaaagaaaaaaagaaaagaagagtccaagtagaaatacaatctaaaaatagctgaaattcggaattaaaaataagcaatattgaaagaagtttctatataacaacccaatacgagattaatacaaattcgaaataaaaataaaataaaatccaaaattataaaataaaaggaagtccaagtaggaatacaatttaaaaatagctgaaattcagaattaaaaataaggaatattgagagaagagtccatataataacccaatacgagattagttaatattcggaataaaaataaaaaaaattcgaaattagcaaaaagaaaaaaagttaaaataggaatacaatttaaaatcaactgaaatacgaaattaaaaataagtaatagtgaaagaagaatcaatataagaaaccaatatgagattaattaaaattcagaataaaaaataaaaaatatccaaaattaataaaaaaataaaagagagttcaactgaaattcaaaaaataaaaaaaaataaaagtattaaaaacactatacggtattaattaaaaaaatttaaattagaaaaagaaaaaaagatttcaattaggaatagtggtggcagttgatacaatatataaaaactgttagtaaaacaccaaatagaatcctaatgatgattaaaaggagggacgagcaagacggttgccgggacttctagaaagtaaaaaaaaaacccaattgataaacatattcgatttttaaaatctcaatgagaataaaggagaagcagcatgcggggtgtataggagtatagttgcagagccgccaacggttagcgggacttttagaaaagaaaaaataaattccaacgatagttatgttcgattttagaatcctgatgaaaataaagaataggcggcggatgggccgtagaggtgtatagtggcatcgtttgacgggacttctgaaactataaaaaatgaaacccaacaagacaataaactctaaaaactacaaggtccaatttttaaaggttcggaacttctaaaaagtaaaaataaaacaatgataatcatgatgcat

SEQ ID NO: 31200 - DNA, 1501 bp, Oryza sativa
atgtaggctcccaagcgaaatcaaactcttccttagtcccggcacgtgtctcacatctgaaagtagcacctcgtttccatcatacatcttgaacttgacatcgtccactccaacaacatgataactcgtgtcatcgcccaagtaaacaacaccaaaatcaccagatttgtatgaaaagaaccactcccgcttcgatgtcacgtgataggaactagctgagtccaacatccacgcttctccagacttctcgttagacactgtgagaatctcatgactgctgctatctgaatcatcaccacgagctgctaaacttgcaatgccatctttcctcttcttcagtaacgggcaattcctccttatatgtccaaactcatgacacttatagcaccgtgctcccttctcattgctcttcgacacccccgcttcatgatcatgctttgccttgaccagcaaactctcagcctgagaagcctccattgcctcgtttttctttgatcttctcaagtctcgtgcaagcaacgacgaaattatctcctcagttttgatagtatccttgccgtgcgtcagggtagtcaccacatgttcatacgacggtggaagcgagcacagaagaattatggccttgtcttcatcatacagattcacatctaacttacttagatccacaaccaactgattgaagacgtccacgtgcttcctaagatctgactcctcttgcatctgcaaaccatacagctgttgtttgagatacaacttactcgtcagcgacttggacatatacaggcttgccaacttgtcccaaatttccttcggtgttttttcatccatgacctgatacatgacagaatccgagagactcaagcgtattgttgcagctgcctgcgccttcatctcctcccacttgccagcatccatcttttccggcatcgtctcctcaagagccttggatatcccctgttgagccaacagatccttcagcctcatctgccagagaacgaaatttccagtgccatcgaacttcaccatctcaaatttggaaaccaccgtcaccgccatcgacgataatcaactcaacagctgttgccctgttaaattgatctgccttggttcaatcgaccccaccgactaactcgaacagtaccagccggaccgaaccggtttttttttctttctccaaaaaaccggaccggtttcttttacttggtcaaccaccagtcaaagaaaaacagatcgatcctgtctcccttcttcctttggcttcctcgctcctcccagaaaccgcgcccgcgccgcttttcccgatgcgccgccgcctcctgctcctcacgctgccggccccgcaagaagcaccatgccccccacctcagaaaccgcctggggcgccgccgcctcccgccgctgtcacctgcgccgaccccgcgaggagccgccgcgtcgcctaccttgggaagccgccgcctgccacctgggagcgcctgccgccgaagtccgccgccggttc

SEQ ID NO: 31201 - DNA, 1501 bp, Oryza sativa
atccaatcggtgggtcggacacttcgggcgggtggcttggactttccggtgagctactctcgatagggagacgtgcggccgcacgctcgggttgattgaagctggaggcaatcggcgttctcgatcggtggattcgaacactctgggcggggtggcccgggcctttcgatgtgttgagttcgacagggagatggctagacgtagtgctcaggtcgttcggcggctgggaagacggcatgcgacttgtcggcttcggctcgcgactagattgatggcgttcaatcgaaagtcggagcgggtggatcctataggttgttttggaggtgttgacgaggtatttgcgtgacaaactgctacggagaaggcgcacatacgaaaagcaacggaatcaggcagaagggcagtcaatttcagaccgtcaatgcgctgatcaatcatgttagcacagcaataagcattggttgcaactgaccggcggtattcgtcaccagcgaggttcagcgggaggctaggtggctgcgctagaggtcgtacgggtgcgtggaggctgaggaggtcacggagatggcggtgtgcacgtgttggtgttgaagccgggaccatggaacgtggccagagcccgagtagcaggaagtcggattgcgcaggactcgatctggagaggttgtgacatggaaggagtcggatatgtttccaactcggatgcatagcacaacagagaaatagattgagggagagacctagtcaagcacggaaggggaatcggacgaggactacgattcgttcatgaatcggactcgatttttcccaaataaaagcagcagaggaccacaggattgcaacaacgcaatcgaaacaaatcatctagcagagggcgagattcgtacccgattttcgcagaggcaaaggtggtttgggcggcgaggtcacgggcggctggagacgcgtcattgcaggtaggcggcgcacggcggcgtggtactcggcgacgttcgtcgcagctcaggcaggagcttgcggcggcggcggcggcggttcccggcgaggaaccggcggcggacttcggcggcaggcgctcccaggtggcaggcggcggcttcccaaggtaggcgacgcggcggctcctcgcggggtcggcgcaggtgacagcggcgggaggcggcggcgccccaggcggtttctgaggtggggggcatggtgcttcttgcggggccggcagcgtgaggagcaggaggcggcggcgcatcgggaaaagcggcgcgggcgcggtttctgggaggagcgaggaagccaaaggaagaagggagacaggatcgatctgtttttctttgactggtggttgaccaagtaaaagaaaccggtccggttttttggagaaagaaaaaaaaaccggttcggtccggctggtactgttcgagttagtcggtggggtcgattgaaccaaggcagatcaatttaacagggcaacagctgttgagttgattatcgtcgatggcggtga

SEQ ID NO: 31202 - DNA, 1501 bp, Oryza sativa
tgatttgggatgtgcatgccatccgattcgtgagaaaataaaaaagtaacaaaaaaaaagaaaaggggaccatccggtattgtccctatcctctctttatttaccaaccgggacatctttactcccggttatttcacccgggactaaagatagcgatctttagtcccggattcgtagtcccggttgggaaaccgggactatggggggttacaaaccgggagtgaagacaatttctccaccggtgataattatcttgggtagattttgtctagaaatctgcttttgaaatactttatagagtaatatatatcattttcactctaacctcaaaaccgcttatattctactccgtttattcacactataagatgtttcggcatatccatttctcatctaaattcactaatatatatatataaattggacacttatatggaacatatacatacgtccttgcattaatctatttacagtccaacacattatgtaacatgaaatcgaggaattattcaatattttatataatcatatgatcagaaaaaacaaatacatatcctctgacgcgtaagagtatatttcagtgtgtaactgatggttactgattaccttgtttttttttaaaaaaatccctccatctagaaaagacgacattttaaaacaggtagtaatagatggaaagtaaaatgttaggatttgaaaatgcaaaaaaacattaatagaacttttatgaaaaacttttatatagttgtattttaatactttttgtaaaaataagtttgaaagtagtgacaaaataccaaaaaacaccaccatttagagagatggaggtagcaaacaggctagtgcaccaacaattatagctaatggttgtgcgaatgaccgtcttaatttaaagccatacttttccttaatgaaccactatattgaccgcaaaacgtgttttaatggcgcattcactgatgatagccatcttaatcgaccacgatgatgtccagagaggcgtactaatccttctgatattttttttctcagaaaataattatcgtcacctataaactgtaacaaataaaacgtgggatctctatacatacacgcttatcgcagagaagaaagatacttacgcgccacgcgcacaagaaaaatttaccccggataaaaggggcaacagctagtagctagtactacttcagaagatcttttttttacacgagtggcagttctcgccatcctgcgccatattttgcattttccaccccgtcaggcaagcgcacgcgtccggcatgctcgtcctctgtttctcacgcgaccctccgtttgggctcctccgctccgcctccgtcttccgcttccgcccctccatctcctcctccttccccacaacaccagctaagagagaattcaattttcaaaccagccccaaggtccaaaacccagctcaccttccttcctccctccctcaccgccggctaatccgcccccagatctagccctaaaacccaaa

SEQ ID NO: 31203 - DNA, 1501 bp, Oryza sativa
tcgctcttatgtggcacataaacaaatgataaacgtcaaaacgatgaacacagtcggcaaagagaatcaaggtattctagctctctggagtattttactgagaaacgaatgtgtggcaatcccaatgttgctgaattacatcaggttacatgtattaaacctcggaggccgtgtgcttcccgaacaacttatgaatctggcataggagtatgggttactgcatgattcccttcatttttcgctgaaactattttatttgtgtacttaatgtttgcatgggagatggagagaggggttcatcccgatagggttgaaaacggtccgaaaacgtttcaaccatttccataatcacatttttctcgaaaaatagagttgaaaaccgtacagctagaaatacaaacgaaattcaaaatatcggaaagccggaaacggaattatacagacagaaacatgtcgatatcgattaaaaacatgtaataaatataaaaaatattaaactctaaaatcacacatttaactttgtacaagtatataatatgatgaaataaattgaatgttacactatgtaaactatagattatctttttttaaccttgtaggagtattccatatagggatttggttgaagagttcatgggcttctaactatatgtcaaagaaagaaatgtaccatagattttggcatacttaaaaatgtggtaattaacataatataaaagaatagtagtttctgtaaatatatggtaaaatttggaaaatggtctgtatacaagaaaattgtttccatttccattttccatatttaaaggtgtggaataaatctctctaattcttcttcttaggggagtgattaatctggtattaggatttgagagacaggttttgccattattattcggatattttagtaatcaagaatcaagatggacttttttttttaactttgaaagcaacaaagataccatgttttcttactgttgacgtagtagtaatagattcatctagagtttgaatcagtttcttgagttggctactacattgtttttggtaattacacttaccgaactgctataataactttttttttaaaaaaaatatttttaagtttttattatttaatattaaattaattatgtgctaataactcttctcgttttagcctaatcaaaagcaccctaataatattacataactactccatatctcatgctacatctatcttttttaataactattagtagtgactgaattatacgagttttgaccacaatttttttcacgatgaatttacaaatctttagaactcgatgttattattgcaaaagttcgatgcaaaataaatcaagttatatgatttttatagcattaaaaaataacaacataagaaaatactgatcaccataataacaacataagggtcccgttattatggttcgctggctgccatgccacaagcatacccttcgtagtcttaggccatttacaacgtgtggctcttgct

SEQ ID NO: 31204 - DNA, 325 bp, Oryza sativa
ggagggggtatcctcctgtttcctcttcccccgggcgtcggcagggcggctgccccccgggcccccgtcacggggcccagaagcacgaccccctcccggggtagattgttcccccctgcggctcccgcccgcgccatcgtggcctcgaggagcccgctcccctgacgccccgaccgcctgcatgatggtcaggatgttggcgcgctctggatcgctgcagagggggaggacaccttgggggatgagggatgcctccaaggagctgagattcagcacccgttggatcaccatcttgaagtcttcagggacccaatcccatttgacc

SEQ ID NO: 31205 - DNA, 1501 bp, Oryza sativa
gattagggtttatgttactgggcttattgggcctcataggtctattaggtcacaattcggttatctcggttaattcggttaaccgagcctaatgaccgaaagacctgaaataaattcggtcttttgatggctgagaccgaactactaaccaaatttctcggtctcggtcttgatcttttcggttcggtttttcggttcggtctaattgtgcccacctctagttttaacggtctgaaacatatatttttattttatcaaaaatataattatgtgatatattattttaaatatttaattgcaacaaattcaatcgtacgattggatcataatcggataagtagtttaggaaaaaaatatttacagtaatgagaaaaaaagaaaaaaaaactagctactacttattttgcatgcatgcaacagtagcaaggagcccatatttttttttcattcagatggggctaccgaacaagatgattttagctcttacactgacgatgaagtaaggcctggtttagttaccccaaaatttttcccaagaacatttcatcgaatctttagacacatgcatacaacattaaatatagattaaaaaactaattgcatagtttgtggggaaatcgcgagacgaatcttttgagcctaattagttcatgattagccataagtgctacaataacccactgtcacgccccgaactagtcccgaccggaactagcccgtgacgctccaaattaacctgttaatcgataccagtcccaggaaacagtgctggtatcacagggagacagaatatcacagcaacagaggtctctttattatagagtagaagtacagtcatgttgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactgggggggattatttatatagagcaagggtgagtacgggagtactcagcaagccaggggaaataagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtatcagtctttagatcttgaaacagggttggcacccggccaacagcttttcaaacggccacccgggccaacaacttttcaaacggccacccgggcctagctgatcccgtcagctgctgatttttcaaacatcgaacccagtttcacaacagcaatttcacaagcagtagtcagacaaaactacgctaggaattacctcacatccgcccatgaccgtgggcacggctgttcgaatagtttgttaacctctgcagagggggtacactttacccaca

SEQ ID NO: 31206 - DNA, 1434 bp, Oryza sativa
gagaagtggcggagataagcccacgggggtcactggggagtccatgccttgttttataagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtcccacacctcccacaataattatggatgttatacctggtaataatttgcttagctcctggtttggagttagatctgtacagccgggtatggttgttcaggatggttgggcctgtgcagcatgggtgtgctgttcagtgttgattaaaatttctgattaactactccactgttttatttcacttaaatgttttgctaaatgctgcttttgcaaatgaggctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagaatttattttccgctgcaattttcttcctggtgaggactaagtgcctcataagtaagtatttatcgttttagttaatttgatgaatctgtatattaaattgtcagtttgtgcacctcggctgattcctggacgaggattttatgcacaaataagttcggaaattactagtgaatttccggacgtgacaagttggtatcggagccatctcgactgtaggataagtcaaatggtcaaactttaaggacgaatttttccgacaaaaatgatttgtgaaaatttctcctttcttgcttatctagaattctttacaaattgtttcattgtctactcccgtctctctttcaacttgagtagttctgagacattgaaacttgaagacgccaatgtgtctacttgtggaggttaagtcaagtggatcgatgaataagaaggtgatggtcgatctgaagtgcccagatgtcaagatggaatgaagttggcatcctaccttagaacctatgccgccaaagtgtcgttgaagaatagttagtaggatagaacgtttgttgtttgctttgtgtgtaggtatggttgcattcccatcattggagtagttcagtgatgagcatgtaattatactaggttgcttgcttaatcaacttgaacaatataatggtctacacacaccagatcagtggtaacctggttaaggtcttaactttagtgtaacctctctccttctatcttctctaatatgcaacaga

SEQ ID NO: 31207 - DNA, 329 bp, Oryza sativa
accacatttattgcggtttggctaagcgtgtcacgccgcatgtaacgcagtgcagtgcactcgtttatccggtctgtgaccagtcacagaccggtcagatcgtgggttaggtggcgacaggcgatctgatgcacgcctcgccccatcccgtcaggacgagggcttctaggcgctcgtccccagctggagctagcgtgttacctcccagagatggcacgttagtcctggtcagatatatgccaggcttcatcctaaaccattataggcaagatgttgtgtgaagaagggcgagcatgtagattgctaagctgacacgtggtggacaagaa

SEQ ID NO: 31208 - DNA, 178 bp, Oryza sativa
taatcatttgcttgctggtttaatcaatggttcagtgaatccctcaaaaaaagaaaaaggaaaatgatttagtgaatcgtttatttgaagacaaaaacgacacaagaaaatttggcagaatgaggcatcatcaacaaattatttacgacagaaatatgaacattagatccaccagtta

SEQ ID NO: 31209 - DNA, 1501 bp, Oryza sativa
ctctaattctttgcttagttttctgtgtcaagaggcctcaaaactcagctctaaagtctaatattttttagttgatcctttttttaacaaaaaagaaattaaaaatgcattttgagtttcctcccccttttaatttgcatttgcatatttttttctaaaaattaatttatgcctcccacatatttggactagtggcgagtagacaaaccattttgctgtttgtttacacgtcaaactcgtcgtcggcctccccctcaccaccttccgattcccctttctcccattcgcacggcttcttcgtcttcttctcttccctcctctcgcccaccccccctcgcagatctcgccgcgctctcctcctcctcctcctcctcctcctccgccgccgtctccgcgaagtcgttcccgccgccgccgccgcgggcaccgcccacgcgctccgttccggcaggcggcgcgcgctcgctcgctcgctcttggtgtctctggagaagaagcggagagagagagagagagagaggtggagaggagggagggggtttgctggggtagtctctagaggctccccctgctgccgccatcgccgtcgacggctcctcctcccctcccccggtggagatccggggtggtgttcctcggtaagcgggattggttttggttccggattcgcctcgcggtgggggctatccgtttggtggggcgcggcgggatggatcccgtcgtaatccgctcgcgagggtagagctgttcgtcgtcgctaatgcggggggtttcgcgttgtttgcagggttcacgcataggaggtggcggctgcgcgcgcagaggctcgggggcgagggcggcggcgcgggcgagatgaaggggtcggccatcccggcggtcgcgatcatgccctcgccgctcttcctctggcggttcaaggtatcgtggccttcttcagctcaactcatggtacactgatacggcgaggcgatggatttagcgccgatttggttgcaagtgccagttgtctcctttgcttaattttacctgcttggggttatcgcagcgcgacattgctatgtagttgtaaaataatcaatcatgttatgtgtttgtcctggagtatagtttggtcaataccttgcaactgcggtaaagggtatcacaggaatcacggaggaattacttacctttgctcaaagctaatcgcagagatgactactactcatagttgggaaacattattggattgaggagaagtgatcttacttcatagggtctagtcttttccagatatttgtcctacacattaatatttccctccttcctgctactgatgcataaaccccattttatctgtaccattaattgtaataaaaggaaatcgagaatcatgatttatccttttcttctaaatgaaaactgaagaagagtaaaactcatctcatgtcttattcttggcttcactgggatgtgcttttatccttgacggaccaagataatagtgttgacttccctt

SEQ ID NO: 31210 - DNA, 348 bp, Oryza sativa
gcccaaagccaaaagaagacttttaaaccctttttcaatttaaagttattcatgaaatgcaattccattgattaaaaatacttccttagctcaaataaatcccagaaaaatctaggaattatagaattaagcaaagtatttaatgaaattttatctggccccattttatattgagatttaacaaattaaaattagatcttctcttttaggcttttaaaatcatttctaataattccttttaaacaacaatttataatttaaggattttaaacaagaaaagctcttaacaattataattagatcattattgatcaaataattactgaactgttctttgtatcatttagg

SEQ ID NO: 31211 - DNA, 188 bp, Oryza sativa
aacaatagcgatttagccggtatatatgtcttttgtaattgaatgctgttgtgttccctctctctttttttttaaaaaaaaaaacagaattcaagtggcgcagcccaacaaaggaaggccacaaacacagaacctcctccgatgggccgcccgctcccgccaatgcaacgccgcatctgctccccagt

SEQ ID NO: 31212 - DNA, 930 bp, Oryza sativa
tgtatgactgcataaaacatggatacatatgagattcacacgtcgtggtgtatctcctatatatctactacctccgtttcgaaatgtttgacgccgttgactttttagcacatgtttaaccgttcgtcttattcaaaaaatttaagtagttattaattcttttcctatcatttgattcattgttaaatatatttttatgtaggcatataattttacatatttcacaaaaaattttaaataagacgaacggtcaaacatgtgctaaaaaatcaacggtgtcaaacattttaaaacgaagggagtatatctctatgcttacttgagaactaagtgttgtactcctatatgcacaggctcccaaggatcaatataatgtgttcaatatctaatcctctattattcaacaatattgttggtttggcatggcatcaacccttgaacacaccatcgagcccatacgtacccatcgtgcgatctttatatcaagcagacacgtggcctttctttttaattacatggaaaacccaaacacccgcaccataagaatgtccactttgtatgtgctcagctgggataattgatcgctaaggttgaggggatctgaaggtgatttttttcgagggttaaggtaatttatttcgcacttattaagatgtagaattaattccctcaattccctctctcttggagagactaactgaacaaggcttgaaaaaaaatccaaatatcctaccaagatgtatacacataaagtatataaggacacactagattttcaaccctccaagtgttataggtaactattgttatccctaaaaggctggacccgtgtaatgatcacagcgaaaaaggcagaaacacaattgttgcaatattattattagtcctacattacatatatcccccgtgaagtttgtgatcttgccatga

SEQ ID NO: 31213 - DNA, 164 bp, Oryza sativa
ttgacacgccttcccgtattttttgtccatatgtgtcggtgacatgggaccgggagtatcatgactagaggcttgggcaggagcaatcacccacgtggcctgaccccctcgggggggtcgggcccgagggtgatgtggccgcccccctctttgtctccccgagg

SEQ ID NO: 31214 - DNA, 965 bp, Oryza sativa
gccagcatggctggcgccgccgcctccatacctgtttccctgtatggagttgcaacggtgtcatttttattttattttttcggatgttttttcacactcaggatcacgatacaaccaaccacaaaaaaaaattaaactcgaactaccacttagctaagtctgaaaatatctagcataccacttagtctactttgcaccttcactaaaattagaccataactcttttagtaaaaccctttgatcagcatgttaaacataatgcactctaccactatatgaaattacttaatctaattcaaaatataaccacatgaaatgacatatataagttaaacagtacatagagatgcaattttttttatttttatttcatttttttgatattttttcacacttaggagaacataggaaccaaccgtataaaaaataaactcaaacggacaaaatatgtgatatgtagaatttttcaaaactctaccgaaatggacaaaatatgtcatctattaaaataggcataactttctcatacggactcggaatcaggcaaataatatatgcacggacatctacagaaaaagttacatccgattctccccgctttgtcgggttcggcgatattaaaacctccaaattccgcttgcaagattgtgttttcgaggagagaagtttttcggtggagctttgaaaaattccatatgccacatatttcgtccgtttgagtttattttttacatggttggttcttgtgagttcctaagtgtgaaaaaaatatcaaaaaaataaaataaaaataaaaaagttgcacatctctctcctctgcactagttcggagagaggagaggagaggaaaaattctacatgtcacatattacgtttatttgagttcaatttttctatggttggttcttgtgtgtccctaagcgtgaaaaaaatatcaaacaaataaaacaaaaattaaaaaattc

SEQ ID NO: 31215 - DNA, 1501 bp, Oryza sativa
ttggtggaagctccatacgttcctcgggcaaagggaacatccttgtcaagattaactgttttgcagtgctaatgattgagctcacaatctgtggaccacgtcctgtgtccttgagagattggtaagaagagatgagctctgaaagctgcttgagccctttgtagagaccaacattttcagctggtggtgtcaggtagcttatggtgtttgcatagcttctacgcttgccaacagttgcttctgatgggttgtttgctgcatagcagtagatattggggatgttgccaatgagactgtcaggatagcatgcatcactcatcccaacttgcttccctggcatgaactcaagagacccatgggtaccaaagtgacagcatcagcctggaagatcttctcaacaaaggtgtggtatgctgcaaagccatggtgagggctagcagattttgagaacaaaagccgcattggatctccttcatagccaaaagtgggctgaactccaatgaatacattgccatactgtttcccatagacaagtaggtttttcaccatcagaaataaggttcccaggtggcttgccccagttctcctccagcaaggaggcataggaagtgagtgactggtactcccgcacattcatgcgataggcaacattgaggttgggactgttgaattgggcctccttatcatgaataacctcctcgatgagggcctcagctgtcagctgtgtctggaagaccctcaacattgtagccatccttcttcagatcttggaggacggaatagatggagttgaaaacattcaggtatgccgctgtgccaacattgcctttgtctggtgggaagctgaaaacagtgatggccagtttcttctcctccgcagagaaagaaagaaggtaactatttctgtgtgctttgcaaacctagtcagcatacaacacttggaatgagtattttcacttaggaacttttcgcgaaactgcaaactagatagcataattggattatgggatcatacacctaaactttttttactttatgtctacaaatgatcgtactgtttcatttgaaggacttggaacttcaatcagtaggcagttttagcatatatgtaatgctacaataaattctcaaaaaaaaataatgctacaatatattcctgattgaacttcatgttaaggtatgcatcacagggattatgtagcaagcttgtggcaccgttatgtacatgagttcttcggaggatggaagagttgattgatcgattacacgagtagttctagttttcagttgagcatactttatgcaccttaagtattgagctttttgttctcacatgatgtgttgtttcatttgaaagataactttcagttgacagctaatgattgcataacacgtggcttttcattgaacttcatatcatatatatgatggtatgcattactggatttttcatatcaggattgcggcatcaaatgtacaagagctctcttcatgggatgaa

SEQ ID NO: 31216 - DNA, 1501 bp, Oryza sativa
aatgagttcattgagtgactttcaggtgcattagtccaaggtgtggaagatggatgcttggagacccccaaaaagtacaaaatcaaagcggaccggaactcgagaagtgtataggatagtttatcttttgaaatcgagtttttaggaaaaaccgtactattaagaggggttccatgtgatgctctgagatatatcaagtgctcttagtgtgaaccaagtgtcaagtttccctaggagtcttttttgcaaatactccatctgtccaaaaatgcaagtccggaacttcctgtcttccaggtccggaagttccggtcttgtgaaaaagattttcctaagtgtagtccggaagttccggtcttctaggtccggaacttcctgtctagtttccagttcaaatttgtgagtaacggctagatgacgtcacctagccgttatacatatacagctcgtttccagctcgttccatggccattccactttcacttttcaaacctagagctattgctagcctctcccaagtgtttcttgccttctccactcaatctagagcctaattcttgtgagaaagagagattgagagggagagaagaagatttggagatgtgtgaagactaggatcttgggtgagcacttggaatatctcgtgggctgtcatctcggtgcttattactcttggagatgatctcctagacggttaggtatcgcccgcgagaatccgttacatattgtggatgtcccgtgtaagtttgtgaaggatttcctctcctccgaaagggaacgaggtaagttagtgaagttcttgtgctgagattctagaggcttttcaagtagagcaacccacacttgtggtggatttctagaagtatgttgagttggatcttggtggtcactcaattctagaaatttgcctaggggtgtttggggttgaaggttgtggatttcctctggggtttttgcacaagtgaggcaaggggttaatcgagacccagctctttggagctcctcaacggagagtaggatcgcaagatccgaacttcgggaaaaaattgctcttgtctctttctgtgatgtttctatggatgattctgtgatatatcctctgcttagaatacctgtgcaccatcttgtgaagattggcttagtcttttgtttcgaaatttgaatttcatctctattctgttacccggaaattcctgtcttagaacaccggaagttccgggcctgggaggccggaagttccggagttccttaccaggaagttccgggtctgtttggaatttaccgctgcgatttgtttttaagttttcagggacagcctattcacccccctctaggcttcatcagcgcgttcaattggtatcagagcgatatgctcttgattcaagcttcaccgctttgagtgatccacgatgtcggacttagggggaaagaacggggaaaatggaaatgaagatggagcgagcagcaaggaaactccatcacccaagggagctactatacc

SEQ ID NO: 31217 - DNA, 1501 bp, Oryza sativa
accgttttcaaccctatcgggatgaacccctctctccatctcccatgcaaacattaagtacacaaataaaatagtttcagcgaaaaatgaagggaatcatgcagtaacccatactcctatgccagattcataagttgttcgggaagcacacggcctccgaggtttaatacatgtaacctgatgtaattcagcaacattgggattgccacacattcgtttctcagtaaaatactccagagagctagaataccttgattctctttgccgactgtgttcatcgttttgacgtttatcatttgtttatgtgccacataagagcgacgaccctcactataaaaatgttgcaattgatctggctattaattcactggtgctacgggtttccgacataattctgagatgatgagaaaacggattaaaataactttgtcgacaatgaggagatgccgtactcctgtctttggtcggcgcaacaggatagaccgatcaataagagtcatgtagctcctcctatccacaacaagcagctgaagaaaaccagagtttgttagactgttacaagtcagggtcatctcgtcgtctaaaattagctgaacaaccccatctgtccgaaagaacgcctgaaacaagcaaatgatgtgtgcacaggagataggaccaaatggttaagtatcttggatgtgtggcggtacttttaacaaaagcacaaatcacggtagctttcggtcttggattctgcgggaaagaagaggagacatgcatgcatgtcagcatgtggggctgaatcgctgagaaagggggagaggaaagggccatgctcatctactgatctatactacatgtgagcttgcccgatctgattcgctaggagaacagatggaaggcctggtatgcacagcaacaataatagatcctttcttaattactccctccatactagtaaagaaagtagtttataacagcgacacggtctccaaaacacaactttgacttattgtttctataaaaatatttattgaaaagtgatatatgtatacttttatgaaagtatttttcaagataaatctatacatataatttatattttcaaactcaacaacttaagagtttttcatgatttatattcctcagttttgacttaaacattgttttaaacgacttttttttatgagtatagtgggagtacgtgtcgacagaagagacaagttcaagtttgaagaactcaggctataggccgggcagctgagaccaaattaatcaagttcagactgaagaattcgcaacaaggacaaataaggttcatgacatgaagatacataaaggccaatttcaatttttttcttcaagtttctaactttttcgtcacatcgaacttttctacacacacaaactttcaacttttccatcacatcgaactttcctacacatataaatttttaactttttcgtcacatcatagaaaagttaaaaatttaaagaaaaaagttggaatctaaataga

SEQ ID NO: 31218 - DNA, 1501 bp, Oryza sativa
aaaaatctgattgagtaatatttttttttgactaactgattgagtaatatttgttaactgctgcaggtgaaatcagcattttcaaaggcttattctgtgttaaccgatgcgaacttgataacaagcttggggcccaataggagcattctgggtaccattgtcagaccagactccgtgctcctagaccggaaaggctggaacaaggacgctacaatacctgacatgttaacagaaccctgggaaccattaccccgtcagtttgatagcgataatgatgcagtctataattggcatgtgatagatgatgaaccactgcccaggaatactcgatcctcatcggaggacacaaggccatcacctacacaaaaaaggaagtcttccaaaccaaaacagagatcgcggaaaaaggccaaggctgattcttcgagtggtaacaatgctgaaaatggtttcaagcgggggaaaggattagcacaatgtgatagatcgcatcaaagtgcaggaagcagcagacggagcaaagggccgagagagtatgacagatttacaaataccctcccacaatatactcagcacattagtaggtggtgactttaggctgttactgatagcatttacagtacagttcgggattgggagatcccacgaggttttgacaggcagaatggcgccttggcagacgtcgaagttcaagcagctttctgtagccatatgtatgatttattatttatttgtttgtctaaggttattcggtcctttgtaacgccgatgaaaccgatatattcagttatattatcatcgtatgaactgcaatttcgccaacttgtctatggcaaagtttcagactattaaaaattatctttggctggaacgtgaattcataattcataacaagacgtcacttcggtgacatccgataaaaataattcataacaagacgccttgaaaggtttaagttttattaaacgaaagaggaacataatttagattgtcgcagctaccaatcacactaaatacatgattggaagttaaataaaatcaagcttatagtcgaatgaaataaaaaggttccaccttcttttcccagtttagaactgaacaagtaaacagctttgtttaccgttaccacaacgacactgcaagcttaatacagctagctaccgtcttttactcgtctttcttctgtgcgaatcctgggggaaaggactccagccttttctattccgctcaaaagaataaggaaatataacgagaattgtatatgaggaatacaggataatcagctatcaagcactttgtgttcaaatatcaagcctcttatacctctgctctattttcctttcgagagctgctcctatgttttttccatagtataacggaaaaaaaaggtcaatcaacaatatgacaggttaaataaacattgaaagtaaaaatgcaaaacaaaagaagctaataaaccgatattgtaaggccacccaacaaacagctgacaggatcaaga

SEQ ID NO: 31219 - DNA, 1501 bp, Oryza sativa
tgacaggcagaatggcgccttggcagacgtcgaagttcaagcagctttctgtagccatatgtatgatttattatttatttgtttgtctaaggttattcggtcctttgtaacgccgatgaaaccgatatattcagttatattatcatcgtatgaactgcaatttcgccaacttgtctatggcaaagtttcagactattaaaaattatctttggctggaacgtgaattcataattcataacaagacgtcacttcggtgacatccgataaaaataattcataacaagacgccttgaaaggtttaagttttattaaacgaaagaggaacataatttagattgtcgcagctaccaatcacactaaatacatgattggaagttaaataaaatcaagcttatagtcgaatgaaataaaaaggttccaccttcttttcccagtttagaactgaacaagtaaacagctttgtttaccgttaccacaacgacactgcaagcttaatacagctagctaccgtcttttactcgtctttcttctgtgcgaatcctgggggaaaggactccagccttttctattccgctcaaaagaataaggaaatataacgagaattgtatatgaggaatacaggataatcagctatcaagcactttgtgttcaaatatcaagcctcttatacctctgctctattttcctttcgagagctgctcctatgttttttccatagtataacggaaaaaaaaggtcaatcaacaatatgacaggttaaataaacattgaaagtaaaaatgcaaaacaaaagaagctaataaaccgatattgtaaggccacccaacaaacagctgacaggatcaagatggtgtaaactcgtcaaatatattcataccgcaaagacataagtttaccaggttacaagcaggtatgtccattaaaagtgaggacatatgctagcatcatcacttaactaatctaccattcttattcagattgacccttcagctgaaaaaaagtagaaggatttgcaccaatctgctggctaattaaaaaaaaaggaagccagattgaagtggccttatggagagctgataagcttccagtccatattagaagtggagatcctttgtgagaccagtgaaacatctcaatatgactggttcattctgcactaacctgaccattctcgtggggatgtaacattgctacctgcattgagcttatcagccatggcaacagagtctgcaggttgggctgcagttaccactgggagagctacgctctcaactcgatcccgtggataccctaccacactagctgtttcaaacatatttccaaatggctgattatgcacgacttgtggtcccaaatgatgaaatgccatcggaccactcgctggatgctgaggcagaacagcaacaacagtagcagcacagttagaaggattcttgaatgtggcgctgtaggattggccactaccttgaacggcataggatgccacactacagtggttggg

SEQ ID NO: 31220 - DNA, 1501 bp, Oryza sativa
gaccaccaattacttgtgtcgccttgttgcggtttctgtaggaaaaacacatctgtcgatcgatcctttgcccttgcccaccggggtcgccactaccactctcacccaactctcaacgcgtatatatgctttgcttgcccaatgtcatgtatatatgtacctagctagtacctgccatgcatctctgtcactcacttgaccagtatacatgcataatttctttataaaatgaaaataccatcacacgtgtttcttatggtaattgaagaccttcaacttttctagtattataatttgttgtctaaatttcaattcatgcatgcaactctgctaaacgaattattaagagctaattaaggtatgtatgtatatatatatatatatatatatatataaaagctaggttgtcgtagcagacacaacatacaatctcttatcatggggctagatataaagcgagggacaaagctcgatttgaggttcgatttcctggatcctgatgcatacacataaaactgtgagtaaccaaaggctggggggaaagtacgtcgtagatatcatagggttgtttgctctttagctctcatcctttttccttcaacttagatatcatttggctagctatattcgcactagctaagatagccccaacacgtacatacactaattaacatggatattaattcttgaaacattaacaaactgtttacctgcacgttatgtactcgctttctagagaggccccagcagagagagcaaaacagtcgatctggagagctgtggatgaggtcactgtaccggcgaattaagagcgtgcctgccagcttgtttggtaaagacaggaggaaaccatatgtacgtatcaacgccagagaggtggggatggaagaccagaaattataacagtaacaaataatcatctgttcctactgttatcaggtcaaagggttgcccatatcaagcacatgtttcagtgttcctatccttattcttgccaaacaaaacaaaaatgataagatcagatcagctgaccaaaacaaacaagtagatgctagtagtatttaactacaagaatgaaaaggtgaacaccactacttacgtagcttgttgctaattaggcgtcaagttgttgtatttaatttacctgcatggatgttttcttttagaacactgttgctcgctatcagtagtatgataataataagataaatgaggtggctagcaaggctatggtaccaacaggcaacgagcagcagaggcgaatgggacgtgtgtttcatcatcaagcacaagctagctagcactacactgttactgtccattctccattcaggcagctagcgctgttgcaagataggtcgcccggccccagacatcctttctttatataaaccagccagccatggcgcacccaaacacaaacacaaagagagcaaaacttaagctagctctgggtgctgcattgtctgcagtttacaaaggtagatcaattagaggagaa

SEQ ID NO: 31221 - DNA, 1501 bp, Oryza sativa
  unsure (1)..(1501): unsure at all n locations
tctcgctgcttggagtctgtttttagccgccgtaatttctctaagcttcagttttttcttcttttgctttttcttccttcccctagcataagacagtctagctgattacgtcgtgtaactaaaactctttttcttctaatatattgacgtgcaatcattttacgcgtttgcgaaaaaaattttccacgaatccaaacctcttttttatttttcctctgagaagcccaatggatctctcttaattccatcaaatttctatatatgattaaaattttaatatttctgatattagtaacaatagtacggacaatatgtacggggttaacaattagtatgtgtaattcaataaaataagatatgcacatatacttttgctgaactttaaatgttatcttttgtggttctttgtctgcatgcccaatagttcgtaggcactgtcgagagtttagattatactccctccgtctcataatataagggattttgagtnttttcttgcaacatttgatcactcgtcttattcaaaaaaatttgaaattattatttattttatttgtgacttattttattatatacagtactttaagcataactttttgttttttatatttgtaaaaaaaattgaataagacgagtggtcaaacgttgcaaacaaaaactcaaaatcctttatattgtgggacggagggagtatataacatcttctttagaaaatggatagaaatctagcctctatatctacaagtgacatacaactaaagtttacaggaatactagattccaagtctcataagtgagaaaacaaaaaacaccacaaaagaacaaaaaaaaaaactaaaacactggaagactaatttcaaatttagatgtagaggctgggttttaatctattttttaaaagaaagattgtgtaggttaacttttagtgatgttagatcgatttgttggacgtttttggagcgtgcattggatagggttagaaaatcatcggccatgaatctcctagtccattggtggctcatcaatcatcgtattgatctatggcaccgaccggtgagctgctgagtcggaatgggtggggagtgaatcggaggacactccagcagagtccaacactcgagctgcctgcctacgcaaccgccggcggcgagaaaattgaaatgatgccacggccaaaggcggcgacagcggcagcgctgcaggctcgatccctcgctttctgtccctcccctgccggggctgcaatattacacctgcaactgcaagcatgcaatggcatggcattttggatcatatctctcctgcctgcctgcctgcctgttgacatgcccttcacgaccccactcaatccgcactcgatttttttttattttgaaatatttaaatttttaattttaaaaataaacacttccaaaatttattttcaagacctgtttgagctgatctggctggcatgccaacgttacctgatcacgtcacgttgacagcgtttttttttaaa

SEQ ID NO: 31222 - DNA, 886 bp, Oryza sativa
tgcaaggcttttgcgcgtacgtgaaaaaacaaacacaaatgtgctgtcgtaactactgtttatctaaagaactttccatgtgcataccgttgggtaaaggctaaatttaatgttgttcctttaacaggcattaggaagtgatttattcttctcttgaacagaccaaattggccatgcatatgtggtatccatgattgctaggggaattagagttatgacgggttcagaccagcctgtcgttctgcacatgaagaccttaatggtgttaagaaaaatttagttcaaggtgcgctccctattatcaaggttagagtcttgacctatattgttctaaccagaggtgcctgttcgagtaaaatcagttcatatgtcatttgatactttgactttaaatgcaagctattactttgttcatatagctcaaatgaggtcaaacaatagtagaatgctaacgttggcacacaattacttttctgatgtaatcccgtgatgatgcacaatgtgaggctaatatattctgacctttttgcagtggcactggtggggacatatttactcagaatggactgttgtttcttgtgcacgttctgttatcacatattcttctgggaaaaagagtactgctggcaatcccctcccctcttcctcttcctcttatcattaaaatagctgtgaatccattttttttaaaaaaaaaaaacatgtaagaccctgaatttgactttaatggagaaatttgaaaatatgcgtagggaatccctgcatatgcacactcacctaatctcaaggagaaaaactagttattccaactaataatgggctcgaacttggtgaaatatgatttgtacagcactacagccaaacctcaagtgcagccattcgacca

SEQ ID NO: 31223 - DNA, 1501 bp, Oryza sativa
tgttaaacatagatgcatgctatgagagagtgtagttgtgtaccagctctttggcgaggtcgacggcggcatcgcggtaggtggtcttgttgccctggctactgccgcagaacacgcaggtcctcttgaacctgctctcctgctgctgctgctgctgctgcctcattctcctctaattgatctacctttgtaaactgcagacaatgcagcacccagagctagcttaagttttgctctctttgtgtttgtgtttgggtgcgccatggctggctggtttatataaagaaaggatgtctggggccgggcgacctatcttgcaacagcgctagctgcctgaatggagaatggacagtaacagtgtagtgctagctagcttgtgcttgatgatgaaacacacgtcccattcgcctctgctgctcgttgcctgttggtaccatagccttgctagccacctcatttatcttattattatcatactactgatagcgagcaacagtgttctaaaagaaaacatccatgcaggtaaattaaatacaacaacttgacgcctaattagcaacaagctacgtaagtagtggtgttcaccttttcattcttgtagttaaatactactagcatctacttgtttgttttggtcagctgatctgatcttatcatttttgttttgtttggcaagaataaggataggaacactgaaacatgtgcttgatatgggcaaccctttgacctgataacagtaggaacagatgattatttgttactgttataatttctggtcttccatccccacctctctggcgttgatacgtacatatggtttcctcctgtctttaccaaacaagctggcaggcacgctcttaattcgccggtacagtgacctcatccacagctctccagatcgactgttttgctctctctgctggggcctctctagaaagcgagtacataacgtgcaggtaaacagtttgttaatgtttcaagaattaatatccatgttaattagtgtatgtacgtgttggggctatcttagctagtgcgaatatagctagccaaatgatatctaagttgaaggaaaaaggatgagagctaaagagcaaacaaccctatgatatctacgacgtactttccccccagcctttggttactcacagttttatgtgtatgcatcaggatccaggaaatcgaacctcaaatcgagctttgtccctcgctttatatctagccccatgataagagattgtatgttgtgtctgctacgacaacctagcttttatatatatatatatatatatatatatacatacataccttaattagctcttaataattcgtttagcagagttgcatgcatgaattgaaatttagacaacaaattataatactagaaaagttgaaggtcttcaattaccataagaaacacgtgtgatggtattttcattttataaagaaattatgcatgtatactggtcaagtgagtgacagagatgcatggcaggtacta

SEQ ID NO: 31224 - DNA, 258 bp, Oryza sativa
ccttgcggttcggaaggactagcaccgatcctgatcatgctgattttgtgctcgatatctagagcgatgtgcacccgcgtcgaaggatccaactgccgtggcacccgggaaagattcttcgcctttgccacctcataaagggagctgatcacctagcgatcaattcaattaatcaactgatgagcagcaaccaaagatcgatcgatccccaaaaccaaccaaacaaacagacgatctcaacctgcgattcttccgcga

SEQ ID NO: 31225 - DNA, 195 bp, Oryza sativa
aaatggatgggatagccaactacgtgcacttattatgctgcataatttcaaccggcaagcatgacaagcagaggaaacactagctaagttttgcgacattttgcagttatcctatctctttttagttaccagatgatttcctgcgcgttattgtgaggattgattcatatggagcaaacaaatagtttgagcaaa

SEQ ID NO: 31226 - DNA, 1501 bp, Oryza sativa
ttcatgaggtatgatttaataatggatggtcacctagctaattatgcaactttatatctatatctataccttattaaaaaataggtaaagcttctgaaatattttttgtccgtgtccgtctttttttccaactgtttttttccatcacgcttcggtttggtattcttcgatctcatctgatctattgcacgccgccgccggaccaaaacctagcattgtcgccacatcatctccccgtgtgttttatccccctattgaattttgtggatttgttccaattttgagaaaaacggaaagagaagatcgaatggataaaaagccctcaaccaattttgatagattaagaagaaattggctggatttgatggggatgaacggctccggcatatatgcaagagactatctaaaggtcggagatggcagtcggctgtgtgagttgggcctatggctccacttgtgggctggaccgaagagaggtaggtcatgcggagggaagtaacggaataggctggggctaggaaggaaagaatggactttcatcccaaaaccaagaagaatttttattagctttttcaattataatgtatagccatcctaatgttttaatttattgctcagtttctaatagctattgtatcactgacaaaacgtttttatccgttgcaacgcacgagcttttttagttagataacaaaagcccataggagttctgatcaaagttttaacaacggcttattctttctaggtaaaggacaaggccataaaggttgatctactccttgtatcctagattttaattgaagtgtgcaccatggacttgttttggataacagatagtactcgtatttcatttgtagggaacatgcatgcgcatcgatcttgcatgcaatttatgagtggaacactttttttttaacacagtacaggcgcacactcatccttctgaactcacacacacaaacactctacccctatgaacatctccgagagactagactggtatatattgagattgatgaagtgtttatgggtgtcttgctctcgacggacacgtcgcctccaagaaaaatgcttcgtagaggcatttttctaatgccatagaaaacaattttaaaatacatttacaacactatatcatttaaaaaatatgtaatgcgtgccttattgtgaattaatatctacaaacgaaaaatatccgtcttgtggcatttcaatagaggcgattttttcatgtctataagataaatccctctatgtctcgtggtattttaatagagacattttttatgtctataagagggtagatgcattttctaaagatattaaatttcaccataatcatatcaaaccaatgttgaaaaaagagcataaactatttattcttgctactgtcaatccttgaactcaagatcttttaggcaactcattattatcttcaatgcgttgaccaacttaacctcatgtcaatacttgtaaggttatggcgtgtgttacttatatt

SEQ ID NO: 31227 - DNA, 458 bp, Oryza sativa
gatgtctctttaatcccttttttgtctctctttctccgtttgtgttgttgttgttgttgttgttgttcagtttgttatgaatggttgattgattagagggtagtaataatgttgtgttcacttgtgctacttttaatctgttcattagatgctgattgtgctagttgattgggatatgcatgtttggtttgtagccaatctcagccaaaccgaaaaaaaaaattgggactgacaaaatttttattatttgtttggtttatggccaaaaatttgccttgccaaattatttggctgagttgaatatgtcaagatgcaactttggtagcaaaccaaacaaacactagccaatttttgccaaaaaaaaatggcattgccattgcccaaaattggcaaggctagaaatggccatgaaccaaacataacctgcagtgtgtgtttcagcctcaaggtggctgtag

SEQ ID NO: 31228 - DNA, 1327 bp, Oryza sativa
aaagcagcatttagcaaacatttgagaatttgataaaacagttaagtaattaaacaatattaatccaacgctatacaacataccctgttgtataggcccaaccattctgaacaaccatcccggctgcacagttctatctccaaaccaggaatgtaccattccaaaccaggagctaaacaaattattaccagattaagcatcttttattatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaatccattgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaaccaaccattaccaggttttagttggcacattaattaattaactaatcacgattgaccatcgtgaactatcaataagccatcatgaaataatagtgaatcattagttatcccataagtgtactaatgtttctaagcagggctaagcaattatatctaatatctagttgaaccaatataaataaagctcaactagtcaaattgtaataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcaaaaagaagcaaaatcaccaaaacagcacataaacaagcatgaacagtacatgtggatatttttaatgtgtagatctcaattttagaaaaattagagacttgaaccaactaaatcggagctaagatgaattagttatgaatttttaaagattaaatcggattaaaacacttaaatcggtttaaattgaattatgacgcaataatgaattatttttgaaaagg

SEQ ID NO: 31229 - DNA, 252 bp, Oryza sativa
agtctcttgacaacaaagtgatttgtcatgtccccactcccaagtcctttgatcttgttgacaagaatcatcatcctatcatacatctcttgtggtgtctccttgtcatccatcacaaatcttccaagccttccttccaataattcaatcttggcctcacgaacggtaggtgatccctcttgagccaattgcaaagtatcccatatctccttggcctcctcaagcccatcaaccttgttgaactcctccaga

SEQ ID NO: 31230 - DNA, 1401 bp, Oryza sativa
ttgtataaaggaaagaaacttgaataattgtaaaaggcaacaaaggttgagaccagtcaaatattgaaggggtaaataaattgttactaagggcctcacttgatgaataaaagatagcatggtatggtaattgtcctttatagtattgttttgcatggctgattttagcatgagaaaaacccatcctcttggacaaaaatccatttatatcgtggttggtacttggtagcagtggacagtctttaatcttgttcagtttggacttgatcaaaattcctgctaagtcttgtcgaaatatattcatatcttgctgcataaagtaaagggagaacattttatatgattttcataatgggaagctttggtgcaaaatatgaatagagttcattgtggttgcctgaaatcattgtattgatgtcagaaatcattgttgattcacacagataatagacagaaaagggaatgaattgagcaacccatataccaacgttacatgtccttcagttattggatcaaccacaggaaggttaaaaatattgaccatataagaggaattttgcttaagttctaaaagaatatctgaatcacatcgtaattcataaggaatttcgcttaagttctaattaactttggttgatcatgttgcctgactcactacataatatttggagtgttaatgccaattcatatagtgctctactatcactattttagtagtgcatatactgttaatcaaaataatttcattttgcaacttgtatatatatctctacatgaggactttgcaaagcaacatctcaggggcctacaatgagttgttgctcaggtaacaagtttcagtatcaaaattcataatatgttcactacaggtttcaggttcatatatctgaccaaagtactgtccttgccagattcagttccaaaatgagacacagttctcaccaggattacaggtgacggaacactttgtcgtggctacatagcacttgcatgcagaggggtagcagcttatgaagccacctcttgtttcatcagaggtaagattgagctaaagatgatgaatttagaaacttcataagctggcatgaactgaacttactgacaaatgcttaatttagaaacctgacaagatctcacgaactaacacaagaaaatctggtctttatgcacgaactttgggtgttcagccagcaggacgttgcggagctaccaggtctacttcagcatgaggaagcagtcaaccaacaatatcggcagcaagcacatgctgggaatgagactgtgttaatcttattaaatcaaaaaattagttcatgttatgccatttatttagtgtaattatagttatatatgtcctgttgtatgcttatgctgccatcggccaatctatgccgttaggat

SEQ ID NO: 31231 - DNA, 1501 bp, Oryza sativa
gaagggattttaagccattattccattcattcactttttatagcaccggtgcatctcatttaactttttgaacactgtcagatttttgcacagttgctagtagtacgtgaggctgtttgttgatagccacccttgtggttagacgagtttgatcatattaaacgtgtgtttggttgacaactataagtgtgggtaagattacttcactgcaaactgaggatccatgcctaagagcatctcctacagtctcttcaaatctaactctccaaatatcaatttggccaactctctatctaatttagccagtcaaactcttatttactccaacagcctctctattcatcctctctattatgagcctatgatagtgggacccacgtgtcagtctttacaaccctttcttcttcctcatctctccccctttccccaaacccactctgctcagctcgcagcaggtgctgccgccgccgccgccaccgctcggggcgagctcgcgtggatgcggggtggccaatcggctcgggcggcgaacacgatgacaggagtgagatggcggcgtcctctactacatgccgcaccggctgaatccgccggggcatggcgatgacgacggcaggcgacgatgacctcggctggcgacggatctggcgacggcgccgacaacggctggcgacggcatcgacgacggctggtgatggtgcggcgtccggcaatgacgacctcggagatgacggttgacgatggcgccgacgacggctagcgaggctcaacgacgacctcgcggatctggcaacggcacgatgacggcggtgttcggcaacagcggatctggcgacgacgcgacgacggctggcgacggcgacagcgccgacgacggctggcgacggcggcgtccggcaacgacgacctcgacagcaccagcgatggcatctcgacgacgacggttggcggagagagaaagaggagagggatgttgttggcgtggggcccacgattggctaggctattttggctggccaaatttggctagtggaaggaggactttggccagcccaatagccagtctgttggagggtgaaattgagccaaaatttccaaaatttaacttaaagagagggataaggagaccgttggagatgctctaactggtcttaaaaagtatggcatggttttactttgtggctaaattgtagctttgattttgatggcaaaatctttggtgagcttggacaaaaaggtttggcaaatctaggcagatgaaccttgcagattgtgacaatctcatgtgtccaatgagaatgatgatgtccatgctctgctcccggaaagaagaggcaaaatccaaggagaaagaaaagaaaagagagaaatctactgattcgccgcagcagcacatggatatggataagctctgctgcgcactgcccaaataggaccatcatgtctgggactttatatccttaccctctgttcgttcgtcttagagcagttacaatataag

SEQ ID NO: 31232 - DNA, 764 bp, Oryza sativa
atgcttgtgtgtcactctacccttggattatcttaacccctgcttagaatatgattatcacaagtaatatataaattattagtcaagttctctctatatgatcttcccacgagataaaataaatacgatacccttggaatactctcgggtgaaatgttacaatggtatatccgtgcgcttgcggatgaacactgtaaccataatataccagaagtatttctgcgtcattactgggaattatatttctagtaatgtcgttaagaaataccaacacttatgacagttatgatagttggaaaggtccgaaacgccctccaaccgtcatagggagtgaatctccaccgtccacaagaaaccctggatccatcggcgcttagaggggttcggccgaaccatgtgctagaccattttggcccatttttggcaggtggccctcttagctcctcccttatacataacagtgaattttgggcctattagatcatgtcaattatgtgttcttggcctattcatccgtaagtctagatctcgacagcctctgattgattgatcgtctattttgttgtcgattctcctccatttatatgtgcttctcctacatagatgttaatagcatagtatatagtggaagtagatattttatttggaaattatgcattgcaagcatagctagtcttcatatattgggtaatattgacggtcgaaattggtcgataacgactatcaacaccaatcttgattaccgatgggaaagctagtggcaa

SEQ ID NO: 31233 - DNA, 1501 bp, Oryza sativa
acacttagttacatagcactacttaattacaatacaccaaaattagattttataactactagcatagcatattgtccatgcattgaaacaggatctaattgatgaaaataatcgttaacctattattatcattattttccgtactattaaattctacatatttgtaaataacatatgtgcatatggcctcacaatatcactttttcttcataaaaaaatagagatggtggtgggtggggtggtggatatgtgggtcattcggccacacatatcctttcttcactcaaaagaagtagggagttgttggtggaaccccacgtgtcatttcttcattctaaaaggtagagagttggtggcatgggtggtggcacattcaccgctaactaccaccactgctattttttttaaaggagtatagatttttttcttagattgaggaatttttattaggtctctttttttattttatttaaaacggaatgtatctgttggttgaaaattccataagatttaaagctccgaatctaagaccctcttttgtttaggcttaggcttattggcctagacttttaagtcagcttattggcttatatgatttataagacaatggatttaatgtcctaagtttagtggttgagtcatacatctacctcacataagccaaaaatacctcacataagccaaaaaagcttctccaacctagcttttggcttaatagtgttaaagtggcttgtggcttcaaacaagccaaacggaaaagctgcttgtttgtttaggtttagacttttcgacttataagttggcttataagtctaaacaaagaggacctaatattaataggcagtccaaaagattattacaataatagttgaacgttttgttataaaaaaactgaaaatttgtttatctggtaggtccgggttgcaccttagacccgcaaagttaaaattgtagtgccgctgcagttttgctaaaagagttgtattattttttttaaaagaaatagtcttcataattattgtagctctttgtctttttaggagaattgtcatggaagggattttaagccattattccattcattcactttttatagcaccggtgcatctcatttaactttttgaacactgtcagatttttgcacagttgctagtagtacgtgaggctgtttgttgatagccacccttgtggttagacgagtttgatcatattaaacgtgtgtttggttgacaactataagtgtgggtaagattacttcactgcaaactgaggatccatgcctaagagcatctcctacagtctcttcaaatctaactctccaaatatcaatttggccaactctctatctaatttagccagtcaaactcttatttactccaacagcctctctattcatcctctctattatgagcctatgatagtgggacccacgtgtcagtctttacaaccctttcttcttcctcatctctccccctttccccaaacccactctgctcagctc

SEQ ID NO: 31234 - DNA, 169 bp, Oryza sativa
ttatgggccttgatgggccgtgtgtagccgtgcctatgctatgggccgttgctttgctggcttgcacacgtcatcgcgtgctggctttccaacacgctcgaaaattcaaaagttgtctcccttttgatatccccacaaaaatctcgagccccacttgccggcgacgaga

SEQ ID NO: 31235 - DNA, 1501 bp, Oryza sativa
gatggttctgtcccccccatcttgtggagccgtttcttcttccgctccccctcgggctgcggcgtcggcgtggccccctccgggcgcctgctgctgacacgcgccgccccgccccctcggggaggagatggggaggaggtaccctcttgcttcctcttccctcgggcgtcggcagggcggctgccccccgagccctcatcacggggcccggaagcacgaccccctcctagggtagattgatctcccttgcggctcccgctcgcaccgtcatggcccttgggagctctctcctctgaggccccgaccgtcatcatgatggtcaggatgttggcgcgatctggatcgctgcagagggggaggactccttgggggatgagggatgcctccacggagctgagatttagcacccgttggatcattaccttgaagtcttcagggacccagtcccatttgaccccccggtgggtcctcatacagtcctcgaacccggtgtactcccaggcgccccgggcgcgccgcttgagtggcgcgatccggcgacgaaggtagtcgccgtacaccatggcccctgtgagcccctgggatcgcaggcccgccaggcggtcgaggacggcgtcgtagccatctcccagatctaccggcgcccgccagttggaggcctgcgctgggggctggctcggaagtcggaggcgcgcttcgtcggcgaggggggtgtagaaccagtcgctcttccagtcgtcccacttcttgcggaggacgcagggaatgtagcggttcagcaccggcccccgcggctggaagtagcagccaccaaccaccgacggcggtgacaccggctgtacggtgaagaaccaccggaacagccgaagggatgggcgcaccccgatgaacatctcgcacaggttcgcgaagatggccaatgtcattaccgcgttgggggtgaggtgcgccatctggagatcgtaaaactccagaacatccatgaagaaagaagaaaatggcggaaccagccctgccattgcgaaagggaggaagaagacggaccgccccgggtagcgtggcgccgggcgtccctcgcccagcgtgactatctcccggcgggtggcagattccggcatgaagcggcgcggcagcccggcctgtctctcgctcacgatgcgggaaggcggcagcacgctaccgtcaagcggagcggagccccgtgccatgacgccggaagaagagatgtttgagagcgagcgcgtgtggcgaaggtagggcacaggaaagaaggagttagggcgcaagcggcgaagacaaggggaataatggcgaaaggaaggaagcaaatctcttccttagcgtctttatacccttgccaacgctgtgcccggttcctcgcttcccgcgcccactatctcgccccctcgcttcccgcgcccacgcttccactaatcccactcgcccgtttgcggcgcacgaggtggatatgcggttgtggcggtcgagatggtacatatcg

SEQ ID NO: 31236 - DNA, 588 bp, Oryza sativa
agacgtgttgtcggagtcgtccgtcaagcctgagtggaagagctagccctagaaggaattggagcaggcaagtgacgtaataatataaatgattgttatatttgtaatgcaattaattaagattattagacctgtaattggacttatcatataagattgtgtagtgttctaatattatttgagttttaatataagattactttatttgtaattagacttagtatgtaattattgactacggaattggggcgacaagtagcaattgactattgtagtcttaattagacttagcatatacgcacgaaacacttagcatatactgactattgtagtcttagcatgtaatattatttgagttttaatataagattattttatttgtaattagacttagtatataattatttactagctagggttgtacaatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 31237 - DNA, 1501 bp, Oryza sativa
tttcttagtactaccacatttctgtaaacattacagctaacttcatgagaaatataaagcagaactggagcattagctaagattcatggggaaaagagacaagtaggttcaccctaaactcttttgcaccagtattaagcatggttgcaatgcaagtttccatcccatggctatgaatgacagccccagctctcatcaaataagcctgcaaaataccaatgaaaattagacagtttagaacacactagccgaatgtgcgctctttctcttttggcaaccatgattggacaatcaataaatgagaattctataaaagctcctaatcaacaccactcccgaatacggtatgctcgatcctaacagaagacacgagagtagccactgctcgattaaccgctcgtgagggggaatcgagtgcccctcgcaggcaattcgtcgaacaggagccgtgcaggctgtgatgagagagagagaggggggggggaccttgggtgcccagaggcggtcgtcggcggcgacccagcgccaggtgctgcgtgcgtccaggagctccatcacccgccccatcacctcctccccgagcacatccacggggtcctctcgtctctgccgcctcctcctcctcctccccctcttccgcctctcccactcctccgcctcccgcttccgccgccgccgccgcccgcgccttggttgccgatgacgtcgcctgcaccttgctcaccgccgccgccgtcgcccgcaccttgctcgccgccgccgcccgcgccttggccgccgatgccgtcgccttgccgccgccggaggaagcgtgagtgcgtgacggctgggtagggaagaaaaggataaggttgtggggaaattagggtttggtttatatatgataggctagatgggctttttgggcttgcaatatagtattattaatagtctaatatacaccctctaagttttgctgacatataattagctcgtactcttacaattactgacagatattttgaccaaaaatatatttagaattactgacatataccatgtctcattatgcactattgctgacatatagtttgccaaaaacctttaccgacagatatgttatcactaattgtttatttttgccaacagatgtctgttggtaattccatgtcatggtgtagtgatcatgcgagcttgtactattactaacaagcacattacagcatgcaagcttgtactactagcaccaggtagacaatatgtgagagcttgtactactagcatatgggaaaaacaattcactgatagagattgtcacacccagaaattctcgaaccagaatttctaagctgaatgtgcattaaatccctgtccaggaccagccagggtacacaaacgataattgttgacatacagacccacatcttacaaaaatataaaagattacaaatgcagcgggaaagataaaagcgagctaaaccgggaagcttgacttcaacagcggacgactccactccacagg

SEQ ID NO: 31238 - DNA, 1501 bp, Oryza sativa
agaatcacagagattattatctaaagaaacagagaatcagggatagtaattgtcgaaactagatttcggcaataataaaagggggtggctatcaagcttggaaagtgtatgggtttggagacaaaggatttatacaggttcaggccttcttataaaagaagtaataccctactcctgtccggggatgaatccgccgagtgtattattgattgtatgattcgggaaaaatcagcatatgcccctagaggcgcccggaccccccttatatattggaaggagtccggattacaaaagataatctatattcctaacggaatatgaagataaaggtaaaatacagtcgtaaccgactaagtctcagggtgtttccttgatacacaagttaagaaacaaacccgagatacagataagatattctatctacattaggtatcctgtacccagttcgaataccatcgccgtgtagatatgggatacccataatctccacagtagcccccgagtcctttgcagtcgaccatcgtaaccctctcaaagatgataatccgagtacttcaaactcttcaagccaaaatctgccgagtggactgtaaagggcgaaaagataaagaatatggtgcatcgaatagatgcacctaattaggtgtagcccccaactatgtgattagttaacaaactaaacatatagttgaaagacaaaataataacactattgtgcattacatgacaaaagcgtacgcggcgcctaaataggcatgctagccgactgctttttagccacaataaaagaaatccgagtggtttacactctaaaaggttcacgaatgaactcacttgacaggcatccgaataaaaaaactctaaagattacccatcaagtaccataaagattatggtaataaataagtcaaatagcctaggccatgactatttaccatgaaaacaggcatataacacgccaaggaaatgactataataaaaacaagtcattcctagttaacccaaacagcttttgtagcctaaaaaagcttgcaaaaacagcataacgcctttctgtcggacacctttttaacttgcattgcaataattccaaagaattatatgaccgcataaaaaggatttcatcagcattgggcaacactgttgtgtgcataatattgccaaagcaaaatatgcctaagtccctaaggaacacaatgggccacgctgttaaaagtattgggctgaagtactgttcaggcctaggcccattagcacctccgatacccttaactgaaaaatccgatatccaagcggcgcttcgtcttccccgccggaactctcgccattttccccactccctgctacagtgcaaagctgcgccggcgaactagggttcacaactccggccaaatccacctccgaaaagtgcatcaaaatccttcccgtgatccaccgcctcaatccctcacctctcccaagccatccctcgaatcaaatcagcacatttgagtgaaaccga

SEQ ID NO: 31239 - DNA, 1501 bp, Oryza sativa
gcccgtggtgcatagataaagaataaaagaagtcaaacatactactcgttgagctgtaggtgagcagctgagctcgtcgagcttttcgagctcggttcgatggggctcgcgagccttagtgcaagctcgggcttggcttgtatgatggtcgaatcgagctcgagccgagcctaagacgagccgagttcgagtagcttgcgagccccgagcttttttgacagccctaagtgtatcggtatgttttattagttagacacaaaatgttgcagtgcccttttgatgatgttttcattcttgccttcagtgtgttcagatgtgttgatgctttggtagttcaaaattgatgtttcatatgtaacaaaatgtttcaattatgtttcaccatttgaattgtcgaaacatttttgttcgagatctgaaacatttttgttcaagggatgaaactcttttatctcattggtgaaactttttttatcgagtggtgcaacatgtgaaacacttcataataatacagtgcaacatcgtccgatgatttataaaatattggacatctgatttgtagcactctccaaaaaaaaaatagaggtgtggccatagactaaggagatgctttagcgccagtttgccatcgatgccatgaaactcatagcaactaaaatctctagccaagtcagcagtggatgccatggcagaagtcgatcaagagctcggacaaaccgtatgcagctgcacatctacgtccttcacctgcgcctctattggccacagtgtcgtatgcccgcgccgcctacacccgttgcatgctcaccattgccactagctttcccatcggtaatcaagattggtgttgatagtcgttatcgaccaatttcgaccgtcaatattacccaatatatgaagactagctatgcttgcaatgcataatttccaaataaaatatctacttccactatatactatgctattaacatctatgtaggagaagcacatataaatggaggagaatcgacaacaaaatagacgatcaatcaatcagaggctgtcgagatctagacttacggatgaataggccaagaacacataattgacatgatctaataggcccaaaattcactgttatgtataagggaggagctaagagggccacctgccaaaaatgggccaaaatggtctagcacatggttcggccgaacccctctaagcgccgatggatccagggtttcttgtggacggtggagattcactccctatgacggttggagggcgtttcggacctttccaactatcataactgtcataagtgttggtatttcttaacgacattactagaaatataattcccagtaatgacgcagaaatacttctggtatattatggttacagtgttcatccgcaagcgcacggatataccattgtaacatttcacccgagagtattccaagggtatcgtatttattttatctcgtgggaagatcatatagagagaacttgactaataatt

SEQ ID NO: 31240 - DNA, 1501 bp, Oryza sativa
gaagctcccgctgcatccgcttcaccagcctcatggcgtcggcgcaccacctcatcgacaccgccccaccgccgccgccgccgccatcgccgtcgtcctcctcacgaagcagcgtgctctccagctgcgcgaggccgtccaccagcgaggcgcaaaaggcggcggtgtcgccgtcgagcagctggcatcgccggcgagcaccaccaggccttaggcatctcatcgtcgtcacgcatgcaacacaagaattaaatcaaatctcaagaaccaaggatcaaacaagaaatggtgaattgggcatcacttttatgttgtgcaaatacaacaatataataatgatctagtgcaatttgttcatttgcatggaagcaaagttgggtttcttggaggagtaggcaagattaattttttcaaaggaaagaaggggaggagtgaagcaagaggataactaggtatgcatactattccatgcatacacctagctttaccttaccttgcttaattagcacttgtgctcttttgatttggcattcttgttcttggagtttggagattggagacaactcaccaaccaaccaaccaaccaaccatcctttggggcttttagctatgccaggtctttgatttggatgtagtggcaaactggcaactactaataacttatagattgacttgtaaggatggatggatgcatggggccggccctttggtgccttgcagggaagaaatggtataatttttactctcttaggggaagtgttttaagctcttgagggcatgtgtccttgttttcttacgtggttcaagtaattaacaaaaacttaaaataagatttagacaacgtactttctccgtttcatattataaaactttctaggattgtacatatgtctagattcattaacatatatatgaatgtgggcaatactagaaagtcttataacctgaaacagaggtagtacattattatgatacgaatattagggaatgatctaatatcaaataattacaaggggtgagacttcgaacccaaatcgtctagcccaacacgtcttgtggagctagccggaagacccctgagcgtttctcaacatactttattatgccatgtgtactttcacttgcaaaattaaatttgatctatatgtgtatgtgaacgaaatttgatctatagatcagagggaagaaagaaagtgcagcagttgcattcacaattggatctgtttcatgcactcctatacgacatatgcattggcattgcatgtactttatactttaatttgttgcaacgcattttaggtttcggtactggacaaaactgaggtgggatgtcatgtgtgatgatttatattttgattgtacaatggagtacactaaaagtactccaattaatccagctgacatgattatttgaggacagttagttcatcattctttccaaaagcacattcaccataatcacatctctaaaggcatccctatttttttttcagattattcg

SEQ ID NO: 31241 - DNA, 1501 bp, Oryza sativa
tcttactagaattaatatcagatcccctccacaggcaatgtctcctagctctatcaatactttctataactgtctttggaagtgaaagagagcacatgtagtaagtgggaagggaggaaagaactgcattcacaatggtcaatctgtccccataagataacaaagcagtggttgatgagagtcttctctctactctatcaactagaggagcaaaatctataactcttggtcttgtggttccaagaggaagacacagataagtaaaaggtaacttaccaatagagcaaccaaacaattttgagagatgatcaaccttttccaaatctacattcagaggaatcatgcatgacttactatagttaatcttaaggccagttgaagaggcaaaagtattcaaaattgccttgagacagaaaagctctttttggaagcagtcaaaaaaaagtagagtatcatctgcatactggacaatcggaaattcattaccaggtgttgggattggcattgtaaaaactcactgagaacaagctttattgactatagattgtaacaagtcagctccaagaacaaataataagggtgaaagtggatcaccctgtcttacaccccttttgcaatagaaggatttgccaggaacaccattcaggataactgaagaagaggctgaagaaaaaatctgagaaatccagcttatccatttaggatctaagcctttctgcctcatgatgtttaatataactgaatgttcaatagtatcaaaagctttctcaaaatccaattttaaaagaactatttccctcttagaatgttggcactgatgcagatattcaaaagaccaagccaaacagtcctgaatatttctagccaaatagtctttgattttggtactcaggagatcaatgcagaagaaattgaagcactcggattatcattttgtgctacgagaagagactatttcgttgactgtaaaggtctcagaggctactgtggagattatggataccccatacctacacgtcatgtatagtccgacagggtatagggtgccatgtatagatagaatatctttaagaggactcgggttaaattccaaacttgtatgtcaaggaatacttgagattctagtcagttacgattgtattttatctgtaactacatattccgttagggatatggactgtattttgtaatacggaccccttcccttatataaggaggggtctgggtgcctctaggggcacgattttcacccagatcatacgatcaataatatactcggcggatcaatcctcggacaggagtagggtattacttctttgattaagaaggcctgaacctgtataaaatttcttgtctctaaacccatctattttttcagtttgatagccaccccttttaatattgccgaaatctggtttcgacactagggcggccagatcgcgcggcggcggtcctcgggcggcttgcgacggcgtgcggctgcgtcgacggccagcggcgg

SEQ ID NO: 31242 - DNA, 1501 bp, Oryza sativa
ggaattcgggtttaggtgatgcaagctgattccatagaaattcaagatcccgcggaaaaattttgaggtcggaagagcaaagccgccgtagaagaaatgcgagaagaccacaatctcatgagtatccggagacgggaaagcctcaccgtgcgctggtcgccacccgatgatctccttggcagggagaacgccgtgcgccaccatctccttaagatcctcctccgttacgtcggacgacgcccattggccttcgaagctttctctctcttccgccatcggtttcactcaaatgtgctgatttgattcgagggatggcttgggagaggtgagggattgaggcggtggatcacgggaaggattttgatgcacttttcggaggtggatttggccggagttgtgaaccctagttcgccggcgcagctttgcactgtagcagggagtggggaaaatggcgagagttccggcggggaagacgaagcgccgcttggatatcggatttttcagttaagggtatcggaggtgctaatgggcctaggcctgaacagtacttcagcccaatacttttaacagcgtggcccattgtgttccttagggacttaggcatattttgctttggcaatattatgcacacaacagtgttgcccaatgctgatgaaatcctttttatgcggtcatataattctttggaattattgcaatgcaagttaaaaaggtgtccgacagaaaggcgttatgctgtttttgcaagcttttttaggctacaaaagctgtttgggttaactaggaatgacttgtttttattatagtcatttccttggcgtgttatatgcctgttttcatggtaaatagtcatggcctaggctatttgacttatttattaccataatctttatggtacttgatgggtaatctttagagtttttttattcggatgcctgtcaagtgagttcattcgtgaaccttttagagtgtaaaccactcggatttcttttattgtggctaaaaagcagtcggctagcatgcctatttaggcgccgcgtacgcttttgtcatgtaatgcacaatagtgttattattttgtctttcaactatatgtttagtttgttaactaatcacatagttgggggctacacctaattaggtgcatctattcgatgcaccatattctttatcttttcgccctttacagtccactcggcagattttggcttgaagagtttgaagtactcggattatcatctttgagagggttacgatggtcgactgcaaaggactcgggggctactgtggagattatgggtatcccatatctacacggcgatggtattcgaactgggtacaggatacctaatgtagatagaatatcttatctgtatctcgggtttgtttcttaacttgtgtatcaaggaaacaccctgagacttagtcggttacgactgtattttacctttatcttcatattccgttaggaatatagattatcttttgtaatccggactcc

SEQ ID NO: 31243 - DNA, 441 bp, Oryza sativa
atggactatggaatttgggtttaggtgatgcaaactaatcccatagaaatccaaaatcccccaaaagaatcttgaggttggaagagagaacccgccacagaagaaatgagaaaataccacgacctcgtgtgtgtcaggggttgggaatgctttgccgcatgctggacaccacccaatgatctcctttgccggaagaacaccgtgcgccaccatctccttcaggttctcctccgttacatcggagggcgcccactgactctcaaagctctctctcttccgccatggatgcgatctggataatatgatttggttcggtgaatggctgggaatggaggggggattgatgcggtggattcgcggatgatttctgtggagttttggaaggtggatttgggagaatcggagaaccctagttccgctggagtggttttgtactgtagc

SEQ ID NO: 31244 - DNA, 843 bp, Oryza sativa
ccccggaacagaaagcagctagcgtgtagtgcatttgcaaaatcaagcgggtagtagtacagacagcctgtttggtagagctcaaatttttaaatttagttataagagttggtctgaagtggagttgtacagctgtctaaacctagcttcacatctctagttcattttatgataaaactctacctaactccgctctcattttaggtggagctgaaactgtttagttgactctaactttaaaagagatggagctgtgctaaacaggcactgacctacaaatctcagcttcactccacattttctagttacagcatttgccatagtaagcgtgatactaaaattgagttattaggatataaagcagacggtttaaagaaaaaaattgaggggttattacggtgtacaagttttgtttttccacttagtataagggtgatactataaggtgattgctatacttgtgcttgtgcctcataaaggctctcagcctcggcgattttattgtacacgtcggagcaaaataacaacaggtaatcataaccaatagcactgaaatatctgctgaaaggacacccgatggaaattgcagtatgaaccattatttgaacaaaagcacctgctcatcgcaattatgcatcacttaacacgaataacaccaaacaagaagcttggcagccaccaagaatgactaggcgcttggcaccagcccagccacctaggaaaacaagcacatcttataggcaaaaaaaaaaaaaagtaacaagatatcatcttgctaggaagctgtttgagaataggaggttcataaagcatcaattaactgtcggtaacaatgaacaaaga

SEQ ID NO: 31245 - DNA, 1501 bp, Oryza sativa
ctagcaatatcatcatctaacctgccatcggttagtatctgttaatagagggtagccgattaggttaaatattaatattgatctagattatatgagacatctaccattctatgaaacttctagcgacttgattatctagatatcgttcttcttttcatacttaatgctgcatcagttgagtttgatctattaagtcgtgcttagaatattgatctttagcctgccctctagttgccgattagaatagcatcggagtttcagccgatcgtatctgatttaacttcatttgttatatatgccttattgatatgttaaatctgccctttatgttaagatattgttgtatctaagtatgttaggcttttgctcaatatattattcttgctttaatatcttgatatagagtagtatcggagtattagccgatacatgctagatctatctgatcggctatgttataaacatatatagtcttgttattgacatatatttcgatctaagtgatttatactgtctcggcatgatgaccgatctatcccaatcacttgatttaagtatacatcgatatgaggagtatatattgttaatatctacagccaatcgagtagatttagtccttctttacttattcatgactgccgatcgatgcacagatgacatcggctcaaagataaatgatatgtcatcggcatctagccgatcggctatcatttatggatttaaccacggtttctttgcttctatttcttgttgattacaggatcaaatcaactggcacgctaatacatccgaaggcgagctttggacctacactggagttaagtagatctcccaggccacgtgttttctgtcaacagcggtctcccatcagccaccgctcctctccctcgccttcctctccaagctgctcgacgtggtgctctcctcatccgacgccttccgcgacatcctcggcatcggccccgtcgccgcgcgctctgcaggccgcctgcctcactggtgacctcctcgaccacaccgttaagacactcgacatacttaaagccgtctccctaatgctcgcttcgctccggggctcgcaccgcaccgtgctcaccgccatgtcgtgcctcctcgccccgtcgctacaccacgcccactttggccgcgcatgccaggccatctccaggcaattccccgatgccgccaagctcgctgccgcgccaggctgtccttcagcgtctctaggaacaggtcctccggccgccacgtccacgccatggcggcgcacttcgcaccgccgccacagtagtcgcccacgtttgcctcccccggcgcaggttgcgggctggggctggcgctctacaccatgagctcggtgctcgtccgctgaagcatctaggcctccggtgttaattttggtaattgttggcgatatggcatgaggcccttcgaccaaacatgctgaaagcatgcacccgatgaggattcaagcccgagacatcaaggttagtcaaggcga

SEQ ID NO: 31246 - DNA, 1501 bp, Oryza sativa
gacagtattgtaacccagattaactccacgcagtcaacccacagaagtctttgttcaacaggaactaggccatatgtaaccaagtgtgcaaaaggccacaacttccagccggcctataataataattgaaacccagcataaggtctctgttagcagtaaaacactgtaaaaaccgttttgaaattaagaaataattcagtgattatagaaagattatggatggaattattagaagggaaaattgaataattatttgaacattaaaaagttcaaaatttgaatgacttctcatagctttgttgtaattttatactagtttaattcaataatagtggcttctagacctaaaactttgagaaaatagatgtggcaagaataattggaggacaaaatgttaatattaacctaaaaaatttacttgtatacagagcaatgaattcatcgaatcccttcaacaaattaaggatcatagtaccaaaaaccatgaccacaggcaatggttttgctgtcaagaacactgaagacaacaaatcaactgcacaactacagctttttcataaactttcaattcttaaaaaaaaaagaagaatatagaatatgggaactcaattaaggcattattataacaaaggaaatatcagtgctttcagtaagcatgggccaaaacgtggatttgagctcactggaaatagtggccggtgattccaaacgaaggaaccccaagaccacgaagtagatactgttccatatcgcagaccaggccgtctgatcgaacacaacctttgcgggaacaacccaccaatccttgaatggaaacagtgcctgagccaagaaaaacagttggcttcatatcattcaccatatatgaacatgacacaaagctttaggcagtagagcatggaagaccacgatgtttacctcgcagaaatggtagtagtaatgtgaaagggacccgtgaagcgtgaacccgacgaggccagaccggaacatccgagcacggtcgaactcgaagatcggcttgccttcgtagcactgcaagcatcaacagcaacagaatcagcaaatatgcaagcgcagctgcataaaagctattactctaaataagaggaaaattaaagcgtttgcacacctgcgcaatccagtcgccgaggagcaccgggttggtcttgagggcctcctcgtaagccgaccagttgtgctcgggcatgtaccgcaagatctcaaagatcgtccatccctgcacccaatccaatcatgaacaacagcccgcccggaacgatgttagcttcgaatcgaatcaaatcaagaacagcacagagaagagaagacaaaatggaacaaaacgatttggggggaatcgacaaaggttcccgtacatgccagtagtcgtggtcgacggtgaggagcttggtgagggcgtaggtgctggcgccgagcacgatggccgtgttgatgccgcggtcgagcatcttgttgccgtccccgccgccggccccggcgc

SEQ ID NO: 31247 - DNA, 1501 bp, Oryza sativa
cacgcctgcgcatgaattccccgcgttgatcgtagaagcaacagaaggctccgcggcggaggtctccctagccagcgagaaggggataagtgtgttggggtgagtatccgatgccgccggcagggttttaaatttcgaaattgctatttctgtcgaggacactgaaattttagaaatttcgaatttttttgaccgaaattatttaaaagtttaactgattttgaatgaatttgaatacaatttgacaaattcacaaaaaaattgtaaaaaaacgaaaatttcgggcgagatatgagcttgccggtgggagggcaaaattaacgaaatttcagaaattttgcaacgaaatttcaaaccctagccgcaggtgtcgccggtaatgagggtcctcttgctggccgaggggccatcttcccgcatcgccgctggccatggccttagtactgtggttcctctttgctctagctatggcaatcctgtcccatctgtttgcaggaaggatgggggtattttgcgaagaagtcctatatcggatctgttctttagaaaaaactcttcgaaaatatatactgtaaagtttatatagtgtacaaacctagaaactaacattggataaaaattggacatataagatttattcacatcactcttagtaaatttttcactatttgtaatttttttattaagagtataaattttactcacgataatgtggagaaatttcatacgtctattttttcatataacgattgttttatatttacactacttatcggtagttattcggttgttttgtgaaaagatcagaacgcggtaagcctgtaatgatcagaaattttcacataaggtctccagactcgggagtccggccgctatgatcgatagcggtccggtctctactactctctccgttttacaatgtaagtcattttagcattttctacattcatattaatgttaaagaatctagacatatatatatatatatatatctctatttagattcattaacatcaatatgaatgtgaaaaatgttagaatgacttacattgtgaaacggagaaagtatcaagcttcctccggatgaaccgtgggatgctggtcagagagagttagcctggagcgttggccagttcggacttcggaggatacaaaaaagtatctaaattcacaacacaaccattctattcatgtcttcttcaccagcaacatctgttcaatctccaaataataataataataaagaaaaaaacctaattaaacaacatcttcagttcacctgcctttagcgaggcttcggttggctttgtctgtaagagcttggtcgatcgctgctgtaatcgctgctagtgtttccctgactccccggcgctcttcttgatcgtggcccgatggactcacccgattccatgatggaactgtaggtatcttctgcgtacgtagtcctaaatatagagtttagatcttctccatgcgtttgtccttgcaagtgcttcaggat

SEQ ID NO: 31248 - DNA, 1501 bp, Oryza sativa; identical to SEQ ID NO: 31247

SEQ ID NO: 31249 - DNA, 1501 bp, Oryza sativa
cttcttcctacacctccagaccgaacccccgtgcccatgcgaagcccgcgctgcctctccttccaatcccacctaccgagggatgaaactgttcggatagattccgtccgtctggaccattttttggattcgaataatttcggtcggaactatccagaaattttcggattcggaaacgaatttggattattttctcggaaacgaaaacgaatacagtaagggtactatccgtcggaatcggaaaacggtcagaaactatccggaatttttttcggatatcctcagacattgataaaattttagaaaaaacacgtatatatacataactttttcatacggaatcagatgaagacaaactttatatcaacattgtagatctcgatgagatctacaactttcttattgactattttattatttgagatcatttaagggtctaaatattcattataatatatcatattaatttttacaaaatctcagatctacaattcaaacaacatctgatggagatgtgttctatatcaaagttgtagagctcaacgggatctaccactttgtagtttataacatttgtatttgaaagcatttaaagcataaaacaaatattgcaagtttcgaagatgtaaagtaaaataaataacatctccaatttatacaatggcaagtaagttatacatcaagtaaaagttcttgagaattgaaaatgataatcatatttgcatatggatctcttagaggaacaaccatgaaaatcgattttcgcatacggttgtgagaccgtctacaaaattgatgatataaatgttggagatgttgaatgatatctcttccttgatcaagaaactcaatttgaggggctttttatataccagtaaatattcgccaccgtattcgttctgtctcgtattcgctccgtatctgtattcgataatattcgatttcatttccgtattcgagttttcgattccgattccgattctgaaaaaaaatatgaaaacaaatatgataaaactagtttccgtccgtttccgatccgttttcatccctacacctaccctttgctctctttttccaaattggatggaaaaatgggttcccctcaatctcctctaccctttcctcgaaatagacgaaaattatgtaagactaatgaaaagttatcaattttttttaagtagtaagatttgaatttccaaacgtttggcttatggatcttcgtgccattaaagatatcaacctactgtcccatccgttcaaaacctcagctgaaaaatcagagtcatcaagatttaaatcaatacccctcgaatttgcaattctgaaattcctgataaatggtggaaggttactgctcacttccttttcgctgccctttggcccaactgattataaagtcttgaggaacattcccttgttatttacatatcatctaaatagttgtgattttttttaaaagaagtcaacaaaatagatcaattcaggcattcagctagtgaca

SEQ ID NO: 31250 - DNA, 603 bp, Oryza sativa
gcatatatatgaatgatgtaattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccata

SEQ ID NO: 31251 - DNA, 639 bp, Oryza sativa
tatccgatgtcctcctggtacttcgagaagccaccctgactgccgagttcctaacgacaacccgtcatgaccatacaaccggggctaaatacggaggaataaacaccccagggaattaacttaggattatataccggcgcggaggaatacccgtactgagctgtcaccatcagcggcccacctctcatccgctatatataaccccaaataatgatatcccgtaatctagacaccacgtctaaactactagatactactctaatatcatcgtcatgacatatagtaattgcatatgcaaacattatacccgcaccaaagcatctcccagataagctagccgtatattcagtataacatgaacataatgtaaagtaggcattcatatactcggaaagtatttcaataccataaatgcatatagaagagtattctaataaaagtacaaagcttacaaaagagaagagaaaagctactagagccatacccgaactcttccgaaggcttccggactcctgatttatactctattcctattccaccagctagatactactaaactaaacttgagagaaatgagagagctattgcttgaggtgtgtgtgtgaagtgagaagaggagctccttttataggcaggtaa

SEQ ID NO: 31252 - DNA, 154 bp, Oryza sativa
aagccgccgccgccgccgccgccaccgccaccaccccggcgtgcgtgagggcgaagacgacgacagcggcggcgacgacgaagaccacggcggcgacgacgacgacgaccacgacgacgacgacgacgacgatgacgacgacgacgacgacgac

SEQ ID NO: 31253 - DNA, 1501 bp, Oryza sativa
gttactaagtacatgtaactatcctagcaaaataaacaagttacagtcacattcactaacaaaacaagtcgcatgtctgaatcacaccaatcaaaagatattgccctctcatcatgaatcagcaagtcgacatgaaaagggcagacaaacctgcatggcatgatatgcagaagaaataacaagtggaacttgttgcatattgagcacaaaggaatagttatgaaacatggtacaaatgactaatagtattgaaacattgcacataccttatcaaggacgccttgttcaatgtcatcattaccttcaagagttggcaaaagaattgatcatgagcatacagagaatggtaattgctttgatttttttttagaaaaaacagattttctatacctcttcatctaaatcaagatagagctcatcaccatcttcagtcttcagcatccacctaccatctagcgccctggggaaaatgagcagcaaagaaaataaagcaacataaatttatgtagaaagtactttcctcatgacaaacggaacaaggtagcagtctgtactcagcagcctcaggtgacatccactgtcctcagcagttatagagtttgtttttaaacacagataaagtaatccagaacgtatttaagccatcgcaaagattctgttttagttcctgactgaattaaatttcaatagtattctgtttcataataaccaatctggttttcaagcagatgcaacataacaagttaatctaagaggaatcaaaatcaaaatgtaagatataactccagagaaaagtaagcacctcaagttttcaaattatagtagttactgctgtataggaacaacaaaacaaaacattacctagctgtgccatactgcatcaagtgcccaggaatgcttatatcactgaagaaatcaagtgaaactgccaaacagatgtagccatatcagctcaaccaattgtttgtgaatgcagcttttcctactaactagtaccagaagaggaaggggccatttgtaacttctatacacatgtgaggcacaattagtccaacagtaaagaacaggaattagtgcttgtcaaagataaaatttatatattcagtttaacagaatactatgttgaaaataaataaccatagttcagcattaccctccagatatttagctagcaatgatttgtgtaccccaacaaaagtaatcactctaatgcaattgaggatattgattccaggttagtaatcaggtctacagggacaaagaaacatactaggatattaaccagcgccaaacttcagttaaatagacctttctcgacagttgcaagatgccaacacacagaaaactcagcccggcgcaaaaaaataataaaaaaaaagtaaacagagaaaactcaattaatcattttgcaatctactttttttttagcaagaagggcagatcccctcccatttccattaaagaaaccagcacaaccactacacccagaacaactatagga

SEQ ID NO: 31254 - DNA, 1501 bp, Oryza sativa
tggatttggaagagcagttgtactatgaaagtcaaggtgtttgttggctactcttaattgatcggttaaatacttatgacatgttagacagaaggcattgctcccctcaaaatgcttccttactctgtgtactttgttcaacaggatcaagggaaacaactctccacttatttttctagtgtccttttagcactcaatgttgggcgcaatttggtgtggtttggaatctttctttaagctttggtgaaatgttggtcacggccagaaattcatattaatctacccattttattgagaaggtgctttatgttgcttggaacatttggaagcagaggaatagtttaatttttgaaaacattgttccctctgttccctcttggagagttctctttaggaatggtctctcccttttagttcatagagtcaaaaattctgagagagatacattgttacagtggttaaatttgttgtaattttttctcctttattaatataaaatcttaacggtggggacttcccctaccgtggttctttcaaaaaaaaaatcaaagactgtgtagagctaaaattaaataatcaggtgcatcgaatagatgcacctaattaggtgtagcccccgactatatgagtagctaaaagctaaacatatagtcaaagtgcaaataacatccatccgagtggctttacaaccgcatcatccatagtatcatatagctaagcatatgcatcgttcaataaaacatctagccgactgctttagctttaatataccaaaaattaagatataaagaggcccgagtaaaaaatactctagaggtccataaatcagcacatatgacaagaatctgagtaaaaattctcaaagatccatcacatgtggtataaatatgttatcatgacaattaatgagtcaaaatagcctaggctatgactcacgccataatcaaattaagcatataacatgccgagagaatgactgttcaaaatccaaccatctcaacaaaacccaaacagcctttgcagcctaaaaaggcttacaaaagaagtataacacatttctgtcgggtacctttttatttgcatcgtagtaattcaaaggaatcatctaactgcgtcaaaaaggattttaacagcattgagccataccactgtgacaaaaattgccgaaacaaaaatgcctaagtccctaaggatcacaacttagccatgctgataacagaattgggataaagtactattttaggcccaggcccattagtactcccgataccctaataacaccagaaaaccaaacaccgcttcgtcttccccgctgagactttcgccattttccccattccccgctacagtacaaaaccactccagcggaactagggttctccgattctcccaaatccaccttccaaaactccacagaaatcatccgcgaatccaccgcatcaatcccccctccattcccagccattcaccgaaccaaatcatattatccagatcgcatcca

SEQ ID NO: 31255 - DNA, 718 bp, Oryza sativa
accccctcggggggactaagaggagggcgaacgcatcaccctcgggcccgacgtccctcgggggtaccaggccacgtgtgcgattgtgtctgcctcaaacctctagtcatgatactcctgatcccatgtcaccgacagtagcccccggcgttatgccagggcgatcgccctctttaagggaaacggtcgggcgtgacgccactcctaagacctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctgaagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagagtacaaaggcactgaggaagggatctgtttccttcctttcgccattattccccttgtcttcgccgcttgcgccctaactccttctttcctgtgccctaccttcgccacacgcgctcgctcttaatcttctcttcctccggcgcca

SEQ ID NO: 31256 - DNA, 1501 bp, Oryza sativa
gtgtttttgtggatttgtgtatggacgagttacaaaggattaactccctttcccctcagccttccaaaagggaagaagtcaaaaaaagagcccccttctaaatgggcaaggtcctccttttatatctcaaggggataccacatgccctctctctttccaaactggactgttctttttctctttaatgggcggagatcggtacggtttccatccgggaacccttctgatgggacagcccacacctacctccactcccggcggagacaggcgcaacgtgagatcgtggctgcccgttgctgacgcgaccagtgccagaccggtcattcttgtccaccacgcgtcagtttaacaacgtgcatgtttgcccttcttcgtgtaacaccttgcctgtaatggttaggatgaagcctggtataaatctgaccagggctaacgtgccatctctaagagataacacgctagctccggcttgagacgagagcctagaggctttcgtcttgacgggatggggcaaggcgtgcgtcagaccgccagtcgccacctaacccgtgatctgactggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgaccccccccccctcgggggaaatcaggaggagggcggacacctcaccctcgggcccgacgtccccgaaggtgccaggccacgtgggcgattgcgtctgcctcaagcctctggtcacgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgttcataatgggcggtctattcaagactgccacaccacttgagcagcgcgcgaatctgggtgagcagatttgtctcgcccggagatatggtaacgccgcttcggtcggcgagcgtaattaacgcgcgcacgatacaatccatttcgattgccacaactgcatatccacttcatgcgccgcaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgctcccttcctttcgccattgttcctcttgccttcgccgcctgagctctaactctttctctgctacgccctactttcgccacacgcgctcgttctcaatcatctcttcctccaccgcca

SEQ ID NO: 31257 - DNA, 946 bp, Oryza sativa
tcacctaaccacatttattgcggtttggctaagcgtgtcacgccgcatgtaacgcagtgcagtgcactcgtttatccggtctgtgaccagtcacagaccggtcagatcgtgggttaggtggcgacaggcgatctgatgcacgcctcgccccatcccgtcaggacgagggcttctaggcgctcgtccccagctggagctagcgtgttacctcctagagatggcacgttagtcctggtcagatatatgccaggcttcatcctaaaccattataggcaagatgttgtgtgaagaagggcgagcatgtagattgctaagctgacacgtggtggacaagaatgaccgacgtgactggtctgataccggtcatgtcgtcagtagacagccacgattccacgtcgcacctgctcccggcgaaagtggaggtagttgtgggccgtctcatcagaaggtgactcggacggcaactatacaaatctccgtccatttatggaaaggggggggggggtaagtccccacaaaaaaagagagaaatggtgcatgtggtatccccttaagatataaaaggaggaccttgcccactgagaggggggattggacttttccagattagaaacctagaacaagggagaggctggctgatactttgtagctccttcatacacagatctcccaaaacacaggagtagggtattacgcttctcagcggcccgaacctgtatacatcgcccgtgtcttgtgtgatttcactctcgcgaactttccacagaccaagagcttagaacctcacccagggcccccggccgaaccggcaaaggggggcctgcgcggtctcccggtgaggagccccacgctccgtcatctggcgcgccaggtagggggctctgcgagggattttctgagctctcgcactctttcgtgtgcgccaagcttttcctgttcagcccaa

SEQ ID NO: 31258 - DNA, 384 bp, Oryza sativa
gccgccagcgccgccgccgcctccgtcgtctcctccactatcgtcgccaccgccgccaccgccaccgccgcctccgcctccgccgcccccgccgtcgtcgtcgccaccaccctggtcatcctcgtcatcatcatcatcatcatcatcatcgtcgtcgtcgtcgtcgtcgtcgtcgtcgtcgtcatcatggtggtggtgatgatcctcgccgggaggcaggatggcgcacgcctggctggcgatggcgaactggctgaggcagaacttcttggtctgcgccgccgccggcgccggcacgccgacgaacgggagcacgagcaccgcggcgagtatcgcggcgcggagcacgggggagccagccattgccaccaagaaacggctagc

SEQ ID NO: 31259 - DNA, 1501 bp, Oryza sativa
tggatatgcagttgtggcaatcgaaatggattgtatcgtgcgcgcgttaattacgctcgccgaccgaagcggcgttaccatatctccgggcgagacaaatctgctcacccagattcgcgcgctgctcaagtggtgtggcagtcttgaatagaccgcccattatgaacaaccaaagttaccaataccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcgtgaccagaggcttgaggcagacgcaatcgcccacgtggcctggcaccttcggggacgtcgggcccgagggtgaggtgtccgccctcctcctgatttcccccgagggggggggggtcgggttgcgcttgccccggccccgagggccgaggcaccccgaccccttaaggaagtctgcgccacatatatgggataagtgagcacagctgtgctcacctaacagcatttattgcagtctggtcaagcgtgtcacgctgcatgcaacgcagtacagcgcgttcctttatccggtctgtgaccagtcacagaccagtcagatcacgggttaggtggcgactggcggtctgacgcacgccttgccccatcccgtcaagacgaaagcctctaggctctcgtctcaagccggagctagcgtgttatctcttagagatggcacgttagccctggtcagatttataccaggcttcatcctaaccattacaggcaaggtgttacacgaagaagggcaaacatgcacgttgttaaactgacgcgtggtggacaagaatgaccggtctggcactggtcgcgtcagcaacgggcagccacgatctcacgttgcgcctgtctccgccgggagtggaggtaggtgtgggctgtcccatcagaagggttcccggatggaaaccgtaccgatctccgcccattaaagagaaaaagaacagtccagtttggaaagagagagggcatgtggtatccccttgagatataaaaggaggaccttgcccatttagaagggggctctttttttgacttcttcccttttggaaggctgaggggaaagggagttaatcctttgtaactcgtccatacacaaatccacaaaaacacaggagtagggtattacgcttggcagcggcccgaacctgtatacatcgccggtgtctcacgtttcttgcgaggcgggtgatctttccacatacagagggagagcgagagcttgagatttcaccctaagcccccggccggactggcaaaggggggcctgcgcggtctcccggtgaggagccacgagctccgtcatctggcgcgccaggtagggggctcagcgtgtgttttctgagctctcgtactcttccgtgtgcgccaagtttcccttgttcagcctaa

SEQ ID NO: 31260 - DNA, 671 bp, Oryza sativa
tgcttggtcgttgcacacctagcaacagttaaatctggttggcatgaggagatagcttccccttctgcttctgaggatggggctaaatcctccatttcatggtcaccatctacttcttccaggacaagtcgatgcttcgccacatgcatttgagatgcttcttgctcattagcacctgtagcttcatgttcaggggtaacagcttcaaagctcctctcctcagaggagcttccttcctcatcttcaagtagttttgtgccaatcaaatttggaagatgaaaaccagtgttgctgtgaagaataatcattcatataaacatgaattagtactaaacatataactaagtacagaaagatgatagagacagttcagcatgcacaaatgaggttagttacccatacaaaatgagaacacacctgaaagctgaaaggcaaaccaaattggtgtctgacaaacaaattttcactttttaagttttctaaccttcagtttgttatgctattgtccatttactaattttcaccactctatgcacaactgtaatgcccttaatgagatatttcatatgcttgatattttttacattctctgccagattttgtagtattgatatccatatatgtgtaccgagttttttctgtcatctgcccaccatacattcatgctaatc

SEQ ID NO: 31261 - DNA, 1501 bp, Oryza sativa
ttttagtgacaccgccacctgatggtccatgagcggcccgatgatatcagtcagagggagagcctacgctttatgaagtcataaggcgatcccggaagaaaaacacagaaggcctactgagtacacttacattgatggcagcgtcgcgttcggccgcccccttctcgcaaaggagaacggggacattgctcgccatcgttgggccactgatcatcacctggccgacacgacgtcccacggcttcgctgctcagacctgtgaatcgagaaccaaagttcgataagtcaggaggaacgcgcacacaagcaagtcagggtaaatgcaagaaagataccccgaggagaaacctgggtcgtgtcctccggtccagaatagtcaaaggctagatgggctcgagcctggagcgactggatccgtctaccaacgaagtcagcagcgacttcataccccgacaaacctcgtactcggagatcgtcgataacatcgatgaaggactgaagggaaggggtcaaggtgggctttgcggtccaagacgaaatcttgtctggttgttcctcaggaacaacaaagacaggatccgaattttctatctgaagatagaaccacctcgtccgccatttgctatgagaggaagggcactggaaggggatataacgcgacttcaggccatcccggagtcggaatccgacgcatccagataccctgttggactacatccaacgcaactcgtagtagaagcgaaagagatcaagaaaaggctctaccccaatgtaggcctcacaaagatgcaaaaaaatactaaggaaggcaatagaattggggttcaaatggagcaaagaaagaccgtagaagttcaaaaccaagagaagaaattcagaaggcggagggagaaaaccgcagagaatgtagtcctcgatcgcaaccatgcgacctaggacaagctggggttcagtacctccttcttctctctccatggtcccacgaccgggaggggcgccatcctcctgtagcttattcagcgacgcgctggtggaggaggacttgccgagatccatcgctgactggagatcgccggagaaaggactgagattgatgagctagggttttgcgggagcggaaaagacgagaagcgcttggaggttggagggtttcttcacaacaggcagacttcaaaatggatccccaaaactctcttaaataaacgcacttccgacggtgcaaatttcaaggaaaggagagagatgaccgccggaaatttcttggtccgttacgcgcggcagtctttctcacttcagtttaaattcgctcatgaccgttgggcttcacatggtgttctcggctatgtcctgtctccacagttctcacaccgagaacaacaacagcctcgacaccagaagtcgcgattggttacacgagttcatttaagcagaagtcgggggctactgtcaaggttacgggttaggtataccctttacccttcgatatacgtcacatatcgata

SEQ ID NO: 31262 - DNA, 378 bp, Oryza sativa
gtgaagaataatcattcatataaacatgaattagtactaaacatataactaagtacagaaagatgatagagacagttcagcatgcacaaatgaggttagttacccatacaaaatgagaacacacctgaaagctgaaaggcaaaccaaattggtgtctgacaaacaaattttcactttttaagttttctaaccttcagtttgttatgctattgtccatttactaattttcaccactctatgcacaactgtaatgcccttaatgagatatttcatatgcttgatattttttacattctctgccagattttgtagtattgatatccatatatgtgtaccgagttttttctgtcatctgcccaccatacattcatgctaatc

SEQ ID NO: 31263 - DNA, 476 bp, Oryza sativa
ccgcggcagttcatcagccgcacttgagcatattggaaatgtatcccaaattgaatccccttgggatagaaaaagaagaaccaaaagggaaaagagagagaagtttttaatcggtttacctggtgtcaattcatatttgttgtgtgttgttaattgttatgaattaaagtatctgcgagaattggagtattttttttagtttgaataagtggtggacgtaggattttataaatgggggtacgataaactaatttatttataaaactgtttgatgaaaacaaaaccacaaacacatggaaaatagggaaaccttatattttattaatcatgattcattaacatgaatgtttatagatacatgggggctcccgtaggaattcgccttttgccttcgtgaggaatgcttaataaaaaggtatgctgactggagattgcttgtagtccgttgattcccagcgcctagtaatgaggctacc

SEQ ID NO: 31264 - DNA, 322 bp, Oryza sativa
gaaaacttggactaatctggtttccattttttttttttgccaataagtcctaaggtagtcattgtctttcagttcttctatatctcaaaccaaaacctggctaatctttctgaacaaaatttggcattgccaattttggcaaggggtgatttttgccaccaaccaaacatacattttctatctttgtagttaaattatctgcttatatcacgtagcaatgctatctacttatgtaatctggatggacatattcaattgtactgggattaggaacatgtgagtaattaattcttttccaagtattaaaattttcaagggaaca

SEQ ID NO: 31265 - DNA, 1501 bp, Oryza sativa
ctgcgtgtatgctgtccttgtatcctagatctcacttgactgttgtttatctcactgtagagaaaggggtcaaagggcactggagcaaagattagctgagaagctggctgcggtcaaaagttctgagggcacatcacaggatgcctctgacaaagtttgagccttccatgcaacgacatgtgcattttgtgaattcccggtagtgttgtcaatgtcacattctctgaggacacagaagttacaagacaccatcgaattacccctcgcggccttttactgtttttttcattggttctcttgcttatcatctgtaatcagtttgtagtgcatggcaacggtggtccgagaatgtgacatttactgattttaggaagtaaaccctgcttaacaacgtgtgatgttttttttcttaggacaagctagttgcatgcattaccacagtttgtggtggtgcccttttgcccctggtaaaaaaagcttttctttccctgcatgttttaaagaccactggacgctttgcgtgaacaaagtgatgtcaaattgtcaggagttgattctttcaatttgttatctgtcctttgatctaacgtcactgcatttatttcgcaaaagatttgctttcttaggttatgtttagttcagcgcaaagtttggattttggttgaaattggagatgatgtgactgaaaagttgtgtgtgtatgataggttgatgtaatggaaaaggactgaagtttggatccaaacttgataacagcattgcatctgagtatctgaccatctgtacatttgcgaggcccgtacagtttaatttccggagggattggtacgatgaagtcaaggtttcaaaatgcgatgataaccgtgaaataattgtggttatcggcgttattaagctgattcatatggaaaaactgcttagtaaactggctatgtaaaagaaaaaataaaagttcaaactgacattttgacaactgctaatatgtccgtgctgtgcaacgggctaggtttacataactagaggaagagaaattagtaaagtactaatagatagagaaattaatctgaatttcaccggttttttcaataacgaatcaataattggcgttgtcattagcggtaaccactctttcgcactaagcccaagtaggcccatattaaccccagttagcccaaacaaccctctcctacagtcctcctactactcctcttctgatcaaaatgcaccgaaatggaaaagaaaagaaaaaggacaagaaaaccgaattaaaagagaaaaatctcgaagcctaagccgcctccctcctgtccccatccgccgctccggcgctcgatgcctccctcctccgccgcccccgccaccgccgccgacgcagccacctcggagcccgtacgcgcccctacccgcgccgcaaaccccgtcgtgcggcggctctgccgcctcgggcgctagccgcagcaggggggcgccctccgaccgccggtggtgggggcgtcggcga

SEQ ID NO: 31266 - DNA, 1501 bp, Oryza sativa
cgcatgaattccccgcgttgatcgtagaagcaacagaaggctccgcggcggaggtctccctagccagcgagaaggggataagtgtgttggggtgagtatccgatgccgccggcagggttttaaatttcgaaattgctatttctgtcgaggacactgaaattttagaaatttcgaatttttttgaccgaaattatttaaaagtttaactgattttgaatgaatttgaatacaatttgacaaattcacaaaaaaattgtaaaaaaacgaaaatttcgggcgagatatgagcttgccggtgggagggcaaaattaacgaaatttcagaaattttgcaacgaaatttcaaaccctagccgcaggtgtcgccggtaatgagggtcctcttgctggccgaggggccatcttcccgcatcgccgctggccatggccttagtactgtggttcctctttgctctagctatggcaatcctgtcccatctgtttgcaggaaggatgggggtattttgcgaagaagtcctatatcggatctgttctttagaaaaaactcttcgaaaatatatactgtaaagtttatatagtgtacaaacctagaaactaacattggataaaaattggacatataagatttattcacatcactcttagtaaatttttcactatttgtaatttttttattaagagtataaattttactcacgataatgtggagaaatttcatacgtctattttttcatataacgattgttttatatttacactacttatcggtagttattcggttgttttgtgaaaagatcagaacgcggtaagcctgtaatgatcagaaattttcacataaggtctccagactcgggagtccggccgctatgatcgatagcggtccggtctctactactctctccgttttacaatgtaagtcattttagcattttctacattcatattaatgttaaagaatctagacatatatatatatatatatatctctatttagattcattaacatcaatatgaatgtgaaaaatgttagaatgacttacattgtgaaacggagaaagtatcaagcttcctccggatgaaccgtgggatgctggtcagagagagttagcctggagcgttggccagttcggacttcggaggatacaaaaaagtatctaaattcacaacacaaccattctattcatgtcttcttcaccagcaacatctgttcaatctccaaataataataataataaagaaaaaaacctaattaaacaacatcttcagttcacctgcctttagcgaggcttcggttggctttgtctgtaagagcttggtcgatcgctgctgtaatcgctgctagtgtttccctgactccccggcgctcttcttgatcgtggcccgatggactcacccgattccatgatggaactgtaggtatcttctgcgtacgtagtcctaaatatagagtttagatcttctccatgcgtttgtccttgcaagtgcttcaggatctgaaagg

SEQ ID NO: 31267 - DNA, 1501 bp, Oryza sativa
ggagcagttcattagcgtgtgattaattaagtattagctatttttttcaaaaatggatcaatattattttttaagaaactttcatatagaaactttttttaaaaaacacaccgtttagtagtttgaaaagcgtgcgcgtgaaaaacgaaaatgaggagttgggaacaaggggaaacgaacacaacctaagtaagtttaaggataagatgggcccacatgtcaggtgtaaccgtcccagaaaccgccataactgccataaccgccttaaggacccacctgtcagtgaccttgggaagtttggaggcttgttgggccggcccaggttcggccgaaccaggggttcagccgaaccctagcgagctcctctcatcccggccttccacgtggacgctcctcttcaatggcggttacagggcaatttggacaattcacatagtgtaaccgtcattacctacctataaaaggaggaggcctcattcacttcaaggcacactcaagcaagctcaacatttctctctatactttagtttagtattctagtgctaagtggagtagaatagaataactctcggagtccttggagtcttcggaggaattagggtatggctctagtagcttttctttattcttttgtaagactttcggaattaatgggatattattctttatatactctcggtactttagtttatctcagtatcggctttactttatacatgtatcgatatagttgtgtagctagcttaccagagaggtgcaatggtgttggtttaatatccgactattcggttgctctatgttatctcgggggatatagcgtagtatttaatattgtagacgtggtgtctcgattattaagtatcattatttgggcatatatgttgcgggacggtcgaggtgtactgctgatggtgacaactcagtacgggtactcctccatatgtagccctagttggacggccatgacaggttgttataaggaacatgacaacccggggtggtctctcgaaacaccaggagggcactgttagggggtataggccacataattgtatactagcagatgtaaactaagattgagtgtatactagaagtatagggattgattgcttttctatttcttcttacacatggcgtagaattgattaatgagagatatgagttattttctttgtgtcactctactctttatgaatacattaacccctgcttagactctgatcatacaagtggcatatatatatatatatatatatatatatatatatatatatatatatatatatatatatatatatatatatatatatatattagcataattctctcttacaatcttccattgggatttggattaaataaataccataccttggaatactttcgggtgaaatgctacaatggtatatccatgcgtttgcggattccttctgtaaccatatatatactaggaccatttctgtcgccattgctgggaattcatatttctagtaatgtcgtt

SEQ ID NO: 31268 - DNA, 1501 bp, Oryza sativa
accggccggggtgttgacattcagatccacgtcttacaaacatcataaaagtcttacataaatgcagcggaaaaacgaaagataactggagctaagccttgacttgatctgcagtgggaacaccactccacaggcatcctcgacggcacggacgaagcctactcctcggagaaaccaccatctgacacatactcgtactctggggttggggaaaatagagcaagactgagtactacccactgtactcagcaagtcatactggaataggggtatgatgcagggatttatcaaaggagagctagagtagttcatttgcctaaagcgagcatttataaacagaagttgaaagaagtaaacagttgtaataattaatcaatattaatcatccgctgtccaacgctatcccacgttgcaacaggcccaaccatccacctaaactatccaatttcattagactaaactagggtgagactaatcacggtgaatctggttgaccgcccataaccgcgggcacggctattcgaatagttttactcagatcagaggtgtacaactgtacccacaagacacagccccacgacacgtttccgtgcgccgacatgccaccacgacataccggaaagaggtcgtgacaggacccttcgcataaccccctctaaccaagcacaccacacctcagatttcacccccactcctcgcaaggcagcgggcagtcccctctcgtgcctaggtgaatccggaagcgacagaggccgtcgtagggcccgcctcgctccatcacgcccacccttgcctggatgcgtcagctagaggaaagctacactacaagcccagccgttgcccacgctggcttgtggtaagtacgataagttcttccagggcatcccgcgaaccagtccttaactgccatgggtgcgaccaacaaaaccatgcacccacagcccaccatgtgatttattttaattaaccaacaccgaagcggtgtcactaatccaacattaccattagaacctacagtctaaacattaataggatctccctcattgtgtgctagttgaactaagcatggctaagcaatccctagtccaatctctagtcatgttatatcccaagctaacaaaggaacatggtacaaaatagtacgactatgacagtaggtaaacatcccatagtaacattataaaacaatgcagtatttaaagaaaaacaatagagcatttgtaatataggatcaacatgttcaagtgacaagcatgacttgccttgctctactactggaagaacctcagcgactatctcgaagtacaccggagcgtcggaagaaccggaatctaagcgacatacaaagcaaacaatacaaacaggctataagactactgaaacagagaacaaaaccatttttaatggattctacacatttttcttgatttactgagacttgaacgggcttaaacggagctcggatgaattagttatgaattttagaagattcactatgttt

SEQ ID NO: 31269 - DNA, 1501 bp, Oryza sativa
ttgtacaatatatacaagcccaaaatgatgaaggtaaagggcagcttggctggctataccgttcgctatattgaattgtcctgtagaagaggcaatgaattttgggtgttagaacgaacgataacatgtctgacagaatgaatttttaattaaactgttccatacattggaagcatttgatgtggatgcgtcctcggagttccttgcttcagatttctcgttggagtaactgccaaacaagaaatgaagaactcttgttataagaaatgaagaactctttttatctttcgcgatttaatcaggctgccgtagtaataaagtgaaattgacatgtttgggcttacgttgacagtattgtaacccagattaactccacgcagtcaacccacagaagtctttgttcaacaggaactaggccatatgtaaccaagtgtgcaaaaggccacaacttccagccggcctataataataattgaaacccagcataaggtctctgttagcagtaaaacactgtaaaaaccgttttgaaattaagaaataattcagtgattatagaaagattatggatggaattattagaagggaaaattgaataattatttgaacattaaaaagttcaaaatttgaatgacttctcatagctttgttgtaattgtatactagtttaattcaataatagtggcttctagacctaaaactttgagaaaatagatgtggcaagaataattggaggacaaaatgttaatattaacctaaaaaatttacttgtatacagagcaatgaattcatcgaatcccttcaacaaattaaggatcatagtaccaaaaaccatgaccacaggcaatggttttgctgtcaagaacactgaagacaacaaatcaactgcacaactacagctttttcataaactttcaattcttaaaaaaaaaagaagaatatagaatatgggaactcaattaaggcattattataacaaaggaaatatcagtgcttacagtaagcatgggccaaaacgtggatttgagctcactggaaatagtggccggtgattccaaacgaaggaaccccaagaccacgaagtagatactgttccatatcgcagaccaggccgtctgatcgaacacaacctttgcgggaacaacccaccaatccttgaatggaaacagtgcctgagccaagaaaaacagttggcttcatatcattcaccatatatgaacatgacacaaagctttaggcagtagagcatggaagaccacgatgtttacctcgcagaaatggtagtagtaatgtgaaagggacccgtgaagcgtgaacccgacgaggccagaccggaacatccgagcacggtcgaactcgaagatcggcttgccttcgtagcactgcaagcatcaacagcaacagaatcagcaaatatgcaagcgcagctgcataaaagctattactctaaataagaggaaaattaaagcgtttgcacacctgcgcaatccagtcgccgagggag

SEQ ID NO: 31270 - DNA, 1064 bp, Oryza sativa
cacaccagaccaccgcaccagaggtcgccaagcccccgatcgagccaagaaaggcctcccgcggccggccggtcgcccccgccaaaactagcgccccaaccccgccggtggctggatctggctgaggggatgggcagagtgcaggcgctagggggagggggaggaagattaagaaggggcggaggagatggcagttgctagtgtcgcactcaaacgggagaggaggaaacgacggtcgtcgacgtccacgctcgactacgagcggaggtggcagccggcgtcatcacactgcgagcgggaacagaggaggcggtgggcaaagccattggcaagctggaataaaggccggtatatatgactgggcaccgacgaggcaaaagtcatccgctttattatgatacctgatccacgtatggatgtggtgataatatattgtgaccaggtttcggcgaagcaaagccacccatatcacagttatcattaaatctacacaaacctcaaaaccctcggtgagcaaataattttgaagatgatgaccaaaagcgcagcttaatcagaggtgttccataggctcatcctatggatgattaaccgacagcctcaatgctacgcgctgggtttcagcggactgcacgcaatctctagtcatcatatctttctattaagcattctcgcaaaggcaaaacgcaaactcctgtaggagccctcatgtatttgttaatattcatgttaatgaatcgtgattaataaaatatagggtttccctattttttgtgtgttcgttgttttgatttcatcaaacatggagggaggcggatcgggagaaaggttaatgcgaatgtacaattctaccctttcaccaccttatcacaattggtaccgcccctcatagagacacggtaccatgaggtaccaaccaatttcagtcgttggatcctcccagatcgacagctaggatatggtattgcatgccctcaacctcaattacggtaaaaaacctccttgtagttttcttctccaactctttttatatcacgtctttgagcatgcaacaattcactcca

SEQ ID NO: 31271 - DNA, 188 bp, Oryza sativa
cacaccagaccaccgcaccagaggtcgccaagcccccgatcgagccaagaaaggcctcccgcggccggccggtcgcccccgccaaaactagcgccccaaccccgccggtggctggatctggctgaggggatgggcagagtgcaggcgctagggggagggggaggaagattaagaaggggcggaggaga

SEQ ID NO: 31272 - DNA, 1449 bp, Oryza sativa
tggcttgaaggccaggttctcccactccttgcggagtgcctgcagtgttgacttgtgggcgcgatcgtgccgatgcgtgccgcagcgatggcgtcccaggcctccttggcagtccgcttctgggaaagcgagaactgcatctcgggcgggactgcagcgatgagggcatccagtgcccgccgatcctcgtcgtagtcgacgtcgccgtaccggactgcctcccacatgtgccgcacctggagcctcaccctcatcaccgcggcccactcgatgtagttggttttggtgagggtaggccacccaccgccgggaccaaagtccctgaccaccgtctggacgccgtggtggccatggtgccggtcaggggagggagagccacgctgcctgcgagggccgcgcgcgggctccgggctgccgccggcacgcccgcgcccgtctgggttcccgtcggcgggcgcgcggtcccttgggccgccgccgccgccgtggaggtgggctgctgcccaccgctctgcccgctcccgtgccctacctcttgcaagctcctcaagctccctgtcggcggtgatgtcgccggcgatggagccgttgatgctgctgcgcaaggtctcaacctctacctccgccgcacgtgccgcatcttccgccgcctctgcttctgcctccgccctggctgctgccaactctgctgccgccagtctggccgccctcgctgctgctgcagcggtctgagccgttgctcgcctgcgctcttctgctgcggcgagctcggcgtcctgctgacgccgagtgctcgagacgaccgaacgccgagaccgaacgtcggacatggcgcacctccggggggctgctgcgtggagagggggaagggaaaggggaaggaggagcagccggtgttgctgctgctggtggtggctgagagctcaaccgagcttgggaaggggtggaacaagagatgtttagcctacaggaaagtgtggctctgataccagatgttagaacttcaatggctactctcattgagaagaggatggcactcggagtggggcaattttctggttttcttcattcacaaactcaaaagccatatcctcccaaagaggattggatacatatttatagctgcttgtagcagccatgcagccatgctagtctaagagggtgctgtcctagagcatcccaacaaactgtcctagagcatctcaacatactgtcctagagcatcccaacaaactgtcctagagcatctcaacatattgtcctagagcatctcaacaaactgctgtcctaactgtcctagagcatccaaactgaaagtagagatgctgtcctagaaagctgaaaagcaggaaaaggcaccacaagaccaagaccaaccagccaagacttattcctatagttcctacattcttatgcttctgtatttgattgccaatttatgatttcagc

SEQ ID NO: 31273 - DNA, 1501 bp, Oryza sativa
tattttaggacaaaaaaatatgttacatccggatttgatctgctctgttcggactgtgtcgacaacaaaaaagcatgcgggttttttggtagtacacacataaattaaaccaaaactattattttaggataaaatatgttacgactgaactgaatttcatccggtccgttcggacctaatcgacaatgaaaaagcacgtagtttttttttgttgtacacacataagttaaaccaccagaagtactatttttgtacaaaatatgttacggctggatttcatcttatctgtccagaccgggtagataaaaaacacgtggttttccgatggtgcaaacataaattgaagaactattattttagaataaaatatgttatgttttcatacagacggtccggatcgggtcgacaacaaaaacacatgttatctctagtttttcctttttcagtccgtacgtgaatacgtgatcctaatttcccattccaagttcgttttcgttttcctatttttctactttccgatcgacgcaggttctgttttacgtaccgagattcacctttcttcaccgtgatttatttactaatttttcataataccccttcttgatcaattctactaccgttaagtgagaagatagtaaaaataaatctaaaccctttaattaaatgagattaatagttcaaattgcttgatactacgagtacggaccatcggagtgagactcttgttcgagacatcagagccatgcacaaatgatcgacaagaaggcctcgttccctagatagcagatagcatgtacaactacgaacaaggccgtcataggcgatgcaaaagccttaccgaaggttggtatgggaaccatgtcttctcttgtgtgaatgatattctggataaatccaagccgacattcaccttttccctcatgcctcatattcccaaaactctttgatatcctctccgcatctttcttcttgttttgtgacttacctcattaatgttgctatgtctttatacagtgatctgttttttatatatggagtgaattgttgcatgctcaaagacgtgatataaaaagagttggagaagaaaactacaaggaggttttttaccgtaattgaggttgagggcatgcaataccatatcctagctgtcgatctgggaggatccaacgactgaaattggttggtacctcatggtaccgtgtctctatgaggggcggtaccaattgtgataaggtggtgaaagggtagaattgtacattcgcattaacctttctcccgatccgcctccctccatgtttgatgaaatcaaaacaacgaacacacaaaaaatagggaaaccctatattttattaatcacgattcattaacatgaatattaacaaatacatgagggctcctacaggagtttgcgttttgcctttgcgagaatgcttaatagaaagatatgatgactagagattgcgtgcagtccgctgaaacccagcgcgtagcattgaggctg

SEQ ID NO: 31274 - DNA, 392 bp, Oryza sativa
cccgtaaccctgacaacatacatgaaatattaaatatatgctaaaataataactaattgcacagattgcgactaatttgcgagatgaatctttttatcctaattactacattatttgacaatgtggtgctacagtaaacatttgctaataacggatttattaggcttaataaattcgtctcacaccctatataatactcaatgtgacacgccaaaactttacacccctggatctaaacaccccctcaaatttgaacaatgtaagagtagtactccttcccaaaatataagaatttagaactggatcggacattttctaatactacgaatttggacagcacgtcccatccagttctaggtttttatattttgggacggagggagtacatggca

SEQ ID NO: 31275 - DNA, 840 bp, Oryza sativa
ctacataatggatttggacttgtcttgttgtttagtcctctcgtagtgttctttagtcctggggaggttcataagtaccggggaggttctgccaatttttttattaaattttgacaacttttaacatatcgcattagttggcctgtttggtagagctctaactcctaaatttaacttcagaagttgggtctagagtggagttgaggtgctgcctaaaaccagctccacctctttagtttattttgtgagagagctccacacagttccgctctcattctaggtggagctgagctccagctctaggagaggtggagctagagctggacctgtgccaaacagaccatgtaagcgttaattaattaatgatctttgttacctacaaatacaccgataatcttattcatatgcaatactagtattaaattcctatgcagcacaggctccgtagcagtcggcccattagtcctatactcctattcgccaatccaccacttctcacaggtaaagcaccttttcttcctctcacattcgtcttcctcgatgcaccctctccttttcatttttacgcaatctttccttccgccatctcctttccattcactggcggccggctacaatcaatctccggcgagctcccactgcaggttctcctttcgcccccgtataaacctcccacttgatgcagcactccaacacactgtatgacccattttcatttctcttcatctggacctcccaaaagctcgactgcagccgcttggaaattgtgaccatggcgagaccgacagcggaccacaacaacgaaggaattttgaggtggcgcgacatggagagataaga

SEQ ID NO: 31276 - DNA, 1501 bp, Oryza sativa
aaaacaacttcttcaaaccaatcctgacttgtacgtagttcttcaaaccttacaacgtgcaggtccattcgattagggatgagctaagaggttaggcatatgatgtgaaaaaaaatcggatgtacacattgcgcgcgcagtagaaggaggggatggaaaaaagacgattgcacttttacaacagtagagactagagaaaatacgaagtatcacttaaacactttcaagacatgtgaaatcattctattgtcctcttctagcttcaattcatgttttcaaaaaaacttttagtcaggtcgccttgtccaattgttttcggtacaagaaatgacgacatatttatgtgcaaaccacatatacaattcagacgaacacagggatgattcatcttttgttctcttccccaacgacttcacatgaatcatatgcctttgtaccagctatatatgacttgctttttatattgagaataagcattattctcatatctccttttccttttctttttcaggtttgtcctcgtacaattgtaatgtccaaaggactggaaaagtgcagtaacagaaaggtgcttcacaaactgaaaagttgaaagccatgtcactgcactacgtctgacaaaagaacaacagctataggtatttggcatttttattggctactctataaaaaaagcacattaatatttgtgtcaaagaatttaatttctacacaagatttataggcagagggcatgtagctccacataatggagctcagatgatcaaatacataattacatagtccttactacatggagtctaaagaaatatatatatatccaagtagtgcagcatcatgcacggccactacttattagaaataaaatgaagtgaataaagatatgcttctgatgatgccaccggcgtgaaccgagcaatctttcatgcagattttcgcctccacctactcccacgcacgcacgcaatgagcaatagttggttgctgacttgatccgagctttgacaaattcagtttggaactttggatgaatctgcaattctgacgacaaaagggaagggaaggacaaaaaggttttactttaatcttctttcactcaatgtctaaagtgattttcagagacatacaatgggctttatatctttcttttactcaacatctaaaatgatattcagagacaacacaatgggcgaagacctgtatttatctctgctctgaaagactgaaacagtctctgctccagctacgaagactgtatacttgctggtcatacagatccaggatgtgtattatttgcaaattcatcagaaagcatgactcaaccatcacacacactcacacgtaccatctgtcatctctttcgatgatatcattcaacagggtgacaaactgaaaacaaagaattgcaagaaagattggaatgaacacaacaggatgacccaggtatgatgatgattacagaaaactttcaggaagataagcgagccaaacatagaaattg

SEQ ID NO: 31277 - DNA, 1501 bp, Oryza sativa
ggaaacattttatagccttgggaagtttgcttggctaatgggtgtcatctatagaggaacagagggagcagaacatattgtgagtacgattccactcctaaaacatgcctagccatttaatgtggttgtaggctgatcagtatttctgataggaacatgtgtttgaaacttttcccccacaagtgtgaatttacaaaccaggccatgcttgttccaaccaaagtaggttattctaaagagaatgggaaaaatagaacaaagcaaggcataaagaaacagcaaaagtaaatggcattaagaaactatggatgaatatgacagtactgcttgaagtgaacaagtaaataaggaacaaattttgcattagaacaaaagaacacctcaaggcaggtgcagaaggggcgctagattgaagagaagcttgtatcgctgcatcttcatagctttgacctggaggtggatatagatgtggttgcctcaatggttgagtttgaggaggtgtaaacagtggaaccgtgttctcctcacgaggtggaaaatcaacaccagcattctgcacacaagggcaggatatcttgttcatggtttggacagaaacagaagcaattgaatattaactcaaaagtaaaaacgttgaagatctaagtttacattgaaacaaagtgcagaacagattgaagttgagtggaacagtagtcaagtatgagctgtgatagcacaggataaataacagatgagaaaactggaatgaacacaagtagacagtaccctgagttcttggtaagcagcgtgatactggggatatctgccagatgcacctccaaaagccacttgccatgtgtcaatcaaactcaatattttctcccgaacatttaaatctggctgaaatcataaattggcaatcaaatacagaagcataagaatgtaggaactataggaataagtcttggctggttggtcttggtcttgtggtgccttttcctgcttttcagctttctaggacagcatctctactttcagtttggatgctctaggacagttaggacagcagtttgttgagatgctctaggacaatatgttgagatgctctaggacagtttgttgggatgctctaggacagtatgttgagatgctctaggacagtttgttgggatgctctaggacagcaccctcttagactagcatggctgcatggctgctacaagcagctataaatatgtatccaatcctctttgggaggatatggcttttgagtttgtgaatgaagaaaaccagaaaattgccccactccgagtgccatcctcttctcaatgagagtagccattgaagttctaacatctggtatcagagccacactttcctgtaggctaaacatctcttgttccaccccttcccaagctcggttgagctctcagccaccaccagcagcagcaacaccggctgctcctccttcccctttcccttccccctctccacgcagcagccccccggaggtgcgcca

SEQ ID NO: 31278 - DNA, 1501 bp, Oryza sativa; identical to SEQ ID NO: 20938

SEQ ID NO: 31279 - DNA, 1501 bp, Oryza sativa
gttgatttggaaacataggtggatgtgtctttggagaggtttcagctaatttcaattccgtcatgcaggatgttagagatgaagctaagtcatggtgtagttttttgttgtttctttggaaagttcttatagcctttgttcccgttatgggcatgcatgagtcctttttaactcttttatcttaatataatgatatgcaactctcctgcgtgttcgagagaaaaaaaaaactttgtttctctactctgctgtacgttggtgtgatatatagcttcaataacttttagtcttccaacttccaatatggtttatatgtctctccaggcagtgattacattttataatctgtggcatttgctaacattaaaatctgtgtatgtgatgccacactaatttaagacattttgctataatttgttgataattcggttcatggttgagtgatgcacattgcataatgagttttgtatattgaattgttgacataattgtttcgtcttaaatactttctgggatttattttcaatgtccccatacaacttttggtttgtcatgttttatagcatgctcataaatgtttgctgaagtacagacaagccaaggatacactcaagctcctaaagaaacgcctgggaaacaagaattcaaaagtgcaaattctgacgctttatgtgagtatttcaagagtccttgtatattgatactcagtgtgttatcttctgatttttttgttttaacaatgtgagttttaggtcgattcattcctaaatttaagaattcacctgtcttcactagctacacaaatttagaagttatttcttgttcttcttccagattttggaaacttcttgtgcttcctccagatttaggaaacaaagagcatagtttctatgtgcacagtcatgtcttgtttaatgtgctgatttgttctgtttgtttgtcttccttttcaggtgctagagactctaagcaaaaactgtggggatgttgtttaccagcaaatcattgagcgagacatattaagtgaaatggttaagatagtaaagaaaaaggtgaggattatactcacattcagtggccaactattgctttcctagttcctgttagaacttcaatggttactctcattgagaagaggatggcactcggagtggggcaattttctggttttcttcattcacaaactcaaaagccatatcctcccaaagaggattggatacatatttatagctgcttgtagcagccatgcagccatgctagtctaagagggtgctgtcctagagcatcccaacaaactgtcctagagcagagcatcccaacaaactgtcctagagcatctcaacaaactgctgtcctaactgtcctagagcattcaaactgaaagtagagatgctgtcctagaaagctgaaaagcaggaaaaggcaccacaagaccaagaccaaccagccaagacttattcctacattctccccctaagtcttgtgcgtcgtcttgtgggaa

SEQ ID NO: 31280 - DNA, 789 bp, Oryza sativa
atctaatggcacgcttagaggtcaataatagggctttattctcgccgtttgctgagttgtcccgtttcgcgtgtagtttcggagcccgaagaccagcagtgcgaggatttcgaggatcaagctcaagatctcgagcgaggcaagccacctttgaacatcttgagcctatatttgaacttaattatgttgcttgaaaaatattatgcattgataggatcgcacttagtctgcttgtcccgtctgcaaggcagattggcagacctacctaacttgttgcatttgacccttccattgtaattgttataccatgttcccttgtacccacctagttgcgcctcggtaatcgtgcactctgcactggtatcgacggtcgccctcaaacttaaaatctgagaaacatcttgggtaaaacttgggttttacaaaagacttggaaaacccgacacctgggtcggtgcttgcgaactaaatgaatttccaaaaccgcggaccggggaacgtaccgggtgtacagtttcccgctcttgcacttaaggaccgtttccttggaatttcatccgaacataagacaagtacgaccacatgggtggaatgggacacccctggctgagtaactagcttatcgggggagccatgatgctaagagacatgtggattcgccggggtggtgtcggggaggacccctgggcttcctggcacagtatggtctgggacctaatctggtgttggtctgggacccctctcgttggcatatggtgaacctgtgtcggctttcgaaatgccttgtca

SEQ ID NO: 31281 - DNA, 1501 bp, Oryza sativa
ctccttataagagaagtagcaagaggaacaaagtcgcctagtgctaatggtaaatagtgtgttgatatttttatgagaaatggaagaaaaaaaagtgaatgtgtagaaaatagactcacaaggataatataattaatgagtgaaaatgacttacataggatatgttatataattatttcatccagggttttcacattgcacttttatgtaacttcatatcaaccatatacgcaaccaaaatgtagaacttgcttacttagtaagcattcatgcaaagatcctacttaatgaccctttgtgttgataagaatgtattttttccgatagtagaaatctatctagtatgtacccccaaccgttgagagtttctaaaaaaagatatttttcatgacatcaaagaagttcacaacataactatatattttccaaaatacataatttacccatgtaaaaaaaattcaagatctaatataaagaaaaatcgatcctatcctcatcagtcatcatagtctcattttttcgcttatactaatacttagtagctaaaattcaaattttcaaccttgaatttataattggtttgaggttttttcatctaagtttatttttcagccattgcttttaaattgttaagaacacatatatataaaagtttatttataaatcatgttttattcgttaaaatgtcgtttggcttattccaaatgatggggctgctagatgacagtattactccgtcccactatataaggaattttgagtttttacttgcaacgtttgaccacttgtcttatttaatttttttttgcaaatataaaagacaaaaaattatgcttaaagtaccgtagataataaagtaagtcacaaataaaataaaaataattttaaaatttttttgaataagacgagtagttaaacattacaagtaaaaactcacaatctaatataggacgaatggagtactttgatatcccacttttctcacaattccaaactagcaccacaaaatataattttgcaggccctcactttcacaccaagaaaactaaacaaagaaaaagtctacggccgcgttcccttctcttcctccttccttctttcctgctgcctgcctagtctagtctaccaccctcctctccaacctttctccttcctcctcatctcctcctccaagccgagccaccgaaattcctccaatcctacagttcgctcgcatctctccctctcctccccgtcccaggcgcggccaggacctccggatcggtgaaaagaggccgccttggtgcttcttggcgccgaatcttggggaggaggtcgctcagattcggtgaggggctcgggttcttgcggggtggaagatgtgtttttggggggcggattcgggttgggggcgttggggaggtgcggaaaggtgggaatttgggggctgatttgggtggtttgtttttgttgttgtttgcaggatttagggtttttggtggtgagagggggaaaatggcga

SEQ ID NO: 31282 - DNA, 533 bp, Oryza sativa
tacatactacactattaatacatgatcccacctatcatacacacattgcgtcttggagtccgtgttacagttggctacaaatctatagcccgctgctattctctctcctcatttatctacttaaaatatgtttgcagatggcttatagcctcctattgtacctgctctaatgtggctgtacatggtggcaaacattttgcttttaacccatcatgatgattaggacggcagtgatcgatcatcggtagtcagagatccccatagggatacatgcatgcagtatgataaggagaaggtgatcccatgaatctgccgcggtgccatcatcactgtgaaggcaggcaacacacctcacactactacggagccagtcatccgtaacgggtcacaaccctcatcattaaccacaaagtgtgtgatcactgattattggtcactaatgtgaaaatctcatttgtgtctggcgagtagccgtcacgaccgatgatagagatatacttgtcgggccccaactctcaccgttcaccgatagg

SEQ ID NO: 31283 - DNA, 975 bp, Oryza sativa
attttttctgcggctaactagctatcctaaccgctatatagagcgcacccttacttggctagacatcgcatccaaaatctttggcagaacgagaaaagatttggttctctgtagtatctcatgttcacttgccaaacaaggatagtgcagagcagtgatttttaacttctgttcttctaactttctctgaagaaccttgcttggaagctgaatgtgtaagtaggatgggaccaaatcttcagcagttaataagtttcagttaagcaattgattactagttgtgaaatcttgaggacactcttgccaataggtagaatgttagcttggaattggatggagcaacgcttcactgatgaaacctggttctcctcatgcaattctcagcattcagtagtaatcatcaatcaagctgctaaacagaatagccatggcagttactacctcagtcctaaaatatataaaaatctataatcaaatgagacattttctagtatcagattcgtattactaaaaaaaatattccatccgatactaagttcttatatattttggaacggagagagtaagtcggaatgcatcaaacggatcccaatgaaattgatccgaatctacgagagcgcaagcgaatattactacagaatatcaggggttacatgcaaaaagttcttcttcccattcccctgaaactgaaaaagatttggcacgaatcgaaccctccaatccattgcttgcccttttttgtgtcctccagcttctagaaacttctagaacccaagtaagtccaagccgccgccgccgccgcctacagttgcttgcaagccgcattggcccaggtaacacgcccgcgatgtgctggtcattctggtgttgataggaattcacagttttgatctctctgctccattctgtagcctccaggtttggcgctcaccacctgttcgacgaaatgcggcaagagggagcagatgtgcgcgg

SEQ ID NO: 31284 - DNA, 201 bp, Oryza sativa
gcaaagatgattactacggctgtctactactactgctgctgctgctgctactactgatgataactaatatccaggggagaggagattccttgccctcacgagctcatgaccatgtgagcttctgtggccttgagtgaatagcattctccccacttggcgcagtgagtgaatggtcagcctttgttcctatcctttaataga

SEQ ID NO: 31285 - DNA, 1501 bp, Oryza sativa
agttatttcctaattgtatttctatatggactctatcctctacttctaatattccttatttttaattccgaatttcagttatttcctaattatatttctatatggactctagtctcctcttttagtatcccttattttttaattccgaatttcacttatttcctaattgtatttctatatggactctagtctcctcttctaatattccttattttttaatttcgaatttcaactatttctaaattgtatttctatatgactctaccttttctttttctccgattaatgtgagaatttctaggccatgagagcgaacgtggaggctcctttttctatttctttaataatataatagatatttatattttttaaagaaataaaataaatggttaaacgttatgcgaaaactcaacgacatattatattttgggatgaaaagatgacatactatcattagtcatgacattagtacctgattgttgcagtctgatagcttatttatcattaatcatggcaagtccggtttttctctactacctgatgttcatgacaagtccctgttggctgttgcaatcattgtagttgtgccagatgggataatatattagcagtttgctaatgacagagtagtgacgttgttttcatacatagagaaatccctagggaacatggcaccctgccggctcccttcgcaacttggtgacaccgaccgcacaagtttcagctgtcaccatctcttgggccgcatgttggcggagaaaggcagcccagccgtcttctagttgaaactaaaaggcccagcacaactcatcccgcacggtttcgctgatgaatcgttgcgggttgccgctttggacaccgcctaggcgcctactccacgcgccgtcggattcctgcccggaactagctcgatctcactcgttgtcgctggtgacttgtgccggcttggctaagatcaagtttagtagagccactcctagcttaaaatcatctataattaatttaatagccaatacatataatagttatatgcaaatatacaccacactattgatatataatttctcatgttatatacacattacgttttatgttttatatatgtatgtatataagtgatttatagtatactattgtataacctgctctgctcgatctcatctcggtgatcccatacttggcacgtacacgtgccctcttgatgacataaacaaagagcagacagcttgtgtgcgcttgtctaggtagaaaaaaagggatccgatcgatccgaagagcatggtgaaaagcacgctattaccagtaccaccactgttcgtttcgtttgttgggtttcggtcatcgccccacacatgtcgcgcatgcatggttgtcgccgcgacacgtgccggcgcgcgcacctccctctccgcaccttaactccttcgctctccgcccacttccccatcacgcgcgagcgctgccatcctctcctcctagctaggtcgatcgacgtcgagaa

SEQ ID NO: 31286 - DNA, 1501 bp, Oryza sativa
gtatatttcatatctaatcttttcttttttctcatggtcgttgatgcatgcatgctcttataggattttctaggattgtggatttgatttgtggcgcaaagggagacttggagtccaagggaagtggttccctttagactattgcagttgcagtccacacaaagtctcgcggtgggagcgcgcactcgaatcatatcattttcatgcggtacgtgtcattgattaatccatctcgcgcccactaatgatggatgatatgactgctatggtaatgctgctcagtgcaaagttagctataacagtaacacactaacggtacgttagttaaaacacctcatattctctgtcgatcatgcatcgtatactggacaataaacacgatcatgcaacctaatgggaaaaagtgttttcatcgttgaagagaacatttcctcatttttttatacctttcaaatggttatcaaactttatttttttaaaaaaaagactcaaagataaaaaaacaatttgatacgacagatcaatatgaaatatgtcacccgcaaacatatctaagttaatttttttattgttggacatgacgagtctattgatcatcctgatgccttaccctgaatcgttgtatggctaatcgttaatgttaccaggcgtccaaactgcttccctaccacggcgagctccttcatgcttttggtggtgcaaatgcatgaaattatgatatttattttttaagaataaattattaaatacataatctcagagttgaaactacacatcttaccgctgcactatcaagcacatcacataaattgtagtaactctcccctcccaaacaaaatcttaataaatacagagatttacaatgcttttgcgcatcgtcgaaacaaaaaaacataaatgaggtaattaaggctttctttgaatggaggaatttagatatttttttctcctaaaaatcaaactaatttctaataaaatagccctgtaaatcttgtatactccctccgtttcaaaatatttgacaccgttgactttttagcatatgtttgaccattcgtcatattaaaaaaatttgtgaaatatgtaaaactatatgtgtacatgaaagtatatttaacaatgaatcaaatgatatgaaaagaataaataattacttaaattttttaaataagatgaatggtcaaacacgcaacggtgtcaaacattttgaaacggagggagtatttactatctccgtctcaaaatataagaacttagaatcggataagacattttctattacgactgtccagattcgtagtattagaaaatatctcatttaattttagatttttatattttgagatggatgcagtaactttcaaaggagtcacgtttggttgaaaattccacgccattgatcagaattcagaaatgcttggggagggtctcttcaggcagggtccacggtctgcaccagctcagcacgagcttctggaagacgtgcaccggtgcaacaccc

SEQ ID NO: 31287 - DNA, 1501 bp, Oryza sativa
tgcatgggagggctcgggagagaggggaaaatggagagggaggtgcggggaatgtttttataggggagggtaggtcggaccgagcccgggagaggcggagtcggggcggcaaccgccggcggcgtgggcggcatcgtggggtgtgggtggcggttttggaggggagagatgggcgatgaggaggacgtggggcggcggggtcccacggccagtggactcgcgcgcggggtggagaaggagggcggaaacggcggcgtcgtggggaggctcgggtggccatggcggcggttggagccggaggaaggggatgacaggtggggccgccggtcccacctgtcggcgaagggagagaggaagggatgcaaagcagactttttgcgagggaggataggagggaggccgagcgggccgagggaggggaaagagaggctggcctggccgggaaagaggagggagggagttgggccgagcctaaaaagggaggaaagggatttaatttggtttttctttttctttaaatgagtttaatgaactttgtgactttaaaattacttcttgagctccgaaacttcacgggaaaatttcagagaatatttagggcccaaagaatattacaaaatattttcggccaatgattttttttaagggaaaattttaattctcccattatttcacttgattaagttactttaacttttatttaatttctagaaaatgcattattaattgatttttaatcccgaccgaaaattggggcgttacacttgcctggttcggtcgaaccagccttggagcccccggctcccaccttgcacgtggcagttccccattggtcctcaatgacgattaaggggtgttaccgacttttccaaccgcctacagccgtcattgacacactataaaaggaggtcctcactcacttggaagaacacacaactttgggctcaagtagagtactattcacttgtagtttcatatttagtctgtgaagggatgctccagaaggagtgccccgcaatttcgtagttcctcagagaattttacggaggagtgccagagtgtcgacattctcccaacggagttccggagaaagccaagattgtcaaccttcctctctcacttgtacctcagcggatgcttcctttatcaaagtaagtgttcaagtttctttatgttatttaattagtttatttaagtaagatatattctcatcggtgtgggttcgtcacttagtgtgcaactaaatgctctagtactaggactctggatgaagaaggaagtttctgcgcaagactagagtagtaattaataacttaggcttggtgtctaggttagaaattacctttgtttattgtgtgctccacggaaagtgaggtaggtggcaggtggtgacagccctatcaggccttcgtatttctccacattcgggtacatcatagagctaaagggtggactcagcttggcagtcctaggggggctgatgcccaaagcattcgataga

SEQ ID NO: 31288 - DNA, 154 bp, Oryza sativa
aaaaagtcaacggcgtcatctattaaaaaacggaggtagtaatattcatgtggttgtctcatcacagttatgcgcatgcatgctctagatttcgtcaggcaagcagtcaagcagaatatcttaacaatctccggagaaaaacagaacaagcagt

SEQ ID NO: 31289 - DNA, 1501 bp, Oryza sativa
taatatgttgatgaagtacaatactctctcaatcctaatataaatataactttgtattgatgtgactgtatgctcagatttataactatagaatataccatatttgtacaaggtttcacttgtattgagacggagggagtagagttcaactactttagtaggtaaaactatgagaataatatgtaggcctagaatgagataagttcatggggaaggattgggatcctttgcatcagagtacaaaaatttgcaccatccattcacaatcaattcactaaacgaagcattttcgagacttccgtgaaagtcttcttttagcttgagttcatcggcctgttggcgtcccattttttttccgcttattaccatcttctgaattaggtagagtgggagcactcgacgaggcatctacgacagtagaggctcttcctcgttttcggccggacaattccataaatagaataaaaaaaaagtaaataagatcaagtaaccagaagaattgtgagaaataaatcaatttattaagttgagacacatcgagggataaaacatttcatactatcatcataagttgattccatttacaattgaatttatttattttttttgtttctttttatgtgagtaaattttattttgggccatatatttttacccatgttgcagcttgggctaggttttagctgagtttttcaccttggaccacttaatataaccatttgtttcatcctggaccatagccgctcatcttctccgagtccaacaggcgataacccatcaccaacgtgctcatccgaacaagcgttggcggcagcggcggttactgatgcgcttatttgatttgatcacaacacattagcttggttgctccatgctccacaatcccagccggccagccaagttacacctacaaccaaatgggcaatggaacatggcttccgttcactgaagcaacaaaaattgatgcaacatcattaaaattagaacaactcaaaccatgcatttgtgttgcctctgtccctaatgtaagcatcaacaaattactagttgctatttgaatcgattcccttgcctcacctcgctgttgtcgccgatccgccatgagctcgccggcctcgccctcgtcgacggctggcgtagtgcatctcgacaacacggcagctgagagggacgtgatctagcaagccaaaatggccctcatggcctagagctaacctgccgtcggctgaacggagaagtgcgccgcagtgcgaatcagctgtgcgttgctgctaaactcccctcggataggactaggagctattggcattaatcaagcacttatcctcttgtgctcaccacatcctcctcccatcgatagcccaaaatgctattcatgatgatagtgatagcaactcaagcaatactaacgcactgcccctggtccaaactgctatattttgataaagttagatggtgttaagtgaaaagattggtaaatccctggtgcattgtacaacta

SEQ ID NO: 31290 - DNA, 1209 bp, Oryza sativa
cttctaggataaggtgcttgacatgcagggtagggaggaaaaccacgaggttgggcgaggcacgacaagcgtggcagtgataaacccttttgcgtttgtgtcatagaaagcaactgcaatcatttcctccagtgtggtagggaaggctcacactcttacagtccagtacgcagtgagatgcatccccagtctcattcgtaagtagttcgatgtgcatgaagcttctaggctataatcatagggtgctcctggccctttcaaggtcggagtgatcccagagtaaacttggtcttagcatgcagaacccgcccatgattgaatttgagttctatcgtgatctcagacatcatgtttgagccgaatctgacccacaatttgtagagaggtagttattctctaaacatcccccccccccccccccgcgctgcttctacgactcgcgtgtcgcgtgagtggggccaacctgcagagtcacgtggccaaagggaaagtaattcccctctacttctcatacccccgggcccatatctccaacatatatgtatcaaaatttgatacctctcggtacctcttggtatctcttaagtatagtaacatttcttttttagaaattagatatatgacagttttgttcttaaaattttattgcaggaggtttttaaatggaaaaaaaggggttattttctgtagtcatggctgatgctgatggcactggtgtgagctagtaacaatccagagaacaagttgacgggaacagatgactataaacgggctattggtgtgcgtcgagatcaaatggataattcctctcaccggcgccggattctcctgggcaaaaatgtggagtttgctcggccaagtggtcagcagctcaggcacgcacagtctctttttcacagttttaataggagtacgagactgactgcgacgcaatgccttctggctcttttgttttgttccttttgttctgtttcgttttactcccccgaaaacaacatcacgctagccgatcaagcttcctcctgcgagaatgcgacgcgaaaactaaatggaaatggttgaaggtttgagcccgatcaggcacgtttcccagctcaagcaaaggatctcacccaatgttactgactttctgctacctgaaatgaatgcagtttctgggcacaggttttggtctctgaatatgaaactctgaaaaagtaattctgaaca

SEQ ID NO: 31291 - DNA, 1501 bp, Oryza sativa
cggcagccacgaacacgcacgtacgcatccacttacttgtgagagttgaagacggcaaatgagtggtgctgatgcgtgccagcacgcgcggccgggtggttgcatggatgaatggatgattgattggagattggagatttagcagggcgacgtggatggtacatactagagaggagaggttggtggctttgtttatgtttgggtgtaatggcgttgggcaacttgggatggggggggcccttctccctagtccggtagcggcagttggtccggccactccttcccgtgacaaatccctgcgagcatgtgaacggcaattggttagccatacagtaggaaaccagtgatcctgatgaaaacccgaactctaataagcttataaatgcacattacattgtatgctgaaaatcagaaaatggtcatgccaagtgtaccttccacttgccaagagggatatgttggatcttcttagcatgcttcccacatcccatgactcttggggccagccagccatccattcaagtgtctgcccgcaataataaaaattgaggttgcgcgcaatgacgaacatgtaaagccactcaagaagcaaaattgttctataaattctgttaaaataatatggttaagaaaattcctcacaaaaaatatggttaagaaaattgtaaaagaaagttacaacatagtacatagtattacctgcatttgggagttcctgcgtgtaaagggcatgattggattcaaagcgaggtctatcatgaggtggatacctgaacagtagtagttgtattaatgagactcacgggttatttcctagagaagaagcatgcatgaaaaaagacccacatataggtaaattctcatgactgggagtctgggacaaaattgtgacaagaatagcctgacaatggtaaacaaactggtatataaagcatgttgtcagtttaatcacctggctgccttatcatgccctacccaaagaataaactagtggcaaatgattccatgtaggcacaaagacatgccacttccctaccccgtgaaccgttagtacataagtacagataagctgtcttgtctagtttttctgaactatggcaagtgggcagggccaagccttgaggaatgagggcgtgtgattactccaaccgattctcacaaaaagaacaccataaaggaaaccacaagggataaaactgtgatggtgatgcacaaaagcacaaactacaagtatacacctttaattctccgtgcagctgcaagaatgcaattcatgcttctcaagcatgcacgtgagttggggtcccaaagaaaagccctccttttattccgatttctctgctccagccttgaggaagcaaagatgacaatggaggtctctatttaaaccccctctttccctcctcaaagccacaaactctatccctctccctcacccacctatcttccttccaaacacgtacatacactgttctctcagaacaagagagatacaaagtta

SEQ ID NO: 31292 - DNA, 166 bp, Oryza sativa
aacaaatcaagacttgcccccttctctcccccaaaagaaaacctctacaagaccaaaccatgtgcgcgctggatggggtttaccggtttgatataaaatcattattctcctgcttttattgaggcttttttatagagagagtttctcggcgattttctttgtgaga

SEQ ID NO: 31293 - DNA, 296 bp, Oryza sativa
caccaaattccaagttgccctcgccagccacaacaaacaagcactcgaacccctctccaaaccgccaaatcacccagcacaacaaaaactacgcgccaatcgctcgcgaaccaccggatcacacggcaaatccgaaccccccaacccaacatccccgaacaaaaaaaaccctaggaacagatcaaagcgccaccatattccccagatcgaggcgccccccgcggagccatcgccggcgggacgaacggcgagaccagaacgcggaaaagccagagcagcagcagcagcagagggat

SEQ ID NO: 31294 - DNA, 1501 bp, Oryza sativa
gaattttaggataatttttcaactgataacgtggagtaattgaattcagtgttgattttcttgattcttttcaataacaattggacacagcatgaactgacaatgggaatcaatatagttctatactaaattcaaggatagttgtattctgtgataatcagaaaattgcatttgttagcccatgacatttctggtacagtaaagaaatccaacagataccacagaaatttgtactcttgtcaaccattcatctatatgataccaatttttaataatttaaccccaaatcaatgcaatatcgagtaggatttgtaaagacatgtttcttttcagggttgcacccaatcatgtgagaaaagaataatataaacataaaattcaaatcaagcttgttgtgtcatatacagtttttcatgcaagattcctactctgagtaacacatagtgtaatattttcaaaggccggtacgcttcaaagttcctgttaagctctttttaattttttaaaatagaatttcggccatcttatcactgcagcatgttaatgtgaaatgtattaccaaggcaaaataaacatattcttatgctataagaatgaattcttcacaattgagaagcaatcccaatggacttagaactttctttgaagttccaggaaacgcagcatgctatcaggtattgcagtctgaattatacattctgcacttgagcctaaagaatggctagctgattgtaactgacaatagaaactgaagcatatcctaatgttttaaaaaacaaatgaggaactcttaacccagaatgaatgatgcaggtggcacaattttttaagttgaaagcagaacactttgagaagcagtgcggcagttacctgcgtatcatctgtaactccatctccacgggccccaaaatcaaccacattgaagactgtgttctgtgattgggctgctggtggctgtggtggcggcagcaatggaggcagcggcggtggcggagatggcaatgtatgaccacttccactgcttggtggtggcattgttggagccggatgtcctttgccctggacaggtctttcgctcgggttgacgggcacattcgggcttgtactcgggcttggctggtatggatcctgattccctttgccatattgcttgtgggaattgttggtctttcctttcccttttcttcgcagcagagtgctggaggatgctctgttttgcctccagtgcttgccacttcttgcgtcagataaactgacattggaacacagaacaagcaagacaaggagaagcaggaaggtgagacctttaatcccaagccccatctttgcttttgtaactttgtatctctcttgttctgagagaacagtgtatgtacgtgtttggaaggaagataggtgggtgagggagagggatagagtttgtggctttgaggagggaaagagggggtttaaatagagacctccattgtcatctttgcttcctcaaggctggagcagagaa

SEQ ID NO: 31295 - DNA, 364 bp, Oryza sativa
acttcttattgcatatgccagccttctttggcgataattagttcaacaaagagacagagaattttagtagcacttttaatgtatgtttgctatgtgcttctctgtcaatttgtaagagacaaagagagacaaatctgatgtacagtctaaaggttcctaaaattgatattgcatccatcaaacgttacaaacatcagcacggctggcataccaaatgtataacagtgtaagagacccaggatatcctacctagtctggccattatatttacatgaccatttcctggttcaactattatggatgctaatctcatactagcatcattatattagagttactagctatgctagagtagtgttcgtca

SEQ ID NO: 31296 - DNA, 1501 bp, Oryza sativa
tctttcagagatgccgccacctgatgatccgcgagcggaccgacgacatcagtcaaaggaagggcctacactaaatcatgtcataagctgattttgagcaaagaaggcggacgcttatcgaatgaactcacattgattgcttcgtcgtgctccgtcactcccctttcacaaaagggtgcggggatgtcgctcgccgtagtcgggccgctgatcatcacctgaccaacacgccgctccacggcttcgctgctcagacctgtcaagaaggaatcaatttttgataagtcgaaaaggaacgcgagtacaagcatatcaaaatgaatgcgagaaagataccccgaggagaaacccgggtcgcgtcatctggcccggaatagttataggccgggtgggcccgagcctggagcggctggattcgcctatcgacgaagtctgcaacgacttcatatcccgataagccccgttctcggagatcatcgatgatgtcgataaacgattggagagagggggtcaaggggggcttggcggtccagaccagaatcttgttgttcctcgggaacaacgaggatcggatttgaatccttgatttcaaggtaaaaccacctgttccgccatttactacgagaagagggacactggaaggggacatagcgcgacttcatcccgtcacgaagtcggaacccgacgcaaccagacaccctattgggttccatccagcgcaactcgtaataaaagcggaacagatcaagaaagggctctaccccaatgtaggcctcgcaaagatgcacaaagacactaaggaaagcaatggaattggggttcaagtgcagaagagaaagcccatagaaattcaaaaccagcagaaggaattcggagggtgaagagagaaacccgcagacaacataatcttcgatcacaaccatgcgacctaagatgggctgaggatttgtacctcctgcttccctctccgcgttttcacggccaggaagggcgccatcctcctggagcttcttcagggtcgcgctggtggaagccgacttgccgagatccatcgctgctggaagatcgccagagatggacctaaagctgacgaagctagggttctttacggcagtggagaaggcgaggagcgctaacgggcggtgtgtgcttgatggagtgggcggacttcaaaatgcgcacccaaaatccctttaaataggcgcacccccgacggtgcgaattccaaggaactgagagaaatccccgccggaaatttctaggtccattacgcgcggcagtttttgacttaagttcaaaattcactcgtgaccgttgggcttcaaacggcatgttcgactacacgtcatctccgtggttctcgtacctggaatgataacgttctcgacacccgaagtcgcgaatggtcgcacgagttcattttgagcagaagtcgggagctactgtcagggttacgggtcaggcataccctctacccttcgatatacgttacgtatcgaca

SEQ ID NO: 31297 - DNA, 818 bp, Oryza sativa
agtgctcatgtcacacttaaaaatggcttatacaaggagtttaatggagaaaggataaaccaaagcctgtacctttaacatctagtccttgtatccataagttagcaaaagacattctccaattccgttcctatacagtagagcgatcatagtgaatagtgacgatgatgagcctgctatcccaccatcacctccagagttggtgggatcttatgcgagtgaacaaatagatcacttatgcacatggtttggctatttgtggattgatgctcggttgcaagttatatatattcccccctgattaatatacatataattttcgagtttagaaacttacggtatacttttgtggaatctgttgctaacgcatgggtattttgctagatatataagaaagataaacatcatgcaatgcaatcgtcacactattttgctagtgcctggacagaaagatacgtttgtgtctttagaagagttacttcttgtggttttgtttcacttatgctgttccacattcgggttagtataagcatatcctaacttcatttaccaatgcatttgcaggtagagtctgtgtcttgtaactgtggttttgtttcacttatgctgttccacattcaggttagtataagcatatcctaacttcatttaccaatgcatttgcaggtagagtctgtgtcttgttactgcagggtagatggaggtcttaaaactgttgtgagtgctaggaagtttgtccctggtgcaaagctgtgcatgcaccctgacattaaaccaaacaagcgcaagtcaaggagctcacacaaagagaggtgccg

SEQ ID NO: 31298 - DNA, 1501 bp, Oryza sativa
aaagcaaatacaaccaaagctatcgcatataaaccaagatttgccacctgcattttccatttgtagtgactggtgagcatcttcctcatgagaacaatgattgcagtggtacaagacacaggagactaaacaagtaggaattatttttgaagcacatatcaggccaccttcaatcagataaaagatggcagtaaaagaatactaccatctttggtatagaaacaatgcactttgtcatgtgcaaaaggttattataataacaagagttcagtggaagaaatttcccggagataccttaagtaaaaaaagagtattctagtaataatatgtttccatgctaaaactgtagtacttaccatagtgaacgcatttctgcagcttgctaaggctacccggcttgtggaattcagtgtcatgcagttcaccattgacctgagaggaagaaaaccatgtcactatgccaagccagagcccaaacatattgcaaattagatagaagcttctgtcaaagttcaagtgatcaaatttacatgtgtgaaacttgtgtggccgcccagccgatgttgaagacggcagcgaagaagctgtaaccaatggttctcacaaggtaggaatcggtccccaggacggtgcagagaagacatccaccgaagacagaggagaaggagatgccgactaggattgatcctccgatgtgccacagcttgaagtgcccaaatcggtcgatctgatcagataccacatacattgctcacagatcagttactgtattttgctaatcagcgcgcattcagcaatagcaaacggtttctcaatttatttagtaccatctcgcctgcaagaatcgtcattaggccatctgcaacctggccagaaagcatcacaatagctgcatccctgcaagaaattgaacacaagccatgattaataaactgagctgctgcagcaacattactttgcttcagacaaatcgaaattccacacagaccactagtgtgattgtgagctgttgtctacgtgggtttaattaattaattagcaatgattaccttggagcaagcccgatttcttgcaagaagaggagcaggtaagtgaaccagcaggcagacgtgatgtcattcagcatgtggccgacaccgtaggacaggatcggccaccgtcccagaggcatctgtccctccgccaacacctcgtcgcccttcgcgtcagccatggcgatcgatcgatcgatcgatcgcagaggcaggcagtacaccagtttcccaatgtgtaatcttcagctacgatctctgaatatgcagaggtgattgcacacattagcaacagacagggaataattccacgcctcatgagatgcatgacaaaaaggaaaaagcgacttttatttgatggcgatcatgcgtaagcttgcgttcacgccagccggcgccgccgcgcgcgcgcgggatcaccgcacgcgagcgacgcgtgccgccccgcgccgcgcgtgcagccgcgtccc

SEQ ID NO: 31299 - DNA, 1501 bp, Oryza sativa
tccagcacgttttgtccctaaattgttttcgtcagttttgctttttataattttgtaacataatagttatctttatactatattgtatttatgtaatacatagaagcaattatttataatgttattcatcaactgtaaagaatggtaggcttattttctttaaaaaagcatgcatactaaattaagtgttaaatgaaaattaagacttttttaattggatataggttattgttttctattaatggatgaattgggtggacatgaaagtccactaaatgcattggttatatagtctaatatgatttggtgtagttcgagatgcggcccaggaatccaagaattgagaatttttttacggtggattaattgttttttggattttaatatttgtatgttaaaattcagcagctatcagtgagatggagtaacctcagttttgtatttttcttcagaacagaagaattaaacattggtgctaattacgtctaaatagaaaaaagtacatttagttctaataacaatgattaaaagaagcaatattaaacacataccacataactgttgatcttcgttctttctgccccataatgttttcttgtctgtaaactcaaagtagtagtccgagaaacattcttttttgcttcgacctattttattattgtatcgtgataaaaaaagattttgagatatctttcggtacacagtacttatcatgttccataactttgattatttttaaaaaatgtataatgagtttatcttaatttttggcctaaagtggtttgccaattgctttgggattgaggcatgtattgagttgcctcgaagaaaatagtatttacataatagaacaatatattaaatgacatgtttgcaacaatcataccttgcatctagtagactcatctgtataccatagaactcacagccattgtaagattaaccgcatcctatagcctaatcactcttactttaattatacacaatacttatcatgttccataactttggaacttttaaaaatatataatgagtttatcttaatttttggcctaaagtggtttgccaattgctttgggattgcggcatgtattgagttgccccgaagaaaatagtatttacataatagaacaatatattaaatgatatgtttgcaacaatgataccttgcgtcaagtagaatcatctgtataccatagaactcatcagccattgtaggattaatcgcatcccattgcctaatcactcttaatttaattgtccacctatcattttttctgtgttaacgcagtaatcaaattgtaaagtaccatgttatctgcaaatgttcatatgcaatataatatatacatttatgttattcaatagatgcaatatagtgtagccttaattaatacaggatagcattattgtgttcttctataggtgcacgattaccttcttttgccaaatatgagcagcctgaattgactaatgtcaccaaacacctcttatgccaaga

SEQ ID NO: 31300 - DNA, 430 bp, Oryza sativa
cacttagtaataatattttacaatccttactacaaaatactccatattattttgtctaaaatgtaccctctaaacaacaaaacttccctttacgtaaaagttcttacttgtgtcacctactcgtataccctaacatcatgccattgttgacaccctaagccaaacacttagtgtaacaatatttttacaatccttactacaaaatactccatattattttgtctaaaacgtacctctaaaaacaacaaaactactttagtggagggtgtagttagtaaaaaagccggctttgtctcctcgtatatacactctctcggccttgctcggttcctcctgtcctgtctcccctctccactccaccgccgccgccgcctccgcgaaatggcgaatctgccgccgtcgctctccatcggcgccgcctccttcgccg

SEQ ID NO: 31301 - DNA, 708 bp, Oryza sativa
agcatgcatgcagcagcccttgccaccacaccaacacattctaactatagcaactagcaagaaccaggcatccaacaaagactttggaacaggaaggaggagagagagagatcgaacgtttcatggtgtacactacattgtgatacacccctaggtgtagtggcatggatcatctatctaaaaccaaattagcatataatgcgatatggataggaggcataagggaatatgtgaacttgtgaagaaattatctcatcactgtactcaaacaaatctcttaggaggctccacaccaacctgaagtctcccaagtcagtacagattgtttctctctgaccactgatagaaaccaagttctcgcacagcatgccacatcattacagactcatttgctgctctgactcttgaaaatcttcagctgaatgatgatgcagctagatgcttttcgacgcatgaatattcagaagtcagcacatatacacatgtacatgttcgctagcggtatagatgaataagaatgtattgcagttagagtttagtccaacaacatatgtggagtggagctttaccacctgcatgaagcaatatttcttagagtgcatacatgaagcaaatttttctcctccattttcattctttgtcttttaaactattttggatcgcatttgtaatatttcggataatgacactatgtcttctccataaagg

SEQ ID NO: 31302 - DNA, 318 bp, Oryza sativa
tttaccatgctttctagttttgcgtaacactgttcttttagtttttttacggctcctttggaatgcaagaatttaacaggttttggatcaatttccgtgaaatctctgtaaattccattcacttgaaaagagaccttagtgctgtatagcgtcagatttcagatcttgttgggattgtgctgaggcacgttaacgtttgtggtggcgttaggtgattaaacagaaaaacagctcatgtaatctactagatacaagacaaagcatgtgggtgtcataaaatcgcaagggtagttcagagtttgtatattttgtatcagg

SEQ ID NO: 31303 - DNA, 230 bp, Oryza sativa
atatttccagaattggcattcaagggtacatacttatgttcttctaagaatttgtgcaatgaaagatgtccggctagctgcatgttaagttcataagaccacaagatcaggacgaggcttggttatgagaaggcttttgattccttgttgatgatggtgtgatggctagtctataacgaaacaaatgtgttaaaaaaaagaaataggtaagcggggaataatcttattta

SEQ ID NO: 31304 - DNA, 184 bp, Oryza sativa
caatcacaatgtgacacctcatatgtgtaaaaagtttataaaaatagtttagtacgcatatcgtttcccttctcctgttagaaagcggggatggttaaaattgatcttcataggaaataaatactccttattagtactaattattccatacatggatggtaattatgtagaaaagatgttgcga

SEQ ID NO: 31305 - DNA, 236 bp, Oryza sativa
aattaactaacaccattgcggtggcaccaatccaaagctatgctcatagtcaaagtctatgtaataatgtgatccccatgtgtgtgctagttgaactaagcatggctaagcatttcctaaaccaacatctagtcattttgatacccaagttatcaatggcataaggtaaacaataaatggctgagtattaggacccatcccacatgacattgtaaaaggatgcaacatttaataga

SEQ ID NO: 31306 - DNA, 1501 bp, Oryza sativa
tgggacgggggaagtagaacttatgcgattgctatttcatgtattattatattagttcgtgcagtccaaatatatactccactcatttcatattatctgtcattctacttttgttgtaagtcaaacattatatttctaaccatccatttttacatatttatatagtttaacatttagattcaacatgagaaataatttcataatttatagttcgtactccctccgtaaaaaaaaatacaacttctagctaacaatttacacataagctatgctcagattcgtagtcataagttcaactctctctctatatatatgtgcgcgcacgcgcgtgaaaactgctaggaattgacagttaaagctgaaaggatgagtggtttgtagcagagggagcagtggaagattaatccacatgtgagaaaagatttcttacaatgaaagaagattggtgaggtttcctagttcctttggaagtagtccagatagtggattgaaagataatgaccttgagatgattagcaataattaaaaaaaaacaacgaccaatagatggaacatgatctagaacaaacatgtaactcatacaagtattgcattgaagtaaattttccgatgaacgacggaatgggaccagtcaagtaattacggaataagttcctgaaaagatcacaaaaataaactagaacaattagccaacacaaaaataatgatgaatacctgacaagcatttgttggtgttcacagaaagaaccatgggattgaatttatattttgtgcaaacccttgatctataaattattagtacaagactctttagtagtgccacaccctgattttgtttcaggaatttataaattatttaataaaatacttctagaatttatattaaagtgtacattaattaagaaaatgaattaaagtgggaaataaagtttcctaaataaaacattgctggatttaatttttattatattctccatgattagtttacactctctagaattttttcggatttttcagagctcaattactaattttaacaatacaaacatcaattcaatggttatttaaatataaaataaattagaaacccctccaaagttctgggtcgaattgagcccatgtctctctctccgcgctcagcgcagctagcgctaggccgctagcctaagtcaccagcccaccgcctccctcctctcactcctgccaacatgtgggatctggtcccacatgttagtgttgtccccagcatccagccagaatcacactgtctgcgttcctctccaaatccagccgcctctctagatcttttccaaaattagttgaggccgtttgttccctatctcctctttcctttccccatgaaatccccaaaaatatctaagtaaatcgtgtggaatcgagctcgaactcggacactctctatccggtagaaccctagtttttcccagcgctgccatagccgtcttaggcccggatacattatctcgtggctacaaacagg

SEQ ID NO: 31307 - DNA, 1501 bp, Oryza sativa
tactccctccttcaaaaaaaaaaaaagacaaaccctgggtttgcgtgtccaactttgactgtccgtcttatatgaaatttttttataattcgtatttttattgttgttagatgataaaacatgattaacactttgtgcgtgacttgtctttttaatttttttcataatttttttaaataagacggacgtcaaatattgggcacgaaaattagggtttgtctttttttgggacggatggagtagtactgctgactttgttagtttgtgctttaatattagcaaaaaagtgtggtctgtggtgtattgcatgggctgttcctaaacatgcatgcacctaattaatctaaatgtactgtgtgggtggatcatttatttgctggtctgatagtttgtttagttcaaaaatgtatctttttttcccttccgataacgtttcgatgcacctttttgattacgattgtcgacgggtgatacccgtagaccggatatagagggtattggggtacgctggtacaaggatctacgtagtacgacatcgagtaatcaaaagacaagaattatactggttcaggccccttgataggtaatagccctaatccagttgatatgggattatatggtggaaaacacaggttacaaaggaaagatggaacttgtcgaatccggcgagattgtagtcgagttgattcgactagctcttgacgacgtggcccctcgcaggctccggcttcgtaggctgtgtgggttgtgttggctctgagattcgatcctctatgccctccccaggggtcccttttatatcgcaggtctggtggtctccgagtaggactcgaacacaccagacccagacccagctcaatacgtaggtaacccagttcttatccgagaaggactcttcccgtctattgatttcgtgaaaggtttccttagatcataaaggaaatatccgcatacgcgtgggtatgccatgtcgatacgtaacgtatatcgaagggtagagggtatgcctgacccgtaaccctgacagtagctcccgacttctgctcaaaatgaactcgtgcgaccattcgcgacttcgggtgtcgagaacgttatcattccaggtacgagaaccacggagatgacgtgtagtcgaacatgccgtttgaagcccaacggtcacgagtgaattttgaacttaagtcaaaaactgccgcgcgtaatggacctagaaatttccggcggggatttctctcagttccttggaattcgcaccgtcgggggtgcgcctatttaaagggattttgggtgcgcattttgaagtccgcccactccatcaagcacacaccgcccgttagcgctcctcgccttctccactgccgtaaagaaccctagcttcgtcagctttaggtccatctctggcgatcttccagcagcgatggatctcggcaagtcggcttccaccagcgcgaccctgaagaagctccaggaggatggcgcccttcctggccgtgaaaacgcg

SEQ ID NO: 31308 - DNA, 952 bp, Oryza sativa
ggggagaaaccctccttctcctctccctccgccgccggccgtgacgacgacgactaccgtgacgccgacgcttgggtcccaccgctgactgcgacgacgacgccgccatcgcctggatccgctggagggagaggccgtcgacgccgccaacggattaggtggtggcgccggattttttttttgttagttgaaaatattttcacaggcgggtggatctactgcctgcgaaaatagatgccgcctgtaaaaatgattttcgcaagcgggctattttcgtagtcgtttgtctacaggcagtccttccccctgcctggaaaaactattttttaccgcctacaaaaatgcttttagtgttggagcatctattgcacctgctcttacggccctcttctctaggatttgaaccatgatgattggagttatatagccacgactttactgccacactattgatgttaccccctcttttcttatttctctttcttcgttaattagtttgctttttaaaaagatactaaatttttacgtaggattttaatttatatgattttttttctgttattttttttcagatttcaggattcgggtcgtctgtcaatttggagcagaattgcacataggctgacatatttgacgcaatgcaacactgttgtataatacaacacttctgtttttattccttaacttgctgcaaatggcacgtgaatttatggatgaatttcttaaaacgaaaggcaagacagcaccaatgatttacgtatccatatatatttatattaaggtaatatccattggtaagaggagactgaacattattatctaggcttaattaagaaataaaattgatgcttagttgcttacatcccagtcatagggattagataatgtaattattcacatgattattgttgatatttcttaacgacattactagaaatataatttccaacaa

SEQ ID NO: 31309 - DNA, 1501 bp, Oryza sativa
gaaagcaggaaataagcagcctgccttgaattccaaacgtactaaatatagattaattatcataaggccccttgtcataatcttctcggaaaatcgtgatttgtcaggtcttggtaaagctaatcagaccggcgaaagggagtgctatgcattatttccttcttcgccagtagagtagctttcgtgtgatgtaatattatctgaacttaataatactactacttataagtcaaatcgttggtaaaaacaacggtaatgacgtattgtatactctgatcaatcttaaatagagaccactgtccttagggtagtatttttagtaataatttttttcagttaagctaattttataattcatggttatttatcccgtaaactttgtaataattgggtaaagcttctctgaagtaaagtccaaaataaattgtattattaaaaagagttagttactagctaaactaggtagctaatgtcatttcattactgcgaaaacagtctacctaaatacctaatgcagaatcaattatcaggcatgtgattttgcagcaatcacgcagaggattttatcaggaatcacaaatatcgccagccgaaatcaatgttcatccagcagagaaaaaaaaatatgccaagttgtcaaacacatggaacaagttgggtagcgacaagcatccaagttttcttccttctcagatggatccaattaagggcctctctaaccagatagggtcagtgttctaacctgctgacactcattagccgcccatagtatgttcttgagagtttgacaatgaagggcatcatactgggttagcagccactgacttgtgcagttctttccctggctttgacttgcatgcgagcagagaggatcagcgtgacaatgaaaatgaaaatatcatcattgacgtcatctcctgaaaatgatcttcaaacggccaatcgatttctccataatttgccatgtgctggatgtgatgatattatctgtactatctttcctgggctgatgtttatcagcaattctctgtagctttcatgcatttgttagccactagtgcatttgatagtacctataacggcttctgcatcagtgcatcacaatgctcaaataaagaaaaatgatgagattcgcccacagcaacagagttcaaaggacatacttcctcatttatttttaatatttagcgcagttgacttttaaatatatatttaataatttatcttattaaattttgtgcaaatatatatatatatatatatatatatatataataagtcatgtttaaaataactttaacaacaaaataagtcacaataaaataaatgataactacataactttactcaaatgtatatcgaaaagttaatggtgttaaatattaaagaaagcaaagggagtatttgatacatgcctatgaaatcttcttcagacataacatccttaaatccaccaaccagattccaaaactgttctggtgcataacaaacaggcaaggat

SEQ ID NO: 31310 - DNA, 224 bp, Oryza sativa
accgaacaggaccgcgcctttttcggcttcggtcgcggtttcggtcgtcgccgtcaacccggggtgagccgaggaccgccatctcgtttcctctttccctcccctctctggggcgccgctcagtcgcgccgaagttcgccgccggcgacaatcggggcgcgggcgcaccgcctcccgtcggccgtgccggcgaggccgccttcgggcgcgccccgcgtctgcca

SEQ ID NO: 31311 - DNA, 230 bp, Oryza sativa
acgctggctcggtcaccaccgctcccgccgcgtctcctcctcttccttccatctgaccaccaccggtgacgacaccgtcaaggatctccacgacccgcggcgagagaacgcgaagggcgacgggtgggaggaggtccacgagggccccgagtccgaccccgaggagtacattgcgttggtgtcggaggacgcgggcacgcacctgccggtgcgcacggagccgcgacgca

SEQ ID NO: 31312 - DNA, 1023 bp, Oryza sativa
cttctccatcatggctcgtttgaagttggctcgcacaagtatcccacccgcaagcagggcgtgaccttaatcaaggacagtgcacaaaaacttaaggtcaataggccgcaccaccctattccatgtgttagtattcacatccacttcctttgatagattgtgacggattcgactagctagtcaccacttatcgagcaaatccctgcgacggtgcatgcatactgtcaccagacacgtgcgtcccatgacatctccgcctcctctcgtattgactgcaaaattttacatatcatagatagaaacaacacttcaagattcccataggctccaccaatcgattgcaaggaaaacaaagtcctggtggaaagggatgggtcggaagaagagctaaggtgaaggagaaggtggctgaagtggttggctttatgggagggtgctgagagttatacatggatgcactttatttccggggggaatgacccgttagtgaaatggttcaatattttctttcttcaataaattctcctaaatctgggaggtgatagatatcgtttggttggtttggattaatattatttacttgttttataatgacaattttaagttgaacaatcaatgcctaaaggtgaaccacatgcaagtatgtttatgtgaatgccattattcttcagtgaaataaaagtgtgggttattttttagtagaatggtagtaattactgacttattaatatgtaatttgtttggttagtacccaaacctagccaagccaaaattttagaaatgcaaaaaaaatatagtcatgtgtgatttgtagcaaagaatttggccatgcaaagcaagtgaatatctagccaactttttggtagcaaagcaagtaaatgtctagccaacttttgtaaaaaatggcaagtgaatatctagccaatttttggttaaaaaaattcaatggtcaattattgccatttccaacaaattggaaaggcggaatggttatgaaacaaacatgccctaattgtgcctaga

SEQ ID NO: 31313 - DNA, 1501 bp, Oryza sativa
tgttgtatcaaagattcagtttcgagtgaggtttccgtggaaaacagcaaaagattcagttttgagtgaagtttcagtgggaaaaacacagtaacttgtttcaaacaagttctctacagaatacaaacaagttctctacagaaagatcacattattgtacaaaatgcaacagcatacagaaaacggcatcgtgtggagagctacagcaaacacactgaaaaacatcactgaaaagtgctatgttgacatgggctaatcggtgtccgtacgccggcggctagctcagagctcgtcgaccgtgcggggcttttgcttgccgtcgacgtggcggtggtgatgcttcttctccttgccgtgatcggcggcgtcgtcggcgccggtgacgcgctccttcacctcctccaccttctccttcgccttctccttcaccttctcgtacccctcgttcgccttctccctcgccgcctccgccgtctcccacgcggcgtccttcgccgcctccgccttctcccacgccgcgtccttcgccgcgccggccttccccttcgccgcctccttggactgcctcgccttctcgccggccgcctccgccttctcccgcgccgcgtccttcgccgccccggccttctccgccgcggcgtccttcgccgagcttgtcttctcccacgccgcgtccttcgccgacccggccttctccgccgcggcgtccttcgccgagctggtcctctcccacgcgctgtccttcgccgccccggccttctccgcggcggcgtcggtggattgccggagcgtctcctgcgccttgccggccttgtccctggcggcgtcggtggattgccggagagtctcctgcgccttgccggccttgtccttggcggcgtcggtggattgccggagagtctcctgcgccttgccggccttgtccttggcggcgtcgtacccctcgccggccttctccttggccgtctcttcgaccttggccttgccctgcttcgactgctcgtgcacctcggcgcccctctcgccggccgcctcggcggcctccttggtcttgtgcttggcctgctccgctctcctggtcgcctcgccggcggcgcccttcgccgcctccttcgtcttctcctttgcctgctcagccttgctcgacgcgcccgacgccgtcgcctccgccgcctccttcgcgtccccggccttcttgctcgtctgcctccctgcctctgcacagtcgcgcgcacacacacacacacacacacacacacccacatgttaattagctccaacacacgatggcatcaggcatggcaagatgccgccggcgagcgcgcgcggcggcgcgcggcgagtttcgacgtaccggaggcggtgtgctgggcggacttggcggcgtggccggccttgcgcgcggcgtcctcctcctcgtcgacgtcggcgacgtggtgcttcagcccgagcccctcggtgatcttctccttggcccagcccgtccacgactcgtcctcct

SEQ ID NO: 31314 - DNA, 1501 bp, Oryza sativa
aataccgatcggctttacaaaccagttaaccctgctgtcaggtactacgactttttagataatgaaaatagattatatatctggctttatgtcataagacacacaagtacaagtttattgaaaaaaatgtaaagataaaaatatatcaaaatgagtaataaaaggggacaaaatcccaactcccctttatttcaggtactgcgacttggggttgtttttgtcagcagccagagctagttgatcgatctatacttctatatatgatgggcctcattggacatgccagccaggtgttggacgaaatagacaatgctgtggtcatgttcatcacaaggctgctgctatgctgcaagatggttggggaagcaaggtgtttgtttgacctgacgatgaagtacaagtatagccgaacaaagttcacatacagcacgccacggtaatgaactcttcccgaagtacaaaacgcagcacaaaaccgatatcctatttggcctgtgcaagatgtccagggttactttgtttgatagtgcaccttattggggatcaaccagctgcagattctgatgttgcctataggctataagccacagaaggccttgagtttatcctcgtggcgagctccttcttcagaaacgcagaagcgaatgaaatcgtcgttgtcatgcgtcttgaaacggggagggtggcactcgtcgacgagctcgttaggtacctggatcatgaaattgggggaggagaagagcatgcaggtgtacctcgtggcatgcccgctcaccattatccgatgaaatggcgcgtgcagacggtcgtttgtccatgcctgaagattgcgaaaattcgaaaattaagtgtgcgatttgcttctcttgaacaattaaggacaagcatcaattatcaggtgagtgttgaagtgtgtatatgaatactcgtacaaactatccctacatttcttgtctatcaaacatgaaatgcctgaaactcaaaaaggttgcagctagcagcagaagagtcacattctgtaatttgttaggaacgggccaattgacatctactacggtgttttacaatgtttttttttcagaatgtttgctctagtcattttgctgaatttcaggaattcaattagtccataattaatattgcttacacattcttcgccgggctaacaatgtgtaagcaacattaactacggactaagaatgttgcttacacattcgatatccacaacatcgtctcacttagctactatctgtgaccgccaatccaccaaatcctcgatccaaaatgatggggaaacaaactttttttttgtacagcattatcagtgtcacatggtagaatttacactgatgcttacccggagggcattgccgacgttgacgatgagcgacgtcggcgacggctcgacgaggacccactcgccgtccctggtctgcatctcgttcccattcacctcgttctggcacacgatgctgagccagttggtgtcctgatggggaga

SEQ ID NO: 31315 - DNA, 1501 bp, Oryza sativa
ccttttaaccaataatcgtaactttgtgacactttggaccactcttacatcctttatattatccatctattgatctacatctcatatgtcaagaaaataggttgggaattcattgacgggtaagagtaagtatagctgagattgttcatatataagaaagttagggtggtccaaaatacaacaaagataagattatccgatctaaaacaaaaatattggttaaagagtgattcagatagacataccgataataaaagtgactgaaagtaaaatttactcataaatataatacacaagccgatgggtgtgttttcaataggatattaacaagtactgttggccttcatctctatttgagcgtgtgttaagaggtgtattcgctggtgtgcgcgtacgcgtagcgggatgagaggggtgcaaaaacacccgcggtcacagcgcccaattcccaaatcccaaacaccgtcgtccgccacgcccacgcgcggcaagaaacagttcgccgcgcgcgatccatttctcgtacaacacagtacgtacttccatttcgcggagcgtgtgtactgcgtaccggccccaccgaatccaccgcacggaatggcggcctatatatgcgcaggtgcagagcacttgcattcttcagattgccagagagattcagaggcagagccgcgagccccacgacaccctcctcctcctctccctatccccttctcccccaaatcatccttctcaaaatcaaaggctccgggtggtgagcgctaatcgagaggtgtgctgcttgatccaatctacacttggggttaaccgcttggtgatttagttgcgcttgcgccactagttagttaatcagtggatagttgggggttgggcgtgctgttctgctccacttgggatgcgagtttgatcgattttgcttttttattttttaagcttgctgtttctcgtgctgcattggtgagaaactagtttttgttcgtggattcagcgttttcttcgcgatcaggcgtccggttccgttttttcttagcgtttttgtcccgttttttggtgtggaatcagtctggttctcgatttagaaactagttgattacttgttctcactgttacagtggatgagatcgcgtcttcgaatgcgatttttgattgcttccatgatacgattttcctgttctcagagctagattctgtggaaagcatctctactttttttttattttggttcgcttcgtgtggagaatttagtgtgatttttgttggaattttcattgacattttgatccgtttacttgcagggattagttgttcgcggagatcgccgctatgcaggaagctcttctacctccggctcatccaggccgcttctactcggactttggcccgaagccgttcggcagcggagatcaacggctctcctcgcccaacctgctgaccaacggtggagatctcttctacggctgctactcccccttcagccctacccgcgtgctctcgccgccgc

SEQ ID NO: 31316 - DNA, 1501 bp, Oryza sativa
gtaaattttggcccaaagattacgactgtttgtatgtgaaaatggttaaggtgctctcatgcttatgatcaaacagtattcccaacctgctgaaataaaaacaaatgataaatatatgtgtgtggtttattaaattagacaatcttttctttaggttttctagtacttctttaagcaaagctatcattttcctaaccaacctggtggtaggaaatttgggtactgatgtcatgatgtgattcttgaaatctctatacttacctaacattttatttaattgtacagagcagctcatatctgatcaggtctaactgtttgaatgttagatcaatgtgccattgataattgattagttaattggttaattgcttcatttaggccacccattagcataggacctagttgactagttagcagaagtttcaccaatctcacttcagaattccaaaaggttttaccaaatctctgtagagaaagctaagaaattatcatggatggcctaaataaaaaattgtttctgttgatgtctcattttctcgttgaggagcagcatatgtagcttgtctcttagctctttgtactatagtactttgtacaaggcgttttgctcaagagagtagtgaatttatatttatctgcatattgtcccctgtcccgtgccaacaaactaaggagcactgaatgttcttaattctgacctaaatacagatgctagcacaacccaaataattaattcactggtagattgccattccccttactccttacccaaatttcatttcagagtggaatacctgaagattctgaattttcctccattttcagaaaacggggtgaaaatctctccagacataaatacctgaacacttgaattaatgccgtaactttgattttgcttgaatatctcgcagtgctgttgtactggactattatgaaattccccaacattgctggtccaaatgcaccaaacacatgtataatgtagtatgccaactctgctgtgcagagctatccactggcaagctattaattccaattaaattcctactaatataattataatctttatgatatttcattagtgtacgtgcacagctagccatgctaccttgtcaaaatttccatattccaagaagtgtaacacagtagtatacacttttcacccatggaaattttagctcatttactacaccattaaccccagaataagtttatttttcacccatttacacatactagtagtaaatcaaaatgaatttattcttcttggctattctcaatgaaatttctcaataattactcttcttggctattttaaatcatttctctttttatctattctcaatgaatttattttttacttttacaaattccgatacaataattactcaaaaataaacttattttaagataaatgattatgaaactaaaaatgcatttattctagggcagagggtgtacattttactgtaaaactaatgatgggtttgtgcgtgatagg

SEQ ID NO: 31317 - DNA, 1501 bp, Oryza sativa
gacttctcgcagcagtttgttggcggccggataaacgagacgaggcgaggcgaacgcgaaagctccccatctccctccctccctccctcattattgattgattgattcgcagattcgccgctgccaccgcatcccgcccacccaccgcgcgccaccgcctccgccgccgacgagcccccgcggccaccgccaccgccacctcatcttctctcccaccaccgctccacagccgccctcccttacatggaagtcgacgtctccatcgccacgcccgcaccgcaggtccgaccacgattccccttcctctagagctttcttcttcttccgttctcgtcaatatcccgtgaaagctccgacctttccccctcctaggttttcttttctttttttttctttctactgccctagtcgctgcgaccgcgatggatgcgatggctgtatgctgctctggttacctggtgatccgatccggcttttcgcgttcgatattacctggggattagacgcgcttgttttttttttttttgtgccttcgatctgttgcttcctgtcttaggtttccgctggtggagctgagtagtattacatcgttttctccaatatatcactctagttgactcgctgagagaataatctgtgcgttcttgtttttgttcgtgccttcgatctgttgcttcctgtcttaggtttcggctggtggagctgagtagtatagtacatcgttttccccgatatatcactccttttgacttgctgagagaataatctgtgcgtacctctttaaaaagatactacttttatcgtaccactgatgatacttgattaggactcagggatggtatctttttggatgcccagttcaggagaaatagggatcctttgttgcgtcatagcttttcgtgattcctgagattaggaccagacctttgggtctcctgatatttgtttatttcgtcctaattctctccactcagtagacctattctccaattgtttcttagtactacgtagttagggaagatacctcctctggggctttatttcttaggagaatcatcattgcttgtcaagtaccatcttaacattgtttcttttccaaccattagaggcattaagagtaaatttttgttttggaaaacaagttaccatgtagtatttcttttttgttggtttacttgtttttgcgttgctcagtagtatgtactattccagggtctttctgtgcgaaagccctactctttggcttaatgttagttgacaggatcttgacgattgtcggttttcattgcaggaatcttagctgattggtgctttggactgcaggtctggacacgttgtccgtttcctgcttgtgcagacgtaggtttggagtctttctgagtgttaaggtggctttcctttttgtccttccatggttgaaatttgtatgaacaaccttgactttctcgaagatctgtgttggtcgataagatgaatcgaagaagaacaatgctattgctta

SEQ ID NO: 31318 - DNA, 562 bp, Oryza sativa
aataggttaattccaccaaatgacattcgaaaataaatgcaatagttgaatagaaacaatagctttaaacgggatcaacatgctcaaagggttgtttgggatctgtgtgacttgccttgctggccttggaactcttcaaattcttctcctgcgaaaacggactctccggaaacgccggaatctaaacagaaagaagcaaaatcaccaaaacagcacataaacaagcatgaacagtacatgtggatatttttaacatgtagatctcatttttagaaaaatttagagacttgaaccaactaaatccgagctaagatgaattagttatgaatttttaaagattaaatcggattaaaacacttatatggattttaattgaattatgacgcaataacgaattatttttgaaaaggaaaaagggatttattgcgtcagcggctagggttttgcggtggaccaggcgcacggcagcggttcacgggaacagacggccgagatcgatcttatccaaaacgaacggccgagatcaaccgatccacggccgggccacggcagacggccatga

SEQ ID NO: 31319 - DNA, 514 bp, Oryza sativa
ggaaagggagaggggatcacggggagtgattccccccactttattgcacgcggggacggcgggaggcggcgggattcgcggcggcggcggcgctagggctcgggggaggcggcgggagcggtgggaggtcggggatgacgggtgggccccacgcgtcagcgagggtggcgggcgggcccgcccgtcagcggcgcgcgcgcggggagggaggccgaatgggccacggggagaggagagagagggggagggagatggagagatgggccgggccggcccaagggagggaagggggactttttagggtttttctttttataaaattattttaactttgtttatttcttcataattattatttgtgctctgaaaattccactaaaatttatttacacattttaggcttttaggaaatatacaaaaatcctccaagccttatttgacttttaactttgcacattttaatttttggaggctttcacatggattttaattattctaggcataatttagagga

SEQ ID NO: 31320 - DNA, 1501 bp, Oryza sativa
aaactggaactaaagatcaaaaagtacccctaggcttttgaatcgggactaatatgatttttgccatccgagtaaacatcaattctctagtagtggatgttttaattagatgatgaggcgtctacataaaattcatatgagtgaagaagagagatgacatcaacataccaatcaataataaacaataacaaaactaaaaaaaatacaacctgtgtatacagcaatggggagaacgagatgtggtggggactggggaggaatggtggcagcagctattctcaacgccaggcatccccaagaagtccataaattaaaatccctcatcatcctagtagtttggaacaatggccggtgcaagagatacaaggatcaaaagcggacatagcttgggtcaaaagcgggagcaactaaccatattggaagatatcacctaattaagatccctgtttttgtcttgtacatagcctttttggcattgatgtaatctccttccatatcgatacttaagtgaccttgtacccataaaaaaaacacaacctacatgtcaacatattaatttgcttcttcgtccctcgatatatcttgctaatcctatattttttatttaaaattactaacgaggatggtacaagccgccactatcatttatgaaagcttcctcctgtcttatactcttacactggtgaagaagtgctttttaagtcccagttcgtaacctcctgtagtcccggttttttaatcgggactacgaatccgggactaaagatcgctatctttaatcctggttcaaataaccgggactaaagatcaatctttagtcccggttggtgttaccaaccgggattaaagatggagcattttagtcaccaaccgggaataaatatattttttctttttttcctctttttcattgtttttagcattgaatattgatttcacaccatcccctaatcatgccaagaaatcccaaatccaaatcatcacatatcacagaacatctccaaatcctcaaatagatatctccaaatacatcacaaactcttaaaaaaattacatcacaagttctaaaaaatatatcacagattcacatcacacacaaatcaaatatatcacaggataaatcataaattgtaaaaaaaaaaaagccggccggccactgcctcctcccctccgtgctggccggccgccgccgcgcggccccccgcgccgccggccggcccgccgtcttcttcgctgtgaatggaaggaaaaaaaaggaaagagaaggctaggagttagagataaggaaagagataagaagttagagaggaaaaaagagatagagggaggagtttgttgtgtggacgggaaaaggatcggtactagggattatatagtgtgttttgatttttattcccggttagtaacatcaaccggaactaaaaataggtttttagtcccggttgttactaactgggactaaagatcttagggccctgacacggcctgacatggaatcaac

SEQ ID NO: 31321 - DNA, 254 bp, Oryza sativa
tagtctacatttaatactttaaatgtgtgtttgtatacatcaaaaaaattgccaaaacaactaaacacggtctatgaggtggtaataattatttcctagtttttaatttgagagtggttgtgccttatattttagaatagagggagtataagattacttatataaacatagtagagccttgtagcctagtggttacaacagtctcagtagcaccttaggtcctggagtaacggctttgtgctttcaatggtagg

SEQ ID NO: 31322 - DNA, 1197 bp, Oryza sativa
aggggaaatgtgacattaaattttatgaaggataaaaaagtgatatcatgcagatctagccaatggctaggcagatgaagacaaacaggagcattgccgtttgctatacaggaggaatgagtacaaccaataaactcatcccaaagccacctgtttcaaccttgtgagccaatgagctgatcagctgaacatgggaaaatgagggaagagaagtacctgattcagcaagaagaccccatgggaacagaaaaaaggtataggccaggaagacacgaatgaatgggctgcttgtgtgcaatgaaacaatctcactgaaggagaaacaattgtgtcggtttgtgtccaataaatcaagatgaagattggcgaatccagctgttgtgctgcaacaattagtttcatagaaaaaggggaggctaaaatgcctgctaaaatgctgcatcgaaccgaagccaccagatgagttggacatgattacatgagcccttttacagatggaaaccgcgctaacaggggaaagggatttgatggatctttgtatctggaccaggaagaaacgttttcgtgggtatggatgaacaacttgttagtgccattgctaccaggtatacatgtatcctgtaggatagtagttggacgtgggtgtagccgcgtaggcgaacagattgattcgttgtgttgttgcttgtttgtgggagctcagcatgcaagaagatcctttaatagctgcccttccagttcttttcctcttatattccttgagaagtggaagaggctgttggtttcgcagagggagagaccgtaggatggtggaaccatggaagatgaaccaaatgacagtttttgatcgagccatcaaggaggaggcgaatcgatgaggggaagaggactcgacaacgcacgatggaggaaggaggaagaggaaaggttcactggctggcccaggtgggaaaattgggctgggctcagcgagcaagagaaaaggtctcgaggaagcaatctgcaccgttaagaacgtgaatccaacggatggaattaagtggtgatgtggcttaacctcaaagcaggaaattgctaataactatactaagtggggatgatttgtataggtatataggattcggtctaatggtttatctttactccacaccctctaatctcaaatcttggcttcgcccctgcgcagcagcctcgtcg

SEQ ID NO: 31323 - DNA, 738 bp, Oryza sativa
cttgttactgatgatttagtgtgtcttgttagattgttactattgccttctagcataatggatatagcaagtatgtttagctggatagtaatgttgtgctctattaaaaacaaaggaacaatggagcggattgcccttaagtttctggtttctccgcgtggtcgaggctctgattggcgactttggtgggcaaagcccttctctaatatccttattgtttaagtttccaaagtgtatacaacctctatgtactaggtggcatctaataattagggaatctgacacaaactaggaatatcaaatagaatacataaatcaagctaggactagaattatgaacatatctaacgcaccatgccaatgtttcctgcacctatggtatttgatcccataacatccgtaacagataacctgtatgcagatggaatgttgcaaatcatgagtcctttactgacagcaattgtctaggagaaaattctagttagtgttgcagaaaattaggtgcctctttgccagcaaattcgacctttgatgccatcattgttggtgtagcagaaataatgtcatcaatgttcaatgcagtctcagttcaatgtaggtcaaatcaaaactttacaagacagatgccaacttcagttcgaaatttgagtaaagcttgttacagttctttttataaagttaatagttaatggctacggggaaaacagaagttgaccgctgttatttttgccatgcagg

SEQ ID NO: 31324 - DNA, 591 bp, Oryza sativa
aaaagagggagggaatcacggggagtgatttccccctctttatggcgcgcggggacggcgggatgcggcggaatccgcggcggcggcggcgctagggcacggacggggcggcggctgcggcgcgaggtaggggatgacgggtgggccccacccgtcagcgagggtggcgggcgggcccgcctgtcagcggcgcgcgcgcggggagagagccgatgggccgcgggggagaggagagagagggagggaattgggccgagccggcccaagagggaaagggggggggaaaaggacttcttttagggtttttctttttataaacctttttaactttgtttatttcttctcaattattatttgtgctctgaaaattccactaaaatttatttacgcattttaggcttttaggaaatatacaaaaatcctccaagccttatttgacttttaaatttgcacattttaattgttggaggctttcacacgaattttaattattctcggcacaatttcgaggatgtattttagagttgttttgggacgcgacaaatcccatcttgattattcatatcccactacatgtttcatagcataccc

SEQ ID NO: 31325 - DNA, 409 bp, Oryza sativa
agccttaatacaagtagtaacagtttaacctcccccatgtcccaagttggatccgcccctgcgagttccgatattgggtcctcccaattctcaatgccattttgttcatcggggggcatatggttcatttttgcctgcattgattcaaatgtggtttcgaatcgtttgtgaaattcgcgggtgtacttgtttatgatacatgaggccttttttcccccatgaggaggcaaactttttagtgggtggatccactagttcatgcctcaattttttttctcctcttttaagttttccaaagagctacattgttgtaaagtgtctgatacaattgattgtttattcaggttagcgcttttggcgtgtgattgatttctaaacgaattttgggccgtgaggggaagttcaatca

SEQ ID NO: 31326 - DNA, 152 bp, Oryza sativa
gtttccgtccttctccgaccgccctctctcgccccggccctatttaaaccctccccgcgcctccctcgcccgtttccgccccttgccgcaccgtctctccgccggaatcgagctcgcgacgtcgctctctctctccgccgtcgccgccgagc

SEQ ID NO: 31327 - DNA, 1501 bp, Oryza sativa
tggaccgaaatggagttttcgggttacagcctagtatatatgaacctacagggtcgcacgcttaatggggcggaataaggggattggatagagatccaatatgagcttaattcagatagggatccgaataggagttctacgggccttggaggcccgagtgatggatcttatatattcgtgaggggtgtgaccggtggagctattgcatcacgtgagaaaccctagccgtcacttccctccccgagcaaaaccatagccgcgcgcaggtgctaacacatcagcgcgtggcgttccgtccctgtacgtgtggataccggtagaggcacagctggtttgcggtgctgatcggtgtgggagtacggcgaggagaatgcacgaggaggagaaggtcgagccggtgcgatcaactacttcctctatatcgacgcgcgctacttcgcgagagttccttcgacttctcagcatcttcttccgctgcgcagcgcgtcgagtggtaacgatctatgatctaataaatgcatggttcctggtttacgcgatagaaaattttgattaatgctatcgtagcctgcgcgtatcccaacagtggtatcagagccgccttgtatagtttatgatctagatcattgcatataattgatatgcgaatgtagtagatgagatctattatgttgtatatgagttcttaggtgatcggaacatgagatgaaccgatagctgcatgggttgatgagatcaatcggtatgtgtgttggtgacttcactggaatgtctagtactcaccaaggccgagcgcgattgtgttcatcggatagtccgatgtccactggaaccgcacgccaatgagaaaatcgagccaatgagattgactcggtttcggcataatttgattacgccgttaaggttttcacatggcgaatcgtagatgagatctatgtaccccgtgttcgttgccccttagatttcgcttggggtttttatgtctatcttactatattgctgttatatatttgatatgacatggtaggatagattcccttagaaaaattaagtgtaatttatgctcttccaataattgcacctcttacggttgtgatcataagtgatgggtttgccatagcaaagtgtcactttttatcatgataaaataggatagatgtcggacatctatatgcggagattattggtttacttgacaaggttatcaaaacagttttggaccttggggtataggttgagttggacatggagatgtcaccccaacagcacaagagtcacatatgatgtgattagtaaggtgtttcttacctattttgatagttttctagctgtgatgccaaagctcactagacactaataaaatgaggatcttgactcactatgttactagagggaattttgtttcacaatacatagtgggagtatcttttgttaaattgtttaatgaaaggttaaatgtaaacatggtgctgcttttgcatacacatatttctattgtaga

SEQ ID NO: 31328 - DNA, 262 bp, Oryza sativa
gttaatgaatctaaacagactttaaacagacttttcagtatataatgaatctaaacatatatatatatgtctaagattcattaacatctaaatgaatgtaggcaaaaatcttatattgtaaaacggaggaagtagcaacatttctcaagctccaaccaaacgatgaaatttccatggagcagtttacttgctgaatagttgaatcaattagacgattgaaacaacctcttccacacttcaaaacctgtcttatctccacagg

SEQ ID NO: 31329 - DNA, 334 bp, Oryza sativa
cccccccctcccggcgtgcccgggccaggccacctccccctcctctcctcctggtccggccgctcggcccaacccgaggggcgccctcccgcccgtgccgcgcacgtgcgcgcgcgtgcgcgccgttgccgcgcgctgaccgcgcgcccgaccgcgtggggcccacgcgccaggcgcgtggtcttcctcccgcccggcttctctctctcccgtgcgaaccatagctcgctccctcctccaaatccgcttgattcaattggccaattccaaaattaattggggggttttaatccccattgaatcctcttcaattgcccccaaattcccccttgat

SEQ ID NO: 31330 - DNA, 1501 bp, Oryza sativa
gcctccaaggagctcaccaccatgctccaccactccaccgcgcacctgccgcagcagcacaacacggcggcgccggcgtccagtggccagctgctagtcaattagcgtgctgtctgtatccaccatcgacatggaaactgaaccgcgagagctcctgcaagttcgtttgctcgatcgctgctcatgttgatgattattactactgctgtttcttccttgtaatttgtaagaagtattagttaggacaagatgatgatgtacacttcaatttctacctggtgcaaatcaccatgccgccgcgagtatgtttaatttcgtaaccaagaaatcgatcaagcaaagttcgtgcctccgcgcaccttgttcttgttcttcttgcatcttgtgtgcttgttacttaaacccaatcctcggccatctcagagggttgatcaccatagtggaaaaaaaagagagataatgtcactgtcattgtaaaccctaccagtatcactggtttcgtcgctgcagcctctgcggtcaaacttcaacacatcaaaaaatcatgtgttttgaaaaaaatgagacgtggaaattacagacgaaaattctctgtgaccaaaacatgctattggaaaattttggagcaaatgcttacctgttggctcatgatcttttttttttaatctaaagtttcttcaccgtcaacgcatgcacgtgggattcctcatgttctaatgttacaagtaaaatatggccgctcgcttgttcatctagaagctttaatcaagacttgactcaactgaggctagacaattattctatcatgcgtcacgcagttcgtcaggcctttgtttatttgatcggtgcagttcgttaggctggtttgcctccatccgtttttcaatagattagctgaagatgctaatcgaaacgtcaggtctacctagagcaacatagattgattcttttgtcctgtcaggcgaggcaatctgctttcaccatacggtcagcctctaatttgtcgttcctccaactattgctcacggaattactgctaaaatcttacttcctccctcccaaaatataagcatatgtggactctgacacggtctccgagatattactttgaccaataatacatataaaagtaagatgttttaaataaagagagttacatattatgataatctgtttaatgataagtctaataacatcaattttatacgattgatcttttttttttttgctattaatagtcaaagttgaaaatgtttgacttgtcactatgctaaaaatacttatattttgggacggagggagtagtgtaaaatcacagcgttttaaacgggtggcacataaattttgcagcattttggttgcaatgccctgaataataccctaaggttataagtttaaattttcacagatgcgaatttcagattgagttatttgcggggctaaattctcaatttaaatggctgcatatatccgctttgatgtaaaggctaggtaacaaata

SEQ ID NO: 31331 - DNA, 1501 bp, Oryza sativa
ggaacgagatgcagaccagggacggcgagtgggtcctcgtcgagccgtcgccgacgtcgctcatcgtcaacgtcggcaatgccctccgggtaagcatcagtgtaaattctaccatgtgacactgataatgctgtacaaaaaaaaagtttgtttccccatcattttggatcgaggatttggtggattggcggtcacagatagtagctaagtgagacgatgttgtggatatcgaatgtgtaagcaacattcttagtccgtagttaatgttgcttacacattgttagcccggcgaagaatgtgtaagcaatattaattatggactaattgaattcctgaaattcagcaaaatgactagagcaaacattctgaaaaaaaaacattgtaaaacaccgtagtagatgtcaattggcccgttcctaacaaattacagaatgtgactcttctgctgctagctgcaacctttttgagtttcaggcatttcatgtttgatagacaagaaatgtagggatagtttgtacgagtattcatatacacacttcaacactcacctgataattgatgcttgtccttaattgttcaagagaagcaaatcgcacacttaattttcgaattttcgcaatcttcaggcatggacaaacgaccgtctgcacgcgccatttcatcggataatggtgagcgggcatgccacgaggtacacctgcatgctcttctcctcccccaatttcatgatccaggtacctaacgagctcgtcgacgagtgccaccctccccgtttcaagacgcatgacaacgacgatttcattcgcttctgcgtttctgaagaaggagctcgccacgaggataaactcaaggccttctgtggcttatagcctataggcaacatcagaatctgcagctggttgatccccaataaggtgcactatcaaacaaagtaaccctggacatcttgcacaggccaaataggatatcggttttgtgctgcgttttgtacttcgggaagagttcattaccgtggcgtgctgtatgtgaactttgttcggctatacttgtacttcatcgtcaggtcaaacaaacaccttgcttccccaaccatcttgcagcatagcagcagccttgtgatgaacatgaccacagcattgtctatttcgtccaacacctggctggcatgtccaatgaggcccatcatatatagaagtatagatcgatcaactagctctggctgctgacaaaaacaaccccaagtcgcagtacctgaaataaaggggagttgggattttgtccccttttattactcattttgatatatttttatctttacatttttttcaataaacttgtacttgtgtgtcttatgacataaagccagatatataatctattttcattatctaaaaagtcgtagtacctgacagcagggttaactggtttgtaaagccgatcggtattaactggttttcgtacaacgttgattgaaagttgtcagtttttaccgactttcagt

SEQ ID NO: 31332 - DNA, 1501 bp, Oryza sativa
ggagaggatgagaaagtccatggtgaaggagaggaggaaggcgttcttgcgcgcgtcgttctggagcgcgtactccgcgctgttcgactccgacaagctggtgaggaagtgggggaggcgcgtccccggtgaggccgccgtcgcagagagcgtcgccggcgcaatcggcgggaacgagagcgtgctgagggcaatgctgaggggtgccgacaatggcaacggctgcggcaatcggctcgaggtggaagacaaggtggtgaggattgggagggctacctatggcagggtagtgaagaggcaggcaatgagagctctcttcagacttacattggatgctgacagtaacaaaagcctgtaggttttgatactcttgattgattgtttatttagttacctagtatcttcagtaacagatgagagatttattcagcaaatgctccggtttgctcgaaggttgtaataagagtgtgggcaagaatcaaggtcaatccataagagcactattttcatgctcttctgatcttggtttcagacttgtttcagtgttgacattggttatttctcaattcattcgagtatttgttgttacatcacaaaggataagttctatagaaaaaatcttccttttcaagtgatgttctttaattttctgtagaattgtgccctgcaatttctcaaatctttgatagatggcttatttgtattgactggaaaagaaattagttgtcaataactagaagctttagagatgcaaagtattggatatatcttggcaatagtattttatattgcttgtttatgtgagaatgttttaactagatggcaactgatttctgggacaaaatcgcttctacaatagcattttatggaactcgtactcgtcgatagcatttcttggatttgggtgtttgtaaatggcatttcttggattttctcttcattaaaatagcctattcagatgaagtagaattcaggtgaagtagaaaccaactactttgggttcacaatttatatttcttttgaggataccccatttcattttagttgtcatcaaagactagacaatatcgacagaaaatggtaagcctggtttcagttggtgacaatttaacagaattcagatggatatggttctgatattagaaggtggcatacctttagtcgctgcaaacgcttcagttatctgaacaaaacaacgaacttggctgagcaggggaaaaaaatactgtagcattcattttgtgtttacatgagtaacgattcttttctaggtggacagatcacaaaaagaaaactaaagctaagatccaactcctaagggtgttaggttagggacaccatatgaatgagacaatcttaattcttggtcacacaaagattgtctcaaggttggtagcatcagtgcccaatatatcacctaactatgccatccaaaatgctacatagcatctcttgtagactgaacccttcatgaagagccccatggaggaagctcatgcaa

SEQ ID NO: 31333 - DNA, 1501 bp, Oryza sativa
tccgtcgtcgacgacggagtcggaggaggacgagcagtgggagaacgaggcggcgcgccgcggcggcggcggcgagagcacgcgggtagggctgaagggggagtagcagccgtagaagagatctccaccgttggtcagcaggttgggcgaggagagccgttgatctccgctgccgaacggcttcgggccaaagtccgagtagaagcggcctggatgagccggaggtagaagagcttcctgcatagcggcgatctccgcgaacaactaatccctgcaagtaaacggatcaaaatgtcaatgaaaattccaacaaaaatcacactaaattctccacacgaagcgaaccaaaataaaaaaaaagtagagatgctttccacagaatctagctctgagaacaggaaaatcgtatcatggaagcaatcaaaaatcgcattcgaagacgcgatctcatccactgtaacagtgagaacaagtaatcaactagtttctaaatcgagaaccagactgattccacaccaaaaaacgggacaaaaacgctaagaaaaaacggaaccggacgcctgatcgcgaagaaaacgctgaatccacgaacaaaaactagtttctcaccaatgcagcacgagaaacagcaagcttaaaaaataaaaaagcaaaatcgatcaaactcgcatcccaagtggagcagaacagcacgcccaacccccaactatccactgattaactaactagtggcgcaagcgcaactaaatcaccaagcggttaaccccaagtgtagattggatcaagcagcacacctctcgattagcgctcaccacccggagcctttgattttgagaaggatgatttgggggagaaggggatagggagaggaggaggagggtgtcgtggggctcgcggctctgcctctgaatctctctggcaatctgaagaatgcaagtgctctgcacctgcgcatatataggccgccattccgtgcggtggattcggtggggccggtacgcagtacacacgctccgcgaaatggaagtacgtactgtgttgtacgagaaatggatcgcgcgcggcgaactgtttcttgccgcgcgtgggcgtggcggacgacggtgtttgggatttgggaattgggcgctgtgaccgcgggtgtttttgcacccctctcatcccgctacgcgtacgcgcacaccagcgaatacacctcttaacacacgctcaaatagagatgaaggccaacagtacttgttaatatcctattgaaaacacacccatcggcttgtgtattatatttatgagtaaattttactttcagtcacttttattatcggtatgtctatctgaatcactctttaaccaatatttttgttttagatcggataatcttatctttgttgtattttggaccaccctaactttcttatatatgaacaatctcagctatacttactcttacccgtcaatgaattcccaacctattttcttgacatatgagatgtagatcaataga

SEQ ID NO: 31334 - DNA, 1501 bp, Oryza sativa
aaagtttttacacgaaacgcaccatttagcagtttgaaaagcgtgccactttgatccaaaatttaatccactatttttagtggattcgaacagggcctttatcaacgagtatgaaatttatccctaaaccaaaataccaaatataacgagtcttccaattcacaaaaccgaatcactcgaggttctagacagtattatgggcatgttcactttgatgcaaaaaaaaaaaccttaccaaattttggcattgtcaaaattttggcaagatttcttatacagttaccaaaatttggtagcaaactaaatgtagtcacttttttgataattttaccaaaatttggtaaggttgaaaatggcatcaaagtgaacaggccctatgtctggttttaattgacatggcaagctgagtctgcgtgggatccacacgggccccacatgttaattgaaacactttcttccacctctcacttctctcccctcccttcctcatcctcaccgcggatcttctcaccggcttcttcccagccacacccctcccctcctaggtggtcgtgcggccgtgtgccgctgttgccctcaaaaccattgtcccacctacgtcggtgataaaatagtagagagaaacggagagagggaggagaggatgggtcactaatgtgtagggttcgccaaatgctattttttttatttagactgaattgccctgacacgtggatctcacactgactcagcttgttacgtcagctaaaaccggatataatactacctaagacctcgggtgatccaattttacaaattgaggaacccgttatatctaatattgcggttcatggacgaatttcggatttgccgataaattaagggacctaaagtgaacttattccatcgatcgagcatgagcagcaaggaaggccctggccggctgctcctcgttgggccttgttcttcttcgaaggtctctccaatccaacccgtgtcagctccttccctcccattcgaatgcgcctgcaagtgccagctatataacacaccaccttcttcttccttccgctccatctccgccttgctcccaatccctcctcttcctcgtcctcttcctcctcctcttgcagtgcgagctctcccaccgccccatcccctatccatggcgaccaaagcggcgctccgatcgttgtggtcggccttcgacaagcaagcgtcatccatcattgacaagctcgtgtggccttggctgatgccagcggacgataccgaggagggcgcgaagaggcgcgcggaggagattactgaggagctcgcgcagctggagaagaccaggatgacgacgtgggcgcgatcggtggtggagagcttcgacacggcgcctcctccttcccctccgccgctgagcgctactacgcctcatcctcctcctccgtcgcctgcgaccagcagcagcaggacggcgacggcgacggcgacggcgacgccgacctcaccgacaccgacacctcccccgacc

SEQ ID NO: 31335 - DNA, 1501 bp, Oryza sativa
gcttgctcgccggggtgagcacgtcgaagtaggcgaatgtgatctcctccccggctttgatgtcccttgacgcgtggacaatggcgtggtcgccgacgtgggtgcgccgggcgttggggtggcacgagtggttgatgaacgccggcaagatccacagcccgacgccgcagttgacgacgccattgctgccgagcagattggcggatggcgctgcgtcctcggtcaagcaattgacgtcgagcactttcaagatcttgtccacatcaagagatgccttcggcgccatggccgtgccgtcatcgagctcctccgtttcttgcttgaaatgtgccatgtccgggatggggagctcgtcttctggctcctcgccggtggagagagtgtagatgagagatgccgtcctcgggcacttctcggcggcgtcgagcaccttgtcgacgaggtccttccacaccaccatcttctcgccgctatcggcggcgtccggaattactccccttccgatcgccaccgccttggagatcaccaggttagctcccgcctcgatgttcttcaccgcgaacacccctcggccgccgtgcgcggaccggcgcacctccaccgccccgacgtgctccgcgaggtctgggcacttcccggagaacccggcgagcacccactccgacagatccaccgcgccgctcctcgcctgcgcgtccaggcgcttacactgctcgaccatctcccggacctcgtcggtgccgctcacggcgagcgccgcgcggaagcactcggcggcgcgcgagtaccggccgaggccgcgcaggacggcgcccttggacagcaacgccccggggtgcgccgggtcggccgccagcgcggcgtcgcagtcggcgagcgcgccgggggcgtcgccgaggcgggcgcgggcgtcggcgcggtgggcgagggtggagcagaggacgcggcggtctttgcaggcggcggcggcgtcgaacgcctcgatgatgagggagcacacggcgatgtactccgtccagttctccttgagcagcagctgcgtcgcgcggctgcgcagctgctgcagcgagtcgtcgtcgaggccgggcgtcgccatggctgggcggcggcgtgagatttggctggggagtggtggtggtgcgccgcggggcggcaatgtcggaggtgtttgtttggctcggtttcgaaagctcgcggctttacagcgtaacggtcggatctgatttctgaatagtttttcgaacgaaacaattctgaattttttaaactcactggagtgaatgcagtagcaacggctatgagctgtcacacactcacagtagtactccgtaatatagacgtcataatggtcatcttgtaaaaaacaaatactccgtatgtaggttatattggagtgaaaaaatatgtattggtcatcttgtacaatgcaatggacttgtgctcggtagagaagaagtgatgaatgaaataaatctagggcttgagaccgggtgactctctc

SEQ ID NO: 31336 - DNA, 1501 bp, Oryza sativa
tagccaccaacttaggttttagtggagcccaaagtgcagacacagaaaacatgctatgtgatctagcatcacaaatgctgtagaacaacattttggcgtgcatcagttcttcccagatgattcagaaattgcgcgactcatttcagtttccggatttgtcatcctttgctcattgttgttttttgttccatgaaatttatttacataattgttctggagtacctttccattgtgctgacgctgaaaattgttcatcttgaatggcatgttgcaaagtttatataacctggtatcctttttgtgcctgtcaggtgctgtggccgagtgaagctgccccacttctactgctgtagcggagaaaaagggaaccccggcgactcaagctcataaacctgttctgtttctccccaagttcagtctgcactcagcacatcaagcaatgtctgaacactattccaccatgaacgttttcagatctcattttgtgttcggccgctgttctgttttcaagctttttaatcagtgtacacactttaaacccagcttggatttcaaaactccccttgtcaaaaactcaaatgccactcgtgacatgaatggatgcattctgtctgagacaagaaccaaatgtgtgcatgtgccttgctagaagaaagaaataaagggcctcatcttttttttgcttatgcttatgtttatcagctaaaatttaaattttcaaccttaaatttggagttgattttggggttttttaatcaaagtttatttttcagcccttgtttttagatagctaagaacacgtatataaaacaattaaagttgtattcacgaattatttttcgtttgccaatatgccgtttcgcttattccctggtagagccgaaaagtgtaacaatccagcagcacggacaggggcgaagctagcatcaaaataagaggggtgcactaccattgagaatctagaaaatttcagcacataactgcacattctagtatttttaagtccgaaattaggaatctggcacatagtatagtttcgccactgccgcacggaaggtgggcgaggaagactggaagagagatgccagttcgagatgcggatgctctttcattttcgtgccgtttccggtgcggtgcaggtgcaaaaatgctgcaaccacacgcgcgcagtggtggtgcgggtttggtagaggacgaaaccgcggtcgttggcttggccttggctggctcgcctcagagccgccaccaactaaccaaccaaaaactcctccccaacccaaaaacgcgacgaaattcgctggcccccacgctgcgatttatgtggaccggctgcggcttgggtgcagcagcgagcagataacgaggcgaagcggagccagatttccctctcctctcctctcctcctacgcgacgcctcctagccgccaccgcttcaccaaatcaaaagctctcgctgctcctcgagagggagttggtggagagagaaagagagagagagaga

SEQ ID NO: 31337 - DNA, 1501 bp, Oryza sativa
tggtgtttgcctcctactacaacaaacgacataagaaaaaacggagggagcaatggagtgtggtatttcctcttatatgcaaggaactacttgggtcaatatctgaaaggctacattttggtatttattaatatatatataagagcacaagatggcttttgacctcattcttttgagctcttcagcttcttcttgagaaagaccatgattgcaaccagaaaaggccagcatgtccatctcatagcgtaaatgcaaggctgcaaatgatcccttggcctgaagtttctgcaccagtttattccccaaggcctcaatttgaggggtgaacttcagtgcatgaaaattaacacggcacctaagtagttgaagctgtgtactgataccattgtttgctaaccgagcatccgtcttgttaaaatggatgacgctatatttgctgaataatggtaagatctgcatagataagataccatgaagagtatataatatatagtaagcatgtgtcaagcaagatatatgtacaaacctgatgcaagtaatatttttcatcagaccagctcacaggtggcatattaagtatattgtttgaatcctctggaccaaacctcttcggaagctgtttaacaatgtgcacttcatctcttaatgtgtcaatgaaatgtttaacatcaaatatatcttcaaaattgctgcaaagtattgcaaaaatatcgcacatttcagatattaacatggtaggtccggtacataacctatcctacaaaatgaaaaatacctttgatcagcccagaatgacctcttgtctagttctgggacaaccattgtaaggtttagcaagcgagcaaccgccaccatgtcacatatctggaatatatggtttcaaaataacagaagtataaaaaagtgagagacaatataatactgagcagcaaaactaactcaagtaaaaaaaaaaacaactgacctctgaacgcatctgattcaaacccccattgcaagataccttcagataaccattactcttatagactcctaaaaacaaaaaaatcaagttaaaactgatatgcccaagtgatgattaatgctgcttcttaagtaaacattcaaaaaaatgaggatgtcaatcagctagtgcatccatttatgttctgccgtgacttctagagtgaaaaccatttttctcatcaatcgcaactgtacttgaagcagccgcttctacaacttcactaacttactatcgatttgggaaagggcaataacaagttcatccacatttgaatccaatacactttcatttgtacaattctactcatccctacagaatgccaccaaatccatacacatcaaaattcaaaactgaacaaaacttaaatcaaactccgcgaagaaataactaaacaaataaacaaataaataagacacggaggagatcacgcacttcgaggcggaagcgcggtgggcggaggcgagggctccgcgtcgccggcgaggccgaacaagg

SEQ ID NO: 31338 - DNA, 412 bp, Oryza sativa
attcaaaaaatttacataattataatttattttgttatgagttattttatcactcatagtactttaagtgtgatttatatcttatacatttgcataaattttttgaataagacgaatggtcaaacatgtgagaaaaagtcaacggcatcatctattaaaaaacggagggagtagtaaatactgaaaaagttagaacacgcatgcacattagagtatttagaacctacataaattgtttccccaaaaaaaatggtttcgttcggttttaaataatgttttataactcaattaacctactttattttgtatgtacaaaattagtcaagaatattggtggtttctataagtgagatttcataagatccattttactcaaaaacctactttttcttggtataccatcttggcacca

SEQ ID NO: 31339 - DNA, 1215 bp, Oryza sativa
agacatgcttaaagtgcttttgatggtaaatctagtaatactccttttgctttacttaaactaagtaattgtataaatattggttgttatatattaaacacttgatcaaacaccaccggtccaaacactcaggaattataacattccagtccttttgaaataaaccctgttaaagtatataagaatggacacctaggttaacacaaaccccgaagttggggtcaacaccataccttgtgggacctcttgggagttcaatagcaacaaaccattgcaccacctagaaggtgatgacatgatgtggtatattaagtactagcataatgcccctgcgttgcaacggattctaaataacatttattgacataaattaaaatcctaaaccatgcatatatcacaattagactgaagggaatatgatcacagaaataacagtattaaactacaactaactttggctggaacgatatttcaatatcagaaaaaattatataactaaatccttattttatttagctataaataattcaatacagaggaaattgcaagttacaataattttttagtggatcaaatagcactaaaactaatatcgcaaacgaaaaaacaaatgaaattaactagaaattaaaaaagaacctattttagcccattgatgaaaatttgatccataaaatctgaacgggtacccgtttcattgatataaattagaatttcatgttctgatcatattcctatgatctcaatattatgtaagtggtccaggagcatggttgggctagaccacgaaggattagagccttcgtccatagatggtggaggttgccaatgaaaaaaaaaatcaaaacaacatgaaacaagaaacagaaaaggagggaagatggacatcagtcctccggcgaccaaactgtggtgagtaaggtggccggacatgccccacgatgtgactagttcgtagatggtggtggttggcaatgaagaaaaccagaatagcaggaacaacaatgatgtggtcctgatagagagagaaacagtaacgacaagctctggtggtgaggacgaccagatgagtgcgtcaaaacgtgttcctggatgaggaggttccgttttccttgaatgtgtaggaagaacgaaagatggagaaaggcgactaacgttgttcattgtcttccctagcctaaacaaaaacagaacatgagtgaagatgggcgctca

SEQ ID NO: 31340 - DNA, 1501 bp, Oryza sativa
ggccccgtttagttccccaaatttttttcctaaaaacatcacatcgaatctttagacacatgcatgaagcattaaatataaataaataaaaaaactaattgcacagttagggaggaaattgcgagatgaatcttttgagtctaattagaccatgattagccataagtgctatagtaacccacatgtgctaatgacggattaattaggctcaaaagattcatctcgcggtttccaggccagttataaaattagtttttttattcgtgtctgaaaagcccttccgacatctggtcaaacattctatgtgacacccaaaaattttctttttgcgaactaaacgagccttactctacaatttgtttttgagggttttatttgcgtggtggtgggtgtgtacacaccaagccgtttggaaccttcccatcctcccactctcacgtgccaaccacatcttccgttttgcaaaaccatgttcacctcctctcgaggtccatttttctatgcgatccacttggatccgtccatgatcctctgctccttttttcttctccttttcccatgatagccggcgcggttgttagctgtgtgtgtgatgtgaagaacgttgttgctgctactatacatgtgtgcgtgtgcggtgacagatggtggaatgtttctgcaggtggtaaataaataaataaaattatgcgcacaactcactatttatctatcgttgttactcacgtcgtccagatggttgtcaagtgtcaacgcaacaaaacaattggatccgtaccaacaaggcaacaagccaactgtgtacattcatcatcttctttcgtactccctctgatgtttgtatttattactacatccatcctataatagttacatttctaccatttaaattttttccaacaaaaatatatttttataagatgtgacacaacaaaggaaatgtgtgacccaatcttccttttaattaagtttgcatatggaatatgttcttcaaccttcattttaatcaagtatacatatgaattatacacatgtagtgtagttattaaatagggttattgtggtaaattatgtttgttgttaatttgtttctaattatttccaaattttagtaaggctttaaattgaacatgtcgaacgctacccaaaatttggtcaaaatgtgttagggttaaaagtggtgaacaagcctgtaatagtaaattttctttggcaaaattggttatatagcatcaaaagtttacttttttattttatagcaccgaaagataccggttcactttaattgcacccaaagttcactttgtttccatttttaacacttccgtcaattctcgatcgttttccatccgccttaatcgctattgacccagccacgcacatgatatgacgtttctacctctcacaaatacaagtagaatccatggcaatgaggggtagaaatatcatattgtgtgcgtggctatgtcaatagcgattaaggcggacggaaaacgatcga

SEQ ID NO: 31341 - DNA, 536 bp, Oryza sativa
tcatgctaaatatcgatgctttctcccgatgctctgcgagtatcaagtatgcaggctttcaatcccggcgcggcgctcaccacgatatcttatcattatccagtactcatgcggattatcagggctttcatcaatttcccgtccaattcatctggtggctcatatggattatccgggcattgatttgatctttcgattcagaaaacattggtcgatcttggctgggaatgagatctatatagggcatatatgcagggtaaacaactaatttgtcctccgtcaacatgatttcatttgcagctcctgacatcaggcgattggtgtcttcctggtgtttatctttcctactcccatcagtatttggatgaggtacattttctctccccttattctcctacgttgagttcattggctcgatcccaaatttatcagcttttggttaagctgatgtctatactgtactctctttttttttctccccttacatcaaatagcgaagctttaggtattcttcagtctgccccattggctggaaa

SEQ ID NO: 31342 - DNA, 1501 bp, Oryza sativa
ttctctgttatacatctgttacagggattgaggtgagagaggaaacaagccaggaaagaatagaccagaactagggaccagaccttaaaagaactaactcttcttattgatgtattgtttgtttcacttattctgcaagttgattaagcaaacaacctaacatggttacatcacaacccaccgatgcaaaccacgcgctacacacacaagcaaggaacacacgactaacaacactaccctacagggtggcttaggttctgcgacgggttctccaagatcttcactgcttcctccacttcgctagcagaccctgcggtcttccggagcttcggcagacaattgacgacatcttcttctccgcaaagctgaccatctagtactagttgaaatttgaagaaggaagaaagagtaaatattttgcaaatagcacaggggaaaggaggaaaaagggactttcggaaatagtttcatttataaaatatgtccttaggttttatccacttggcttatcctacagtcgagatggctctgataccagcttgtcgcgaccgggagaattgccttttcccgaacgctagtgtattaatccccgtcccaggaaaagccggggtacaccacacaaacatgatataaaagacacatctttattatatcgataatatttacattattacaaaggcgcttcaggcctggcgatcaaaaataaacagcagcggactagcgggcctacggctccatcttcacaggcgctcaactggggtataagccaagactccacctaagacttcttctccaaaacttctcttactgaggggggagaaagatagagcaagaatgagtacaaccacagtactcagcaagccacatcggagatgcataattaatgcaagcggggggtacaaggggataataatataggggttaagttttgcagaaaacagcatttaaaagccacttagttgaccaaagccatttataaagacgatcctagcgctacacaatattattaatcaaggccgtgaaccttcacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaaccccacctacggccggaacccccgggacaggtaggcaggactgagccgctagcagcaggacaccggccctgtgccatgacatctcgactaccgggccgcagctcgtgtagccttcatttgccctggaga

SEQ ID NO: 31343 - DNA, 289 bp, Oryza sativa
tgaaaatactctctgaaagagcataatattgtaatcagtggcacatctctcttttttttttctcaggcagaaaagcttttcattatatgaatatgcagcagcttacaaaaataatgcatcgatcaagcacatgtaatgtatatatgtacagtacctatagaatgactaactttggccggccttctatatttcttgtgtgtaaaaaaggctatgcatatataaaaagaaaaccataagagatagatatagaaaagaatgaagaactgcaactatatatatactttgtagg

SEQ ID NO: 31344 - DNA, 1501 bp, Oryza sativa
caaaaataaacagcagcggactagcgggcctacggctccatcttcacaggcgctcaactggggtataagccaagactccacctaagacttcttctccaaaacttctcttactgaggggggagaaagatagagcaagaatgagtacaaccacagtactcagcaagccacatcggagatgcataattaatgcaagcggggggtacaaggggataataatataggggttaagttttgcagaaaacagcatttaaaagccacttagttgaccaaagccatttataaagacgatcctagcgctacacaatattattaatcaaggccgtgaaccttcacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaaccccacctacggccggaacccccgggacaggtaggcaggactgagccgctagcagcaggacaccggccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccggaaaacaggttttaggggttttgaaagaggaagagaggtgtatgtccaattccaccataatccaacaattccatagtgtccaggtgatatgagtattcccaaggtctagagttataaaaccacctaatgttgcctaattaatccgcgaagcatctacctaaattcatactagtggaaccatgaatagagtacccactagttggggttttgcttaatctagggtgaacaaggtaataatatcaataacaataatattaaggttataacaaaggtaaataggcatggctaaataaaacagtgatcacgcgggaatttaaataaagcgataatgcaataatttaaatcaaaataattttatgaactgggattcaacatgttcaaggatgatgtgacttgccttgcttagagagaacggccttccgaaccttcggcgacgaccgcgaaccacgcttcgggaacctccagaacgacgaagctacgcgaggcacacaagcaaagctacaa

SEQ ID NO: 31345 - DNA, 1038 bp, Oryza sativa
ataggactgcatattgctatcattcacaggagaagtttccttctgattgctggttgaggcgaataacggtcttctgcttggtatcgccctccggaggttgattgtccttggctcggcctggagtaggtcggggagagacacaacttcttccatcgatgacaattctttgctgaggcggtcggtgcagagaatggttggtgctgaaggtattatcgctatgacttactgcagagtcaggtgcagcgagaggagcattggtgctgtggatgatatcgtcgatgttgctgttggagctgactagctgatgagacaatcgtagggttgttcgttggatttctgcggtcttggtcaacaacacactgagttggcaatccttgggcacatggtttgtaccttcgcacagaaaacatgtgaccttgcgggtgggacactcccctggtggatggtcttcttcacaatgagtgcagagtgtgagacacacgctagcaacgtgttcaatttccccgcaacgggtgcatgcctttgattccatctcttcctcgccgagatgtcggggagactcatcttcatcatccgaggagacttgatctgacccttcactatcagatactctgccaccatggcttaagaggtgctgggtcaactgtcgtgcacctcggaaagtatttcctctttgacgtctaggaatagttatccctgctggaggccattcggtgctggtaatagtcatcttacgtacttcttcttcagttcgcatcggtgcttttctcttctgattcttactcttcttgcctttggcttgcttagtatgtgaccccacgtggtacgagaggctaggaggaaagcatttcccgggattcaatggattctctccgttgagctctctactttgcacactaggctgcaagcttgacttggtgtgaggaggctggtttagcgatgtctgccctgctaaaccagggaaggggcttctttgacatatacccatggacaattcagggcatagtgtccttgctctctacaatcatgacaaaaggg

SEQ ID NO: 31346 - DNA, 1501 bp, Oryza sativa
atacaaagcctatttctccgtgcctttttgtctccccacccaagatgagcgtaccgcacagtcgcacacaccctccctgccgtagcgtatataggcccagaaagcaagagtcgagagaaacagaaagacgccgagacgcggagaggtgctggccggcggccggccgcgcgcacgcccgcacgcgcgcgcgcgcatgtatatgctgtctccgatccgacgcgacgatgctccatccgatccgacgcgacgtgtggagctagctagcgcgagccgcccgtacgcgatgtacgcccgcgcgtgccgcggtcaaccgggatgtggagtggatcgcacaggatcagtactgctgctgctgctcttttattgctgcgcggagtgtcggagcgctagaccgagagcccggccggccctgaatcacgctcgggtgtgaccccatgaggtgactagtgatacggtgatgccgcgagctttgcctcttacggcaagtacaataacttgaaattaccggctaatagtaagcttacgttggattttatacctacgtggtggagagagagtaccaagagaaaaacatcgtcgattaatctgtcgacgatcatgcacgggcaccaatacacctagcactggtttgaagcctttctatcgacagcaccatcgacggaacaaaaaattagcatgaataatctttcctgattggcttggaggaaagagaaaagctgggaaggagcgagagagaagtaattaaataattattgatatgtgtgctgcagtaaatgtaaagagacaactattatatttattatctattaagttacctccaaataacgtgtataaagattagagtaagcagtcgtcttttttattgcccttgcccttatctcctctgatcacaactacctcgactgagtgcgtgcgtgggccatccgtgtgcctgcctgcctcactggccgtcgtcatatgacaagcaatgtgaatatagtgcaccgggcacggcctgtttgctgcttgcattccctgcgcgcggcaatgtatactgtagatgaccgtgaaattcagcagtcgatgaaaatctgaaatacttccatcgagagcatcggctctgcgccggatggccaatatcaatcaatcagcatttaatttgacaattttaccttttgtaaaaactaatttcgcaaataaaccgcggccaaaactacccttttatttagcgtcaaatcgtatggcgctaaacttagacatatcagcgtcaaatagcacggcgttgaatgcacgttggcacgccgactcagcctcccatccgcggtggcacagcattcagcgccagttgacgtgatgctgaggtgtctaagttcagcgtcatacgatttgacgcttaacaaaagggtcatttttaaataagttttggtcgcgattcatttgtgaaattagttttcggagaggatcaaattataaatttttgtgaatcaatcagtccgtcctccatatgtaatcaagagcgagg

SEQ ID NO: 31347 - DNA, 1501 bp, Oryza sativa
aatgtaaagaaagtgaatccgagttgcctgttcgtgggaactattcccagttatgaaccaagtgaaatgttcgaagatagtctatagaggtcagattaaaattgcatctaacaacaaagcttcagatttggcaggaaaacgatcagacaataacaagttcagcagtaaagtcatttaggaagacgtcaaagcatgtcaagtgggataagttggttctgttgagaaacataattcaaaggcaaagttatcgaccctcgcatcgaatagcagaagtagctagcacccggagaccaggaaaactaatatgaggcagtttgtggcaagatagaagtaaatgacaagcatgatattcttatgatgacgaacatggtatcctagtaatgaccagctagtgttgacgcatgacatgaagtggtaacttgtatgaggttgacgccaaagatatgaactatgagaagttctggatctgaagccccatcatcaagtgccacaacccagtcgaagtcagctaaaggttcaaccagggacaagtcgggtgaagagaagattctatccgcaacaggagatcgagacaagcagtacagagtggagaagttttgctaggcaagtttgttataaaagacgcgatggaagaagtcagacaagaagagaagaccgcccaacctatcttcatgctagcctcctcgaatctcggggacgagattcttgtaaggggggtggatttgtcacgtcctgataaattcatcccgaaataaaaatcattttctaaaaggaataatagaattaattaaaattcgaaaagaaattggcaaacactaaaatacgtgcaagaaaaattcgaatgtggcccggagaatttttgttaaattctccttggtctaaaaagagccctcaaattttacttgaattttcagagcaccggaaataattattaaacaacaaaaacaattatcaaagtttaataaaaagaaaaatctaaaaataatcctccttttcttttgggccaattttggcccaaagtccttcctctctcccctcggcccgcggccgaagtctccctttcctccctctctttctctccctctccttctctccctcctcttgggccccccttcccctcggcccagctccctcccccctctctctcccgggctgcctcttccccccccctcccctcccggcctgcccggcccaggccgcctccccctcctctcctcctgggccggccgcccggcccaacccgagcggcgccctcccgcccgtgccgcgcacgtgcgcgcgcctgcgcgccgttgccgcgcgctgagcgcgcgccccgcgtgggacccgcctgccaggccggtcatcttcctcctcccgcacggccctctctctctcccgtgaaaaccctacttagttcctccctcgaatccgcgcgatttaagcgttggattccaaaattaattggggggttttaatccccattgaatcctcttcaattgcccccaaattcccccttgat

SEQ ID NO: 31348 - DNA, 627 bp, Oryza sativa
cccttttatcactttcgccttttttccaacctcgctgctcttccaagtgaccaatggcagccacacagaaacacctgtggctggtaaattaattaacacgcctagctggctctgcacttcttcagcttgttcaatgatactactacatcaagcttgtatagctagctagctgtagtagtgtacagtacagggccacagtatgtacagatctgcaacaagctgtacaaatactcctacatgagtgatcatgctgcaggaaaaacgtacaccagaaatcagaactcacatgagcatgagcagactagactgatctgctgctctaccagagcacctgtattccaatacgctcctgtcccctcaacctttctgtagtatatactaagatctcaaaaaaaaaacattctgaatactatctctgtgactgacttgtgggcccggaggcgatggtgctcacagggttgcagcgtggtgggcccggaggacgatctgtaaaaatatctgcgcagagcctttttgcgcttttacagttgtatttgtatacgctgggtagagtacatgcaagtgtacaaatacagtagaatacgggttggtggcgtagagaaaacctggagactttgcctgccatga

SEQ ID NO: 31349 - DNA, 1501 bp, Oryza sativa
ctcgtcgtctcgcggtgccgcctccgtcgtcggattcgcagcggcgcgttccacgtcgtccccgtctccgtgcagctgccgccggctgccctcgtcgtctcctcgctggccccggtcgtcgtcgtcgtcgtcctcccgtcgttcccggtcgtcgtggcgttcgtccctccgtcaagccgttctcgtccgtcgtccgcgtttgtcaagtgtgccgctgcagccccgtcgtcgtcttcgtcctcgactccgcgtcgtcacgcctcgtgccggccgcgtctcgccttcgtccaaggatcgccgccgaagtcgtcccctcgccgttcgtccccgtagttcccggccgcctccgccgcgcccgttcgtcgttgtcgttcccacgcctcgtcgcgtggtggtaaggatccctccccctcgctgccctgtcctcgtcctttcggtgtcgcccgtgcccgttgtgcggttgtcggccccggtacccgtgtatcggtgtcggcagtcgttcgcttgtgcgcgtggtgaccgtgttagtgtgtccgctcggtagccgcgtggtttccacgtgtgcaacccgtgtggtgtttagtggagtccgtttgtcagccactcgcctcagttgacacacgggatccgcttccgtcgacccgtggaccgtctctgtgcactcggtctaccgcggtcctttaggttgacatgtggggtccgcatgtcaacagcgcagccttcctgtcttttctaggctagcgcttacacatgttttatagttgcaaagcttaattataataatccgcaaatctccatgtaacagcattaaacttcggatgatcatatcttggtcatacgaactctgaatcgacccgttcaagtctcctaatgtttgttataacctaaagaaccctgtgttttctttttatgtattgttattgcttctttataggcttgtagctttgcttgtgtgcttcgcgtagcttctgtcgttccggaggttcccgaagcgtggttcgtggtcgtcgccaaaggttcggaaggccgttctctctgagcaaggcaagtcacatcatccttgagcatattgaatcccagtttataaaattattttaatttaaattaatgcattatcgctttatttaaattcccgcgttatcactgttttatttagccatgcctatttacctttgttatgaccttattattattgctattgttattattaccttgttcaccctaggataaacaaaaccccaactagtgggtactctattcatggttccactagtatgaatttaggtagatgcttcgctgattaattaggcaacattaggtggttttataactttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccgaccactataaggattaa

SEQ ID NO: 31350 - DNA, 1501 bp, Oryza sativa
ttgggacaaaggaaatatgttgttgaattcctttgtatataaaggtagcaaatcctccacttccataggaaagaaaagcattcagtgtgactgtgtgagccaaaggaaattctcctcctcctctcagtttttttttccattcatggctttgtatgtctctctcgtatatttttttccatgtgatccaaacaacacaaaattttcactattcatgtacttgaattcctaagttttttaccttacacaaattaagggctccttcggaaacacaatattctcaaaacacaattgcatgaaaaatacaggattgcagtgtcatagcacctcaaatcctatagattgaaaaaaatgtgggaaacctatagaaattacgatggagcgcggtaaaaacataaaaaattgaaaagagagactgacacaatggatttttttccccagaggttgaagctcatgttagaattcttccaaatttatatgttttgagccaatccaaagcaatttcacagaatttttggatagctatttctttgacccaaatgatcacataggaaattttttcgtaggattaaattcctctaaaatcatttgtttcaaaagagccttatattttattcctgtatattttcatgttcctgtgttgtccattctttgtttcaaacagggcctatgcaagcatctcttcggaaggcttaacagtacagcacgggccacttgcgtggaagttgcttgctgcatcgccaaactgaccagtttgtacggactacgcaagtacttcaccactgcacacgcttcagcgatactggaggtcaggaagccggcaggaagtagcagatcgttagaactccacagcttaatcaattcctgcacgaactggagcaacactactcctatggagtacaagaacatataatttgtcctctcaaaaaaaaacaatataattcgtcgctcgtgcggaggagcaaattaaagaagatcatgaacaggatcgatctcactggacgttcacgttttatcattcattctccaacatggtcgtctagaccctgtttagattttaacttttttcttcaaacttccaactttttcgtcacatcaaattttcctatccacgcaaactcaacttttccgtcacatcgttttaatttcttcaaactttcaactttaacgtggaattaaacacagtcctaattgcaaagatgcgaacacgttgatcgagtcaaaaagaattatagtattactttagtagcatcctccgtctgtaaatctaactaggcctcctcacatcgcatgcagagatggatgcgcatccacacagaaaggggaggaacaataagaagtaaaaaacaaaaccaaaaaaaaaaagaatacacgtacacgtttgagtcctactcgatcgagcacacatgacacgtgtgtatgtatgtacaccggccgcggcctggccacgtgctaccaccaggtgggcaccttcctcccgccgccgcccgcggcggccacggcg

SEQ ID NO: 31351 - DNA, 806 bp, Oryza sativa
taatccgatttaatcttcaaaaattcataactaattcatcttagctccgatttagttggttcaagtctctaaatttttctaaaattgagatctacaggttaaaaatatccacatgtactgttcatgcttgtttatgtgctgttttggtgattttgctcttttctgcttagattccgttgtttccggagagtccgttttcgcaggagaagaatttgaagagttccaaggccagcaaggcaagtcacacagatcccaaacaaccctttgagcatgttgatcctatttaaagctattatttctattcaactattgcatttattttcgaatgtcattgggtggaaataacctattgtttgttatagcccttttgttcttgattactttattccttgataccttgggttattataatttgactagttgagctttatatattggttcaactagatattagatataattgcttagccctgcttagaaacattagcacactattgggataacttatgactcactattatttaatgatttcacgatggtcaatcgtgattggttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcgtgggcaacggctttatcttttgtataacatggttcattgcggagcaccagactgagaagtggcggagataagcccacgggggtcgctggggagtccatgccttgtttataagg

SEQ ID NO: 31352 - DNA, 794 bp, Oryza sativa
ttccccagtctgatggtagttgcctacttgggacagccgaatctgcgaggatcttcggtgatccggatcagaatttccatgtctgttccaaccgctatggatcggctgcatgtatcagcaggagttcttttttttaatgctacaattctccaatctctgaacatgtgaccaacaaccaaacagttttttttttcttttttcatagaaacttgaaacagggaaatcaatcagtggaatattagatcgaccacgatgcagcttatggcatactaattctcaaatcaaacatgcatgcagttcacaggatctgaggaatttaagctaagcattgacgcgggataatcttgaattcttgacaaaaataagaggagcagtttatgacagcaaatattcacattttgaaagtgtattcctcaaagattcattctacaatgttctgtagttaaaaccacaaagttccaatatcctacagcaaatttggaaaaaaaatatatgatgcctttagactcttgtttaatgttcctcttcaaagagtaggcaaagctagcagcaatgcaaaaatagcttatcttggcagaaacagtcattttcacgggtccggaactgagttgaagacagcatgataattggagagatcatagaacgaagttgactagtccctgttgccccagtttcagacgttcctcccaactctagtgctcgactgagggaggctaactttgactctactcccaatatatgtccttctaattcaggtcggttttagattgcataaattaattaaggcctaatta

SEQ ID NO: 31353 - DNA, 1501 bp, Oryza sativa
ggcggccataggcacggcggagcggcggccgggagaggggagggaagggggaaacgaaatgggcggtccacggttcaccccgggtcgacggcgacgacgggaacggcgaccggagcggaggaaggcggcggcgcggctcgggtcgacgaggacggcggtgttccggcggtcggcgggcgaaacggaggggtggacgaggtcggcgaggacgcggcgaagccgaagaaggcgacgccgaagcaggagaaggtccggggcgacgacggcggcggaccggagctcggcggtgacggcggagagagggagcgacggcgcgagctcgattccggcggagagagagagcggcgagaggcggaaacggcggagggaggcacggggagtgtttatatagggttgggagggggagagagcggccggatgagggggaatcggccgcggaagatccggccgccattgatgcgctggcgaggtttagggggaaatgattccgagcgaatccgagggagagagagagggagaaatggggggaaagggggagggaatcacggggagtgatttccccctctttattgcgcgcgtggacggcgggaggcggcgggattcgtggcgacggcggcgctagggcacgggcgaggcggcgggagcggcgcgaggtaggggatgacgggtgggccccacccgtcagcgagggtggcgggcgggcccgcccgtcagcggcgcgcgcgcggggaggaggctgattgggccgcgggggagaggagagagagggagagggaggtgggccgagccggcccaagaagggaaggggggaaaaaaagactttttagggtttttctttttataaactcattttaactttgtttatttctttttaattattatttgtgctctgaaaattccactaaaatttatttacgcattttaggcttttaggaaatatacaaaaatcctccaagccttatttgacttttaacttagcacattttaattgttggaggctttcacaaggattttacttattctatgcataatttcgaggatgtattttagagtcgttttgggacgcgacatcaccgcccgcaagagtacctccaggcccgagcttgttcgtcagtccctggcgtggacatgcttcatggagacccctcgcgccgagcccacgcccttggttcctcaggaggagggagcctctggcgttggtagcacggaggatgcgctgctgctcaccttccgccctggcccgtcgcagaagtagacgagcagttagtaggcttgcgcgtgtattcttctcgtttgtttttctggttgagtcatgtggggcatggttataccggtgtgtggtataactgtgtcgaagcctgtctttattttatttgcttaagcaacttgaaccttaatgaaccaatttaatagcagaaataaattcaagaattatggtagtcgtgggtggttagttttaatagtcagctctctctgtttgctggttctgtgtggtattttc

SEQ ID NO: 31354 - DNA, 1501 bp, Oryza sativa
aattgaacaaaccaagcatatagtcaaggaataaataatccaaccaaccaagtggttttgataattgtagtcaaccaagtgacttaatattaatatatagcaacatgatccaagtgatataccgactgctttgtaaaaattgatgcatgcaacctaaagctgactacatcattgaaaattcacatagcaaaacaactataaaaaagctcgaatgctgtgagtaaagaaatttccaaagtattggacatacgccatgcgcacactgctttaacagatgtgcttaagtccctaaaagacacatggtttcactacacccaaaaatatacggcatatgtggtgtaaaattcgagtaaataaactcataaaggatttaccaaccgcctggaaaatgaccaaaatatataatcagcctaagccataatattggtcaataaaagtgcacacttacgtggcaaaaagcaatgatattgtatccaatcaattgctttatgaacccaaacaacgccttgatttatataaaaaagtcagcgggcagctatataaagcattactgtttggcaccttttaaaatgcaatgtaccaactcctaaaaagttgagtaactgcgatataaaaggattttaaggtattgggcacataatcacgcgcacttttgcctaagcaaaaagatgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtgatatagaccaagtatagctcatatgaatagcttctgatctgagtgattatcccttatgggatactccgaaatagatataataattgaatcccgactgacacaagtattcggttgataacccttatagggaataataaatagtccagtctttgagcatagaaaatagacccatgtttatgaattcatgttgcatgtatccagagcaagtccaaattgaaggtatgatacttgtgtttgagctaagcccctgagcatatagcttgtccttctgtcgtaatcacagttgtccattgatcgtagctgacgcagttggcatagagacaagacgaccaatatagagataatattgcctaccagaggtggcaaaaatattggtggtagtgaagataatgataccaatcaaaagtgatgaagttgcatagccgtggaggcgaagaaaccagtcggtagcagtcaggtcagccagcaatgaatatgaaggcgcccagcgataaagttgtgtagccatggcagcgaaataatcagtcgatgacagacgaggcagctggtgaagaagatgaagatgcccattagtggcgacataataagccattcgtgaaggcgaggataccaatcgatggttacgaaagcaagccaacggtgaagatgtagacacgcatcaaaggcaatgacgaaatccaccaatca

SEQ ID NO: 31355 - DNA, 1501 bp, Oryza sativa
caagccaacgtgggcaacggctgggcttatagtgtagctttcctctagttgacgcatccaggcaagggtgggcgtgatggagcggggcgggccctgcgacggcctctgtcgcttccggattcacctaggcacgagaggggactgcccgttgcccgctggggacgggggtgaaacttgaggtgtggtgtgcttagctagagggggttatgcgaagggtcctgtcacagtctctttctggtatgtcgtggtggcatgtcggcgcacagaaacgtgttgtggggctgtgtcttgtgggtacagttgtacacctctgatcagagtaaaactattcgaatagccgtgcccgcggttatgggcggtcaaccagattcaccgtgattagtctcaccctagtttagtctaatggaattagatagtataggtggatggttgggcctgtggcaacgtggtatagcgttggacagtggatgattaatattgattaattgttacaactgttttactgttctcaacttctgtttataaatgcccgttttacgcaaataaaccagtatagctatcccttgataattccctgcatcatacccctattccggtatgacttgctgagtacagtgggtagtactcagtcttgctctatttttccccaaaccctagagtatgagtatgcgtcagatggtggtttctccgaggagtaggcttcgtccgtgccgtcgaggatgcctgtggggtggtgttcccgctgcagatctagtcaaggcttagccccttttatcttttgtttttccgctgcatttatgtaagacttttataatgtttgtaagacgtggatctgtatgtcaactttgtcgcttgtgtaccccagccagtcctggacggggattttaatgcacattctgcttggaattctattcgggaatttctgggcgtgacacgcatgggagaggtgtgtgcaaagctagggccacctatcggcacggaaaagaagcgtcgtaggggcgtgggatcggatggtgactttgcctgtccaagtagacatttaccaccttttagttgtagtgaccttttagttgcagtgacagagattttgactgttgcgcctcgtgagccatgtgggccacacccatcacccacccgcacgcactcgatcgattaaccacccaaacaacgccaatgcaagcagctcgttcccaagttgccacaacacaccatgcatcttcgagttcgactcgcgggcgcacttgtggagattatgggtaccccatacccacacggcacggttatccgactagttataggggataacttatatatatgaaatatgtaacagatcatgacttgggtattacgtttccttgtatattacggaacggcctaaagtcctggtttgataagattgtaaagtagatttaggaaaccgataccgtattggataaggtttctatcttgtaatcatgtcccccatcctatataaggtgggcaggaggccctctagggggca

SEQ ID NO: 31356 - DNA, 1501 bp, Oryza sativa
gggttttggagggaaaaaaatcaaatgttactagatcatcttgtaagtatgagcggctttaattagtttgagatcaaaatgctgcaaagttgcttaattcggttgcttggtaacctagtgagtagtgagaactactgtggctgaagataactccttttcagcaatgtttgtggttttcttagtcaaatatcacgcttcctttttgttgcatcttttcttcgtttgcttcacctgtcccccttgattctaggaccctgttcgcagggcactggctttggagcttcctttttgttgcacttgcacatcgatagatatacgcatgcaactttaggcacacaacaagttcaacttctgtataatacagactgtaaagtgtcagcaagcagtaataatatgagttgatgggagattgggagctggtaaagtgtcaaacagaaacggtaatttcatccattgtcaagctgatatgtagcctgtagatactgcacattcagtacataataggactacgatgccattggaaatcttagagcaatgaacatcgaaactaaaactccaagatatcacataagactaaatggtgagttggaagagaaaagtgtgaagagaagaaagtgctatccctcatgcaagaaacagtccatacacaaactccaataaaaattttgagttaaagttattagggattgtgtgttagagacaacctgtaatacatgctacctcttaatttactattacatggtatgcatgaaattagaggtaatattactcttaggaataacagagaaaacagtactattagtttaagccaggcccaacaaggggacactttcctttggtccatagtctctagctgttgagctgctatgctcacattgcttagttccaggctcagcccagcaaaaatattctcagcttttcaggctacacaaagaccatacctttcgggctcagcccaacttctgttttttaagtggttcacccaacttctctcaattctataaaaggtcaggataatggagttcatttgttcagggaaagaaaaggcaaaattggttaaatagcatcgaaatttcatgtttttttatagtaccgaaagataccggttcactttaatagcacctaaatttcacccaattttcaggggatccactagagtcgattctcgatcgttttccgtccgccttaatcgctattgacatagccacgcacacaatatgatatttctacccctcattgccatggattctacttgtatttgtgagaggtagaaacgtcatatcatgtgcgtggctgggtcaatagcgattaaggcggatggaaaacgatcgagaattgacggaagtgttaaaaatggaaacaaagtgaactttgggtgcaattaaagtgaaccggtatctttcggtgctataaaataaaaaagtaaacttttgatgctatataaccaattttgccaaagaaaatttactattacaggcttgttcaccacttttaaccctaa

SEQ ID NO: 31357 - DNA, 1501 bp, Oryza sativa
tgacagtttcattgatccgagaacacctatatatgcgggaacacctctctccagtgcaaactgtacttgagcctcatgattatcccttggtgcaaatgacatggtcaaaacatttttcttcaacaggtaagcacctagactagcaacctgaacaaaattgtggcaggaaaaagcattaaaagattaaactccgtaacatgataagaacaacaaaaactaatgcttgattgctcatctaagtttgcatctttagagttgaatcctttacgtaccccacaaccagtgtcgagtgctgttctcactttcccattggctattgggataacagaagcaagatggtctatatacttgtctgcaccctgaggaaactgtgttccaccaccaggaaacctgaacactttaccctcgtagtgaacccaattctggatagccttctcaaccgtgaggctcttgtgagggatatttgcataatgaacataatcacggctctttggccaatgaaaaggagcagcataaccctttggtgctggaaccagacaatagagcttatccttttcaggtgggcaatgcctctcccgatatatcatattatccctagggaaggtcattgcacgcttttgctcctcacagggagtgtaatctgtgtactgtgcatcacatggctcgaaagttttaacctcagtactcccagtatcattaggaaggtctgaagcactatgatgggtttcaaaattcaggtttggaagaaccacgcatttagtctgttcgttcaccacagctgctatgctgtctcctcttccgaaaccacttctctgccacacacccaagagatagaagaaggaacaaaggccaaataaaacaactacagatacagtggtcctggtcctgctctcagttgaactccgcgccatacctcactgtaagataaatacaattagattcagtaaatgtgtatagcacaagtatggacaaaccgacaagttacaaataagagtaaattttagaacacccctcaatctatggtcaaagttgcagaaaaccacatgtatagattagagcaagtttaatagtatagccaactattagctccaaatcatctatagccaatgtaatagccaattcatacaatagttgcttactatactattaatatctggtcctacctgtcatacacacattacgttttggagtccgtgctgcagctggctacaaatctgtagcccgctgctgttctctctcttcctttatctctttaaaatatgtttatagctggcttatagcctgctattgtacctactcttaagcaacgttgaccataaaacatggggttctgtgcaatttactctaaaaaataactctgaagttcatcatcaatggcatacattaagcaaggaatggaatgaattcttgatttccgctccttatatttccaatgaaacttactaatcaagccatcagtccattatacaactgaattatgttcaaccaaaaaaaaaacatg

SEQ ID NO: 31358 - DNA, 1501 bp, Oryza sativa
attcgcgagagctttgagactccgttggctatggtttgagtgggagtgccctgacaaaccttgggttgggacaacaccccactacgatgagttagatgagcaaatcttcgtggccgcaacaaaggtaacaatcggtaatgggcagaaggcaaaattttggacatccaactggattggacaccagccgctgaaatacctagcgccagcgcttttcaaccactctaaaggaaagcaacgcttagttcaggatgcgttaaccaatgacaaatggattgaggatattaggcatgagctgtccatgccactgatccgagaattcttcgcagtgttccgccttatctgggataatgagacaaacctggaggaaggagttgaagacaccatcacctggagatggacaaataccggtaaatacacagcaaaatcggcttagcccaattcgccggtagagaagactcaagggccgccaccttgatttggaagacatgggcgccatccaaatgcaaaaactttgcatggcttgtcctgcaaaacaggatatggacatccgaccgcttgcaactccgacaatggcccaataactacttttgccaactctgctacaggaacttggaaacggcgcaacatttattcaagaattgtccattcacgcgagaaatttgggacaaaataatggctaggatgaaccacaaccaacccttcccggtgcacaatccggacgagagcctagttgactggtgggaatcaagaacaaagcaacaaagcaaatgtcaaagtaaggggatgcagtcactgcacatgctcttgagttgggaaatctggtgcgagaggaacagacgagttttcaaagataaaagaacttcaaatccctcaactaacggcaagaataatggacgaaatacatggtcggtccgcatgtggggcaaaaaatcttgcgagaatagcgccttaacctctcatcctttgttgtaattttcctttttttctgctctcctccccctgtctttccccttgtcaccattggtggcatttgtacagtgcttatcttctgaaatataaaaccagctaagctggctaaggtttcaaaaaaaaaaaaggaacagtagaagctaccatcctactcatcttgaggggttaccttttaggaagcatggtcctttgtggtactctttgctggcatatcatatatcttaagcaatattgtctgctagttattagagcaattttcttttttgatactctcaaaaataataaatttattccagattttttttttgcaaaactaaaattccccaatattattattattttttctttttgataaacaacatcttgttaaatttccattccctcatctatagccatctctctctctctctctctcacacacacacacacacacacacaacacaaagttctcactctcaaatactcgcgatgcgcctcgccttcctcgcttgatgagctaaggagatcgagttgaggacaatggccagcaatg

SEQ ID NO: 31359 - DNA, 1501 bp, Oryza sativa
aatgcctggagacaaattatattgcaagcaggcctttcagggtcaatgcggtaagatatcaacaacttatgttgcagcaagctattgcaggtatcactgtacaacaagagaaactaagactaataaaatttatgtgttctccattcagggccctgttcatgcatatgttgcagtccctggtggccgaactagttacctctcagagctgcaatcaggtcgggaagtaatagttgttgatcaaaatggtttgtggcgtactgcgattgttggtcgtgttaagattgaatcaaggcctctaatccttgtagaagcaaaggtacataactaacaatgatctcccttcaaatgattgctgtacattcatggattgtcaatttcatggcgtatgggcttgctgcaggagaacggtggagatgatacttacagcattttcctgcaaaatgccgagacagttgcacttatcactcctgaaaaaggtaagcccatatggacaacttttgaagataggactgtaagttttgagctgcaactataataagccataaatttcagttatgtttgaatgatgctaatcaccatgtgattagtacacatattcaatcaactcattctggaaccatatgattgttttatgtaggatctagtggaagaactgctatacctgtgacttcactgaaagttggtgatgaggttttggtgaggaaacagggcggtgcccgtcacactggaatagagattcaggagtttattgttgagaaatgagactgcgtcagttattcagttacctgctagcaggccagtctttgttcttcccaaacaattcttttgctaattcatgggagtgaaaattcacaccaacttatgataggggactatctgaatcatcattgaattcgagccatgtacatctgtatatactatagtactagtaacttttaagtcaaggaggaaatttccatttggatgtgaaacgatctgatgggtctcattctctgataggatcataacattacgctatgggtaatcagtccttttcagctggttatgtctgtctcaaccccgtaatctggcaatctctttctgaaaaacagttccgtcagaatgtgttcaaagggagctgtcagatgtgaatagagaagtgcatgaacttgctatctcaaatcaactgctgagaaaacctgggaaaaatatccaattcacagtttgtcacctttcatagtgagataatccttttgactgagatcaataaagcttccattatataaaaaaatatccctccgtggaaaaataatataaggaattctggttgaatgtgacatatcctaatactataaatctggacaaactctttgtcaaacctattcagattcatagtactggaatatgtccaatcaaactaaaatccattatattttagaacggatgaagtataacacagtgagtacggttctctgcatcatgatcccagcatggcagagagcagcgtgaagcaaaatcaagg

SEQ ID NO: 31360 - DNA, 231 bp, Oryza sativa
agctaagtgcctttatttttcctctttatgtgatattttccattgagcaatttttttatatctactcatgctaactactcgtccagcgccggacgcctagttttatcattatttatcatattgatttttaatctcagattaatctcttgttattttttgttgttgttcgcatataattacgcggcactattgaggcgattaatgctggtcatggagtcgaggcgtctcagc

SEQ ID NO: 31361 - DNA, 1501 bp, Oryza sativa
gatgatgacttgttgctcacaacaatcctattatagtcacgaacaattcgccctgattccaagaaagttcgtcaactcgaaatatggctagaaaagcaacaagcagaactaggagctttgggtattcagaagctgacaaacacaccgcccacacacaggattcggcttcagaatagcccctgctttagtgttcaggccaaggactaggcaggattagttttctcaatgaacaaccaagcaaagctgattaacaataatgtgttcaggaaacctagctgtaatgaatgtgcaaggggaataagaatccatcctaagttgttcttagcctctgatgaggaatttgctatattacagtcaaactgaatggcctacattacagtattacactgaaccaaccctctgctgcttctgtcctaagctggctacgcaaagaaactaaacccgtcatcatcttgtccaccttctcatcatctcctaaaccggaggagcacataatctattaatcttgtccagaatcctcatgagcttcttcttcttcttctcatcatctctggacacaaaagttttgtctctaccaaatccacaaaaaccaacaccttcagctgccgaagaagttgcattttgttctgatgatgatgatcatcatcagctccggttgtgtatcgggtcggagcctcgccggactcgccacttgctcgtctgcgccgcggccgtcgtcgccgcgaaccgctccttcgccgcgtcgacgccgacgacattgttggccggaggcgccggcgccggcgccatagccggagccggagccaggacgagctcggctctcgtcaggccgtgcaccgccgtggcgtggtgcagcgccacaaccacgacgacgacggtgcagaccaagaaaaggtcgagacggcttgtgtgctgcaccatgttggcttctgctgctgctgctcagatggagacaaacaagtctctaccttggctctctctgtagctagaatggtttgtacaatgatcaatcatggtgatgtcttgtctctagatatagcaggggcaggcagtgtcgagtccaaaagcacaaagggacaagtgaagccaagcacagcatattagcatagcatgcctaaggctgtgcaatggaaggttctgaaaacctgaaagtttgagggaggcagattttggcaaagtcatgaattggggggggtacttatctcccaacagacaaaacctaaagttgcaattgtagatttgtaggggataggaggagcaacagtatgctagaaacaaagacttgctttagctccttgttgttgttatcttccccttcttggccactgtctgcagtaaaacccccaacactaaagcagcaggcacagtggtgagtgaaacaagtgaggcttttttgcttttctatctttttttttgttgttgtttgttgttcttggttgaaacacacttttctctttgaatcttcttccaagctaaggccaccaaagatgggggagcattc

SEQ ID NO: 31362 - DNA, 1501 bp, Oryza sativa
ctccaacatttatatcgtcaattttgtagacggtcccacaaccgtatgtgaaaatcgattttcatgattgttcctctaagagagccatatacaaatatgattatcattttctattcccaagaccttttactagatgtataacttacttaccattgtataaattggagatattatttattttacttcacatcttcgaaacttgtaatgtttgtattatactttaaattctttcaaatacaaatgttataaactacaaagtggtagatctcgttgagccctacaattttaatatggaacacatctccatcagatatcgtttgaatggtagatctgagattttgtaaaaattaatatggtatattataataaatatttagacccttaaatgacctcaaataataaaatagtcaataataaagttgtagatctcatcgagctctacaatgttgaatataaaatttgtcttcatctgattccgtatgaaaaagttatgtatatatacgtgttttttctaaaatttgctcaatgtctgtggatatccgaaaaaaattccggataatttttgaccgtttttcgattccgatggataatacccttactatattcgttttcgtttccgagaaaaaaatatccaaattcgtttcagaatccaagaatttccggataattccgaccgaaactatctaaatccaaaaaatggtccggacggacgaaaactatccgaaccagtttcatccctagtagagataaatatagcatctttgatttctttaatgaaaacatccaagttatgattgaggataaggaaggtcaccaaatcgacagcagcaagccccggtgccacgtcctctcgttctttagatgatttctcctcgtaaaaatagtttatggcgatggcgatcggcagccatgctcctttgcctaaaacagcgatagcttcattgctggcttgctgcattgctcgccgaaagtcaggtgccactactctaaaatcccttctgaaatcaaccattatactctaatagaagattagatgatattctatttctgcctgtcaccgttttgtgcgtaaaagttcgattttttgctactgcttctcccatcccataaaaaaaacttatactagatgtgacacatcctattacagtactacgaatttagtcatacatatagggcaagtttggtttgaggccaaaacggaccttaccaatatttggccaaaggtacaatttagcatggccaatatttgacaaggccaaattgtgtttggttaagggccaaaactaaccttgccaatttttggctaaaccaggtttggtttggtgccaacttttgtgtgcagcgtggaatacatatggccgatgtgccactgccaaagcctgcgtaggagttcaaatttcaagcccgcacttcggctcccatcaatgacgttaccgattctttctcttcaggccggccgatatttggatccaaaccaaatttgtgttcctactgtttatgt

SEQ ID NO: 31363 - DNA, 1501 bp, Oryza sativa
tggtattgttgttcagggatgaattccagactcgacgacaaattgagggacctaaagtaaacttactacggaggaagaagaagcacttactgggccatggcccacaacatccggtccatctattttcatcgccactatacctccggcccacggacgcgacgcgcttacacacatggcccacatgccatggtgcgcaagcgcaaccctttcttcctcctctgtcgctctctctctctctctctctctctcctcttctccactttctccctcctcgctagtgcgctctccttggcgagctcgctccgacgaacgccaagcccattgctccgcgtgtggttgggagagtgagaagagaggagatattttcggtgcggtggggaggggggattgagagaggccgaatcaaccaaccaacacctgcctgattcatcttctcgatcgatcctggggggtctaagctaatgcgcgccgccccgatctcccgatccggtccgcgcgcgctcgatccccgcgcctgatttctcctccccgcccgtcgccgaggagagctccgtccaggtagcgcgcacgcatacgcaaaattttggcgtatttaatccatgatctgtgtttgcatcgaatggataggacgtgctcttttgacttcagtcggtgctggtaggatgaaacgatgcaaagatactgtgttgttgaagacataatccgatttaaaacatttcttgttaacttggaacaagttatctaaattttcggtagtgatagtttctgctgtacatttttttccttaccaaatctaattcaattgcagaatgtagtaatgtattgatgcctttggctggcaacatagagaggttcatggactcgtttctagttctgctagtttcggtacttacatattttctgcacatatctgcatgttttttttttggttgaacataattcagttgtataatggactgatggcttgattagtaagtttcattggaaatataaggagcggaaatcaagaattcattccattccttgcttaatgtatgccattgatgatgaacttcagagttattttttagagtaaattgcacagaaccccatgttttatggtcaacgttgcttaagagtaggtacaatagcaggctataagccagctataaacatattttaaagagataaaggaagagagagaacagcagcgggctacagatttgtagccagctgcagcacggactccaaaacgtaatgtgtgtatgacaggtaggaccagatattaatagtatagtaagcaactattgtatgaattggctattacattggctatagatgatttggagctaatagttggctatactattaaacttgctctaatctatacatgtggttttctgcaactttgaccatagattgaggggtgttctaaaatttactcttatttgtaacttgtcggtttgtccatacttgtgctatacacatttactgaatctaattgtatttatcttacagtgag

SEQ ID NO: 31364 - DNA, 1501 bp, Oryza sativa
cagacaaggtttcatcgtaaacaatttacgatttcattatttcatcaatgctcaatagtaacaggaaaatcatgagtaacttctttgtgactgaagagaggcgcaaatgtgcaaacaggtgggccatcggcattacataggaagcttgtttgtatcaattagttagaaccaggtagcactccccattacctcactccgacaaacaataaacttagcacaattctgtgtatgcacaagtacagtggagtgatcgatcagggtatggaactatagagacgcatgtacctgcaaaacctggcagttctccaatgtgctcttcccaccctgtccattcaaaaaaggattagtaatgcaacgcgtcaaataaaatcatgttctaagttctaactaagaacagtacaattaagcgaatgaaaatgcaacatgaagcactgaaatctcccggggctttcacatcatcaattcatcagacatcaaagtaagaaagtagcagcgttacacgaactcattcatcagtgttggagttggggtttgggaccttggagtaggggacgatgtggtcgtagtcgtggcagaggcatccggggcagccgacgagcttgcggaagacgacgttgccgagcgcgtcgcggcgccacctctccgggtcgcgcccggccacccgctccgccttctcccagcaccgctgcttcaccacgtaggggaagctccgcggctccgacgacgacgccgacggccgcggcgccgtgaggagcaggccgtccagctcctccgcgaccgcggccacggaggcggaggaggaccgaggggaggtcggccgaggcgtggccccgaacaacggcggcgagggcggcgcgtcgtgccgccgccggcgcagcggcttcctccccaccattatctccctatctcctcggattcgatggttttttttcttttttctttttttccctctcctatttggatttcatgtgagacttacaggtggggcccaccggataggatcgccgtggaggcatttcgtcgagcaggttgcatgctcgaccaggacggcgccgccgccaatgatctcaaatctaccaagtgagcttcgccgcgttcttcgaggagctctcccgttgcagttcagaagctacaggcaatcgaagatcatgtgagttgatggcgatttttctttgttttcgggccactttggattgatgccaatatatgccatgttaattttttggtagtttgaatagtaaatatgatggtttggttcgaaaccaaatgaatggtaatgcccatatttaatttggtagtataattctagaattttctgcatcataacataaaatttggattcatgtgaaaccatgggtggttttagttctttgtgatgggaaattgacaagtaccggaagtgtaggaaatgtgtgcgtgaactaacattggtcaggttgcgacagctgtgccaagacaacggttgtttggttcatgtgtgtgcaggtgatcggagtccaga

SEQ ID NO: 31365 - DNA, 1501 bp, Oryza sativa
gatggaaattcgggttccatgacgcctcacacttttaaccctaaaaatagaagtgacggactgtagattatcagttaacaaatagttattttattattaaataatagtcccagcaacatattgcaaccaagaaatagaagcacctttactttgtaataactggaagtccctaagacaatctttagcctttacaccatcttgcgcatgcaatgtacaaaacttgcgtgcaggaattatgtagcaaggtttactcaacaagtcaatatatactgccagagaaaactaataatggatgcatgaataataatttaacaatttatattttacacttccatcattcataactcatcatcgagtctaaatgtatttttgtaaaagaggttttcctaaaaagatttgaataacaagagaaatgcgtgaatcataatttgttataacattgtgaaagctcgtgggccacatcttttgtcttacaacgtatcccctccatcccaaaaaacataattaaaccttaggtttgaatctggacacacacatgtgatgtgtttagattcaaactcatagtttaatttttttctgggacatagtagtatatgctcataccaaaatttaaatcttaaaacttaattttagaattaattttaaggtttttattatggcttctttttttaatatcggagtttaaatcattaaaaacacatatgtaaaagttttaaccatatattatttttttacgctaatatgtcttttggcgtattatcagcaattggccaactgatggcagcttgtatcgcattacaaatcatgtatttgtaaatacttgctttctcttttttatataatggaatgtacttccggcctttactcaatgagctatagccaattattacgtcaaatcgctcaaaagcgctcacaatctaataagaccacaaaacacaccaatttaacataaagcaacacaaattaataagcaccaacacaagatgaaagacccataattattgaatcatatttgtaaatacttactttctcttatttttcgcccatcgaatgcatcatcgcaaaaaatattttctctataccaaacaataaaaaataggtctttttaatgccctgtttatagtccagataatttatatgaattttgaagaaatcaacatatttagccaaatggtagtactaggcttgacagcaaggtgtgacatgcatagccattatccagtcaccaatatccccattgttttacttatgcttacccttctaagccaaaatttaaattttaaaatttaatttcagagttgattttaagggtttgtcatcgtaatttattttacactatttgcttttgaacgctaacgacaagtatacagaacatttatcataaataagattttcttacctataagcgatatggataagcataagtgaaacaatcgaactgcaaaactactttgcgtgagagatgatcacgagcacttcgatgccaaacttcacaacgctg

SEQ ID NO: 31366 - DNA, 1501 bp, Oryza sativa
tttgattgccaagtaaggcgggttgagagggagagatggtggagagaatcaaaaaaccgcacccctgcggccacaaatccatcttgtggctctccaccctcctccgtgggccccaccacctccacccccctccctccctccttaaaactatccccaatcccatcgcctcgcttgtgcgaatgaaaagatttcaagaaatccaaccaaaaatctcgcgctctcctctcctcctcctccgcatgagctcatcggcgttggcgttggcctgtcgtctccgggaggagtagtgcaggcggcggcggggaattccgaaacggagtttgttcgttttggagcggagtggtgaggtgagtcgtcgagatgggggagtgcaaggtgggaggaggaggcggaggcggagactgcttgatcaagctgttcgggaagaccatccccgtgccagagcccggcgcctgcgccgccggcgatgttgataaggttggtgtgttttctggcgatcctttttgtgttttgtagtatcgttttgagggcttgagaattcaagcgatgtagtactatgttgtgatctggtgatgtggcgatcggaattagcggtcagttcgggataattcgattggtttgttttgcttggataatggggagtgatttgattgattgattaattttggccatttctttggtttgaacatgataatggtgatcaaccgggagtccatatattggtcgtgacttataaggttgtatattaaattgttaattggtaattaaaacggtataatcttgagtgtacatacatgccttataagtctgaggttggtgtgtttctttgactttcttattatttttcttttcatttttggggatatcaatgtgagtaggcgtgtttagtttccattagcgaaagaatccttcaaaagtatcttgtttttgcttcgtttccatgctttccttagatagtatcagttaataatacaggaattagctatctgaaagatggaaccttcttgatgagtttctagactgtgcagactgtttcaattaggccttttcctcggccttccatgttttttttttcttttttggatgaaagcagagctgcttcttttcttagcctacagtactacaaaagtttagaggcatatgtaactagatttaaccaacacaaattgcacaactttattttcatttcctaagctagagatcagaacatgtggccttacaagctatcagttacataatcatatcctccagtgttttactagatcaactgaacaaactgaaacaatgaacaaactctgtcacagatcttcctggtacaataacctgaacacaaaactgtccatgtgggcttatagtttccaactgaacaaaattgcaaatttaacacccaaaaactcatcaagtttcttcacatgcttgcaggaccttcaacacagtggcagcagcacgactgaaccgaaaactcaagagaacaccgttcaagactccacaagtccacctc

SEQ ID NO: 31367 - DNA, 1501 bp, Oryza sativa
gagagtgaagaagtattgttccatagcagattctgactcgatatcttctgtgaaacttgaattaacttgcatgctctccaagaaactgatgcatcacagtaacacacagccaccaattcacatgtttccagttcatttttcatcaaatacacactattactatcctatctacagaaaggcatctctatctctaacaatttgctgctgctatcttggcaggaacccgtactgcgagaccggaacctcgaacgccatcatcttctcccctcgagcaaacccgttgcggtcgtaggacgagatctcggtgatgtccagctccttgcacgccctgatgagctcctccccgaccctcccagctgcctcctgtcacaacaagccagccagctcaagatatcaatacaaatgagcagtttatgtctaattactaggtgaaattcttggaggcgtcgtttagaagtcctattcctttagggtgttgtgtgcttattttgttttaagtagtaggatcagacgtagacgcgtggtgtggttgtatattttctttttcctgtctatagtctcccaggactgtaggcttgtattttattccttcaatagaaacatcgcactatcttgtgcgggttgtttcaaagaaattcgtggaggaacggagtgggcggcgtaccacggcgccgcagggcgggtcgccgcagatggccttctgcagcgtgctgccgtagaagaggatcttcctgttgtggtcgtcgacgagcatggcgtagagctgcctgttggagcagaacacggacagcctcggcttcgtcgccgtgccattgaactgcagcgccggcggcaagaaccggtacatgttagcagaagggcaattggtttgtgctgcatggtgagccagatcggaacgagccgtaccttcttctgcagcctgcggttcctgaccttggggttctccttcctcgcgccgtgcctcgccgtggcctcgatcctcgggtacgagcgccggcgcccgactccgccggcgccgcctgcagaagccggagtgaagaactgcacgccaggcgagctgggagggcggcagcacgccgggcgcggcgagaatggcagcccgggggccgcgcggagcgatgccatggcacgcccacgggtggagaccttggctagctgcttggggtgggcaggcaatccgtcgagcaggtgcggcgcggaatcccggtgggagctgctacagtgcccgagattaggatttaggaatgggatttgtcctcacttctggggccccacctgtcacctgacaggtaatacaaggcttaagcaagggtgtaatcgcaaaattccccctcgagtttattctttccgtatccattttgtgctctcatctcaccatctaaacctcgattaatttcaaacccccgtcaaaaactactcacgtagtacaactacaagccaacccgctgcaaagctttgcccaccatttccacacccgcccaaagctgagcaacgcacgcgc

SEQ ID NO: 31368 - DNA, 1501 bp, Oryza sativa
aagtgtgaatcctgaatctgaactgtacaggtgctgtatgctaatgtgctatacttgctatcctacaaaagtgggccagaaacgcaacaatcattgtggagggaattgttttttgaacaaattttggaggggaaagatttcatcatggctctttaagaattcagctccccatgtatgctatcaacttatcctttcaaagttcatatggcaaatttgagtcagtgggtatttatttgcagttgagttattgggacagtggcctgagcatgtagtagcagtctatgtgacagttctctccacaattgccaattccttgggtcgacagtacttagtactacttagcgtcttggttatgtcaacatattatggtttggaaaaaggggttttctttggcactgtaggcatttcatcatatttttcatgtttacttgattctccgaaatattcttacctgaattccttgcggtagattttcagcttaatttggtaacatgtcaattatgcaatctcttagattcaaacttgtcagtctgtcacctctggagacagcatagcagtcatttcatgttacataggactacaacaccacatggggctgatgtcttattatctgtcaaaatccattataatgaatttcattaaattacagttgtcattatttgagttttattaccattttctgcataaaatcatccagggaacctttacaccttttctgaacataggaaaacttgcacttgtactatggaatgcaaagctttgaaaaactgttacatgtaaacctttttctgttctatggggattgtactgacgttttgtagcattgtgatatccacttaaaaccagtataatatttagcaatgtgcacggttgtaaatcttctttgaatggatttttctattcaagttcattctttggaattaactggtcttactgttcaagtgaatttgctactcaccattgttctcactctgtcactgatgtagtaaaacatgttgttcgattaccaaggcctacacttagaatggacaaaataaaaccgcttgctcatatgagtatatataccagtcctctctgttctttgtaaaatctgagtgttaattgggactccatattgcatattatcaattgatcactatattgagtatattcttgttgagctgcttttgtgtcttggcagactcttcatacgttgcatgataatgtgcacaagggcgcttatattggcatattgataggagctctggtacaggatcagcatgttgaagctgaaccagacggctcggtccagagaatcagttgttgatgaagctgtgcccacggccacggctcaaaacaggtatgagaagttcagcttcagcacagtatgctaacttacctcctgcctggacagtaatcaatacatgaataaatatgcacaattaacgagagagaagaaaaggtttgaatcatgtcgagagtgaagaagtattgttccatagcagattctgactcgatatct

SEQ ID NO: 31369 - DNA, 549 bp, Oryza sativa
aaaaatactagaatgacttacattatgaaacggaggaagtaactcacatccggtgccccttcgggttacccgtgggttaattccgatccccaccctcgctcacccgcaggtgaaaattctcccccggccctggctctaacggaaaaattgccacccctagtaacagttacaggaacaacatccacaatgaaaaaaaaagaactacaactgtgcaggtataactgttacggctgtgttaatgcaactagcataaacgataagagtctattatgttaaccttctctcttttttatcacaaaatttgtataagtagtacttacaagaatttttccaatttcttttttgaaaatttaaatttagataaaatttatcaaaccctatagccgattacccctaccttaactttacggaacgcacggttacctcacggtaaccggtcggctgggaaaaccatggtccaatctgatcaaactggagtctgtctataccaaattaccaatttttcctggcttgatcgctttgttttatgaagaacgctggcaacgctgc

SEQ ID NO: 31370 - DNA, 284 bp, Oryza sativa
accagtactgccaaaacaatatttttacagagcagtttaaagagggttttgcactgggaaaattggaaaccaaatataagaaaagagttcaaatataatagctttatttctgaacacacttgagttggccaaaagcaacagaatgacaacacatataggcttggagatcaaagttgcatcttaaagatcgtgtcaatatccaaaacgacgtgttttttaacttgagtgagtggattgccaatattgacagttgacagatgcctaatccaaattcctttgctagg

SEQ ID NO: 31371 - DNA, 522 bp, Oryza sativa
tatagtaagagagggtattaaggtagacctcaaaatccaatactagacattaagagagggagagagagagtagcactaccacgagagagtggagattgatagattttttttttttggtcttaggagtggtctttatacatatagttagctcaaccaaatgttttttttataagaactactctcactttagaggcttaagacatccttatatctgtattgtggctaccctaatgatgaactctgacaataaggcgatggaggatatggtagcacggatttatccttcaagaattgggattaaattgattatatgtgtaaatatcagctcttttctttttcaaatggctaatcaaatgactggtgttatattaatgggttaattggatctatgatattgtaaatatgtcatattagaaaaataccactactatttgcgatatcggctacgtgccactgaaatttggggaaattgaaatcatgccactcccatcaagttttctgtcaacctctgtctaaccccca

SEQ ID NO: 31372 - DNA, 1501 bp, Oryza sativa
ctcgaaattatccaggatcatcatgcgccgtccctcgtgaaggccgccgccgccgggtccgtcgccggcgaacagcgtggccaccgccataagccacccgctgatccgcccatgcacaacagcccatcctgttgcagccactcctcgccgccggcacaaccaccaccaccgggctttctcaccgacaccaccggcgacggcagcggcagcctgacggccaatgttctgcacaatgtcaatctcctgcatatcaatcacactcccaaccctgaaatggtggaatacctgctagtattccactgcagatcaaacactttcctttggttggcttgtagagtagagatagggtacagtctgcaaacagaattggttcatcggcactggatataggatacagcttgcattgcaacagagtttgcagaatgcatggctttactaaagagggatcacccttacaatttttgcgctgttttattggactgaaaattaacacaaatcaatgtacccagtgacttgccatcagccaagcagctgtcttttcggtttccagattggattcgggtaaagtttaagactccggaagcaggaattttaggcactgtattgccattagataatcgggtggataatatacatattggtttgccaaacacttggaacaggccacaaatttcgagttaacttttatttgattgaggatttcacaaccggtttatacaaggtctagtacccaagagaataatagcgtactgaacaaacaaagggacaggaaagaacaagggctgcttctgtcaagaaccatggtcacttgaacataaatgcaaggtgagataaaacgataatggcgttagaagagggaaggaagaaatgatcagaagcagcaggctactggcattgacacttgatggtgttaacgataatgttaaacaagtcgacacgaaaaaatcactactactcctactcctaagcctcagtgaaggaggaaacggagaacatctctctcgcattgcagtaaatggtactgctggtgctggactcctcacgtttctcagctgttgaacgctggaggtagaacagtagtagcactggtaaacagtggaagtaaaatttcatttatggattattaatttgctattaaaggacagtttaaactgatctaaagccaagctaacatggtgaacttttgtggctaacgcaagtatggaagggttgccatacaatgtacaagctaacatgaacgttattgaagctgaaaaaactataatgtaatactcctatatcctactgacatgtctgcaccatatattgatccatgagactcattcctgactggccttttactggcacatgcatggaacaatcagcttaaagttaacagtcagctatactgcatttagctgcacgcctgcactacaacagattttgcaactgccattacattggctaatagagaaagctagcatacagttgaaaaccaaacggaacaaacccccaacgctta

SEQ ID NO: 31373 - DNA, 1501 bp, Oryza sativa
tgctggtgtaagtgctggtgtaaggctaaatcatgaatcttggaagggctttgttgtgagtaataaatcgggtgcttatgtatcgcgtgccatgctttttgcatgattattatttcgcatcatgtgggtaaagtgtacgtactctgcagagttaaaactaatcgattagccgtgctcgctgtcatgagcggcgtgtgaatatgtcatgagtatagacatgtgttttattcttctaaagctgaatttgaacttcaaaatgtgatgtgatttatggattatatccttgctgccatggaaggcaataaggagctatgttatatgtgtttaacatctattttgatgcccatttgctaagtgtatgcttgctgaaatttaattgaaaataaatctgaatttgaaatgttctttgcaaactaaatttgctttatgctaaaattatcccatgtaagctttactttgaatacgccatgcatgtagagtattaggcttgcttggtgcttgccagtacaatttatgtactgactcttgcgtgtattgttgtattgttgcatgtttagaattggttgcaggtgagatcactctatttcgatggggatgtttctttcttccaggatggttcttactagggtctaccctagtcggttgcaggaaagatcttttgggtagaagatgcttccgcgaacctaactattcggccaatcggccatacttatctaagttataagttgtataaacttaactaaaacttagaacttagaattccctatgttgagatatcatgtgcttgaatgaaagtgtttagtgtgttccttttgttagggacatattaaacatgagtatgagttaaagatatttgagatgttgtagatctttagccatttttgttaagtcttctgaatgtgtaacacatctggttgccgtcttcgagtggtttgacaggcacatctcaggctgaagttgactggcaggctaaaggcctagcaatgtctcacatatctttctctcggagcgtcgaatgtcttaatatgtttgatggaagaattgtgtatagctattcatccttcaaatatactaatgggttcggagtgcttccgacactaaatcgggcgaaccatatatccgtttcgactgtctcaacgagagattcaatatggtggactcaaatatatatttggcctcatgttgttggtggttatggtgcgcttctttataactcaatcggaaactctccaaaatgttcagaaatgaacttatttatgacctaaccttgcaaaacatgttgaaccaataaaactcatggaattctgttgatttaaagaaagaatggcaaggtaacatgttatcttcttttattttactaaaatgttggtggttgtattatgtttaatgacaaccaacacctacagtattacaaacacgctattgattagcccatagagattagagtcttttcctacccacaaaacatataaatttgaaggtaggagtatttccctttgtt

SEQ ID NO: 31374 - DNA, 193 bp, Oryza sativa
atatatattccctccgtactcgtaaaggaagtcgcttaggacaatgtttaagtcaaatcttgagaatataaatcatgaataactctcgagttgttgagtttgaaaatgtaaaaattatatgaatagatttgtctcgaaaaatattttcataaaagtatacatatatcactttttcaataaatatttttataga

SEQ ID NO: 31375 - DNA, 1501 bp, Oryza sativa
tccgagtaatactcagcaccttgcgttactcggtccatccaacgagtccccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacatctatagcccccgactcactagtcaacggcgaaccagttgaggtagcgaggcaaaggaaaaagcaaaatatcatataaagaataaaataaatgatgacttagctttgtcgtattccctcgatgacagcaaaagtagccgatgtgggaacgaagcagtccatcaatggtgacaaaaacaccagtcggcgccagtggaaccaagccagtggtgtagatgatgaagcccattaacagcggcgaagtccgccaaccgtataggcaaaaacaccagtcggcggcggcgaaggccagccggtcggcgaagacgtggacgcccatgaacggtggtgtgaccaaccaaccgtataggcgaggacaccagtcggcggcgatggaggcaggccggcggtgaagtcgtagacgcccaacatcggcggcataataggctagccgtgtaggcggaggcaccagtcggcggcgacggaggcaggccggcggtgaagtcgtagacgcccaacagcggcggcataataggccagccgtgtaggcggaggcaccactcggcggcaacagaggcaggccggcggtgaagccgttgacgcccaacagcagcggcataataggccagccgtgtaggcggaggcaccactcggcggcgacggaggcaggccggcggtgaagtcgtagacgcctaacagcggcggcataataggccagccgtgtaggcggaggcaccactcggcggcaacggaggcaggccggcggtgaagtcgttgacgcccaacagcagcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcctaacagcggcggcataataggccagccgtgtaggcggaggcaccactcggcggcgacggaagcaggccggcggtgaagtcgttgttgttatcagcaatggcggtggcgaagacaagccggcaaagtggactcgcggccgatcgaccggaaagctgagacgcctcgactccatgaccagcattaatcgcctcaatagtgccgcgtaattatatgcgaacaacaacaaaaaataacaagagattaatctgagattaaaaatcaatatgataaataatgataaaactaggcgtccggcgctggacgagtagttagcatgagtagatataaaaaaattgctcaatggaaaatat

SEQ ID NO: 31376 - DNA, 1501 bp, Oryza sativa; identical to SEQ ID NO: 31357

SEQ ID NO: 31377 - DNA, 1501 bp, Oryza sativa
taccatgtatgggctttctccataatcatgtcttcaaagtactcactagtacatgtatttctgacttgagcataagccccacagaactttgcaatatccctcttgacattatcccagtgtgtcttcatttgcttgactgtccttgtatgtgcatttctaggcatattgctgttgaactcatcagctacatccttccagtaatactctgacttcttatcatttccatctacagaatcaactgagttgttcaaccaagcgctaacaaaccgcaagttttcttcttccttccaattggtgcgtggcgctctcctcactccctcttcgctgctatcactcaactcttcgatgttaagtggctgcttctcttgctgtcttgtagttgtagggcaaggaatggatgactccgacccatgggaagaagtgttggcagcaacttcaactgaggtgactttgatgtggtgcaaagagtactctgttgcttgcagctccaaacacttgatttggtgagttagcttgtatccaatttccttgacgttgagtagcttgaaagcttggaggagaataaccatatggtgggtagttgcctggggcaccaaatgggtagaaattatgtaagaaatttgggttgaagctttgggaaaactgagatgggagaaaacggttggggaattgttggggaggagagttgtagtgcctagaattttctaggcttggagattcttgatttaggagatttttgaaacttctgttggatgaatccatgatgaaatgaggaggtgtactatgaagctctgtctattttgtttttataggcaacatggagctcaagctgtcgagcaagttttgtagccaacatagagctcaaggcaacggtaacttcaacgtccaaccttcaaccagcatatatctgctgcagggtcatggatcaactgcttttgtttttatattcatttccaaacagtgaactcaaaaagtaatatattgtattctcttgtgggcaaacccatagccatatggactactttagccattaatgctttaaaggccacatctacattgtatagaggcagcccatataggtgtttttattgtataatgcccgcttttgattgatattgtggatgccctttcttatagtacttgccctagcccctaagttgtgtcttagattttaaaaaacatggaagaaaaaggagttgaagtggtatattcactaatagaaaaactcaaatgccactaggctcctcatttcggcgactaaactttgggtgtgtttagttcacgctaaaattggaagtttggttgaaattggaacgatgtgacggaaaagttggaagtttgtgtgtgtagaaaagttttaatatgatggaaaagttagaagtttgaagaaataagaatgtgtaaaactttgcagttttggtttataaagtttcagcatgaaattctgaatgtgtgatgctaaccgcctaacttaaccatttgtgtggaatttttcagcgat

SEQ ID NO: 31378 - DNA, 1159 bp, Oryza sativa
taattatcactgaatttgataacgccatgtcaatggttgctagcggtatttctttttggaacttgaccttgctaattatagtaagaccatgtacaatagcagactattagccagctataaatatatattaatgagataaaagatgagatagaagagcagcgggctacagatatgtagccagctgcagcacggacttcaagacacagtgtgtgtatgataggtgggactatatatactaataatatagtaagcaactattgtatgaattggctattaaattggctatagatgaattggagctagtagtgggctatgctattgaacttgctctaagagaagtgcactgcttatttattcgtgggatcacattaatcagatgggttcagattatagcagtttagatggattgggtatatccgtatatgctagagcactgctaaagatgaatgagataaatatttttaaaataataaaaatggttcatatttcaggcttccgcccataaaacacacataaaaaaaagtcccaaaagataaaaagattcgatgttatgcgaaaaattctcatctccctcctaatgataatatctagctaaaaatagaaaatataaatctgtagatcctataacaaaagttaatagaaattaactaccagggatggagaaagagggacgagcagaggcccggcctccctcaatctatgtttacagtggcttttgtgaaaatttaaaatatcagtattattgttcttctccaataagtaaaatttagtgtttttagattctaagggtggaaccagctaaaaaaatatgaaaataacatgcattgggttaattagatgatctttctttttggttattggaaactttctgagaaatataattgtatttttaaaattgttaattcaggctttcaactatatacacataagagttactagtataaaattatactccctccgtcccataaaaaatcaacttctggctacgaatatggacgttgattttttatgggatagatggagtatataacaaatgttgtacgtttgagagacttaactctaatcctaggtggttgtgcggagaattatgctagtcctttctaagaccgacataccatacaagttattccaacaactcaaagtgaaaaaacaaaaaaga

SEQ ID NO: 31379 - DNA, 1501 bp, Oryza sativa
ccgactctctctctctcctcccctcccgcgcgcgcgccttgggccgccttgggccggccggcccatttagctcggccggaccgccccatttctctcgggccgcgccctagccgccgaggaaaagtctatattccctccctcttttcttttcttttcttttcttttccaaaaaggatttaattaaatccttttcctttagaccaaaaatccaataatcttagaaatttaatatcttcccaaccgtaaatccgtttgactccgttcaacttccaaaattcctcaaatctcgagatctatctaatggcacgcttagaggtcattaataaggctttatttttgccgtttgttgagttgtcccgtttcgcgtgtagtttcagagcccgaagacccgcagtgcgaggatttcgaggatcaagctccagatctcgagcaaggcaagccacctttgaacatcttgagcctatacttgaaatttaattatgttgcttgaaaaatattatgcattgataggatcgcacttaatctgttgtcccgtctacaaggcagattggcggacctacctaatttgttgcatttgatccttcctttgataattgttatatcgtgtccccttgtaaccatctagttgcgtctcgatattcgtgcaccctgtgcgagtatcgacggacgccttcaaacttaaaatctgaaaaacttcttgggtaaaacttgggttatacaaaagacttggaaaacccgacacctgggtcggtgcttgcgaactaaatggatttccaaaaccgcggaccgggaaacgtactgggtgtacggttttcccgctcttgcacctaaggaccgtttccttggaatttcatctgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgttggcatatggtaaacctgtgtcggctttggaaatgccttgtcatgaaagcttggaggtctcccgacgtggctgatccccacgagctgggtgatccgggttagtaatgtcgtgtgggtaaagtgtaccccctctgcagaggttaacaaactgttcgaacagccgtgcccacggtcatgggtggatgtgaggtgattcctagcgtagttttgtttgactactgcttgtgaaattgctgttgtggaaaggggttcgatgattgaaaaatctgcagctgatgggatcagctaggcccaggtggccgtttgaaagttgttggcccgggtggccgtttgaaaagctgttggccgggtgccaaccttgaatcatttcaaaagactgatacattgcacaaactccgaccggacgagacacactgtctcatccgtgtcgtttgagaagcactcacttagttgttttt

SEQ ID NO: 31380 - DNA, 1501 bp, Oryza sativa
gataatactcgcagtacggcgcacgcacagcacaggccaggcaaaacaagaaagcaacgggagacatcgtggtggtgtataaatttttccatcgacttaattatcacatgcgcatgatctgatactcagatcgatcatttacggttatatatggtagtacgaggtaatgggctaatggcagattaaacaagagtcggaacagtgtctcctctgtaataactctgcatttattttttttacagcagttctgaaacttcaggtcggttattagtactagtagtaaagcagttagccatagtaccattgctgctgctgaatcatgtctctctcgcaaccttgcgttaaagaaaaaaaaatctctcttctcatcaacccaacgctgtaaacgatgcatcatcggcgcgatggcggaggaaatacgcacgaacaactaaccaagattgtcctatcaatactgctatcgtaggtgtaatactgtagaggatccgtgtccacgaacacaagtgtttccaggggatctctccggcgtcggcgtcgtcgcgttgggttggtggtgtcacaccaaacgcaacgggggagaggaggacggggagatcgacaggtgtggcgcacatgcgcgtgcagggcgatgtcgcctcacaattgtaagctgtgatgcgtctgagtcgcggatactacctggctgcagttggggcagggtttacgaaaccgcacggtcaccacacggttactatacacggtaaccttttcaatttttgaaactacggtatgtctcgtggtaatcacgcggttactgtggtaaccaccttaccgtgggggtgtggtaaccgcatcaaaaacggtaaggagactacttgagctttggtcgtcgtcgactcgtcgtcagggtccagggaaaaaaagttggtttcctttttctgcagatcgatcggtctctgacaatcttgcgatgatactgttggtgaacttttgtcagtttacgaatgatctgtgatggaaagtaagttgggggcagactagctggcttacgtctactgcttcacttcactttcacagtttcactgtatgatgataatgtgatatctggaatagtgtagatgatggtataggacggacaggccactatgtattgctatgtatgggtattgctctgtatcatgtgggtacaaacgaaactattattatctaaaaaaacaaacgaaactattataaaaagtgaaccaatattctccgaaattgttgtaatcgatctgggtcagcagttctgctttttccttgtgtgaggtgcttcctttctgaatgacaatcagttggagttggagttggagttgatgatagtagtttctcccttcattgttcatctattttgatcttttcttgggacatttcttctgctgatctttagagctacgctacattcagtttccattctgaaatctttttcgggccaaacttttggacgaaattgggagcttttatggatgaaattgaggcccaaaac

SEQ ID NO: 31381 - DNA, 1501 bp, Oryza sativa
aaacagaaacatttaaatattttatgaaataaggtacacatgttgaaacatatctctatcacatatgaaacaactaatgttaacggcttgaaacatatatttttcttttatcagaatataatcatatgatatctggttgtaaagatttagattagtagtttatgaaaaaaaagttattttaaaaattaatacatgtatgtatataaggatggagtgaaaagagcagttggatggaccggtccatcggtcaaccgatcgggagttttctcccaagtgtattatagtatcttttgaattttatattggtatatgttttatacttttattgggtagaaatgaaattatgtttggagggagctaatgttcacgttttaaattgaagggagctaatgtaccatatattgggggtaccttttaaattgctggtactcaatcgatcctaatgttcacgtttcatatggatcatcatctatcattcttttaattcacctgccggccggctatttaaattttactttttgtcatttaccacggacgacgaattaataatgaattaaagagaggcgtacttacattgggtatcactcactatatagtagatcccaaagccacgagctcgatcgatcggtctcgtcgcaattaagctagtaacttaattacatcatcgaccgatcgttacctaaccgatcgatcgagcagacgtacgaatttttccgttccactctccaggaaaccatgcctcccatggatcgccatcgtctcgccgacggcgacgattcgtcgatcccgttttgccattaaagggattattgattaattgtctgctgatcaaccactagatagctagatcgacagaaaccttgatcatagagtatacatagtgaaaaaagttcgagcaattcttaaacatatatagaagttagggtctgctagattttaagcaatgcacgattttagttcaatttatatttaattgtgttattatataagattttattttattttattatctattttatgtacttttgcatatttgcgtatgttaggataatttattatattcaacccttttatctaaagatgtgactttgtttataaataaataaaatgggataaaataaatgactgaacttaaaattttctttttttagataatggaaataataaaaaaaatctaaacactcttaattagttgtactttctttaagcaaacggtgaaaatgagctggagataagtctggcaccactaactctccattgttttataagaaaacaaaagtgtgggttaaacgatctacgtgtcaaccgaaaggtacgactaagtaatacgatgtataaaaagtaatgaaaaataaattaatgataatgctaagtttaaaaaatgtgttgcaactcgcggtccacgggcaatatatgctattactccctcggtaccagaatatagcaactaatgggatgagacacatcctaggacaatctaaaaaaatatattacctctcat

SEQ ID NO: 31382 - DNA, 1501 bp, Oryza sativa
ctcgttctccacttccatagaaacattttctctcccataaaaaccattcactcttaaaaaaactgattctttttaaaaagactagtataaaacccaaacagcataatcggctcaaattcttccactaaactgaataaaaagaccgttacgacgcacgggtctacagctagtatataaaataactgaatattgaatattgtgagggtttatatgtaaatcttcccaatggaggagcaagaggtgtgttcaagtgagaaaggaggagaaaaaggcaccgcctctccatgcattaaggggctgtttggtttccagggacttattctaagtccctgtcaaatcggatatttggacactaattaagagtattaaacatacagtaattataaaatccatttcataagtttggactaattcgcgagacgaatcttttgagtctaattacgccatgattttgacaatgtgatgctacagtaaacttttgataattatggattaattaggcttaaaaaatccgtctcacggattagctctcatttatgaaattagtttttttattagtccatatttaatactctaaattagcgtccaaacatctgatatgacatgggcttaaaaagttttagccccatctacacatcacacgcttgccttcttttctagtactgaggtggtatggtaggtcggtctgtagccagccagccagctgattttgcttccgccgcttttctccgtctcttctcgctcccttccctccctcccatctccctgcggtctccgagccatccacctcgctgcctctgccgccttcgtgtcgtgcgtccctctcctcctcctccgcgtgcagccacggcgtggcaggcagctaccacagcagccgctattagctcaaatcctcgctggttgacctcagctgcgacgactcttcaggatgagcgagtagagtttctgtggcctcgtttctttcttgcggattgggggtgggttcgtttgtttctttccttccttcccgcgtgtgaggcagtgagccagtgacacgcgggaatcgatcgaaaggccggatctttttttagcttgggaggaggaggaggaggaggagctgcgcgtgtgcaggttcgagttgactttcggggttggttggttggttctttgcttcgtttgtcgctctgcggatttttttttccggattggtggtcgaggtcgatcgaaacctcgcaaagattggacctttgccgcttgcctgctcggttcttatctcgtttggctgagttttgtgctcatttggagcccctgttcctcttgattccttgcattattggccatcccttgtctcgagagagcttatctgccaaagattcttgggctagaaggtttcttggttcattgcacggttgagtagtagtgcccaagaggatttgcagcagaggcacaaagtttgatgggtggctgatagtttggtggattggatagagaggagaaggagcaagagggagggcaggagaga

SEQ ID NO: 31383 - DNA, 1501 bp, Oryza sativa
tgatgatgacttgttgctcacaacaatcctattatagtcacgaacaattcgccctgattccaagaaagttcgtcaactcgaaatatggctagaaaagcaacaagcagaactaggagctttgggtattcagaagctgacaaacacaccgcccacacacaggattcggcttcagaatagcccctgctttagtgttcaggccaaggactaggcaggattagttttctcaatgaacaaccaagcaaagctgattaacaataatgtgttcaggaaacctagctgtaatgaatgtgcaaggggaataagaatccatcctaagttgttcttagcctctgatgaggaatttgctatattacagtcaaactgaatggcctacattacagtattacactgaaccaaccctctgctgcttctgtcctaagctggctacgcaaagaaactaaacccgtcatcatcttgtccaccttctcatcatctcctaaaccggaggagcacataatctattaatcttgtccagaatcctcatgagcttcttcttcttcttctcatcatctctggacacaaaagttttgtctctaccaaatccacaaaaaccaacaccttcagctgccgaagaagttgcattttgttctgatgatgatgatcatcatcagctccggttgtgtatcgggtcggagcctcgccggactcgccacttgctcgtctgcgccgcggccgtcgtcgccgcgaaccgctccttcgccgcgtcgacgccgacgacattgttggccggaggcgccggcgccggcgccatagccggagccggagccaggacgagctcggctctcgtcaggccgtgcaccgccgtggcgtggtgcagcgccacaaccacgacgacgacggtgcagaccaagaaaaggtcgagacggcttgtgtgctgcaccatgttggcttctgctgctgctgctcagatggagacaaacaagtctctaccttggctctctctgtagctagaatggtttgtacaatgatcaatcatggtgatgtcttgtctctagatatagcaggggcaggcagtgtcgagtccaaaagcacaaagggacaagtgaagccaagcacagcatattagcatagcatgcctaaggctgtcaatggaaggttctgaaaacctgaaagtttgagggaggcagattttggcaaagtcatgaattggggggggtacttatctcccaacagacaaaacctaaagttgcaattgtagatttgtaggggataggaggagcaacagtatgctagaaacaaagacttgctttagctccttgttgttgttatcttccccttcttggccactgtctgcagtaaaacccccaacactaaagcagcaggcacagtggtgagtgaaacaagtgaggcttttttgcttttctatctttttttttgttgttgtttgttgttcttggttgaaacacacttttctctttgaatcttcttccaagctaaggccaccaaagatgggggagcattc

SEQ ID NO: 31384 - DNA, 1501 bp, Oryza sativa
tggtattgttgttcagggatgaattccagactcgacgacaaattgagggacctaaagtaaacttactacggaggaagaagaagcacttactgggccatggcccacaacatccggtccatctattttcatcgccactatacctccggcccacggacgcgacgcgcttacacacatggcccacatgccatggtgcgcaagcgcaaccctttcttcctcctctgtcgctctctctctctctctctctctctcctcttctccactttctccctcctcgctagtgcgctctccttggcgagctcgctccgacgaacgccaagcccattgctccgcgtgtggttgggagagtgagaagagaggagatattttcggtgcggtggggaggggggattgagagaggccgaatcaaccaaccaacacctgcctgattcatcttctcgatcgatcctggggggtctgagctaatgcgcgccgccccgatctcccgatccggtccgcgcgcgctcgatccccgcgcctgatttctcctccccgcccgtcgccgaggagagctccgtccaggtagcgcgcacgcatacgcaaaattttggcgtatttaatccatgatctgtgtttgcatcgaatggataggacgtgctcttttgacttcagtcggtgctggtaggatgaaacgatgcaaagatactgtgttgttgaagacataatccgatttaaaacatttcttgttaacttggaacaagttatcttaattttcggtagtgatagtttctgctgtacatttttttccttaccaaatctaattcaattgcagaatgtagtaatgtattgatgcctttggctggcaacatagagaggttcatggactcgtttctagttctgctagtttcggtacttacatattttctgcacatatctgcatgttttttttttggttgaacataattcagttgtataatggactgatggcttgattagtaagtttcattggaaatataaggagcggaaatcaagaattcattccattccttgcttaatgtatgccattgatgatgaacttcagagttattttttagagtaaattgcacagaaccccatgttttatggtcaacgttgcttaagagtaggtacaatagcaggctataagccagctataaacatattttaaagagataaaggaagagagagaacagcagcgggctacagatttgtagccagctgcagcacggactccaaaacgtaatgtgtgtatgacaggtaggaccagatattaatagtatagtaagcaactattgtatgaattggctattacattggctatagatgatttggagctaatagttggctatactattaaacttgctctaatctatacatgtggttttctgcaactttgaccatagattgaggggtgttctaaaatttactcttatttgtaacttgtcggtttgtccatacttgtgctatacacatttactgaatctaattgtatttatcttacagtgag

SEQ ID NO: 31385 - DNA, 1501 bp, Oryza sativa
cgctctcccaccacacctgcgtctccgccctccgccggaattccgctcccgcacctccgccatcagcgctccgctccgtatcagccgccgcgccgtcctctgcatcgcctgtctgccaccgatccccgccgccagctcgctctccacgatcctccgcctccccgatgcacgaggtcctcccgtcaccaggtcgtcgccgccgttctgctccaccgatccccgccgcacgaggtgctcccgtcgctaggtagccaccgcgccgtcctctgcatcgccttctccaccgatcccctctgcatcgcaggggtgagctgcagctatggagttcctcgccggtgggggagcagcaggtgaatcccgtgagaggtgagtagttgaacaaaactcatcatgcagttcatcagcaggtgactagtccgaaacttggcatcgtggaggttcatccggattcatcatgcattctgaaacaaaacccatcatccagcgcttgccgcttttcctcagagtacaatgaacgcggggtgctcggcgaaatgtcccgtccggctcctcacctgcaatgcatgtgttctggagagtgtttatggattctggatcttagatcccctcaacgacttggatcgtcagtaaagcttcatcttgaaggtgcacatctgccgttgtttcgtcaaaatactatgcatgatctttaggtgataaaatattgattgaattgtctactgctatcgctcagaatccatactccatcaatcttacatatacacatatttgttgcgtcaaacacaagcttgctttccatacatccctgaacaattcagcctcacaactgctcttgacatatctcattcagaatttttttttctcaaattagttggactgatagaaaaatattgcttttcaagattgtaaaataaccaactgactgggaagttgatgtcatatgttggaagcaatctgctaaaatgttaaagaagtgcatctaacttttgtacccagtgaattgcaaatctctatctcgtttttttttgtttacagtttctttggttttaaagtaaaataggttgacatgggaactttactagcagaggaataggcttatattcttggaaaaaatacatttctccatgcagaatgtgattacaataatgatacttgctgccatgatttctatcactcatgcacgcattgcccttgatgattgtatgcagttgggatatattggtgagttcaccctctatctctctctcaaaccattatttatcttcattcactattcacttacaatttccctcgtattagtgatatgtattagtgagtttatgaaaaaaagatcagatatttaaaaacagagttagctcctttggaacgaagacaaaatgctactttgataacttgacttctcaacaccactcttatctgcacacaatttttttaatgaccagtttgaactttcatctctttacagtcatcaagcaagaaaatccttggcggttctgcttcc

SEQ ID NO: 31386 - DNA, 1501 bp, Oryza sativa; identical to SEQ ID NO: 31365

SEQ ID NO: 31387 - DNA, 1501 bp, Oryza sativa
atcaagtaaacatgaaaaatatgatgaaatgcctacagtgccaaagaaaacccctttttccaaaccataatatgttgacataaccaagacgctaagtagtactaagtactgtcgacccaaggaattggcaattgtggagagaactgtcacatagactgctactacatgctcaggccactgtcccaataactcaactgcaaataaatacccactgactcaaatttgccatatgaactttgaaaggataagttgatagcatacatggggagctgaattcttaaagagccatgatgaaatctttcccctccaaaatttgttcaaaaaacaattccctccacaatgattgttgcgtttctggcccacttttgtaggatagcaagtatagcacattagcatacagcacctgtacagttcagattcaggattcacactttcacagttcatcaaacagggggcctgcagtaagagacaatacctgattatgctagtgatccaaagggcaaaagcaggtgaaatgcagcctaggaaaaattacggctgaggcagacagggtgtgctccagctgctctggcctgcagtttttcgggccccggcctgattcatgatccgtctgatctccatggcctctgttgttcgtccagaagcagcgtacatgtcgctgagcaaaatgtagtacccaccctcctccgggttcaggctccttagcttctggaccgcccgctctgccatgttgatatccccatgtgtccggcatgcaccaagcaaagcaccccagaccacactattgcttggaattggcatttgttctatcattttgtatgcttcctcaagttgcccagcccgaccaagcaaatccaccatgcatccatagtgctcaatggtgaggtccactttaccatagttgccactcaagattgcattgaacatggcacgcccctcctcaacaaagcccttgtgtgcatatgcggtgagaactgcaagcagtgtcgtcccatcaggcttcacagatttgccatcagccagcatccgatgaaacaaagcaactgtgctctccacatcaccatgcgatgcatatgccgagataaatgtattccaagatgccaagctcctcacggtcatgccatcaaacaaattacgtgcttcagtgaggctcccacacttggcatacatgtccatgagtgcattacggagtgacaccatccacccgaagccattggaatcaacatactgacacacacgctccccagttgcaaggtccccgagtgcagtgcatgctgacacaacgctcagcatggtcacttcatctggctgcaccggcattgcatcaaacaatgccaaggcctcctgcggacgtcgtgccctggcatacgcggatatcatggcagtccaagaaacaacatcccggtgaggcatctgatcaaacaccacgcgtgcggcatccaaatcgttggccttgaggtgaagagtcagcagccctgagaaggagatcacatcccgagca

SEQ ID NO: 31388 - DNA, 205 bp, Oryza sativa
acggagggagtagtaagtaaactacccatctttacctatctacttaaacttttataatgaactagtctattagtgttgtactccttctgctcaaaatataagggattttaggtggatgggatatatcctagtactacgaatctagacatgatcctctccagattcatagtactaggatacatcacatccaactaaaatcacttat

SEQ ID NO: 31389 - DNA, 1501 bp, Oryza sativa
gcgcgccgccagcttgaaccgccgcccgacccacgaacgcttccaccgccgcgttcagccgcccgagcttcgtcctcgcctcctccccgtcgctgccgctgctgctcgggatgatggggttcgccatggcgggcgcggctgttccggcgcgtcgcgcgtggctgggtggtcgtcgcgtcgcgtgcgcgtcgcggggatctttttaaccagttgttgcggctgtgggcgtggagactggaagagtcagaggatccagccgagcaagcgaaatttcgggaggtgtaatggattattactatttttgttctaaaataaattttattcttaattatcaggattcacatttgcattgagagaaaagacgaaagtatccctcattaataagagaacgtggttgtatttcggtagatggatagataggaagtatgaaagggaactcttctatttacagagagatcaaataaggaaatatgagcatatttatatacctctaaaatttcagcttgatccttttcatgtccctgccgttacatttttctatcatttcactgttaagtttggtggctcatgtctttaatgcccttgatgatttaggtttggaaataagtttgaaaaataatgaaatttttgtttgagtgtatagtatatgcattttatgtaactaatgagactaaataattagtgcggaaaattttgacataaattttaaaaataaaacaaatgtaataaattaaaatttttattttactagaaaagatgtccgtgcgttgtaacgagtgaataatattttaatcttattattattatacaatttagctatggtgaaattcactgtaggaatttgcttggatatttttaagataatcatgagctgcagttaggagtccgattttcatctcaaactagtatgcaagtttttctaaaaagatttcttatacgacttctttcgtattttcaaaagcaaacgaacttaaaattcgacacaaacaccaatatgtatttccaaaagagaacgaacttaaaaccaactcaaacacggatgacgtaccaaaatactggcaaaaatatctttaatttttataatagtagagaaatctaataggacaatagatttcttttgattgggagcattcataaaaaatatcgtgagcatttatagtcctagctttgtatggatgctcctcatttttatgacttttgaacaaataaaacaaatacatatgttttattttattatctaaaaataaattttatcatatactccctccgtccctaaatatatgggattttgcttggatatgacgtatcatagtacaatgaatatagacataaagctgtctagattcgttgtactgtaatacgtcatatccagccaaaattccttatattttgggacggggggagtataatatatcgcacaacaaacaataataataatagtctcatgtgataaacttttacattttcaataatgtaattcataaatttttatattcattca

SEQ ID NO: 31390 - DNA, 346 bp, Oryza sativa
  unsure (1)..(346): unsure at all n locations
cgtcagagagagaacccccacacgcacgagagagggccacaccccgtgtaaaccnccnctctttttttttaatatcctccccgcggatattatatacaaaaacaaagaggggccctctcccggtgttatccacagagggtgttaaaccacccccaaatatagccccggggagcgccacaacctctcccccccccctttccccgtaaaacaaattaacccgtccgggaagttcacacagaaacacaaaatgtgtcgtgggtgaaataaaggagaattttccctaaattccccgtggttgtcaaaaacggggaacctccatagaagaaaacccccggtggtgtaagaa

SEQ ID NO: 31391 - DNA, 1501 bp, Oryza sativa
tcaaattaagcggcaaaaaccgtttaataaatagtagtactaaatattcataaaatatatagagaaaatcccttgtatacccctaaaattttagctaatcccttctacgcctctgaattttgcttacttcattatatagtctaaaatttgattttgatccattctatgctcctcccgtcagatgaccgtctaatttctacaaaaatgaccattttatcctttgaatgaatataaaaatttatgaattacattattgaaaatgtaaaagtttatcacatgagactattattattattgtttgttgtgcgatatattatactccccccgtcccaaaatataaggaattttggctggatatgacgtattacagtacaacgaatctagacagctttatgtctatattcattgtactatgatacgtcatatccaagcaaaatcccatatatttagggacggagggagtatatgataaaatttatttttagataataaaataaaacatatgtatttgttttatttgttcaaaagtcataaaaatgaggagcatccatacaaagctaggactataaatgctcacgatattttttatgaatgctcccaatcaaaagaaatctattgtcctattagatttctctactattataaaaattaaagatatttttgccagtattttggtacgtcatccgtgtttgagttggttttaagttcgttctcttttggaaatacatattggtgtttgtgtcgaattttaagttcgtttgcttttgaaaatacgaaagaagtcgtataagaaatctttttagaaaaacttgcatactagtttgagatgaaaatcggactcctaactgcagctcatgattatcttaaaaatatccaagcaaattcctacagtgaatttcaccatagctaaattgtataataataataagattaaaatattattcactcgttacaacgcacggacatcttttctagtaaaataaaaattttaatttattacatttgttttatttttaaaatttatgtcaaaattttccgcactaattatttagtctcattagttacataaaatgcatatactatacactcaaacaaaaatttcattatttttcaaacttatttccaaacctaaatcatcaagggcattaaagacatgagccaccaaacttaacagtgaaatgatagaaaaatgtaacggcagggacatgaaaaggatcaagctgaaattttagaggtatataaatatgctcatatttccttatttgatctctctgtaaatagaagagttccctttcatacttcctatctatccatctaccgaaatacaaccacgttctcttattaatgagggatactttcgtcttttctctcaatgcaaatgtgaatcctgataattaagaataaaatttattttagaacaaaaatagtaataatccattacacctcccgaaatttcgcttgctcggctggatcctctgactcttccagtctccacgcccac

SEQ ID NO: 31392 - DNA, 1501 bp, Oryza sativa; identical to SEQ ID NO: 31045

SEQ ID NO: 31393 - DNA, 1501 bp, Oryza sativa
gtctgcagcttgggaggtacagttagatttattgtactgtaactttgttggttatggtctcttgagtttacacggtatcggggaaggttctctaaggaagagcttagaaaccatgacatgcttttaaatttattgttgtacactgttgaattacattatggggagccttggaacttcacatgagttgcaatagaaagagttgatgctgcagcagacaacttgtgtttaggtttctgtaatatttacagtttcagacaaactaatagctctgtgatctgcaggccatttgcgaggcatattgtagtgacacgaacccgacgcgtgaccctgatatgcttgatgctgtgaaggcagcaatattgcgtatgacatattactggtacttactgcaacctcttctctttccctctctctctctctctcctcccgtaaaagatacgacaattgcttttgtggggtgctgcaggtacaacttcatgccgctttcaagaggttcagctgtcgttggttacgtggtgttgcttggcttatttctggcagcaaacatggatgtcactgctagcatccctcatggggttcaggtagattgggaggccattctgtctcaagatcctgacacatttgttgataaaatcaagccctggctgtatccatcaataaaaacaagcaggaacctgaaagactatgcagatgtcagcgtggcattcagcaccacaggatcggttgtagcggccttaacttgtgttgacacatgagtttgatattgatttcagcggatactataggttggctgaattgttagcgtctttgtttcaccataatacccccatgaactgttaaaacagctttgtctagattgtcgagcatttttcggtttgctacagtttttcagttgcttcatagagctgtatacctgtatgttgtaatgctgtttgtttgacacaataatgtcattctttttcccttgaacgatggctttgtaataataattaccaataattcatgaaaacgtttgacaaacggagcttgtttcttatgctatgggtggttcagatttagccttgtttcttcatggattcgcaattttggtttgagatttcgggcctatctgtcagtcctgatagtattatccccttgccaagaaggtggaatttgtttttgtcaaaagaactgttcagattcagtgaaggattgttcgactcctgggcatattagttcaaactgaaaatattacgttcgaaagttcagtctccctgctttcaactatttgccacttttagatttagcaattaactatttgccatacctatctcaatgatatgtgggttcacatgtgtctatgacatatgggtccagtggcaaataattaattgccacatctaaaagttcaatatgattcaaacgtggcctgctacggcccagtttggataggcccgttatgattcaaacgtgggcctctgtgcggcccaagtttggataggcccattgggtttcgacctac

SEQ ID NO: 31394 - DNA, 1501 bp, Oryza sativa
gtatgatttggcttatgagtctttgatatttatttaaagtcaaattgtatgtgtttttatggatcaccatataagatatagattttataattattgtaccatggaagttttgcttattagtaattcggctaatgtcaatggtcaatgtgatgatttattctagagttgttttctttagaaacattggcattgttaatattttgcatacatgctcaagccgattacttacatttgtagtttattggaattcatgtctgtgaggcatatgactttggtgattcattattgaattggctaagtgttttgatgccatgatgattattgtttcaaaagccatttgaattagtattcaactagacatgttagttggatgttatattttttcatatgtctagagagaaggaatttcggtccaataatttgatacaccaagcatctggctattatgtgaagaaaaattatatactaaaggccgatgcttgatttcaaaagtttggacgaaattggcaaagtcatagacagaggtggtctgaccggcattgcacggccggtctgaccggctctgcatggccagtctgaccgggtagacagtgaggtctgaccggcattgcgtgtctggtctgaccgatcctgggcagagagctggggggcacgttacaattgatttaaagaccggattaattgtgaattcggacatttgtgcccataagtaagaaatagattggagaatcactttgaatagaatatttcaatgatcctagtcttgggattgatcggaagattcggcggcaagcgctcaaatattatatcgccgaaaaataaatgtagtattacttggataatgatcaatctaaagttgctaggagagtagtacatgaagggatttgtgaaattcatcaatcggcccgtaagataaattggttgcttaggagagtggggtttcattggccgaaagtaattgatgattgtttcaaatgttatagagggagtgaagcttgttaacggatcggcaatgttcaattagcgcctatcgctgtattgaatcctattatcaaatcatagccgttcggaggttgggctttagatttcattggtcaatcttatgatattaagttgttaagttcttactctcaggctaatggataagccaagtcgagtaataaaacattgttgaaattgccgtttcgccagttgaggtaaatcttggctctcttcggtatttcaagtaagacgagttgtcggttgaagattatacgaccttgatgggaagcaatttttgaagatgtcatcacgagcgtttgaagactttgaacgagatgaagacacttcaagacggtgttttcagagatcaattaatgggaaatacttgaagaaatacttcccgagcatttgacaagatgattaggaagtcctatggccggtaattggattatcaccctgagacaacatattctatgcgtttaggttcacatatgatcaccaaaaaggcggggggcacgtg

SEQ ID NO: 31395 - DNA, 1501 bp, Oryza sativa
aggcccggttgctgcgagagagaggcacgaatccgcgtcacaaaccctagaccagatcagagatcccgcggatcggcgagcgagagattactagagacattagtactaaccagaggtcgtggatggaggacggggagcgggcgaggtgcgcgtcgaggatgcggatggccttggaccagttgcgccccccgcataccctcgccagctccgcgcgctccgaccccatgacggcggcgcgcggcggcggcggccggtcgccggggaaggggaggggaacgagaggtgggaggcgaggcgaggatggatttgtgaatttgtgagaggagggagggattagttactcgttttctctctctcacttgtgttgtgtggtaactttagcacatgggcccctctctttttcggttttttctgttgcggtttgttttttttcctcttttttttatacttattagggtgtaactttgacacatgggcccctctctttttcctcttttttttctgttgcggatttttttttttgtgtgtggggaaaggaagcagggcgctttggtgcgtttggatagattagttattttttcccctaaagcccctgatatcataatggattacagaatgatcctaggtcctcagatgcaggttcagttgttcagactccaatgtgaaatggattgaaggtttttatcactttattttccttttttttcgctaataagtgtaaccgtttataatcggttataggtgaaacaatatgacatctaaatatgcaccattggatttggaacatgaatcatcctctagaaaaaaaatcacttgcatcattcattttgtaatgaaagtttgatgtatgtgataacacaaagatacaaaggatacaaagccagacatatatagttaggtctgttttggaatgagtctaaaattctgagaagcagctggtgagaatttgaaaagctagaaaacctagcttttgacttcttataatctgagcaaaaatctcaaatgtttgatttaaagagaatttgtagctgcttgaagttcctcgaaacatgcccttagtaacttctgatgtaagaattgtacatgaaacaactttgatgtttcatatgggaatcaactttatccttttttcttttttccgtccgaaaacgtatacatctaggatcttgctttctaggacctctaattaatacgcaaactcccctctatcttttccctaagaaattatatcgcactgtaaattttctctaaattttctcttggaagaggttgcttaacatttggaacttaggaattatcctccgaaactatgtacagtataagctaagtattgtatagtacaggcttgagtaaagcctcatggacgtagcaatttgagactaacattttcttaagatcgaatgtcattagccctgtttatagtgaaagcgaaacgtgagactaacattttttagaaagaaaattacaactcgctaacacatgtgacaatgtccacagaatc

SEQ ID NO: 31396 - DNA, 989 bp, Oryza sativa
gggtaaaagagattaaataaatgaaaggtgaatacagaaaacgggatggagtatatgtaggttaacacgaaagggtcacaaagaagaaaattgggtttttgtgtgagccgaatgccaaaacggtaagttaacgtctcccggtatgggtaacgaagcgctataacaagtagtgtataataaaataattcagtttggttgaccaaaaaaaaaaaaaaataaattttatgctcacagctatatttagttataaagcaagaaacaactatggtccgggttaaattaggtcataatcgaaatattagtgggtgttagaaaagaacaataattttaatgagaaatggaaaagaaattagcagcccgtaagagacgcaaaaaaataatcaaaatgtgtaagaaaaaaatataataactttcacattgaaaataaagaagatattcaaaaccaatcagaacatttaacgatctagaatccatagttacgcacatcttcttatcaaatcagtcaattaataacattaaattccatcaatcttcaatgcatgtgtggaactaatctggaacacagtacactttgtgtgtatgaatgtaatagaaagtagccaagtcatacctctattacaatgagtctggtgggcatctcctccccataacggcccactccctcctcctccctctatcccccgggcagcatctacctcctctcttcctgggccggccgcccggcccaagccgccccctgcccgagccgcccctccttcccgcgtgcacgcgcgtcgcacgcgcgctgacgccgcgcgcccgcgtggggcccacgcgccaggtcgtcgtcctcctcccgcccggcatcctctctctcttctctctcccgtgaaacctagcgtcgtttcctcccctaaatccacgcgattcaagccggctctttccaaattaattggggggttttaatccccattgaatcctcttcaattgcccccaatttcccccttgaa

SEQ ID NO: 31397 - DNA, 1501 bp, Oryza sativa
tgacagtctgcagttgaccactggtgtgaactttgtagtagtactactattactactaataataatatgtgcttaatacattgctttttgatgtatggaaactgcaagtttaacatgcagaagattgccggccgtgtcataatttatataatcaaatataatctactaattaagcatgggtcatgatgggtatgggtgtgtctaccatcattcattttcaggtggtccatgtgtgactgtgattctgtggacattgtcacatgtgttagcgagttgtaattttctttctaaaaaatgttagtctcacgtttcgctttcactataaacagggctaatgacattcgatcttaagaaaatgttagtctcaaattgctacgtccatgaggctttactcaagcctgtactatacaatacttagcttatactgtacatagtttcggaggataattcctaagttccaaatgttaagcaacctcttccaagagaaaatttagagaaaatttacagtgcgatataatttcttagggaaaagatagaggggagtttgcgtattaattagaggtcctagaaagcaagatcctagatgtatacgttttcggacggaaaaaagaaaaaaggataaagttgattcccatatgaaacatcaaagttgtttcatgtacaattcttacatcagaagttactaagggcatgtttcgaggaacttcaagcagctacaaattctctttaaatcaaacatttgagatttttgctcagattataagaagtcaaaagctaggttttctagcttttcaaattctcaccagctgcttctcagaattttagactcattccaaaacagacctaactatatatgtctggctttgtatcctttgtatctttgtgttatcacatacatcaaactttcattacaaaatgaatgatgcaagtgattttttttctagaggatgattcatgttccaaatccaatggtgcatatttagatgtcatattgtttcacctataaccgattataaacggttacacttattagcgaaaaaaaaggaaaataaagtgataaaaaccttcaatccatttcacattggagtctgaacaactgaacctgcatctgaggacctaggatcattctgtaatccattatgatatcaggggctttaggggaaaaaataactaatctatccaaacgcaccaaagcgccctgcttcctttccccacacacaaaaaaaaaaatccgcaacagaaaaaaaagaggaaaaagagaggggcccatgtgtcaaagttacaccctaataagtataaaaaaaagaggaaaaaaaacaaaccgcaacagaaaaaaccgaaaaagagaggggcccatgtgctaaagttaccacacaacacaagtgagagagagaaaacgagtaactaatccctccctcctctcacaaattcacaaatccatcctcgcctcgcctcccacctctcgttcccctccccttccccggcgaccggccgccgccgc

SEQ ID NO: 31398 - DNA, 330 bp, Oryza sativa
atgattccattcgcctctcactggtacagtcgttcatcatatttgtactactaccactattagcagtaatagaaatgtggaggggtatattgtaacaaaaaatgtataaaagggtataatcatcattagcagtaactaaactttttccctcttttttggctttttcgatgaaatatatttagccgggaaaaaacatatataaatgacaaagtaaatcataattattggattagtaaattactattttacctataataatatactggtagtataatattataggtagagagcaccgaaacatcactcaattttctttatttcgaccctagt

SEQ ID NO: 31399 - DNA, 1501 bp, Oryza sativa
aacaccaatgaaagtttgcggtgcgagagattgctacatactggttggagaaccagtgagcgagtagaattatctctcgaacaccaatggaagtttcggtgcgagagattgctacgtaatgattcgagaaccagggagcgagtagaattatatctcgaacaccaatgtaagttgcggtgcgagagattgctgtgtactggttcgagaaccagcgagcgagtagaattatctctcgaacaccaatggaagtgctagagttgttttattacatgtgtatctcatgtggccagcatgactcacatacccaacttataacatatctggatgtccgttcgcaatcatgtcaggtgatcaagccgacgacgttcgcgaggaattatccgttaacaaccttttctcgagtagtccagccatggccggtgctatgaggtaggtcgtcggtcttcgttggtaggttgggcgcgacaactccgcatttatcgagaatgctctcgatagtgggatgtactcgaccacaacctactcgagtgctcaattgttcctgaaaaatattttctagaaggcaagacatatagcagagaatatcgagtatgtacttaaaaaactgcatgggtcttctagtattatcaggatataacgagcagattaaatatcaatcattatgtaaaccgtaagtaagcatgatttatacataagaaaatagagcgagcccccagcgttaaaccgcagtcgatttaacatcggaaacactcgcacagcagatattgtataaaagacatgctgtaggtaaacataataaattatagatctgacaatatcgtatagattggaaaaagtaggtatgataaattggatataaattattgcgtacctttgtagatacatgccaaatgtatttacgaaattagtagattaatttaaaaaatcaatccactaattaccttgattagcgcgctgatatgttcctgtgtacttgggtaaagtttcgattcgtctctgagtacacgactgtgtatagagtcgctttgacttttccagcgtggcatgtatctggtgtccgtgtgcatgtaggaccaatacaggccgtatacgtacacgatacagatatttggatcaggcgcatatgaaatccaaccgacatacatggatgcatttgtctcggtagaaatcgatatcgcgcatagaggaagtcggccttcgtatgaatccaaggagtacagcgccgtgtagaccttagtctgaatcaaaccaacacgtctgtgcctgcgaggacatccgtcagcttccagaacagtcccatattggatcggtcaccaatgctgccagtatcgttcgtcctccacgacggcgataatttcgatctcgtcggaagacatactccggtcggatttgatcttccccacagtgaagtcgtcgagtagtttattgttggagaattcatctcttgaacccatctcttcaaaatcctgaagcaccaaaatcctcctacttggcgcgccac

SEQ ID NO: 31400 - DNA, 1501 bp, Oryza sativa
taattctatcagaggttgggtcgatttggaaaagcagtttcacaagtaccccccctcggggggttaattttttatcatcatatttggttgtgactgcattaaatgcttaaacaaaatttctatcaatgaagcagcaaggcacacatgcgatgcatcgtacgaagcatttctgccatagccccacctaatatgacgatcaaatatgattttttttgaaaatatgatgatcaaaagtgaatagggggagtatttctttgctggagtccaggagatgaagctatcatatttgacttcgatcaagcaaagatctgatgaatcagtgccagattttattcatagattcagagatataaggagtagatgttatactccgagtttaattgattcacagttggctaatttgaggaattgttgggggccgattaaagacaaattttcttcatttgcttttgaaagcttggctcatttagtacaaaaagtatcggctcttaaacaacgcttccagaagtctttgacagaaaaatttactaaaaaggccaacaatgttaacaatgtatggaattaggcttctgactcagatcaagatgaagatccagatattagcttgatagaatgggcgaggataaaaatgacagttgttggtcaatgggttaaagatattggaaatgaggaaatatttgattttgacatcaacaaagccaataggatatttgatcttctattgcaagagaaacagatcgtgttgcctcagaatcacatgaatccatcagtcgaggagttgaaaaggagaaaatattgcaagtggcacaatacaggatctcatcatactaatgagcgcaaagtcttcagacaacagatacaatcagctatagaacaaaggaaagtcaaatttgatgatagtaaaaagtcgatgaagatcgatggacatctttttccattaaatatggttcatccctgaagatctgaaggaaaaaataacagggtaattcatcggaccaaggttagctcaacaagtttgatcaacaaatatcagaagaggcaagaaaagaactactatgaagatgatagatattgttttgacccacattgggactgtgagttcttcaggttttgttggaataaggggatgaggttaccgaagatttttcgggttgcagtggtggagagatagcttatgaccaggagaattcttctcgccgatatgagatgaaaagttcacatcaactgattcaaaagaagcttccagttcattagcaattggatccgatccatgaagattattttgaatatgaagaggaagaacatgaagagaaagggcagtaacctcaatggtgtcctagtgaaacttctactaaaaatcaaaaaagaagagttcaaagattgaggaataggtagcagatgcaagaagtggaggaagaaattagtcatcaactgaatagtccaaggaaggagtggcgtgtgaagattacaattgtcaagattgataatgcaggaacttcgt

SEQ ID NO: 31401 - DNA, 1501 bp, Oryza sativa
tggcataatatatggctcatttgcaaaagcagcatttagcaaacatttgagaattataaaacagtagagtaattaatcattaattttaatcaacactaaacagcacacccatgctgctcaggcccaaccatcctgaacaaccatacccggctgtacatatctatctccaaaccaggaatataccattccaaaccaggaggctaaacaaattattaccagttatagcatcttttattatgatgagaagtgtgaaactaatcacgaaagacattgttagacccgcccataaccgcgggcacggctattcgaatagttttactctggccagaggtgtaccactgtacccacaagacacagccccacaacatgtcaccatgtgcctcaataccaccacggtacctcggaaaggagctgtgacagtacccctcgcacaacacaatccaccacagcgcacctttcctggatcataatcacccttataaacaaggcatggactccccagcgacccccgtgggcttatctccgccacttctcagtctggtgccccgcaatgaaccatgttatacaaaaggtaaagccgttgcccacgctggcttgtggttggcacggttaatgtttcacaaccgaaactcgtgaaccggtccttaattgtcatgagcacgaccatcaaaaccatgtgctcacaacccaccattatcaagttttagttggcaaattaattaattaaccaatcacgattaaccatcatgagctatcattaagccatcattaaataatagtgagtcataagttatcccaatagtgtgctaatgtttctaagcatggctaagcaatcatatctactatctagctgaaccaatatataaagctcaactagtcaagttatgataacccaaggtatcaaggaataaagtaatcaagaacaaaagggctataacaaacattaggttaattccacccaatgacattcgaaaataaatgcaatagttgaatagaaacaatagctttaaacgggatcaacatgctcaaagggatgtttgggatctgtgtgacttgccttgctggccttggaactcttcaaaatcttctcctgcaaaaacggactctccggaaacgtcggaatctaaacagaaaggagcaaaatcaccaaaacagcacacaaacaagcatgaacagtacatgtggatatttttaacatgtagatctctattttagaaaaaattagaaacttgaaccaactaaattcgagctaagatgaattagttatgaattttcaaagattaaatcagattaaatcatttatttagattttaattgaattatgacgcaataatgaattatttttgaaaaggaaaagggaattattgcgtcagcggctagggttcacggtgaaccgggtgcacggcggcggctcacggaaacgaacggccgatattgacccatccaaaacggacggccaagatccatcggtccacggccagaccacgagagacgacgacga

SEQ ID NO: 31402 - DNA, 1501 bp, Oryza sativa
atggtgagatatgacttcttttagcactatttcataaaacaataaataaaaagcccgcgcaccgtgcgggcttccttcctagttataaaataaagggagtaattttattttcttttctaaattcgttgagaaccaatgacaaaatgttgattgatgcacgttggctacttgttgatgattccatacagcttgtaatcaatttctgtacgtgttcatccgacgttgcttgtacgctcaagatatgtttatttccttggttgttatacctataaaaatatatagacacatataaattttaaggttcacgcaatagttggatgtacactataatgaactatagtttgtagtttctccatatattcgtgtgcacttagatttcaacctactaggtgaagccacaccatagtattgccttctctattttgttaattttggtttttggtagctataaatttaggtggagacaaattatattttttaaagataactggagacatattacctaatgaatgataggtcaagcacatcatatgagatatcagatatctagccaaagggtttttccgatatgtccttttcagcctggccataactttttcccccaagaaagtgaaatggaaattgtccgttggcgaagccaatcaattgagaacaaatttggtgtcattctctacttcactttcgtgggtcagattaccatacgtgtacgtccttaattattctacatttgaggatcggatttaggcgatttacctatttgatgttgacaagctggttattattgttctaaaaaatgttgtggttaattaatttggaattttattttatcattctttagtttggctacaacactgttttctttaatttatctcttgcaagcttgctggattgaccttctatgtataggttatgtgccatatggtggagctccaataggctagaggcataagtttctcatgaattagtccataaaagatatgtaagtttcgattttggaaggggacctctacattattgacgagaaaaaaaagaagggtgtgagaggacaactagcaaacagcttttttaaaaaagtcagaaaaacaagaaatatatatatgtgcattagcaattacaattttcaacttgtacatacgtacgttctacacagcttagcccttacatactaaccaccagggttcaaatttttattttggctattttctatcaggtactgaaataatttgaattttaataaaatttggtcacatttaaacaaaatttgccaaattcacaaaaaatggaaaaaagggtggaatagttttggttttgggggggggggggggggaggggggcgatagacccaaaattttgaaaatttcagtccgtaattttgaacctgcttattacatatatagtacgttaatttaatcatgttattacaagcttcccgatccttgtgtatccgatcataaattaatttatcacttggtcatttttgatatgaatggtgcattgcagc

SEQ ID NO: 31403 - DNA, 1501 bp, Oryza sativa
atttattttctaagtagcatttggttcaatcaagctaaccaggatataaaaatcaattcagatccctaagaattgcctcccaacttcaactgcggttacacgagtagttcttgttttaatcataccctaatccccagcatcttactccagacaatagcaatttgcaaccacatatggacaagtttgtacacaaacattgagtgcgtgcaaatgatgcaacatttaataaaactatcaaaatacccatgttttgtctaggtgtcagtgctttttttgaactatttcgtcccggtgaaaaacatcacacccgcatgacccgatatcgacactaaatgaaaaaagctcacccaacgagtcaccgagagattttttttgaaacaaacgctctcaatccattccaatatgtccaagtctcatgttacggtgctttttgaactaattcgtttcggtgaaaaacattgtacccactgttgatgtgaaaatacggcagcctgggagatctgcttaactctagtgtaggtccaaggctagcctcaagtgtctcaagggcgtgccaactgatttgatcctgcaatcagcaataaagaataaaagcagaatcaattgactgatagccaattggccgataggctaatagcgtattgttgatggtctcagcattgtcgtggcgtggtagctcctggaaccttcgcatgatcatgttcacgcggggtgtggtgctggcgtggcatgtaccatcgtccactcccatgtaagggtagaaggttgacaacgccagaccatttttcatgacgtactggaaagcgttcaaggcgaggccccctgcgcagcctttgctccttggatggcaatccacgagctcctgctctgacaggagcaccgggttgtcgtagtttgcccctgcatgcgatgacgcggtggctctccagcgcgcccgtcatggcgaacgcccagcaagagccgtagcacccccatgaacatgactggaccaaggcacggctggccttcgcaggtcttgttgcgccaattgatggagacagggagcggtagggtcccgttgccatcgtgccttttcacgggccaaaacgcgaggttgctctgcttcgtcatcatgtgacacatgtcgcgactgagtgcttcgtcggtggcttcggcgaagatgttgagacctggagcttggcttgcaactcaaagaagagaggcaacgcggtgcatcatctcgttgaatgctactaacggcggagcttctcgacgatcttgcgtgctacattgtggccaagtgatagggcggccggactgtgttgcttgcctcctttcatagaaggtgcagagagcgagcgagccaggtaggcaagtagccaaccagcagtgctgtcgaaacatgaattcggcaataataaaacggggtagcgcacgagacctaaaagtggatggatgcggagacaaggatttagacaggttcaggccctctcaatgagaggtaataccctactcctctttg

SEQ ID NO: 31404 - DNA, 1501 bp, Oryza sativa
gtgatttttgcttacttgttcatgccgagttgccaacacaaatcgaagttaggaaactacgtttatgaagtacatgttaagaatgcaaacataatacccatacatgcatcagtctcaaatacgtacacctaaaaaaacaactacacagttaaaagaaatgtgggtgtgattcacgttagatcaatctgctcttttctttgtaataaaagcatgtgcagagaatgcaatcattttgaagagttactaacagaaaaatatatcttgcattggtaaaggctactcttataactcactagattgcaaagcgctatgcagcactagccctaactctgcttctaacttctaagccctgcagtatgctgctggttctttttattccctaatatactaggaagatattttttattccctaatatactaggaagacatgctggaaacagctgttgatgttgagtctatgaatgcttctctctaacactaggaattcacaacttcttgatcaatcttgttgtaatttgatgttcaagctactgaatgataatcaggtcaaaaggatcgaacgatttgatgaatttgaggagatggtgcaaagggaaattgttgaggatgtggagaaggtggagagagcgaagactgaagatagagattgtatcaaccggtatgttagcttttgagtttaaggcttattattgttttccaccctagattcaccttcatatatgtactggcatgcatatacacaggctgttgacttcttgtgggatgcccaaaggggaatttcgagataagctaatgtggggctgtaatgttgctgccatatttgttgcatccggtgcagttgggtcattgattgctaaaattaaaatagatgggagtgtgtaagcatgccgagtttggtggaagacggttttttttaaacgttttcaatttttaattttaaaaataaatcctttcaaaacttaatttcaagatatgaaccttttggcccagctagccggactgggttgacaaaacaacattatcacgctagccagaccggcgtgatagcgttatttggtcaagccggtctagctggcgtgacagcgttatttggccacgccaggataaaactcagtattgttttggccaaaaggtttagattcgagaaataagttttagaaaggggttatttttaaaattaaaaaataaaaaagttcaaaaaaaataaaaaaaatctttggtggaaatgcttctgtgcgttatgtaagcacactaaactattgtaaactattgctgtcctgtcttcggctggaatctgcacatgtactcctgttatatgatactcttattatcgtgtggtttgtgatgactttttgctggctaggctatcacagtccttgcacctaatatccttttgtcttagcgtggtgtaagttaaatattaatgaaaggatggattggaggatcatcatttagctgaaagagaaaatataatttttaaaacttatttgtctgagttcga

SEQ ID NO: 31405 - DNA, 1501 bp, Oryza sativa
cactgtgcacaagaaagcttttccttttcttgtgagagcgttcttaattcaacctctaagataaggtatttaagttatagagataaataaattagagatggaggcttgaacaaaagacaagcttttaatctgtggtaacagcaagagtcagaattaatctagtgcaaagtgacagatgcttaacacaccttaaaaacatcacaacgcctaaaaccttatgaaattatataactcaattgtacaaattcattcatcataaataagcatggacaatctatggcataatgcaataatgaaatttgaccgtgccatctcttacccaagaggagtgtgcttttgattgccacataaattaacaaccgtatagagcaatcccaaaaggcgaaccaaatactttggaaagttgcacatgaattttgaggcagtaactaaatacttgaatccatagttgttgtttttgtgtgtgtgcgcggggtaaggttgggagcacatgaaaaaggtaaattttttcaagctaggaggaaacaagtgcaatgataaacagatgacacaggaggatttgggactataataatatatattaactttgaacaagacatgaaccctatatatttggggtggtaaactctagatcgaaaccaaggaatgaacttaattaggggtgcaggaacaatgtgagggccaggtatggtacctcgtggttgtgcctgttgagagggctgaatcgggggccccggagcttgcggggaggagggccgccgtcggagtggtacgcggctcgccggatggccctgcccgccgccgtggcggctggtcgtcgcagcatcttccggcgactagggttagggtgcggaattgcccgatgagagcactatccctaattaatattggaaaccctcatctcattcgatcactctcccgccatcgtcttatttttactctacaggcctattcttcttggaccctcaacagaactcggcccagcaactaaaaattctgatagcctttttttttttgctcgaaaaatcatttttcttttcttttctcgacgtcttacaactcaagaagaagaggaaactaaaagtcctattcactttatctttggatacaaaccggaccagccttctttcgagcctaccgtagcacaaggttttgatttaacgaccaaaattgataaatcatagattggatccaaggtcagaaacgagaaggtctgtgtccatagaagcagaaaccgtatcggccggctacgggaagcatcttggctatcgtctgcagcatcagttgatactaaactagacaattctaggaaggtggttctagaatcattgttgggatcgattgagacgccgcacaagaattaatgccatgtatggaaagagtccaaagaaggcaactgtatctattaattaggatgtttttagtagtttctttatagatatattcggtaagagtccacctaaaggatttgttcatatttttaagttgtaatagaggtaga

SEQ ID NO: 31406 - DNA, 212 bp, Oryza sativa
agcaaatgtgactattcggaaaatatgcaatgatagctcttggtggtacaattcatgcgaaaagtgtcttagggttgtcaaaccatttggttacacctacaagtgcactggttgctacaatattgcaatggcagtaccaaggtaatagatccttaatttttgttttatcactgtaactacttgtcaccctgtttacctaagcgagatcataa

SEQ ID NO: 31407 - DNA, 269 bp, Oryza sativa
ccacacgtttcaagtttcaaccaccagtttctgtaattttcccagcgttccacaatggatattagcttaggcggcaagattaaggcaacaaaaagaaaataataagatcaggaggagaagaagcgttggcagctagcaagttttaacctaaaccacatgtgaaaccatcagtttcttcccacgtattccttcccgttgtaagggtaaagacacggccgcactattttaatctcaaccatcagtttgctataattttcttacattctagg

SEQ ID NO: 31408 - DNA, 1501 bp, Oryza sativa
agtcaaagaaataaaaacgccaataaatataattatgaaaacatactgataaattgataataagttaggtttggcacgaagcaatcctagtaaattgatggctaaagcctactgggaatttttcttaagaaaagtatgggatatcacagcccataaaattttctattctcatattattgtgcaggatattatccatcctattatttgtctcctcaaccatttttgtgcattgaatttctcatatcatagtgatgcgttctataaaaaaaaagtgcacctccaaataccaacaacacacagacatgcttttgcacaatcttgcaaaagtggtttacaactagtagctctattattgataatgcccttatctttgtatccatattctgaggcccattctacttcaaaaattatgtttttttaaatctttcttcaaatattgacctccatcaaaagcacacagtaagattggtaatgaatatgaataaagaaatcttccgatagtaacactaagtataggtatgttttacgctgttttctcaattgtttttgttcctcgaggaaattaacgtatgcaaagctattttgcataaagtttctcgtgtgtgcacaaaatctcgcataggtcctcgaaccacctgaagctaggtgcgatcttgtaaattaatttaaaagttgtgccaactagtgcgacaacttgtctagctgctatgcctttgatcttaactaagaggtaccacgcgggcaatatttgcacaccaacaatatttacaaaaccaatttaacaacttgtatgcatgtagttgaatcagctaaggaatatgttggttctttttactatattcacttttacagtataaataagtgctaattaacatgtttctgaaaaaaatattgtgcaaatcttatagagctgcaatagttactgatggttggtgtcatacattgtcggttcacattaaagtactcgagtagagttttcattcgattgtgtggcatagaaacgagcgatagaggttatgtgtgtgttgttaggatatggagacagtggtcactgtagactaggcacctaccgccaccagccaagccaaaatcagtccaggcgcgcaactctaccacaacaaactagtaacgcagccggtcgtaagcccaacgtacaaaacatcccggcctcctccactcaaataactccatcaatcgttctttccttgcctcattgctagtgtaaccgcctcattcgatagagggaagcgatgccaacaccgcctcagctaatcttcatcctggaaggccaggaaattacagcaaactaatggttgagattgaaacaacacagtcgtgtctttaccctcacaacatgaaggaatgcgcaagaagaaattgatggtttcgaatgtggtttaagttaaaccctgctagccgccaacgcttcttctcctcctgatcttattattctcttcttgctgccttaatcttgttatgtttggttcctgatcggtgagga

SEQ ID NO: 31409 - DNA, 260 bp, Oryza sativa
  unsure (1)..(260): unsure at all n locations
attttctttttccccccccccaatttttggattttttttggaccaattcccaccctaaatttttcttgaatgagcgagattttcagttgctcacntggtgcattctgcatcacanaagtaataatgatgctatcaatgtcagaaatactgctatgctagatcatgcaatttctgatgatggttgaagtttttgcttntacggttttcctctanaattccaataaagaattgtccgctagcattgttttgaatgatggaac

SEQ ID NO: 31410 - DNA, 1176 bp, Oryza sativa
  unsure (1)..(1176): unsure at all n locations
accgcctttaaaaatgtgtgtcaaccgcccaaatttttgcggccacaaacccttagaagggttccacaaaaaccgaaatttccccaattttcctcaatctggagaaatttcttttcaagccatttaaaaagggggntattttttggtttaagaacgcgaaccaaactccccttcacaattgttttaagaacgtgttttactataagaccattttttttgtttgcaaagcccgggttacattaatacctcgttttcaaaatgggtgtgcaaccaatggagaaagccttttttaatggaatattttttgggggaagcaatctttgtgattccatagagggctttccgggaacttgcattttgcattccaggcaataagccatggtactttttggcagaaccaaaggagcgtattacaatggttaaaaagtgaaagaaattatgcagatacacagtaatgggtgaaaaaatggtcgtcttgttaactattgagaacaaaatgcacatcagttgaaagaaagcangttgttgtagcaataaggttagatgtgagtccattaattgattacaagggtcagtttgtgtgtgtagatgtgtctatctgttccctataagcttggtctagcagattaaggctacttttcaagcctttgaagcaaggtacaggtccaatgaaggttgggcttaggggtgtggcaaagcctaatctcaagttgggccaacacatgccctgggccgatgtgtgaatgtgaacaattcacctagctagaagcagcatccactcaggaaaaagaaaagctaggaacagcgatgcactcatgcacatggataggtatgtggccaattaacataattgataattcaaactccagtaagtccaaatcatattttggacaaaagcaagcaaacagcacatgtgcacatgtgcacctaaagacaaaggaaatgcatccatataaacatttggcaaaattttccaaacaaactctgccaaagagaaaatcagaatatatctcatttgttggcttaaaaccttatagtatgtagacaccgcatggccaaaaaatgatgatgtaaatatcttgataaaaataaaaatatagcaatcagtactttagatatatactttaattgactagaaatcaggtataattttattattaaggcccactgcagtaa

SEQ ID NO: 31411 - DNA, 548 bp, Oryza sativa
  unsure (1)..(548): unsure at all n locations
ccctccaccaggaaaaacgggtgttttaaaaagccaaacaaaaagtgttcacagaaaatgtccaaccttttataaccggacagcccatcgccccaaaattcctgtgggtgttttggcctttaaaaaggaaaatttttaaaaaaaaggtcagttgaatataggccaaaaaacataccttaatttagggaaccccccatatccaaagggaaaccgtgaatatcggtttagcactttaacccccggtgaaggtagaaggaactcctccagaagctgtgggcccggaaaacaattttcttcggtgggcttttcccccggtttgttcaaatcacgggcaaaaatgtataatgaaatttccaacaagtcggtcagagttttgacaacaccatgaagggcttcatccgggcacccaatttcaattgaaccccaaattctccgacgggctaaatggcagactcgtgcttaacccaagaaacagccttaaatcaactgggtaaaaagcacaggagggcacaaaccngacccatttcccagcgcaaaaagaagacgga

SEQ ID NO: 31412 - DNA, 1501 bp, Oryza sativa
aaaatcgaatatacggatacatatttaaatattaaatatagattaataacaaaaaaattatagatttcgcctaaaaactgcgaggccaatttattaagcctaattaatccgtcattagtaaatatttactgtagcattacattgtcaaatcatggcaatctacacacaatttatgtaattaatattttttatatttaatactctatgcatatgtctaaacattcgatatgacatggtgaaaaatttttatttaaaaactaatcaagacctgaattgcctttgcaaagtgtcagatggtatgtctgggaaaatctaagattctaagaatcaactgctccttccattttatataatataagacataactacatttatttaagttgtttcataatagaaggtgtgtataaatgcatgttattaactagcacatctttttcattaaaatattattatttaaatcatctaccatcaagatctctaattttattaggcgcatgtaatatatttattaaggtaatccaaactatgatggtttgggtggtcgtgtggaattgagggagtacttgataattaagatataataatacggaggagctgtgaaacccagcttcttagagtttagctcgttcatgtttcagattatgtatgtagagcgtctcagaatctcaatgaaagtacatattattttggagaagcctttttatttcgagagaagctgcagttgtcaaaaatttttctaaacaggcccagtgactctgactcgtagttaagggtgcattgtccactttttaaaattgtactccttcatatttcacgtgcacgctttcaaaattgttaaatgatgtgtttttgtaaatgttttctatagaagaattgcttgaaacaaatcatattaatttttttttcaagttttattgttgacataaaaattatgggtacttccactttaatatttgtttaatttgcctctaattattggtaaaattacttattttaaatacatatttttgttaatcacataaattttcttccatcgcctcttgcacgaaagcgaccgaggcattcacttgttgctcccatgatacgatcattacactaacacgatcattacactaacgcgtcaggtacatcattcatatcatacatgtgcatagtggaataattatccaaaaaaaaacatttgtgattattattggtcatactaggttgcttaaaaaaaatttcagttaaactttatccactgggtatattaccggtacaacgcacgggtattttactagttttttttcatataaaacagaaaagtctgaaaacgcgtggaccaattttggtaactggccgaactcccattagactttacgggcaaccggcccatcacgcttttttgcgtggccgtaatcgaaaagaattcgtccccctagttgtgtccccggggagaataaatttcctaatctaaattattccgccaaaaatccgccgcgattggccaccgctggctcca

SEQ ID NO: 31413 - DNA, 1501 bp, Oryza sativa
aaaggaggaccctgcccactgagaaaggggatgacgcccagaatacctgaactccagaagagagaaagcaagtgcactctccggagtgaagaaacccttgtaaaactcatccataatcccaaacacagaagtagggtgttacgctctatagtggcccgaacctgtataatccgactacgtgcaaactcaccgatagtcctagggatgagcaagcgactttcaagagacgggcctccgcccccagccgaactcacgaaaggggggtctcacgactccccgctattgagggtcttccctcgacaatatcaaaggtaccgagatgtatcaaatttgatatctcctgttacctcaaaggcagtaaaatcgctcttcctacaaatataattacaggctaaaaaggctaaaaaacaggggacgattgaaatgatggaaaatgtaattcgatggtacagggtggactactcacatagaaaattggttgactaccgcaaaggtcatgggttcaaagtcctatttctacatgtaatggcaaattgacatctgttttagtttgcatcattgcaaatgtttacagaaaatggaaatgcttttgtttgcgtgtgttgtcatacaaggtgttaggaccagggttgtcattgacatgatgaccaatttgagctgcctaatactacctaaacttaggctcattgctgacgctgctctagctttcaagttttggccctctcctatttccctgacgtcatctccagttacagcacctaatctgaatcattgccatcaaaactctcttctgcaccgcaacttcacaacgtcatcttgacgtatcaaagacgttaaaaagaacattctcctgagctagtaagagtgcattgacgagcattagtacccagtcaaacacaactctgcattatgagcaaagaatagtatgtactcctactatgtagtaatactactcactagtcaagtcaaaatggcacttgcttttgcccaaccaagaaggcaccaaacatgtcgttaattctgcaagcaagaccgggtaagagcagtggtattttggactggttaggcatgtagctttgtgtctcgatcgtctcttgcatcgtctaggttaggttgattgctggtcgaggtagttggcgttggaaaacttggaaaagatgaggagttgtgtgtgtcactgtgtggtgtatcaacgtcgcgtcaagacccatcggcatagtaggcagtcagatgcgtatcaaagcaaggccgaattcatttcttctccggttgctgttcgttgctagcgacacgcacgctgaagcatattcgacgccacgaaaaagagcagatggggttacacactattggggagactttcacacctagccgggttcacactgggatcagtgtcggtactctgttcctaatggtttcctcagattcaacaattctatttctagccaatcaagcaatctttgcttgtctgttacagatgcaagggttcagacttcagacatga

SEQ ID NO: 31414 - DNA, 1501 bp, Oryza sativa
caccatgtacagctcgtgccacgatatcatggcggcggcggccgatcgccggtctgggagcagctgatcgatctgtttcctgcgatgcgatcgagaggagcagcgtgcgattagtgtgttgctgttacatgcagagagtgagtattgcggcgcgcgatgccgcgatgggatataaaagtacgctgtcccgggctcccggcctcctgcgcgctttgactggttctcttcgaggtatgtccgtatgtgacacaaattttgctctggtggagaactccacggagcaactgaacctcgtggcactgcttcaaaaaaaaaaaaaaactcgtggcacagatatggctacgtagccaaatctagtaatctcgaaataagtttatttttttattcttttttgtctttaaataatttgtttttagcaattattatatcgaagtttataaaagtatgacataattaattgtattgtatgtagatgaagaaattaataattatattgaaatttgataaattagatgtattataggtttttattagtacgtgcgagatagatgaaaatgaaatttattttaaggctgtgtttagtttacacttaagtttggaagttaagttaaaattggtacgatgtgatagaaaagttacgtgtgtataaaaaatttgatgtgatgaaaagttgaaagtttgaaaaaaaaaactttgaaactaaacagggccttagacggagggattggcagtagacacggctagtgtacacattttgcaatgaatttttccgaagaaaaaccactgtagatgtgtcagtccagtcgtctgtagatggtctagtggccgttatgtgtgctgtcacgtcaggccggcggggtgcacctcgaaatgccgtgcaattttggatggactcatggcatgcgaggcattgtcagtgtggctggtacagcccgtgcagatgcagctgatccgatggcctcgcaggctggcaggctcttttcaggcagcagtgcagcaccggcctagtatgcagtctccaaatcccacgaggccgcaagaaggcagcccgcaaactcggcccatacaaatgctgaactagttatcggcccaagagcagtaaaacgcttctttcagcgcttccggcccaggagcctcaaatcacacctcagactcgaacatgaattgggtcgcgctaccaactgcgctttgctctacacttactcctatcaaagcaagaccctcactttggcatcgcagatttgcggcgtcacatggctgccgcggcttggcttctctccgttgtgtcgcacacgaagagtgccgctccgtactttctacttgcagtagaaatcaatctgatccgtagatctagttatatccaaaggctcagatctttttatactccacctcaatttatagtactagaagtgtggagggtcattattgtccaaagaaaaataagcgctcatgggtaaaatagtactttcatccttttcttttaaccctacccccctctacg

SEQ ID NO: 31415 - DNA, 1501 bp, Oryza sativa
cactcactgattactgctttgcaaaaacactttgattagtagcagtactgctagtactagtgttgtacacttgtactgtgctcctttgcctttgcattccggagtgaaatgttaaagtgttcaccaaggtttctcgtgaattttttccaccgttttcttgcattcgtttcagttttgactacgcacatctgctagtaggagtagtagtacggaagtaactagccctacactgactaatgtgtcggtgacttcatgatccacaatccacatcatatcatttgatggaactgaaattaatctaagtactctcgagagagacagcatcaaagattcaagaacatgacaccacgccagtgtggtctggatcctcgatgcctctggtcgggtgctaattaatcactgcggaaataaaaacctgaagcatgtctgttccatccctttttcatcaccgtctttgggcgtggtttagttctcaaatttttcttcaaactttcaatttttccatcacattaaaaattctgtacacacgtaaactttcaacttttccgtcacattgttacaatttcaattaaacttttaattttgacgtgaactaaacacacccttgatagagtgacaaatagtaaattctcccattgcattacacagctgaatggagtatgccagcatctcgtttgcagtttgcttcggtctcgtttagttccaaacttccttcaaacttttaacttttccatcacatcaaaacttttctacacacataaacttctaattttttcgttacatcgttcaaatttcaaccaaacttctaattcattgtttttctcaacatcctagtgaccttaattcaggcctttggcacgatgactgtgcaccggtattgctgaatagatgtacttccgtccgattgtatattccgtattgctatattttggatggagtatcgtaccaaaagaaaactctagtacagggcccacagtaaagcatttgcgagtcttttgagagaggggaaaaaaaactagaaaactgtcattctgctgtgtttagaattcgtcattggttccataccatttgtttagtttttttctccaaatttgtagttacatacaaatgttagccttttgattaaaaaaaagagaaagaaatgagagtcgtgtaaattttggtgttgttggtagaaaagaacggtaaaccaacacttagcctatgctcagttaaacaacgatggataagctgaagccagatgaactaagtaatcaagaataatttacgaataaaacgtttatatcttaaaatccaaaggcaagaaaatagcgcgccaattaactaacacacacgtatttgatcacccccacaccattttataatacggatcataccagaataattttattttattttttatttgatgtggcataatttaggtcttcttttttttttctcgcacattagatgccacacatgattcttcctgcactctaaacgtcatggcaaaggacaaaaa

SEQ ID NO: 31416 - DNA, 1501 bp, Oryza sativa
ggttaatgcaggcttcaagggaaggctgttgtttttgcaattgattttatttgagctcttttctgaaacaactaagggagtgcttctcaaacgacacgggtgagacagtgcgtctcgtccggtcggagtatgtgcaatgtatcagtcttttgaattgattaagattggctcccggccaacagcttttaaacggcctcccggacctggctgatcccatcagccgcagattttccaaacatcaaacccattccacaacagcaaatttcacaaggcagtagtcaaacaaaactacgctaggaatcacctcacatccgcccatgaccgtgggcacggctgttcgaacagttttaacaacctctgcagagggggtacactttacccacacgacattactaacccggatcatccagttcgtgcagaatggccacgactagagaccttaaggctttcatgacaaggcatttcgaaagccgacacaggttcgccatatgccaacgagaggggtcccagaccaacaccagattaggtcccagaccatactgtgccaggaagcccaggggtcctccccgacaccaccccggcgaatccacatgtctcttagcatcatggctcccccgataagctagttactcagccaggggtgtcccattccacccatgtggtcgtacttgtcttatgttcggatgaaattccaaggaaacggtccttaagtgcaagagcgggaaaccgtacacccggtacgttccccggtccgcggttttggaaattcatttagttcgcaagcaccgacccaggtgtcgggttttccaagtcttttgtaaaacccaagttttacccaagatgtttctcagattttaagtttgaaggcgaccatcgatacccgtgcagagtgcacgattaccgaggcgcgactaggtgggtacaagggagcatggtataacaattacaatgggagggtcaaatacaacaaattaggtaggtctgccaatctgccttgcagacgggacaagcagattaagtgcgatcctatcaatgcataatatttttcaagcaacataattaagttcaaatataggctcaagatgttcaaaggtggcttgcctcgctcgagatcttgagcttgatcctcgaaatcctcgcactgcgggtcttcgggctccaaaactacacgcgaaacggaacaactcagcaaacggtgaaaataaagccctattattgacctctaagcgtgccattagatagatctcgagatttgaggaattttggaagttgaacggagtcaaacggacttacggttgggaagatattgaatttctaagattattggattttggtctaaaggaaaagggtttatttaaatcctttttgaaaaagaaaagaaaagaaaataaggagggagggaaattagactttcctcgggcggctagggcacggcccgagagaaaggggcggctcggccgagcttaatgggccggccggcccaagaaggtggcccaaagcg

SEQ ID NO: 31417 - DNA, 1501 bp, Oryza sativa
atcactagtgaggaggcaagtcaaagataagcactactgagcaattagaaacagctaggagtatgttggaaaacatgagccacattattatcatccttgacgacaaaaatgaacaaaaacaaaaaaaaaagagattaaataccactctccccgtccagcttgcttttgcctgatgggcagggagatcgtcgattttccagtagctcccatccatcctgctcacgggttggatttggctactgctgtggataacgtttcttgtgatccttagctttgctttgtcgtttgacatctacatcacttttcattaatatggtttattatatgctagtagtagctttcttgcctacgtaattgacgctctctctcggtccacggcacggtgcgtacgtgttttgtcgccattgagaaatcggcgacgtttgggccgtgcgcccgtggcgttttcaagcctaataatcagtgaggtgttgaagtttcgttcaaaaaaataagtgaagtgttgaagaaactggcaatggcaactctccgtatctcgtgcggctactacttgaccagtgctattttggctgtatgagatatcctggtactatgataccgtatgaatctaccaaacagtgagatctatcgagataaatctcttatattttaagatggataaagtatataccactggatctttcaaaaatcatatgctactgatataccctctccatctcaaaatacaacaaactttagaaaatagtatatactaagaagaaaggtaaaaggacatagtaaaaaagaaaacatttttaccttctcaaagatgagtaaggtgtatgccagtagtttattggcaaatattacctcccacgttattatatttaaaataaaatttaaactctataacttgctatattttttatatgttgagatgaaagtagtatgcatgtatgatctactccctccgttccaaaatataatattttttttggtatctaagtaaaatttgctatattttaggatgaagggtgtatactgtatcgttatcatcccaagactgcctcgcttacacgatgggctacgcttttgtctctttcgtcgtgcttctactaataaaagataaacaatttaagaagataaaagatcatgctactttcaaagatgtgacacgtgattggtttgtgattttgtacacgctcagcaattaaactgtttgtgcattgataaatctattttatttaaattaccttgttccggatggaggtactataggcttcctaggtgccatgctatggatctatggtcaccaactcacaaaggacttctcttttgccccctactgactgctgcataagattttttttcccaactgaaatgaaagtgacatcagacaacaaaatcatcaactggatggagaaactatcaatcccggcaaagtaacagttggagaccgatagtaagtaaacttttcaccgcaaaacatgtaataaaacaggcaacatgttgcagacaccat

SEQ ID NO: 31418 - DNA, 1501 bp, Oryza sativa
tgacttaaacatattgatttaaaattgagacagctgatctacttggctgcatattattttcattctccaagtccaaataagttagaattagaactatgagtaattacatacaagcaaacggcagaaaggatgccccaatagacagattctctgaaccatatcttaaacccataataccataatctccttctgaacagtccctacaaataaataaataaataaatttaaccatgtcatttttatgggttcaatgcatattgatagaaatcaataatgagaatatcagaattattggtagcatatagtggaaaagtataacacctatgcatgatctgcgaccataaacaagatatggcctacctgtttgccttaagtaaagggaatgttccaaatgcaccaattcgatacttaggatagtaagcacacgacctcagctgcaccatgctggataaaaaagttataagcgaaatcaacattatctatgcaccatttaggatataagtttcaacataaatgtcaatccaacaagaaaatgcttacggttttggtgttgacaaatgaaggtccataaaggtatttggatcatccaaatatctgtaaagtaattcagttgagccattttttgtttagagtaaatgcttagaatagtaacaaagtggcatagaaatctggaaataatgaagctttagtaaactatgcaataataaccacctctgccagcgaaacagagcctcaccacccgttgtagtcatctagtaaagccgagttaagaaaaaaaaatacattgcaataacgtaggaggaaaaaaaaaccggtaaaaacatcataacaaacagagaagaaaaaaacgttattgataatccacgtttcgcacaaaatttcaccgaaataaaaaggaaccagatcaaagatcatcacaatgctaacaaaacgaaaaaaagtcaatgttcgaatggatactttggcggtcaaatcaacatgagaatcaaccagtggcctcaacataatcatccctgaggttatgctcccaacttgatcgaagtaatcgtcaaacaggctccgccgctggagcttcccgaacatgacctcgtacgccggcaccgccatcctgcccaaacaatgccaaccacacttcagctccataaaaaagacaaccaaattcgtcgatgaatgcaagcaatctgagtagtagaagatcgcggagatgttggtgacctggtgcgggcggcggcggcgggaaatgtgaagggcggcggcaccagcaccatcgccggcggcatctcgtcgtaccgccgcatcgtgctcctcctcccctgcaaatcgatctcgcttccaaactaaccaagcggccgccgctgctgataagtcctttttccttttccttttcgccttcgttttcgcgctcgcggttgatctctcccggccttgtacgccacccgcgtcctcccccatcctttcttgccaaacaagcctggcctgcaaccatgggcccggcccatgt

SEQ ID NO: 31419 - DNA, 1501 bp, Oryza sativa
taaaaacaattcaatcatctcttgcagtttaatattagacataaaaaatttatcatcatgcattttaagcagtattgtcagaatacattagtataacttactccagaagagccagtttatgcttctcaatctgaatttttaggatcagaatgttagaaaaaatgcaggttaacttgaactgagtgcatcctaaatagagatagaaggggaagaacctgaatagacaatgcacatgttaattttccactggaaagacctttaaatggatgcattgcttccttctcatatctgtatcaacatattagagaagtgtcattgttcattgcttgagtcagtaaaatgtaaacagctagtttagttttcattttttaacaaaagaagctccatcaatttagtccattgagtgatcgtcaaaagcatagaaatttaggtatcagataaataaggataaaatgtgaagtgcccattaagttatgtaagcaacataagtgcatacaaagcatgtaatacacaaaaagtctcctgcagaagttcagattctattgacataagccatgcaacaagtcactccaaggagtcatagaagcaactatacaaatgattcttaacttcctgaagcttgtgtctaatattagaatttagaaagttattaattcatcgatcatggcagaaactcaaagatactaaacttaggattgttaacaaaaattcatcatttttaatgcaagatgagacatagattagaattctacaacacgaacttaactgttatgcacatcaagatcaaatcattttaaaatttatttttgactaagaaaatattgattcagcccactttggaactgagtcaaacccatcttgaagttttaactctaaatagtaccattatttcaccaacaggttataaacctttactgaaacaaaagagagaaatccttgagaaaattacagttggaaagccaaagatgtgctatgccttttttggtctcacaggctttagttactggcaagtaccaccgagtggtaactagtaaccagcagagaaaaacctactggccagtaactatgggtaaccagttgctaccagcctacactgtgaaaccaggcagagaaaataaaatggaagttcaaaagctttttgtgaccacagctggaacgcgcgtcagtttttcaagcagcaatactgcagcagtatgactaggaaagggtaaaccttacacaataataacgcctattggccaaataaattcggtagtttgcaataatagagagtacttatttgctatcatatctattagttaggaaggtatcagtttagtttggaataagatatgtagtttgttagaaaagtatagagtaaggggtgttacgtgttagtgttgggtggggttcgtttctacttttttcaaacgaaacttatacccctcggaggtatcaagggatgcacttatgtacagccttatgagaatcactaatatttagtttttcattacaaggtctg

SEQ ID NO: 31420 - DNA, 1501 bp, Oryza sativa
ccacactcacacagttatattaaccatcacatttactatcggatcggctctacaatttcgagggcctaggtaaatttgatagttcgacactataggctcgtaaggcttttctttttaactgtaacataaactacacatgtgtcacaaccgccagatcgaggacaaaccgacggacatgatgcccgagatattcaatggctcaatgcctcaactgaaagatctaaaatactcaacacgcttgacaccctagatcatcaaattaaattgcccttctaaacatggctgtccgcacgccttttttggcacgatatcgatttgatttgagggctgaggttccctttggtttgtgccttaggcgatcccacaaccggccttagcctagagccgcgaccctgctctactcacaactagtaacaattggggaaactctattcatttcttaagggaatatccccttattttttttatgtaacttaaaagtcataaaaaatagaaaaaaatagtaagatagatcaatatgtgatatgtcacttcacaaacatgcacgttcaaattcaacttatacaagaaaaaacaaaataacaaatttgactatgaatagaacgcgtaaccgcagtcaaatttattatttttgtttcgaatcttatatttcaaattttaacatgtatgtttgtggaaaggtatttcatatattgatttatcttcataatttattttcaaatttttgatgattttttaaataacagacacaaaacaagaggatatttcctcgagggataaaaatccatctccaacatattgtgcactaaactattgggaacgcaattttgtgtgtttaatcttatggaaatcgatttgaatccttgaaaggacactcataagtgtataatatactcatagatataatttaaactatagtgctttaattctcaacattttgacaaattaagctgaatatgaatctttccttgtccttacccagaatgcaacaaatcaaatgaatccaccagtccatcaccatatcactattatcatcctctctcgtttttttaggacggtttttgatttaataagcaattaacgaaaatggtaaatatccctaaactattaagcgcaaaatattggcattgagacccaatataatggccccgccgtgtcgctgtcccgtccacgtgccccccgagagctgagcgataaaaatccaactgctcagctcagctcagctcagcctccgttgtacatcactctcctctcctctctctctccagaggccacggcagccgccaccgcccggagaaacaatggaggccggcgaggcagccggcgccgtcctcttcctcctcgccgccgccgtctccctcctcgccgccgtctccaccggcgccctcgacttcacctacctcgtcacaggttccaagattttctttccatttttattttcccatccaagttaattagcttcttgctttcagtgagctgagctcttgtcgtggtacgttcc

SEQ ID NO: 31421 - DNA, 1501 bp, Oryza sativa
tcgcatttaaaggctacaggtatttttcttttttacggagtgatcaaaccggatcaagggataaactactgcaaattatatcttctcgccctagtggacttctttatggagtgaactatatcaaatgttttgcttttgatgctgatctaattagtctgctgatcgttacggagatgttggtcatttccaactcttaatcttgctaatttttttccttcttttgctccttgataggctcgcttggcaaggaatctcccccacaaaattcagaaaagaggagggactgcataatcaggtactgcatactccccctcacagcttcagtaatgcttgcatgaaaaagttattaaaacaggctctctcaaaacaaaattcatttctttgccagttactaagcttaccgtctttacaactgagaattgctttattaaagaaaaatcaaagttaatatgagtgatcttgggtgttgtaaatttgatggtgtaacagcatagaagcacatggattttatgctgctatgttgctgtaacacaagtttgccaaacatttatgcagcatctccatgttctatctagtagtggtttattttgtgtacaacattgagatattactcccaatgaaatttctacagatttttataaacatattgaaatatgatccattctctaaaaatatgaatgatttgcactatatcatgtaataatctagctcataatgtattacttactttgttgtattttaatcatgaatgatttgcactacgattatttccacatttggttgattaagtatctgccaatcaattgccattcatcctttttattttctgggagcaatttttaccatcattttttgcattgcacctttgactgatatttctaagcattgctatttccttttgagtacctcgacaaacagagttgagcccattgtatatcctataactgattaatgcttgtaggtatggatctatttgagcttcaacaaagccctatcagaattttgacatttcctgtgcatgtcaaaggttctgaatagatacacttcaccatttccttttattgcaggataacatttttagctattgttttcggttaattttcaacatatatagattcatctaggttgacattgacgatcagcgattgtgccaactttattcagttaaaacctgatctagccatttgcagttgtgcaactgccgttgataattttttttccttcttggtatagtcacatcattagtttgttgtatatgcatgtaggcacttattatttatcatgtgcagattttatccattggcataagttatactaatatctgttgttttatcctttgtgttcacaaaatttgtattgttgaagatcatttgaactttgaagtctattgattttggcgaattctgaattcgagcaaggttaccattgaccatattatttggataattttatggttgtttctgagatggatttcgtgtccaaaaattgttgatcactgatt

SEQ ID NO: 31422 - DNA, 594 bp, Oryza sativa
ttcgtgtgggttcacggccttgattaataatatgtatagctctagacttgtgttacaaagtagggttggagcacttaagtgacttttaatgttgttttactgcaatccctaaccccctatattatggctcccttgtactcccttgcatttattctgcacttgtgggtatgtcttgctgagtacggtggttgtactcagtcttgctcaatttttcccaaacccagaagaggagttcctagaagatgaaggttttggtgtctagctcgtgcctgccgtcaagcacctgtggtagtcgccctagtcttccgctgtttcccgtttgtctttgtgtgtgctgggccttcgccgcccatgtaataaattaattatttacgcttcctcttgataaactctgaaatgtatcaacttttggtgtaccttgcctcctgggacaaggaataatacacgcacgtaaggaacgcccgttgggttagttccggtcgtgacataaggtgaactagtagattgatagagagcttaatacacttcaaatagatgatattttaatataaagggcaaatttagacgatcaagacccaagtagtggaaacacga

SEQ ID NO: 31423 - DNA, 1501 bp, Oryza sativa
taatcttctctcgaactagattactccaaagccgagtgcttcaatcatcctcgccatgatctcccgagtacttttaccaaatatgaagactgtggagggctgaaaaataaagtcaggtgcatcgagtagatgtacctaatagatgcaccaactgagtggttttgataatcgtagtcaaacaagtgacttaatattaatatatagcatatgcggtgtgaatccctgaataacatgatccgagtgatataccgactgctttgtaaaatatgatgcgtgcaacctaaagctgactacatcattgaaaattcacatagcaaaatagctataaagaagcttgtatgttgtgaataaagaaatttccaaagtattgggcatacgccatgcgcacactgctttaacagatgtgcttaagtccctagaagacacatggtcccaccacacctggaaatatatggcatatgtggtataaaatccgagtaaataaactcataaaggatttaccaaccgcctgaaaaatgaccacaatatataatcagcctaagccataatattggtcaataaaaatgcacacttacgtggcaaaaagcaatgatattgtatccaatcaattgcttaaaaacccaaacagcaccatgactatataaaaaagtcagcgggccagctatataaagctttactgtttgacaccttttaagatgcattgtaccaactcctaaaaagttgagtaactgcggtataaaaggattttaaggtattgggcacttgattacgcgcactttggcctaagcgaaaagtgcctaagtccctaaaagaacgtgacaggccacacctgaaaatatgggctgcagacatattaggcctaggccaaaaaatatgccttcgacaccatttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaataactgacgcagtcggcatggagatgaaatgaccaacatgaagacgaaattgctcatcagaagtaacggaagatgtcagtggtagtaaagatgccaccaatcaaatgtaatgaagttgcataaccatggaggtgaagaaaccagtcggcaacagtcaggtcagctagcagtgaagatgtaggcgcccaacaacaacgaaagaacagtcggtggtgacaaaagcaaacccaacgatgaagacgtagacgcgcatcaacggtga

SEQ ID NO: 31424 - DNA, 162 bp, Oryza sativa
ccgacgatgacgacgacgacgagggcagcagcgacggcgggatcatgaagaggctctgcgccgcctcgagctgcactctgatcctctccagctccgccaccccgagccctcgccgcggctccctcctcatcaccgccgccgccgccgccctctcgccgtagc

SEQ ID NO: 31425 - DNA, 495 bp, Oryza sativa
gagcttgacctgggccgtgtcctttatcatgcgtgccatgcctctcgctgactggcatgtgcactgcttgctgccttcttctctactctcacacagggtaaatacgaaagtacacgtgtcttttgcctaaaaaaaagtaaaaacaaattataattgttatatagaagtgaacaatgcaaagttttagtggtatagaagttaacggtgagatttctatagcataactctgagctggtgcggttttggtgatatgaaaccaattcttttggttaaatattttcaacttattctgttattaccgtaataaacaattgagttaatctgtaattcttacttggaataagtgaggattgttcacttttgaaaatataaatttgctactgttcgcagaagttagaagtatgtatatgtgttacagttccattatgtgaagcaatatgttgcataattatctcaagcatattttttttctattgtagttttcgaaccacaaaa

SEQ ID NO: 31426 - DNA, 1501 bp, Oryza sativa
tgcatgcgagtatatacatagatagcacggcaaaatcctagttaatccagatcaccctttcttaaatttgagaggagttattaattaatccacatcatctatgagcacacgcggaagaggaggaatcggatccgtgccgcgttgctccgggccctcgccgtcatcgtgggcccggcccatgaccagcacgctcagcaccacgcgcctccccctcatcaccaccctctccccatgcaccatcgccaccaccacctcctcctcctccgcctccgccgccgtcgccggcggcatctcgtgccggcacagcgggcagctgccgtggatccccagccaccgctccacgcactcgccgtggaaccggtgcccgcacggcatctccttcctcctcccgctcccgcacgtctccctggactcctccccgtcgtcgaggcagatcgcgcagtcggacgcctcctcgccgtcgtcatcctcctcctcgacctccctcagcgccgcgatcgatgccctggacgccggggccacgccgccgccaccgtcggcgctggcgctgccgtcctcgtagaagacgtggtgcaccaggtacgcccgcccccgcagctccggcgccgacgagacggacgccccgacgagcaccggcggcacgcccgccaccgtccgcccgctgtccctgtccgtcaccggcgtcacgatcgacaccatcgacgagggagcattggtgagcgacattacccgatctcttcaatttcctcttaataattcttcgcgatgcttttgctaccatctgcctcgctctcgctatcgttctcgctcgatttgatatagaggaggaaaagacgccttctcgatgatcggtggattgggttgatgatgcgcatggcgccaaagggttcgaggtaggtgagccttttttttcttttttgtctcacaattttgcagctccgacaaagcggtggcgatcgattgggatttgggctccacatgtgcacttcgtcttcttgcagcaacacaaggtccatcacttcaattttggatgcatgctgattttgcttggattcaggctgaatttggtttgtttggacaccagaaatgtccttttttgactaggaaggttgttgctgttcttgacatcccagtgcaaaaggggtttgatgattcacaattttggaatgttcttggaagatctctttgatgattgacaattttggggtgttcttggaagatttctcatggtggagccatgtgcgcagaaactcagcaaaaaggcagacctgtgaatttgttgatatatactggattgttattgacatttttgaccttttgtaactatgcaaaatactacaggtcaacataaactgtgacgtactctacaatttaaaaatgctttctggagaaatttaaacacagaaaagaatcacatatcagattgatgaaacggcagcagatttgacttgatttgtcagaagcagcaatgatcaggtagagtgccaacgcaattcagccc

SEQ ID NO: 31427 - DNA, 1501 bp, Oryza sativa
ttaaactatgcttatacataaagcgtatgtttatatagaagagaaaaagaaatggaggctgagcaatacatgtttgtgcttgacatggagccatttggcttttagggagtccaaaatatgggatattaattgctggagcctggaaatgcacttaactccatatacggggcttgctctcaatcaaagtttatataaagatagctttctttacagggtttctatttcttctctaccaatataccaatcacaattagctcttccacctgtcccatctcgacccatctgtctcctgattgcccatcccattgtggcttttcctgaaccctcctgtagttgtagattgttgctccttcctcaacatcatccccttcttgcaacagaaacaaccttccttcttccttggttttttgtccctttcaaacacagactccaccaatttccaccattcactcgagtctagtgtagtatgaagcctcaaaattgttatgaaaattggagtagaagaaatggattggggatttggtgttcgccacaagactgcaccatattacaagttaccggtaacaacaaatgaaatttagagttcaattttgtactttcccattcgctgatatgcaagtatctaaattggttcaactcaggttacaacacttaatatctaaaggagtttagattctgatttcacgcactaatcagaaatgataacaatctttcattaataggaattatgaaactggttgtaggtcatcgtatctcctgtggcccatctccttctcatcaagccatttgattcccttcaagtacaagtccgggagaccagtaccaaaatgccttcttgtaaatcttcatttctgaacatttttgctccattttttaataattatagctaaggttttgatagttaattaggccacctggcattgggtgctttgagccttggtaattgctaccctgccactcaatgccatggcagcagcctcatttctacatatcggtatgatccatataaagtggtctcatggaggaaccagagaccaggtttagctcctacaacctaactttgtcatgcccaacacctcgtaagtgtttctcttgtggtgctcttggtattttagttagatattccctccattccaaaatataaggcacaaccaccttaatccaaagaccaagaaatagttattattatcttgtagtttggattatcctaataaatgtaatgcatgcatccaatagagttagagaatgtgagagtgaaggattttaaaaaatagtagtttaatggagaatatgtcatagttaatgacatgcatgcatgtatgccttatattatggaacatctaaaaaaagtgtgtaacatcccagcccagggcttaataggattaatagaatactcatatcaactagttgcaacttcttttccggaagccgatttccaaagaactccagggttaagcgtgcttggcctggagcaatttagggatgggtgactgatcgagtg

SEQ ID NO: 31428 - DNA, 1501 bp, Oryza sativa
ttgttggtgccggtggtggtgttgaaagttgatgttggtgttgctgatgatgtgctgttgttgatgctactgacctgctgctagttgtgatctgctgcttgttgcttgccatgctattgctaattgccatgctgttgccgatctgaatttttttttgaacgacgtttgctgatctgagttgacgctactgatctgctattgttgaaaatggtacgatgttgttggttctggttggtaattagggactttgctgatgctgctacttgtagtggttctgcttgattgtttgcaggatcagatttgctgacgtgctactgcgtggagaggggtgacagggaggtgaccaccaagtggttcccgcgatcaatggtcacacgggcgagcgtgataatctcacaggagggagagcctgaaacagatttcagttggtagttttgtagagggaccactttttagatttagggagtcaattttagccaatctcttggagggctcaatattttaacaccttaaattttatttaagattcccataaacaaaattttgggatactcttggtgatgctcttactgagttattctagtacagtactgaattttaacacctatcattattctgaatttttttatgctacttgtagagaagtaaagagcaatactttctagtatatctgttagtgggttttattatgacccacacaacgggtaatgtactaatgagaatgatttgaactgaggaaattaaatttatattaatatttggtgctatccctaaatttatattaatatttggtgctatcccaatctgcagtccattggaaaagcttgagaggagagcaacatgcaacagacaataatcctgtgggtctggggttcagcacttcaaaactgacgaccattgtgagaatacataggaggtgctaactaagatgattgaaggtgacaatctagaggaggtgctgcaggaattggaggagatgaagaacttcatcaagacaatgcatagcacttatcatgctattaggatttaaaaagaaaattcatataagagttagtttgtaatcaatttgtctatatactgaaatgacaatattacacaatgtgtaaaatgcctctgcttcttccaacttgacttgcactgcttttgcatctcaatgacagcccgcgcacgagcagaactcgacggcaatccacgacaatgcacggcagtgagagttatcgttcttcccttccttaattcaaaaatgagcacaagaacaaggttttgctgaatttcaagtggacaatggacactgcagagcagactgaagtgaatataatctaccttatgcacatgacaacaggaaatcgtgcctagggtggaaaatggcatctccctcaccacatacacagaccacatatatggacgagggtgaacagatatataccttcatgaaaaaaaattgacatctgaacattcagggaacttaattctgaagaaactcaacatgaatatattgtta

SEQ ID NO: 31429 - DNA, 1501 bp, Oryza sativa
gtgttggttcggattgtgttactagtttagacaataatggaatagtcgaatcaagtaatggttcggattgtattgctagcttacagaataatgccattgaagatatagccgaactaaatgatggttcggattgtatcacatgcgaaagtgaaatagcattgtcacctaagaccgagtcacaaatcggtcatgtggatgttggaaaagatgataacaatgtcttgcgggatagtagtgaaatagaatccaaagttgccatacatacatatcaaaggccgtatcctgaacatgtagattcagttccatacccgcaaagatttgaagtgtccaacttcacgaaattcacaggtgaggatgctataacaacaatagagcatatcggccaatttattgaacaatgtggtaaggctggtagtgatgatttgcttaagttgaagttgtttcccctttccttgtcaaactttgcatctacatggtatagtttacttgctcctagttcaatttctacatggtcatgaatggagcatgagtttcatgattatttcaaagatgcaagcttgatggagcaaagaccgattgatacttcatcggtcacttgtgaaactatttcggttacatctattcctaagaccggaattgttagtgatcctcttcctgttagttctattgatgttgacaaaaagaaagggaaaagtgttatttggggatcctcggcccaagaataggatcaaaaatacgaaggccgaagatcataaagttgcaaaggatgagtcatctatgtcacgtcctgataaattcatcccgaaataaaaatcattcgctaaaaggaataatagaattaattaaaattcgaaaagaaattggcaaacactaaaatacgtacaagaaaaattcaaatgtggcccggagaatttttgttaaattctccttggtctaaaaggagccctcaaattttacttgaattttcagagcaccagaaataattattaagcaaaaaaaacaattatcaaagtttattaaaaagaaaaacctaaaaataatcctccttcctcctttgggccaagtctggcccaaagtcctccctctctctcttggcccagcccaaagtctccctctcctccctctctttcccctctctctcccgggcctctcctccccctcccggcccactccctcctcctccctctctcccccgggccgcctctccctcctctcttcctgggccggccgcccggcccaagccgccccctgcccgagccgcccctccttcccgcgtgcacgcgcgtcgcacgcgcgctgacgccgcgcgcccgcgtggggcccacgcgccaggtcgtcgtcctcctcccgcccggcatcctctctctcttctctctcccgtgaaacctagcgtcgtttcctcccctaaatccacgcgattcaagccggctctttccaaattaattggggggttttaatccccattgaatcctcttcaattgcccccaatttcccccttgaa

SEQ ID NO: 31430 - DNA, 1501 bp, Oryza sativa
gtcccttcggccgcccgttcatcctcgccggctcgtcgtctcgcggcgccgcctccgtcgtcggcatcgcagcggcgtgttccgcgccgtcctcgtctccgtgcagctgccgccggctgccctcgtcgcctcctcgccggttccggtcgtcgtcctctcgtcgttcccggtcgtcatggcgttcgtccctccgtcaagccattctcgtccgtctcgtccgcgtccgtcaagtgtgccgctgcagccccgtcgtcgtcttcgtcctcgcctccgcgtcgtcaagccttgtgccggccgcgtctcgccttcgtccaaggatcgccgccgaagtcgttccctcgccgtccgtctccgcctcgcccgttcgtcgttgtcgttcccacgcctcgtcgcgtggtggtaaggatccctctccctcgctgccccgtcctcgtcctttaggtgtcgcccgtgcccgttgtgcggttgtcggccccggtacccgtgtatcggtgtcggcagtcgttcgcttgtgcgtgtggtgaccgtgttagtgtgtccgctcggtagccgcgtggtttccacgtgtgcaacccgtgtggtgtctagtggagtccgtttgtcggccactcgcctcggttgacacacggggtccgcttccgtcgacccgtggaccgtctctgtgtacccggtctaccgcggtcctttaggttgacatgtggggtccgcatgtcaatggcgcagccttcctgtcttttccaggctagcgcttacatatgttttatggttgcaaagcctaattataataatccgcaaatctccatataacagcattaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagcttctgtcgttccggaggttcccgaagcgtggtttgcggtcgttgccgaaggttcggaaggccgttctctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctagaataaacaaaaccccaactagtgggcactctattcatggttccactagtatgaatttaggtagatgcttcgctgattaattaggcaacattaggtggtttcataactctagactttgggaatattcatatcacttggacattatggaatggttagattattgtggaattggatgcatacctccccctctattcaaaaccctcaaaatggttttaggctgggctcggggtgcatggttttgttagtagcacctcggccacctaaggaccggt

SEQ ID NO: 31431 - DNA, 1501 bp, Oryza sativa; identical to SEQ ID NO: 31394

SEQ ID NO: 31432 - DNA, 1501 bp, Oryza sativa; identical to SEQ ID NO: 31045

SEQ ID NO: 31433 - DNA, 1501 bp, Oryza sativa
attttttaagcagctttcgtataggaactttttttaaaaaaaaacgcaccgtctttagcactgtgaaaagtctgcgagcaaaatacgtgggaggtgagttgggaaaattggaggaaagaacacagcttgtatatgtagttctctgcacgtgtttgtgtctattttacgaaatatcctatagatgcaagtcttcacatgttacatacacataacatgtacattaattaactaacaaatattcacaaaattctaaaaaatatgtatgtatactttcaataaaagaatttgtaatagtattatatccacatatgaaattccatcttcaaattcatcatacatggaaaaaaagacaacattttgacaaatttatagtcttaaaactatcagaattttttttgttgttacagccaaaatataatgaattaatttgtggttagatttatacataggtgtaatactatccatagtatatgcatatatttttttttataattttagataatatttattagttggtatgcacggagtgtgctgtgcacaggatatgttcccaccttactataacaatttacatctgacatagctccatacatattatagtatggtaatttttttggccttttcagtacgatgagtgtagctcaactgattatgttccttgtgatggaacctacccacccaaattcaagttccagacttgatatagatgagtttaagtcctatacttgacacgactgctcgcatctatggctaattagctttttaaggataggcaacttaccatcggtgattttatttgggtgctcgcatttacggctaattaggttttcagtgatagatgacttacccgtgggttcaagttttagacttagacacatgtgtttgtatgtatggctaattatattttcaatgatagacgacttacccattaattgatagtgaggccctattgatgacttcgtcgattttaaaatatgcgacatgatgactttatcaattttaagatataccggttcagtctttagatatgtttataaaaatatccgcgtatttataagcccttggatttgtagtatgttttaaaaaagaaatattttatcaccaacatataggaactggataaatctacgtgcatggtgcatctatgattggtgtagagaggaagactcgtttagcagtgtttgcagtttgcataatgtatagtaaatactcggtgcatatatatgcacgcacacgttttgatagctagtatcttgtagtttagcttctaggaaaaatatcaatatttatgggtggacgactgaaaaatgcttgagttgttctcgctatggtataaagtctgcaggtagcgcgcgtcgtctccagtccagtgaagaaagctcacgcacgcaacacgcacgcacccctagctcatgtgcaagacgagccggcgagctgtatacgtagcagctggactctggagaagcatcagctaagctgtacgtactactgtagttcgatc

SEQ ID NO: 31434 - DNA, 1501 bp, Oryza sativa
aaagagagaaaaaattcataatattaagtgccgggtccatgaatcaagtttagactagccatttaagtcacgccttgcgtgaccatgagcagacatctatggttacctttttatatatctcagtatgtacattcaattttattttgatatttttatatagctgataacatcatattgattatttaacactcggtatagtttagtcaaaattatactgtactccagctctgacctaccatatagataaaagtgaaaacaactgaaatatatatgatcattatttgcatacagagccaactttaaatgtttttcattagcagaaattctcacaataaaaacaaacacattcttctacaaatatattggcatttattaaatctgaaaccaattcaaatatagaggggccattacacttttagtttttcttccatccagtcaaaacaggttggatgcaaactttaaagcttctatagattgcaagatcagtaactttgcctcatgaaagtatttcccacaaatcaagacattttaaggccatgcattcacgccacctcactaaattgtaaatccacttgaaacgtcactgtatgctaacaatgatttgatatgaatttaactggagcatgaacagaccatctttatccgtttgtaacagtttaatttccagttgagaactggttgtaatgtattaagaggctcagggaataaagctcttgaccaaacgaaagcataattaagaacacattgaagctttccatctgagatgttcttcctgctgctttctgtttcctgttcaataattaccacggaagtggtgaaagagtagaaaatttcaattatgttaaatagaaaacttcaatcagcaaaactaaaaaggacttgatttatgacacagtcagcaaaaataaatttattgttctatgaaacaacattattcctcaacaactcctatccagtttttaccattcaaaatgtactaatgttcatgattcatatagaggccttagatgcacggcagtaaatcgaacaaaaagtgaaaccacaagtttggaaaggccatttaattcattaatgtcacttcaggtgaaaacgaataatgcaaatcaatattgcagtcattttaattgctgctttaaaacttgtaacatcaagagatacttaataataccatatttgattgctttattatttgcttcataaattcacagaaatcattattgaatcagtgaatacacccttcacagcaaaccagaggctagcttagagtcaaatacatctgatcgttaatagtactttatttacagttaagcaaatcaccttgtagaactatcttttctaggtttccactcctctgcttgctacaacttttgctcgttagacacacatatatagatacacacatctagaaatacaccattcatttatataatgttaggggcaaccttttcttttttttctaaatacatgaatagttagtattacttctttttttttttggggg

SEQ ID NO: 31435 - DNA, 1501 bp, Oryza sativa
taaaaacaattcaatcatctcttgcagtttaatattagacataaaaaatttatcatcatgcattttaagcagtattgtcagaatacattagtataacttactccagaagagccagtttatgcttctcaatctgaatttttaggatcagaatgttagaaaaaatgcaggttaacttgaactgagtgcatcctaaatagagatagaaggggaagaacctgaatagacaatgcacatgttaattttccactggaaagacctttaaatggatgcattgcttccttctcatatctgtatcaacatattagagaagtgtcattgttcattgcttgagtcagtaaaatgtaaacagctagtttagttttcattttttaacaaaagaagctccatcaatttagtccattgagtgatcgtcaaaagcatagaaatttaggtatcagataaataaggataaaatgtgaagtgcccattaagttatgtaagcaacataagtgcatacaaagcatgtaatacacaaaaagtctcctgcagaagttcagattctattgacataagccatgcaacaagtcactccaaggagtcatagaagcaactatacaaatgattcttaacttcctgaagcttgtgtctaatattagaatttagaaagttattaattcatcgatcatggcagaaactcaaagatactaaacttaggattgttaacaaaaattcatcatttttaatgcaagatgagacatagattagaattctacaacacgaacttaactgttatgcacatcaagatcaaatcattttaaaatttatttttgactaagaaaatattgattcagcccactttggaactgagtcaaacccatcttgaagttttaactctaaatagtaccattatttcaccaacaggttataaacctttactgaaacaaaagagagaaatccttgagaaaattacagttggaaagccaaagatgtgctatgccttttttggtctcacaggctttagttactggcaagtaccaccgagtggtaactagtaaccagcagagaaaaacctactggccagtaactatgggtaaccagttgctaccagcctacactgtgaaaccaggcagagaaaataaaatggaagttcaaaagctttttgtgaccacagctggaacgcgcgtcagtttttcagcaagcaatactgcagcagtatgactaggaaagggtaaaccttacacaataataacgcctattgcccaaataaattcggtagtttgcaataatagagagtacttatttgctatcatatctattagttaggaaggtatcagtttagtttggaataagatatgtagtttgttagaaaagtatagagtaaggggtgttacgtgttagtgttgggtggggttcgtttctacttttttcaaacgaaacttatacccctcggaggtatcaagggatgcacttatgtacagccttatgagaatcactaatatttagtttttcattacaaggtctg

SEQ ID NO: 31436 - DNA, 1501 bp, Oryza sativa
ccacactcacacagttatattaaccatcacatttactatcggatcggctctacaatttcgagggcctaggtaaatttgatagttcgacactataggctcgtaaggcttttctttttaactgtaacataaactacacatgtgtcacaaccgccagatcgaggacaaaccgacggacatgatgcccgagatattcaatggctcaatgcctcaactgaaagatctaaaatactcaacacgcttgacaccctagatcatcaaattaaattgcccttctaaacatggctgtccgcacgccttttttggcacgatatcgatttgatttgagggctgaggttccctttggtttgtgccttaggcgatcccacaaccggccttagcctagagccgcgaccctgctctactcacaactagtaacaattggggaaactctattcatttcttaagggaatatccccttattttttttatgtaacttaaaagtcataaaaaatagaaaaaaatagtaagatagatcaatatgtgatatgtcacttcacaaacatgcacgttcaaattcaacttatacaagaaaaaacaaaataacaaatttgactatgaatagaacgcgtaaccgcagtcaaatttattatttttgtttcgaatcttatatttcaaattttaacatgtatgtttgtggaaaggtatttcatatattgatttatcttcataatttattttcaaatttttgatgattttttaaataacagacacaaaacaagaggatatttcctcgagggataaaaatccatctccaacatattgtgcactaaactattgggaacgcaattttgtgtgtttaatcttatggaaatcgatttgaatccttgaaaggacactcataagtgtataatatactcatagatataatttaaactatagtgctttaattctcaacattttgacaaattaagctgaatatgaatctttccttgtccttacccagaatgcaacaaatcaaatgaatccaccagtccatcaccatatcactattatcatcctctctcgtttttttaggacggtttttgatttaataagcaattaacgaaaatggtaaatatccctaaactattaagcgcaaaatattggcattgagacccaatataatggccccgccgtgtcgctgtcccgtccacgtgccccccgagagctgagcgataaaaatccaactgctcagctcagctcagctcagcctgcgttgtacatcactctcctctcctctctctctccagaggccacggcagccgccaccgcccggagaaacaatggaggccggcgaggcagccggcgccgtcctcttcctcctcgccgccgccgtctccctcctcgccgccgtctccaccggcgccctcgacttcacctacctcgtcacaggttccaagattttctttccatttttattttcccatccaagttaattagcttcttgctttcagtgagctgagctcttgtcgtggtacgttcc

SEQ ID NO: 31437 - DNA, 970 bp, Oryza sativa
taacgagttaagacgcgatagatgtgaataaacgtcgaattagaagatcatagtaaatatccatcataacactataccaacatacatcatatatatgaatgagataaaccatcaaatatggttaagcataatagaatagagatatcgagattgcaacgtccctagtaagaatatatatttaatagctagtaggacaagtagttacaccaccagcgggcgaaatagaggtgatagagagggcgaaagatattgcgaactattaagtatacataggaaacgtctcatcgctgttagtagattatgcaatgagagggagaggaagtcgcgagggaaggatactatcgattttgggatgagagagtataaaatagattgaatagcagaagaacaaaaagtgggggatagaaggaagtattaagagaagattttttaaaagaagatctgtgagagaaagacgaaatattggtttaataggccgaaaaaaagggattatgaatgtaatattaccaccggttgtaataaaagggagtaagtaggcagacggtgggtttactgctagtaaaaagagcgtgaggtgagcaaggcggataagacccaatatcgaacagaacaacttctccggatagataagagatgtacaatttaagttggtatccacggaggttttaagacggccccctagtggtacgtgtagtgatggtgcaaaaggaccggcaacctcctccccctaaaggtccaggccttgacaacaaaactctcttcgctcccggggggttgtctgtatggcaaacccacatttaaattttgtttcacggggaggaagaaaaaaggaataagatgcgtgtggggcccacatgttagtgggccccacaaatgtgtatgtgaatgacaaatgggtcccacgtataactttttaattgaaatgccacctaagcgccacgtcaacgccacgtgtaaaaaagacccggtc

SEQ ID NO: 31438 - DNA, 1501 bp, Oryza sativa
gaacaaggacgggtccccgggcctctgcggtcttggggacaacaaatgtgacgtacttccttcgttttataacgtaagtctttataggattatccatatttacatagatgttaatatacatatacatatatatatatatatatatatatatatatatatatatatatatatatatatatatatatatatatatatataggacactcatatggggcaccatggtgcccgggcaccatggtttcaaatgcacaaaatcacttaaatttttcaaaattttcaaattgtgagtatatacctagttataagaattcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttcaactagttagtaaagtagttaatattaatacctaaataattgaaaaagtttcatgctcatttgaattgggtatatactcaatttcaacaatggtgcccgggcaccatggagcaccaaacaaatttactatatatatatatatatatatatatatatatatatatgtgtgtgtgtgtttagattcattaacatttacatgaatatgaacaatgctagaaagtcttacattatgaaacggagggagtatttctttaaaagacgtactccctccgttaaaaaaaacaaaaagacaaccgagagggatagtataactaatttggacaaccctccatccaaattcgttgtacaagatctatatgttcaaattgccgaagagacaactggcaacttagtacaccccatcctccatgggcggagtacttgttcatcatcgacatcttcaaaaagctcgttcatactaacaagaaaacctgtaaatatattagttttgtaagttgtaatattaaatatattttgataatatgtttattttgggttaacaatattactatatattttttcacaaatttagtcaaacttaaaaatgtttaactaagaaaaaaaagttaaagtaacttataatatgaagccgaatgagtaaattacaaactcatacgcacggtttgaaattttgattcgaaatttctaaaatttcggtaatttcaccctcgccggcatgctcaaatcttgcccgaaatttttggttttttgcatttttttataaatttggtcaaattttcaaataatttcggtcagagattcccgaaatttccaatatttcgttcacctccggcataacacctaatttcgaaattgaaaacctgctcgtagtcatatgtgttttcttctatgttttagctagccagctatggcgcctatataaatcccccacacgaacgaacaaaacgatcgatgtgtcgaagtggacaagctgcttaactaatcagctttccctttcgcttgcgcacgtacgtacgatacgacaatggcgccgccgt

SEQ ID NO: 31439 - DNA, 1501 bp, Oryza sativa
aactttctctttcaacaacagcaacttgtctcgcatttgctacttctattaatgttacctgagttgtagatggggtatggttggatcaatgttatactattggaggttctatgattgggcctgttcggctgcctgttctgcagttgtggcacagccggcaccaacagtgccacatgcacacgcgcagccgcagccgccgctgccagcttgctgaacaggcccactacctgtttgtgcttgctgtataaaatgtttatatagctatatgcatatgcattgtttcagactataaatgagtggtattgtcatacctatagttctgaacaggcgccccattagcatgcatataatggagcaacatgctgattatcaaaaccatgagatttgagatgtgagaattaatcatgtggatgaactagtgaaaatgtgttcaatgccaaacttgtatctcaatacagagtaaatgtgtaaatgtatagcattctccaggtagtattttattttttgtgatttctccatttatcatatttttacttttataaactatgtaagttgcagttatgtagaaataagtgggtttgttcactgtacaacaataaatcttacatttcttatcagatgattatatgttgcttaattgcctgaagcaaatattttctgcaattatagctctcaaggcataaaaaaccaagacatatgaccatatactggttgccctacacatgtggagcgttgggtctctcggcatgttctctgtggcttttgcgacacagtagcttgatgggaagttctgacatcgacaactgggttcaaagtgccaaagagtcaatagctggattttgggatgtgcatgttgagaaacctgtaggatactttctatttatgtccttctattatttatcttatgcatttttaaatgatgctagtgtaagttaactgagggtgaatcaaggcattctagttaaagtcttttctcgttattccgacattgacatatatgagatgttctctgaggtacaggaggataagattttgttaatctattcatgcaaatatttgtctaacaaaaaggaaaaccagataaagggaaagaaaagcatgctgccttgtgcatactagccgtactgttttcttatagtataagcatatatgatagagtatagaaacaatttcatgtgtttgtttactgcagcacttgcacttattaccatgaacatccttaagtttacatgtgtatataaggcatataactaactactatctttgttgacaattataaggcacacacgtagtttcaaaattttggacattgtaattttttaccaataaataagtaatgtaagatgcaacattatatagttgtgtgatacaaaaatggtaattttgaatttttgtttgcaataacttatgatcatgattttgtagttacacacgctatattgcaaaagattcacagtcataaattcattttggcagaccacaccaagtcaaatcgcacaca

SEQ ID NO: 31440 - DNA, 1501 bp, Oryza sativa
gctatcaaagatatgtgtgataactaatggatttcaaactagcagaaaaatgatttacaaatggattgaaatagtattttgctccggatgcccgaggtccgactcgctgaatcaagccgacggcagtggctcaccgggagataactaatactaataatcccccccccccaaaaaaaaaaagaagtaatactaactattcatgtatttagaaaaaaaagaaaaggttgcccctaacattatataaatgaatggtgtatttctagatgtgtgtatctatatatgtgtgtctaacgagcaaaagttgtagcaagcagaggagtggaaacctagaaaagatagttctacaaggtgatttgcttaactgtaaataaagtactattaacgatcagatgtatttgactctaagctagcctctggtttgctgtgaagggtgtattcactgattcaataatgatttctgtgaatttatgaagcaaataataaagcaatcaaatatggtattattaagtatctcttgatgttacaagttttaaagcagcaattaaaatgactgcaatattgatttgcattattcgttttcacctgaagtgacattaatgaattaaatggcctttccaaacttgtggtttcactttttgttcgatttactgccgtgcatctaaggcctctatatgaatcatgaacattagtacattttgaatggtaaaaactggataggagttgttgaggaataatgttgtttcatagaacaataaatttatttttgctgactgtgtcataaatcaagtcctttttagttttgctgattgaagttttctatttaacataattgaaattttctactctttcaccacttccgtggtaattattgaacaggaaacagaaagcagcaggaagaacatctcagatggaaagcttcaatgtgttcttaattatgctttcgtttggtcaagagctttattccctgagcctcttaatacattacaaccagttctcaactggaaattaaactgttacaaacggataaagatggtctgttcatgctccagttaaattcatatcaaatcattgttagcatacagtgacgtttcaagtggatttacaatttagtgaggtggcgtgaatgcatggccttaaaatgtcttgatttgtgggaaatactttcatgaggcaaagttactgatcttgcaatctatagaagctttaaagtttgcatccaacctgttttgactggatggaagaaaaactaaaagtgtaatggcccctctatatttgaattggtttcagatttaataaatgccaatatatttgtagaagaatgtgtttgtttttattgtgagaatttctgctaatgaaaaacatttaaagttggctctgtatgcaaataatgatcatatatatttcagttgttttcacttttatctatatggtaggtcagagctggagtacagtataattttgactaaactataccgagtgttaaataatcaatatgatgtta

SEQ ID NO: 31441 - DNA, 1501 bp, Oryza sativa
tgcatgcgagtatatacatagatagcacggcaaaatcctagttaatccagatcaccctttcttaaatttgagaggagttattaattaatccacatcatctatgagcacacgcggaagaggaggaatcggatccgtgccgcgttgctccgggccctcgccgtcatcgtgggcccggcccatgaccagcacgctcagcaccacgcgccttcccctcatcaccaccctctccccatgcaccatcgccaccaccaccttcttcttctccggctccgccgccgtcgccggcggcatctcgtgccggcacagcgggcagctgccgtggatccccagccaccgctccacgcactcgccgtggaaccggtgcccgcacggcatctccttcctcctcccgctcccgcacgtctccctggactcctccccgtcgtcgaggcagatcgcgcagtcggacgcctcctcgccgtcgtcatcctcctcctcgacctccctcagcgccgcgatcgatgccctggacgccggggccacgccgccgccaccgtcggcgctggcgctgccgtcctcgtagaagacgtggtgcaccaggtacgcccgcccccgcagctccggcgccgacgagacggacgccccgacgagcaccggcggcacgcccgccaccgtccgcccgctgtccctgtccgtcaccggcgtcacgatcgacaccatcgacgagggagcattggtgagcgacattacccgatctcttcaatttcctcttaataattcttcgcgatgcttttgctaccatctgcctcgctctcgctatcgttctcgctcgatttgatatagaggaggaaaagacgccttctcgatgatcggtggattgggttgatgatgcgcatggcgccaaagggttcgaggtaggtgagccttttttttcttttttgtctcacaattttgcagctccgacaaagcggtggcgatcgattgggatttgggctccacatgtgcacttcgtcttcttgcagcaacacaaggtccatcacttcaattttggatgcatgctgattttgcttggattcaggctgaatttggtttgtttggacaccagaaatgtccttttttgactaggaaggttgttgctgttcttgacatcccagtgcaaaaggggtttgatgattcacaattttggaatgttcttggaagatctctttgatgattgacaattttggggtgttcttggaagatttctcatggtggagccatgtgcgcagaaactcagcaaaaaggcagacctgtgaatttgttgatatatactggattgttattgacatttttgaccttttgtaactatgcaaaatactacaggtcaacataaactgtgacgtactctacaatttaaaaatgctttctggagaaatttaaacacagaaaagaatcacatatcagattgatgaaacggcagcagatttgacttgatttgtcagaagcagcaatgatcaggtagagtgccaacgcaattcagccc

SEQ ID NO: 31442 - DNA, 1501 bp, Oryza sativa
ttaggttgtagtctaaatagttttctttgttttttaatcaagctatgattttgtcatttatagtcttttgagctataatctttgtaataattggttttagcttctttaaagcaaaggccggaatgaattccattatctaataataatattataagtactatgttaaatttgtcaattatatttcctagtccatttgtatttggctcatatatagcattaaaggtattgaccgatattgttgtaccacattgaagtttaataaattactatatgtacgtcattatacaatattttataatataaatgcacgcacgcggcgatactatcatcaacttaacaccgcatccgtccgtccgtcaccattcacaccgttcacgtaccgttgccttaaaatctctttctggactttgattaattaaggaagaatccaaagttacgattttgactcgaaagaatctaattttaatgaagtgattttacgtttgaaaggtaacacaattttaagtattattaattgacattacctcatagaagtataaaagtatagatttaaaatgatatatcacaaaactactacatatgtaataataaagttatcataaaactacaagtctaacgtcaagttaattaatcataaaatttgaatatttataactcaaacataatattaaaactttaaactctaaaatctataattttatcataattttattatatcatctgtagttttagatatttagctttaaacatatagttttgtaataaatttattatatacctataattttgtgataatttggtcaaagtatccatattttttgtaaaatttactcataaatcttaaatctgatgtagctttgtgaaatttactcattaaatcggcgataagtatttatgaacatagagagtacttactgttactttaaatctaaataactgaaacgattctaaactgatgcgaatatattcgccagttccttacaagtcatataaagggttgtgcaaaaaattaaaatatttcgataacatagataatatgtgatatattgctccgtacacatgcaagttttaaatattacttctacaacattaaaaacaaatttgcatgtaaatatatgttaactaagctaaagtttaatttattatttctacaacttatggatgtcgaattttaacttatatctttgtaaaatgcagtgtaatcgatcatgtattaattaatctatcttctctcttttttttaaaaaaaattcataactatttgaatgtcatacaagaaataaagagacaacacgtggatagtttaaaatccattctcctaaataaataattctgggtcaccatacaaaaactaaatctaatatggataccactgttgaaacaattatgacgatccagctagtcagctctaggctatatgtgcatacacacacatgcttgcctgggcattctccctgttttttttaattacacagtacaacacagacccttacaagacacg

SEQ ID NO: 31443 - DNA, 1501 bp, Oryza sativa
aaaatagaatatgcatttaagtgtatggcaggatgatatgaaaaatagcttttaagcaatactacactacaacaggaagcaagtggatttgacaaactttggtagagataggacagtactcttcatcaactttacattgaaatcatccatgcatttcttgggcatagaacaatggccatgtaaattatcaattgtagagtaaaggatggtgaaataaattaattggacaacataatgataaaaggggatcagggagctgacgaaccactgtcctggattaaaatgaagatatgcaaggaaaataaataaaatattcattagatattgatgccagacattaatattgttttggcagtgagaagtggccaaacggcaacaatcggaggacttctttttattgaaaaatcgtatgacttctggctggatgggcctagcccaaacctgaatcaagattagggcctaatccagatagaaaataatggggagatcatacctcactatcccaaggaaggtgacggcagcacaatggctagaagaacacttgctccactccatagcttgtacccaaaccctaactgactcacaagataggtcatccaaattgacgctgcaaaggatagaagcaaggatgctgaagatggagaagcagattgagttagggcttggcttgctctgctctactccatacccataccctaactacagatagattcatcacaaaataagtcatccaaattgatcgctgcaaaggataaaagcaaggttgctgaagataagaagcagatcaggctagggcttggcttaccagactgcacatgttgtcaacaccgtgcgaagaggtggacgaaggcaactatggcagcgggcgtgcacccttcgtccaccttgagaaattggccggtcgagcaagcgaatcaggcggaacggtggcggcgcttgcaggtggctcgcaagaaggcgacgaccccggccgctagctccgcaagaaggtggcggcggcgggcttcgcgactcgcaaggggaagatgaagatttgagtattttgggaagggaggcgcagaggatgtcgaggatcgaggggattggggaagctatgccgggcgcagcgatgtgcatgtgaggcgtggacggttggatcaaatcaacgcgtggacatcggacggtgcatgctgggtgatgactgtagtactgtagcatcttttcctgggctgaggttgatcaaatcactgctagtagtgggttgtaaaaactaaggatttaatatgatatgatatgatatgatatgatatgattcctactacaaaattgttgtatttcaaaatggggcctgaagaccaaggctcattttaccaggactggaatatcacattgcaaacacgaacataatcaaaagacaccatcatcagttcacgcgccaacttcccattgtaaaatcacgaccaccatgtacccagaagctaaattgaaccaaagtatcagcacattcgcaactataaacagt

SEQ ID NO: 31444 - DNA, 1501 bp, Oryza sativa
cgtccgactgggctgactggtccgggtcgcctaccgcgtctggttttttcagctacggtttggatggctgaagaaacgtgcgggtaggctctccctgtcgcgtctcgcttcgttgtcgtaggtgatctcgatacggtgtttgcagtggtgatatggtcgacgtattcatgttgttctgcaggagatggacgtgtcgagttaaacgattagtattaccgaaatacccctatttcataaatcttaatgtaattgtttttcactttatcaattctcaatgtaattattttatactagtacttttataaattttgatataatgattacttaaaaatggatttattttaggacaaatagaagaagctaaaaatgaacttactgtgagatgagatgaagaaggttgtgatttctgctttagcaagagattctaagaaaccgctatttattctcataaattagatgagaatttagattatttggggatcagatattataaaagttgtttataacagtagtgtaactccacaagcttctaaaatagatcctcgttacctcaacagagcattcttgctgcagcaaagaaggcaaagtttaacaatggggaccaaacctgttcaagtaagagggtggccgttcgaaaaaacaatggggaccaaacaatgcaagcgtgtttgatgaattttaatctcagtcagcttttccaaaccaactgacaacgcaagcagggagtcatcgtcaacttttcctttcgctagttccctgggccgggctttattctggttggtcaacaaacccaaacatttgcacacgagactgatgtgagatgcaagctacatggcatgagacaaccgctaacctccctacaattcaaccagataatgtagattatgcgcataaccagtcagtaaaccagcgcgaacagtatgttaaatggactagcacctggcatttgacgacccccaaatgcccaatgttacgagaacacgactagccgatcttcatgacacttccctgcaacaaaaataaataatgtaattcctgcaaaattgttgtactcacttcttccctaaatgtttgacaccgtagatttttttaaacatatttgaccattcgttttattcaaaaacttttgtgaaatatgtaaaactatatatatatatatacacataaaagtatatttaggaatggagggagtatttcataatgaggcctgaagatataggcacattttatcatgactggaatatcacatcgcaaccgcaaacataatcaaaagacagcatcatcagttcaccgccaactttccattgtaaaatcacgaccaccatatactcagaaactaaattgaaacaaagtatcagcacattcgcaactataaacagtcacatcaacgacctggtctatgtttaagaagactctagtgcatttttgtcattaatagttatacctcaaaatatcaagtaaaaagagctccgtcgagacgccgaaaggaattcttattcag

SEQ ID NO: 31445 - DNA, 1501 bp, Oryza sativa
gaacactgtattttttttctagcttctcaataataccccctccgttctgaagtagttttgaccttattaaagctattttttaaaatattaactaaatttatagaaaattattgtaatatttatagtatcaatttattttattaaattggatattaatatttttatattttttgtaaaaatattacttttttataaatttgattagaactaaaaagattaaaacgactgaagtggagatagtgatattaatttgctttttggattttataactacggattttttataaacgggatgaaaggtatttttggctgacacgtcggggtaagtactctctccatattttaatatataacattattgatttttcaaccaacgtttaaccattcgttttatttaaatttttttgtaaatatgaaaatatttatatcatattttaaaaatatttaatgacgaatcaagtcacaataaaataaatgataattacataaatattttatataagacgaatggtcaaacgttggataaaatatcaacagcgtcatatattaaaatatagaggaagtattacactagactccacttgtcagtgtcatgtgatacgcgcattttctcctctacccgtacgtgtgcaactctgcgagggcctcgctggtccccacggagagtgagtggtcacgttacgtcacgtcacgaagtgtgggccccagttacatgggcctacagtcagtggagcggaggagggaagctaagcccgtgtttagattcatttttttaaaaaaccttccaatttacagtcagtggagcggaggagggaagctaaggccgcgtttagattcatttttttaaaaaacttttaattttttcgtcgtatcaaatatttagacacatacataagcattaaatgtgatcggaaaaaaaccaattatacagtttacatgtaaatcacgagaagaatcttttgagcctaattacatcatgatttgacaatgtggtgctacagtaaatatttgctaataatgaattaattagatttaataaatttgttttgcagtttacagacaaaatctataatttattttattattaatctacgttcgatttaatatgtgtccgtatactttaaaaaatattttggaccaggaactaaacaaagcataagagagattctggaacattccttgtggagtgttgcttgggctgtcgcggtcgggccggcccaggaaataccaggcgacgtggcggaggccacggccctgggcgccctatccgtgggccgataaggcgcgcgtgggcgcgcggccatacaaagccgcgtggccctccacctccgcacgggtcgctctcccctctcttcccccttcctccgcggttggtggtggctgcgccgctgcccgcatcatcaccacctcacctcacctcagctcgcgagctccgctctcaccaaccgcagcgcgcgacgaaggggattggattgggttgggttggattggagagagagaa

SEQ ID NO: 31446 - DNA, 1501 bp, Oryza sativa
atggttctgacgccatgtaatgcattatactaaagaaaagaaaattgcaacatgtttttagctttacctgatctctccagtgtatgctcctccttttccaatccaaacattctgagcagatacctcaatacgatcagttagtgagttcttaacctgatcaatataaatgaatggtggtgcaaccacaacatctgcagtattgccacagcaagttaattgaaggtagaaaaagatagacagtggaagctaaaaagaattccggaggatggatttggatgaaaaagaaggcatgaaagaaccaatcaaatacacacatctaacacagtgtgtatagagaggaagagaatcatgcatagatgaataaaacgtgcttaccaacatcaggttcaagtgtagcagcattcaattcagtcacaagcttgctgacagagtccttcgttccattctaaattgagggacaagaaattatatcatcagaaccaatcatactgatagtaacatatctgaccaaaaagtcgggaaacatgtcttgatatagttagcataagctctcgataaaaagtgaagcaacatataataccgagatgattctccaaaaggaaaaatgagcaactgaatcagctcgtcctaaggatggcctaaagaagatgctactatctttatttttggacaagatactgatgcacactttcttaccctcggaccactagaactaatttattttggacaagatactgatgcacacactttcttatccttggagcactagaaccaatccctgtctacgtaacagtagttgctcgactccatgaaatttgggcaaatgagaaagccagggactgagaagatgaagtctgaaaaaaattatacatttttgcatataagatgcatattccccaagagaactgcttaagccaaaaacgactacatcttgtggcaccaaaagcgactccatatctagcaaacacgaccaggtgtggtgtagatcacgatgtattgatgacgacaaaaaatcccattcattccgctcatctttggaatgtcctaggcggcaaccacaaggcgccaacgactcaagatcacgaaggtgcagcagcagcagaatctccatccatcatcgctctgctcataggtaccccgtgcgtctgcaaaagttgattgatgaggaggagcggatacttacgcacttccagttgcctccaacgaagaactgcaaggacagcagcagcagcagaaagaaagaagcagcaagtcgtcagccacgagcacaaaagggcaacgaagggaagtgtaattaaacgatagcaggaaggaggatggatggcaaccttgccggatccggccatggcgacgacgcgctgggcgcggcggcgggagcacccgaggcggagctgctgcggatgcgccggggcggcggcggcgacgcctgcgcggcggaggtcggcgaggcgggagaggtgggaggacgcgagggacgacggcgccgccattctctctctcc

SEQ ID NO: 31447 - DNA, 1501 bp, Oryza sativa
gaatgttccagaatctctcttatgctttgtttagttcctggtccaaaatattttttaaagtatacggacacatattaaatcgaacgtagattaataataaaataaattatagattttgtctgtaaactgcaaaacaaatttattaaatctaattaattcattattagcaaatatttactgtagcaccacattgtcaaatcatgatgtaattaggctcaaaagattcttctcgtgatttacatgtaaactgtataattggtttttttccgatcacatttaatgcttatgtatgtgtctaaatatttgatacgacgaaaaaattaaaagttttttaaaaaaatgaatctaaacgcggccttagcttccctcctccgctccactgactgtaaattggaaggttttttaaaaaaatgaatctaaacacgggcttagcttccctcctccgctccactgactgtaggcccatgtaactggggcccacacttcgtgacgtgacgtaacgtgaccactcactctccgtggggaccagcgaggccctcgcagagttgcacacgtacgggtagaggagaaaatgcgcgtatcacatgacactgacaagtggagtctagtgtaatacttcctctatattttaatatatgacgctgttgatattttatccaacgtttgaccattcgtcttatataaaatatttatgtaattatcatttattttattgtgacttgattcgtcattaaatatttttaaaatatgatataaatattttcatatttacaaaaaaatttaaataaaacgaatggttaaacgttggttgaaaaatcaataatgttatatattaaaatatggagagagtacttaccccgacgtgtcagccaaaaatacctttcatcccgtttataaaaaatccgtagttataaaatccaaaaagcaaattaatatcactatctccacttcagtcgttttaatctttttagttctaatcaaatttataaaaaagtaatatttttacaaaaaatataaaaatattaatatccaatttaataaaataaattgatactataaatattacaataattttctataaatttagttaatattttaaaaaatagctttaataaggtcaaaactacttcagaacggagggggtattattgagaagctagaaaaaaaatacagtgttctaaaaaaaaaagaaaaacaaattcagcctttattttcatcggcttctcagactcggtctcgacttcagactagtctgtctgaacgaggtcgagtcggaggagttgcatcgctagcttaacccgaccgctttttaaatcgaaatcccgcagttaaatcagagatttatgcagacaaaagaaaaacacacacacagcaattactattctccaacccaacacgccccccgcaccgccttccgtcctcataaacgcgagtgggtttaaactcgagttgtttttttgttcgttaatcctcgccccctctttctctctaatctccgcca

SEQ ID NO: 31448 - DNA, 158 bp, Oryza sativa
ttcctgcagcccgtatgagtttggttcgtggctttaggcttgcttacttaatgtttaattaaagggggagcgtgaggcttccttgtatcactttaaaaagcaatagagttgagttttgagttagggtttcgagtttagtcaaaatttttgtaaggagt

SEQ ID NO: 31449 - DNA, 1501 bp, Oryza sativa
ctgtttttggtttcttttcactattcatgtcctcagtcctcgagcaggtgcaccattgtccccagggccatggcaatgtgccaaattgccaatgcttgtcatgaatatgacaacgctagctagctcagcggaccacggctagaagcacagtggcaacatcgccaccagtgtcgtggtcgttcgccgcccacagttggcaataccactgcattttagtagcctttcatgcatgttctgcctaattcgtgatcgaagaatcatgtactatataataacgtatagattatatatttatatgtaggggtagggaaaataaacagtttaatccaagaaaactataatagcacgtactagtagaaattatgttatcttcctattgtttgacataaaatgtactatctctgttttacaattacttcttgttctaattttattctaagtcaaatatttttattttcaatcatcatttttttatatattatgaaaatatttctcattatacgttaataacataaatcttacaatattaaactataaattaatgtttgacttaggatgaaagacacagtactctaaaatggaccagtagcgtgaatgtctcggtcagaataaatatgtgaaccctgtaaaattttcacgtaaaagtaatataccatgtatgcatatgtagtagtaatatatactgaaattttttttaacatttttgatagataaagttatgcaccataatgtctttgattttttttttcaaattgtttgagtacgattgaattatagaaaaatatagcaacacctaaaacactaaattaatttatgaatttgacattggatatattttgataatatattagttttgtgctagaaatgatgctatatttttctataaacttgatgaaacttaaaatttctaactagaaaaaataatcaaaacgatgtatagtatgaaacgaaggtagcagtatattttcatacccgtacatgagtacaacagctatttaaatgggagaaaatcttcccttttcaatcaatcataaaaaagatcaccaaaatccctcccccaaagaaaacacacacagtacaatccaaatcacaatcgacgtcctaatcgcacgcgcttttaatctcgattaaactactgaacgtaaatagcacaactatccattccctcccccagccaaagctatagcatagagcgacctttcgatcgttccctataaatcaccacccctcctcgtcgcctccctttcgctgcttacatgcaaaaaaactcccataaacccctcctcttcgagaaaatccctttttgttcaaccacgacgcgaattcccaagcaacccccccacacccagctgagtagctgacgcagcaccagcagtcgcggggaaagggacacgtctcgccgccccagcttcccgcctccctcccatcccgccgccgcggacgcgtccaagccacagcaacagcaaccactccgacgaacacctcgcctgcgcgatggtgg

SEQ ID NO: 31450 - DNA, 1501 bp, Oryza sativa
ctcgaagatatgctcatcagaagaaaaaggagaataattacttattgataaaccataaagttacctttcagatagctcagtaaagtaagcaccacccaagtaaataccgacagaatagtacggtagatttagtgaaaacagtcagacctcacaagtaaattagaaagttattactgcacatgtagaatgaatatggcatgaaaagaacaaatgcaaggagagaagacaaaaccaagttatagttcagaaatgcacgaatttcatattggtagcaaagtcttaaaagaggtcttcaggaaaagaaaaaggtaccaagcacctttttttacaagaaaaaataagtactaaccattgccgacttcagtagaatttcaccaacctcagattattacgagttctttttgatatatttgatggtagtgcattagagccaacatctaacagacttcattctagatttgtagtaatgctcgaattaacaatcctgaaaaatatgaaaaaaacagttacataattccaacatgtaagatccctattcactggtaggcgaataatttttttgtttgcaaagtctgacatagttgaactagtattgcaacatatcttcaataaagaaaagatcaaagacatgcattatgaaatatctcctctttagaatcatgctatctcatacttttcaccacgacaactggtacatgtaagaaatgaaaaagtttttttttagaataagaaaaagtagatacctgataaacgagtagttgttgtttttgtttttaatgagaatgtgacaacatagcaatccaggctgtttcctgcacctttctttaagtgactaatcagaaattcagaattgacaaccataaaaagccttggaagccattgatagaggggcaatattaatgctctgagcaaaaaatgaaccactgatagatggacactataggcccctacagaaatttgagccttccttttctacctcttttttgtatataaaaaaacttctctaattcttttcatggaacctcagctcaacttggcacattgatgcctggatcagatctgctgcttaaatatatctctgcttcagctacaatgttcttgggagcatcttttttatctttcttgcttttctagtttttttcaaggcaaaaggaagtagattccgttcagcccctaccagactgcaaaactaggcagtaatagtagcatcgctggattcaaaatggaagggcataatacaaagatacacaatccttatgggtattcccaaaaaagaaaaatggagtacgtaaactttatttcttcttaatacaatgatgcgctccttgcgtattccaaaaaaaaaaaagaaaaatggaaggggaagatacagtggaaactgtaccatacactgtagaaaaaccattgtcatatgtcactgtagtagttgctctggggtcatcctattgtcctattggggaataaaaagctatgattgcgtgcgtatgctattgtgcagtcc

SEQ ID NO: 31451 - DNA, 1501 bp, Oryza sativa
ttcctatcagcaactccagctcaccaatctccacaccttggatcagatcgaggcctccactataataagaaagtagtttggaaaggaagcattaggggggagtagatcaatttatctctaaacaccatagtgtttctggtaatccacaaagtccagcatacagcagcaagaagcaatcttaacgttcaacattctagttttcgtgaaaaccggacttccaagccggctcaaaataaaaatattcaactaaaatttaccttttttaaacaaaattggtctgattttttttgttggttaaccaacagtttctgtgaaaaatggaaatcccgttcctaccggttttcgatccggtaccgtgatcttgacccttgctttcagttgaccaccatgcattacctgtcgtttcccttcgttttcatcatcatcgtcagcagcagcagcagcagcagcagcagcaaaaacggaggctggacatcggtcggttcgttcttccaacgatcttgcctggccacattggccatggacctacctggacatcgggtgcaaaccgacaattccaacacaccaacactggcccaaaccagaggcaaaaaaaacacgacaaaggcgagcgaccgccacgcccaaaacgcagcagaggcattgtgcagcaacgagccaaagaatcgatcgatgatggcgagtgatcaccaaagttttcgcagcggctaatgcgccgagaaaacgaaggatcgatcgatcagatcatcggatgggccaaggaccaaccaacgaaggcccccccacacacaccagcaagacatcattcgtgaatggcagcggtcgtcttctacctccatatgctctgctgcctcttccattcctttccaagaaagcatttggggcatttttatcccaagtactctgtttcttcctttttgtttttctttcgagagagaaaaataaaagggaaaaggcaaagaaaacaaaaggcaatggaataagtgaaacgagaggggaagtagtaattcttggtatcatcattttgcatatcattgctgacgtcactgctagctgtataaataggctaggtgtgtaagcaaacaagcctacactcggcttgcttccactctgcacactcaagctgtagtggccactattactagtttacttgcatctaacttcctccaagcttctaaccaccgtcttgccatttagggttagctgactgccaatttcaagaacataccggtcactcttgccataactgatcactttcctgcatatccagcatatatatacatataacagtaacgcacatttgaattgggtttcagtttacaatttattgctgctcaaatggcttcttggatcatcactcgatctacttggatcatgagtgtgttcttcgtcatcctatcattctttcaaggtattgagattggcaatggtgaattgaattcttggttcttgggtttgttctgtttgtaagttgatcatggtggatttggtgtgtgtgcag

SEQ ID NO: 31452 - DNA, 1501 bp, Oryza sativa
tggggttttcggatacgaataaaaaatttaattttacaattcatctgaaaaccgcgagacgaatcttttgagcctaattaaaccgtaattagcaaatgtggattactgtagcatttatggctaatcatgaactaattaggcttaaaagattcatctcgtgatttttatgcaaactgtataattagtttatgtttttatctatatttaatgctcgatgcatgtgtttaaagatttgatgtgatgtttttagaaaaaaaaaattgaaaactacagcaggcctttgatttgaaacacgtagcattaccaacacatccgagcttgtactccatggttattattgcgttcgtgaacgaagaatcgtgtgaacgaagaagcctggacaatttggcgtgcatgcagttcggtgtgtactggttactactccagtgcaaatttgtctttctgttgccaactggtctccatctgcacaaagctgtcgataggcattatctccggaatacagacgttcgatggatttgaaccgtgcaatacaactctacactctacagcaacgcgcccgctgaatttgggttgccaaggccaacaaaaattcatatcgtttcgcaccatgcaatccagcagtacgccaaaccttccgagctggctagagcactcagcactgcacgtgagaagaaaccaaccgggcctatgttctgtaagcccaacttttcttccaagcccatgtccatgcagtcgatgattagtggaataagttcatctgaggtcccttaacttatcaacgaatccgattttcgtccctcaaccaaaaaaccagacacaacgggtctctcagctatcaaaaccggtgcagataacgtcactcggcggttttggaggcggttttggctgacgtggcacctacgtcgagcaatttgatccggaaaaaataataaaacccatgggacccacatgtcaattccacacacaaaataataaaaaaaaagtgggcccacttgtcattctcatccctcttcttcctcctctctctctccccatttccctccatctctctcccatatcctctctccaggcgcaacggagaggcagtggggcatggcggccggcgggagaggagggagcggcgcggcagcggaggcatggctccggcggctgtgggcggaagaggaaggggcggcggagcttcttttctctctctcggtctctcctctctccacgccatagatccctccctctcccacttacccgcagccatggcggaggacgcccccagagccgccgccgctgccgaggggagccagcatgcatcggccgcggagagaggctccgccgccgctcccgcggcaccagtcgccaaggccgcggaggtgctgctcccgtccctcagcatctggccgctatcgcagcgcacgccggcgaggagcagacattgatttgattccaagattttttttttgagcaagggtcaagacccccataccagtacaggttcagccaaagcggc

SEQ ID NO: 31453 - DNA, 1501 bp, Oryza sativa
gaggagtacctcgtgcagcgccgcgcgatcgaggctacggtcgacgatatgccatgggagatgatcggcagcagcaggagaactggtggacccatgtttgcggtggcaggtggtggccgcgacagggtggagctggaggccagggagcgtcgcaagaacaggatggacaagagtaagaccgccgccgcctctcgcgcccagcagccaccgccgccggcaggtaattaatcgatcgtgcttggttttgctcgtgatcaccgtgtacaaatgtgcaatcctaacgcagtttttgccgtctcgatcgtgcgtgttgcagatgctccggggagctcaggtggcggtagcaagaagcgtggaggtgggatgaagaagaagcaagcttaatcatcaagaagctggattgttcgtcgtcaatccatttggtgccgaagatttcgtctgcatcatttccgtttcaacgaataatttagccatgtcgtttcctgactcggcgtgtggctctgtgagccttagggagctttgctccattgatgttgttgtgcatgcaattcttgcatgggtcgtcgaactatgtttctggagttgtttgtgttaaagtcccaaacttatgttgggtttcatttattctcggtcgaatcatgcttgtgtaacatcatgatttgtttggttttcaacaatttatagcaatttaaaacttgtttggtttggtcatataaaaaccttgtttgtttaatttcttcgtctttcttccattataaaaaaaagtgtttttcttccagcattactacgtactgtaccttcttcttcttctttttttttacaaaactcttgcaacaaaaatctcaagtgtctaagactttcagtaacattgtttctgacttgctgagttgtactaaaactttgttttctcaaaatcttactaagaattgattcagccaaaaaaaagttcgtttcatttagtcagtagttataaaatagagtatcaagatataaatactccaaaatgtaagcatttttacctatgaatctagacaattgtgtgtccagatttataaccaaaagttactatattttgggacggatgtagtaacatgcaacatcaatgacatatcatgtttatgaaaagtctgtaagaactttctatgtatcattttccttttttttaaaaaaaaataattaataggaaaacggcagctcgagggcagactatccatcgggccgcacttgtctagtgggcctctatgaaacgtggcccaacttcccaactaagctaatactccctcaaattgtaagtcggtaaggcccagcccaagtaagcgcgagggcagcgagcagtttccccctccccaaatccctattccttccgctctcggcggcggcgagcaatcccaccgccggttgccgtctccaccttccgcggcggccgcgcgtcggctgcgagtttctctggaatctctggaatccctcgtctgaccgaggaagagcggcgggggtgacgaga

SEQ ID NO: 31454 - DNA, 621 bp, Oryza sativa
tgggcgtaagaggaaggggcggtgggagttggccctagctgcggcagacggcaggacaggagctgcacaaccgaggccccgccggcgccgactccttcttgatgtcgccggcgccgccaaggctgaggaggtggacgcggtggtggtggaggaggaggaggaccgcggcgcggcgcggttccatgagcggaggctggtggtggtgtttgtgctgccatcccagccgatgtgcgccacgtgctggcggtggtggtccgccgcgccgccaccctcgccgccgccgcctagacacgcacacagcatcactaataccaaactcctaaatcaccccacaaaaaacaatcgacaagatcgagcagaagtgaagaataagcatccaagactccaaacaacgaaccttggggcttcttgccgctcttgccgcctccatcgacgacgtccacgctggatccattgcggcaggtggaggagaagaggatcacgatgaaccggtccatccgccgctgctccttgccactattgctcatggctagctagccactgctagctaagctgatactatcttggaatcaaatcgcttgccgctttggctgaacctgtactggtatgggggtcttgacc

SEQ ID NO: 31455 - DNA, 1501 bp, Oryza sativa
gccggcggtggcgacgagtacagcggctggtcaggagagacagggtacgtgtcggccggcggtggtggtggcagcggcaagtccggcgtggcgggtgtcgcgtcagctggcggcggcggcagcaatggctggtcaggcatagtgtcaaccggtggctggtcgggcgaggcgggcagcgacgtgtcaaccggtggcgcgagctggtctccgaaagacaggtccgagctcccggcgccggcgagggtcgacgccggcggcgtcagaagcttcgctgtggttgtggtcgacggcggcgggagcacgtccatcgtcggcgacggcgagaccggcgcggccgcgccgcactgctgccccgtccacggctcgccgctcgcctgccacaccgacacgccgtccttgctcacgatcctcatgtcgccgccgtcgtcaaggctcagcgttcccggctcggcgtcgatcccggtgtcccagagagagtgcccgccggcgaagagctcgagccccaccggcgagaacgccaggtcgcacgcgtcggcgccgccgacaagggtgcactccgactcccacacgctgccaccaccgccggcgccgccgccagcctgctggatttggacgtagcacgcgtcggcgcccgggccaccggcggagctgtccacggcgcggcggaggtacgcggcgtacgacccagacggcgaggtgaggaaaggctgcgcgctctggccgacgtccacggcgggcgcgacggtggcgatcacctgctgctcggtggttcttgatatgtagcttttgggagaggcggccatggcggcggcgagccgcatcacgagcaggaggacagcaagtgaagaagacatggtgaaaatggtggtgaggtgtgaggagcttggcaatggagggggtagggttttaatggaggcaagaggaggatttggtgcagcttttttgtggagcaactctcaggtgtagtggtagtaggagaaaggtgtgcattgcatggagatggatggagtagagggaatctgaagttttaatccaagattaattagcccaagtttcagttagagattgtagtgtagttggggtcatttggtcatgttcatttgttcaacagatccaacaggttgcattaggtggaatgcagccaaactttttcagtctgtactctgtctaacactctaattcaggataactttgttaataggtattgataccttcccaaaaaataaatggaaaactactggttatatcagttcaaaagggacgtactactactactcaagttatgtattgtgattttcttcgcatttcagaagagtagaatgtccatgaacagttaaatgagaaaaaaaagacagcgtgcactaaatcacatatcatcgaaatgtgaatacactataactaaacacatgcgtaagctatttgaaaccatacacatctcaagagaagataatctgaaatgcaatctcccatactcccacgcaaacggatatccaaaacgagt

SEQ ID NO: 31456 - DNA, 740 bp, Oryza sativa
gacatgtgaatgatgaggggatgtcctctagagcttagaatccactctcgcactttgggctactaaggaaatgaccacgcattgagaggatggcatacttggccccaaggccactcccgggactgtgcttttgcaaagcttctcccgtcggttctcaatgataaccctaagcccatgtatctaggtaaacgagtcctatgcattgtttcttctttctttttgaacacaaacactattttatccgtgtaaataagttgcaacgatagcgagaactactccaagcaaggaaatttctttctagtaaatcataattattctgtcaaacatgtcaggtcatgtcctcgcatggaagctagttgtataaatttccatttcggccgaatctcgtagatcttcatgctgagatttaaacatataaactcaattgccacccttatacttggatatacttatgaggttttctcccatttttagaaagacatatacacctcattccttgagagagatccctctatgaagggagctcgaagtgccaaaactaatactacatgggtagtacatgattagaaattaatttatatttttttgagtttttctcaagtctttgagtggcgtaggtttatatctcttgatttatactaggagatatctatacccttatattttagaagtctaagatagagttgacattgtcgatagctgaatttcacacatttagtttactctatcaaagacttctg

SEQ ID NO: 31457 - DNA, 442 bp, Oryza sativa
catgagttatataagatttaaatcatgtaggaacttttcctattcggctcattgaaacagaggattgggcatttccaaattcaatgaaatttttaagcaatgacgagtaaatgcatgtagattttgaagaaaagttagcaaaagctttaacttcattttttttcccgagtctacctttcttatccgattcctttcctatagtctatttaaatggttgtttctatatttttcatatgttatgccatcctccaattcttgtaatttgttttctattcatccatttcctgaatattgtgcttcaaagacccttaaagtatattgagaaaagtgagtctcgatgagaaaggaaatcaatgaaaaaaaaaaggtgataattggaaccagaggaaaattttgatacattgatgtttcttgaaaagaaatcatttccatgttttttagg

SEQ ID NO: 31458 - DNA, 1501 bp, Oryza sativa
taaaacggaccgtcaaagttagatacggaaactcagggtttgccttttttttttttgacagagggagtagtaggataggagtacggagaacgcgaccaccatgtgcttccgtacgtatcgcaatcggcatcttctgaatggttggagacaagttggagtagtcgtcgtcgatccatccagtaggcgtcaagcgctaagctgcgggttttgcagtaatcagcagctttcgacgacgaattctctcgctgattgggttctaatggtctgcctgtcattttgatgtggttttcttatcctttttccactgcgatttgcatgtgttttgtcgcggtggtcggcaaccgatgtgcaggattctctggtttgatgcgattccgagtccaggagcgtcggctcttgcagactgcagccaccaaaatgtttatttaaaatacaaggcgaatcttaagctgtgtttagttggatccaaagtttagattttagttgaaattagagatgatgtgactgaaaagttatgtgtgtatgacaggttaatgtgatagaaaagtactgaagtttggatccaaattttagatctaaacacagtcttaaaggttaaagttaggaacagtaagttttgtttttcactaggtagtactcctactgatttggggaacactagaaaaactactccggttttttaaaagagaaaaaaaaactactgcagtgaatttcgaagcatttttcacatttgagtattggttttggtgtgacactgctactgatttggtgtgcatgaaaagcgtctcaagttgccaaaagttcgtacactgatttacgtactgcaatttacaagtgggcctgtccatcaccatgtagagtgaagtacttgaagtacttttaggctgtgtttatttcagcgcaaagtttgtattttgattaaaattagagatgatgtgactgaaaaattgtgtgtgtatgataggttaatatgatggaaaaggactgaagtttggatccaaactttaaatctaaacacagccttactatctggacctcatccggaccatgtttactccggtactcctatgatttatgactgctggagcctgcatcatcgttgatgatcctttcatccgggctgttcagacaccgaaaggccggtttcgttcttcagaaaaatgatggtgcctaccccggctgtaatctctgcaatatcctgtattcctgttctgtcctgccgtacttgccttgcctccccgtccctgtcactcgctgttcactcgcttttgttcgttttctcaagacggtgttcactcgctttctctctttatgaaactttgctgctcgtatattttcaaagattagatatttataagaaactctgttgaagcctgaacagtcctacgagacagacaacgctggatcggtagcttttggccggtcctcaatctgatctgaatccgaattactccatgtccgatttacttcgaggacgcctaaaaatcctctaattttccaa

SEQ ID NO: 31459 - DNA, 1501 bp, Oryza sativa
  unsure (1)..(1501): unsure at all n locations
ggtcataacgcttgagaatccttgcagtctgtgggttgaatttgtcctccaaatcttgtaaggcctgcgcctttcaccttgtgtaatcctccgaaatgtaacccttaggtttctcttcgtcactggcatattgaatntctcctctatatcatctatgaaaagcagccggatattatcaagtaggccttgctggaagaaagcctgttggaagtactcagatatgttttcgctgtcaaaagttttcttaacaccctgaacatatctcttctcctcatcttgcaaggtctgcactttcttggctgcccgcccatcggccattgtcttgatcagaaactgctgcgattcctcccaagctcggatcctgagtcgcatttcgtgattacgtatcccgaatctgacctctacctcatccctggcatcttccatgaatttcctgaagcagtactccctaatgtggtcaggcatgtcttgcacgccaggataatgcttaaagaacaattgcctgtttctctcttccatgtcttgtagtgcttgcgccttcttcgccgcccccgccgcctccacccaaaacttctcggattccttccgagcctgaaccctgagttcctcgtcttgatcaagcatcccggatttcccctcgaaaacggcattcacgaacttgagccggagatcgtcaggcaccttgtagtcattgcggtgctgctcatggagatccagcctgatgtggtcaggtagctggtagcagctgagaatccttgcaatctgttggttgaattcctcctccaaatcttgcagcgcccgagccttctccagcgcccacttgccattgtcagccaccaccatctccgccgccggtaactcggtcgctcaagattttcgggacgagtcagccaagatgcgatgcgacggggagtgaagggtcgcgttaaatttgaaggggatggaaccccaagggaaatcggagacggaaaccgaacctcatcgtcgctgctcttgcgcggttactccccgaatccgaatcaacgacgacggctgctgaaatcgcatcgatccaagtctgcgtcggtttcttgtttttcagcgtatatgtttggagatatttctcgtattccccgtcttctttacggtttggattagtagctttttcttttctttatttttttaaaaaagtttcagaaaactccactccatattttatggttaaatttgcacaaaaccacatgtattatgaagcgtggcaaataatcacaggttttatggtctatctatactaatataaaaaggagaagttgtgactagcaatcctacaggtgaaatcaatccccatgtccccaccctctgtgtagcggtgaaatcaccgattcctcatcccaccgggcgagcgcgagaacccctttcgcagtaacaccgcctcgagcgctatccccgccaccgcttgccgcgttattcccgcgcacagagcaatgacaccggatgatgcgcctcctcgcgcattgaatac

SEQ ID NO: 31460 - DNA, 1461 bp, Oryza sativa
cacattatttgaaaatattttcacgaatttaaacacgctttctcacagatgataagacatcatattagtaccttcacgtttagaaaaacgctgtaatgcaagttgggtaatcatttcaatggcagccattctcagcaaaagagtggctcgatcaggagaataaacatgcataatgcacaataacattaggttttaaatgcctgaaggatgaagaaacaaaataattgctgcttattttctagtgtcatagctgaaccaccacttaagtgcactcctcctgattcagcatctgaagcagctttaactgcctaaaacaagaagatgatatcaagatggttgctgaaaattttgagtgttacagagaaaatgtttgacagcagcattaagagttaatgtgttgtaatacttgaaataggaagcactttgttgcacactcttgcaatagtgccagcatactggagttccttagtctcttcaccagtccaactgaggattacaaaaaacaaaaagttataaccaattgaatgtaacagaaatgtttattattttatcataatgattcattgcaaacatgtactccctctgtttcatattataccccctccgtcccataaaaaatccaattcttggtttgaatctggacataaggattgggttttttatgggacggagggagtatgtcgctttgacttttttcctagttaattttttttaagctcgaccaagtttaaagaaaaatttagcgacatctagaacacaaaattagtttcattaaatctaaccttgaatatattttgatattatgtttgtttgtgttggaaatgctactatattattctataaacttggtcaaacttaaaaaaaaaaatcaaagcgacttataatatgaaatggagggggtagtaatttctttgaaccatgaagatggaaggtaaactgaattttttaaacccagcatttaaatttgtcaaaaacaattgaaaacatcaaaaagcttccagcaccacatgctatgtcttctatgtggctgcaaaacaaaggatgcagattgtgaaatgaatacattaactcttctttactacaactgatctaaagaaaagattcggagttggttgataaagtagcccaggaaatgtaccatttctttatactttaccaaagttactattgaagtatatcaatcaagataacaaataatcaattgactgtaaacaagtctcataagtctggacttactgtgcctcatcaagtttgacttgtggttttctgaaaaacttcccttctctgatcaaactatgttttgatagtgaagaaaactaatctgactatccaacctcgcagcattgtataatagtgggtgtgcttagataattacagaaaacaagaaagatgtactatcagaattcatgatccggtgattggatattcagataaattttctgctctatcaaaacatctttc

SEQ ID NO: 31461 - DNA, 1098 bp, Oryza sativa
aaaaaggctcaagaaaagaaaaggttaaaaaacttctcttggttattttgtgttaaaggttatttgagaaagagtgataaatgcaataggtctatgtgtttagtgtttattcttcaacctatgtgcttgttaagatgttgcattataaatcatatgaaatcatgaattttgattgttgattcaagcttaattgtaaaatctttggttcatggttatactttaatacatgcttgttttgttatagatgggtttatcttctttttattgcaacacatgacttgatatgctatatgtatgctaagctcttgaacattaataaacataattcctatgcttgatgaaatcattgtcaaaagggggagaagtaatgtgaaatttttggattttttggagtagcaaagtgaatttttgagaagagcatgttgttggttcaattgggaatttctttcttttaaaaagggggagaagttttcttttcgatttttgagcacgatgtgtacatttgtacgaagtgtgctttttaccaccaaatatcaaaacatttttatgagtttgccaatgtgttcatcaagggggagattgtaaaatcaaaggtgtttttgattattattctgtgatgaacaattgggcattggacattattggttttgtatttggaattaatcacgaagtggttttggagatgattggttttcacaggtgaaatctgcggcattaacattttatgtggaccggtcagaccgggctctggtagccggtcagaccggcgtgtatcgcgcggtcagaccggcgcgacccgcggtctgaccggccgacactgtgttggtttcggtttcgggttgtttatttggatatccgagtttattccatgattatgacttctagatggatactatacgtatgtaatactattgtttgctgctaatgagtcaagttggagatagcttggtctcggaatatggtttctttgtttgttccatgtgtaggtgactcgatgtctcgagaaagtatttgcggtgatggacagggagtcggcttggggataagacgacgtccttggtggtcagagatcatgcgggatacttaggctagagttga

SEQ ID NO: 31462 - DNA, 250 bp, Oryza sativa
tcccccccacgattttattttttttaaatagactataaaatcacctagctcccaaatttggctagaggaggggggcaaacagatatggctagaggaggggggcgaaagtggcggcagccaccacaggcagcggtcccctcccctccctcccagatctggcctaaggaggagagcgacagtggtggccagccactgcaggcggcgacggaggcagcactcccctccccttccttcctccctccctcctaga

SEQ ID NO: 31463 - DNA, 710 bp, Oryza sativa
ataagctgttgaatgtggggaccacatccacagaaatgatagtatgcgttcatgaaataatataagtagacctcccaccacctggatctactttagtatgcctatgttataatgcttaataaaaaaattctaatgcacatagcactgcctaattactagaacgagtatttgattagattagcgcatagatattccaaactgcatattaaattactaatgaacaggcatctgattagtcagatcatagctatcacaatagcagacaatcgaatgcctggggtatacaataagatcatggttccctcaagtgatcactgtgacaagaaatatctgacatacctacataaattatggtgaatcacataaaaaaaatgcaaatagaagacactaacactagatgctatttgtgctcgtgataagagaaggtaacatgatgcatgcagcaaaaagaacgcatcaagccatccataaaacaatgtaaatgcaatacagttaaattcaaataaatactcacatctgtttagttccataaaagtagaccagcagcttctttttagctgaagaaaggccccatttctctggctcacttatctgtaacagtgtggatattcatgaattgaagtgctcatgattgaaacaactaacacatgctctgaagaaaccgcaaatccttgtaaacaaaccagacataggaatgctaaaaatagaaa

SEQ ID NO: 31464 - DNA, 1501 bp, Oryza sativa
tagaggaagaagatgaggaggcggctaacctcgttttcgtccccattcagcgctgttgagcccatcgttatccctgttccaaaccacgcagcaacttgacggagagggagaggagcttgtcagtgtccggcctagggaggaaggccgccggttggaggaagaaaggagtgggggtcgccgccgaacttccgctgtcaactagggaggtcggtgtttggtggtcggtgtttcagaacagataatgtttggtggtcggtgttgtagatagatcgaggcaacttgggaggaggaggtgttggactaccaacgtcgatgcgggctacgacgacggtgccgatagaaccgcggtgcagccgttggtggaggcgacaccgcgccctggacaagaaccaggcaaccagctgccctgcccctggcgagctattcgattcgagctcgtactcgacagaagcccagaatattgcgagctttggctcaaagcctcaaactcgaagtcgccagaaattgcgcggccgtttttctctttttctgaacgattttgttaaacatcacgcgacagattttttttttttgtggaaatcactagaatttgcttccgttggatcgcttgggcatgacttaatttaacggctgtgatgcgtccctaccgtgcacgcctgcacgaaccacctagtagcatttttattggacacacaaccaacactataaccagataaggaatatgaacggatgcaaccatgcgtgttagtttggtttgatgaaataaaatataaaactacagttttatataacacaattatatttgcaaattcagttgatatgacatgtaagtgcaatgtaattttgataaaaattattgtgtaagtaaatatgtattagttattttctttaaaatatagaattacagtcctatataactaaaattacatttgtaaatttagttgatatgacaggtaagtgcactataattttaatataaatattgtgtaagtaaatatgtatttattattttcttttgtaatccgttagttgtaaatgtaaggatagaaaaaatctggtcacccaacaaatgaataggcgcgcgaaaaaaaagaaaaagaaaaaaaagggttgcatcttgtcggggtacacagctactgctcgtagtactacggcctcgtggagaaatcatcgggagcaaatcaaccttagccaatcggtgcgaaactaagatcacgggcagccgggcagcaatgcaatgcagcatgtccttccagctcactgtaacgtttattgcaccgtcccggcgggcggtatcgacgacgggtggggggggggggggggggaccgaaagtgggaaagtgcgcccggttgttgcggcgatttgtccctaccactacgctggagtagcggtattggatgctccagctatcgattgagatccagtggcctcgttgaggtgagtgaaatttcccgtagagagtccaagggcatgtttagttcaaaccaaaattagaagttt

SEQ ID NO: 31465 - DNA, 789 bp, Oryza sativa
caaagaggaccttgctattttctaattactgaaagggcaaggccactcgggatcaacacatcaacatctctgaactggtctacttgtctctgcaggtaggaggaagctagctcgtaaaaataccacaacaggccctatatatctgtgctctccacttgtggcgagagagcaaaactgcaagtacttctatagttccttgcacctaatgatatgagtttatatttctgaacagaggatcaaatgataaatggggactgctaagaaaagtgcaatctttgttgcactgctgtgcactcacattcttgtgaaccatgcatgtgacagtggtaagaattctgtttatccttcttttgcatttttcctcagctagtctattgttttgttgtttagtttatcttatgatatgtgatttgttgaccatccatgtgacaatggcacagatttttgctctcccgaggactacaacagaacaactttgtccctcaaacttatttttttcttatttttttatagtttttcagcttgtggcgaccttttctttactcggactagagatgcatttacccctttacctctcagttcttcctttgattctttaataactacaattttgatatttatattgaatggaagaaagtcaagataaaaaagtcacaaaatctcataaaaatggaaaaacaattcaaattcctcagtcataccaaatattataatcattgtagaatatcagatatcaaactggatgatccaaagataataaaactcagtggaaactggatggatcattgt

SEQ ID NO: 31466 - DNA, 1501 bp, Oryza sativa
taagttcatcagcatttccactcacattttagtaccttcagccagccagtggtgttcctacgttatccttctcgaggtcataggacccagataaataattatccaattttaataatgtatattatattaattaagtatatcaattcataagttagatacttaattactctctctatttcataatataacgtaaaactattttttaaaattgttttataagataaaacatacgtatatgcatgtaactagctagcacctactctccttcaccctcaagatctcttgatttattgggtgcatacattatatttatttacattacgtgaactagaagttgataataattatttcttgctcgttgggttaagtgtgtggttatgccttatatttagaactgagggagtatgattagacccttgataatttccgttctcggttcgtcactacttcagtgcttcttccttcaagatatcaagtgtttcattacaagttgggaaaatatgtagtgcaaaatgtaacgtaaacctgaaaactatcgttggataaaaaaaattggcatatgagatttgttcacgtcatcttaagtaaaacttttactcccggtaaaacattccctcgttgttaaatccgggagtaaaagttttacttagagtaacgcggacaaatctcaaacgtttattttgatttaacggtagttttcatgttaaataatatatgaaatttgcactgattcttgtataagcctacttctaagcatttggttgccacctctggtcccttctgaaacatcaacctgcacgcaggaagtgtttgacaaggacaccttcaccaaggacgacagcatgggcgacgcggagttcggcatcctggacttcgtcgagatcgccaagcaggaccacagccatctcggcgacggcgcggtgatgaagacgatccacccggacaaggaggagaactgcttcgcggcggagagccacatcacatggaaggacggcaaggtgtcccaggacatcgtcctcaagctcaggaacaccgataccggcgagatcatcctgcacctccaatgggttaacatcccaggtgtctcccggtgattcgccggcggcgagcttatatatatatatacacacacaacacacacatatatgtatgtatgtatgtgtgtgtgtgtaatatacacacacacacacacatggctggtgtggacacggtctatgaggtatgaaagataagtaaaaaaaaaaaacatcctgatgagatcatgagatcagtaggatgggataaaaatatgtgatgctgatatgcagcaggcctgtgctactgggagtaatatgcttgtttttcagtgtttggttctgcataccttctgttgcttttctgttccgcagggatgtataagttctggaacacattttcagtatgccactcgaaataaattactgtcaattgaaactaaaaaaaaacaacatttacagattgacagaccaggtgagatttcagg

SEQ ID NO: 31467 - DNA, 158 bp, Oryza sativa
ttctattttttgatcaaaatataaaagggactacgaaagaggaaaacaacctccaggttaattttaaaaccatgttttaaaatcataaattggttgcagctcaaataacccatgggtattagtgaggtgattaccgccacgtgaaccctgtgtttagc

SEQ ID NO: 31468 - DNA, 1501 bp, Oryza sativa
gatatcgggaattaggtttcgcttaccacggtaaatcatgaaaagccgaacaaaatccatcaaaaacgtctttcacgatcctctttactgttagcataatctagctaggccatcgtggtttactagagcttgtgccgcaggacgaatatgacggcatcgaacctgggcaaggatggctgggaagaacggcgacggaactacgagagcgagggcagtgatcactgggtggaacagcggccgccatggccgggtgaacgggtagcgacggtgattctcaaaattacccctaactatagagttagtaactaagtactccctccatcctactacctccgttttttaatagatgacgtcatttattttttctcacatgtttgaccattcgtcttatttaaaaaatttacgtaattataatttattttgttatgagttgttttatcactcatagtactttaagtgtgatttatatcttatacatttgcataaaattttgaataagacgaatgatcaaacatgtgagaaaaagtcaacggcgtcatctattaaaaaacggagggagtataatataagcatttttaagtatggtgtccagtcagatatttttaactttaactattaatagaaaaaaaggatcaatcatgtaaaattgatgttactaaatttatcattaaacaaactatcataatgtataactctttttatttaaaacatcttattttatagttattattggtcaaaatagcatcctgaatactgtgtcgaagtccaaaaatgttcatttttgggacggagagagtgctaaggccctgtttagttcctaaaacaaatttcacatcgaatgtttggacacatgcatggagtattaaatgtagacaaaaaaaaagtcaattacacatattgcgtgtaaattgcgagacgaatcttttaagcctaattacgctatgatttgataatgttgtggtacagtaaacatttactaatgacggattaattaggcttaataaactcgtctcgcggtttactgatggaatctataatttattgttttgttattagactacgtttaatacttcaaatatgtgtccgtatatccgatatgacacacagaagcaaaaatttttgccaaatgaaccaggcctaatatacccttataatctgagcactcagatcgttcctacaagtagtattacctaaatttggtagcgttaccggcgcgtggaggtggattggagcggtttcagaaatatcatgcatatgcatgatgcatccgtgtagttaatgaaaatataaaaagcctttggctggctgcccggcgttggcgtccagcttctccatcttcctccacggcgcccaagttttgcgttgcctaagcctgccttcctgccgtttctttctgtcgcccgtcgtctcctcctcctcctcttccttcagctttaactccggtaataaggtcgacgcgcgcggccgcgagaggaggctgatcagcccggagagacgatct

SEQ ID NO: 31469 - DNA, 818 bp, Oryza sativa
attcgagattgaaatgctgagttaaatcttgacttatcgctaatgccttgagacacatccatttggcgaattttgtgagcaaggtgtgcagtgtagaggtttgattatcaagataagcacgtaagatccaagaaatattatcatgttctctcaacattctgttggagatacttcactatcggtttttcttatgttgttggcattaaccaagattaactgtaccaaaagacagaccagaatttgtcaatctagggatatggataatctaaaagtgcaagaaataagcttatttagaactaacacctattatttgcaacctttgtaatgaccaaatcttaaccaaattagttttttttttgttcctgaaaattttgtgctatagtaaaaatgtctagctcagttttttaaaacatgtttactacttaaatttttattttggtatccctggaggctcaatgaagtacctaactcagtgttaaaaaatacttcatccgtttcatattataagactttctagcattgcccttatttatatatatgttaatgaatctaaacatatatgttgtctagattcattaatatctatatgaatgtggacaatgctagaaagtcttataacctgaaacggagggagtagtacttatgaggacagctattttaccttcttttaaagcaatgacaattcatgacatgttactgttatctgacttacctgacaacagttgtttttacgccaggaaaaatatgttttgttattttatatatttttcttaaagtagtttgatctcctaacaagattgtaatttttatcttgcagc

SEQ ID NO: 31470 - DNA, 1501 bp, Oryza sativa
catagatggttcacctctgagtgaggcaggtgcgctacattgggacagccgttgaggtagggccgagaggcgtgccctccatcggtgtcgccattggtaggactgccatgagtgtgtaagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcaaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattatacttagctagactctaaattctttaacttgtgtgggatgggatattgcatgatgatttttatgctgatggagccacttcctgagaggcgggaatgtggacgtcctcagaaaaccataacgattcaatggcgggaagctatccttgggatcacaatggatggtggacagaaccgtcattgtttaatatgaacactggtattaaaacgtgatcaatctatgctaggtcttaggcttgtgaaaagaattacaaaatttgctttgcgcaaaagaaccatagccatcctttgaattcctctgtcatgtgcatcattgctgtggtggcttgctgagtacggttggtactcatccttgcaaatataaaatttatcagaagcggaagatgaagcctcggaggatccctatgcctactatcaggagggagatgaagacgaaggcgtccagtaggtcttagtacggtcgttgcctgtggcaatggcatgccgctgcctgaattccgctgccttatctatttctgcttttggatgtattccggaccgctcggtccgatgatttaagactatgcctgcgggcctataatgtaataattcgtattagacactcgtgtatgtgcacttggtattccagctatgaatccgtgtgtaccaaactacttgatccagggaaatggtactgtttacacgattgattcctgttataaaaacgggggtctacacgccggtcgcgtcatcggcagacaaccgtgctcccacgatgcatctgcctccggtggagtggaggtaggtatgacccatctcgtcggatggtcatttggaaagcagccatggcaaatctccgcccattaatgagggagtaacaggagatccccggtgtcaggcgagagacggcgctgagcctcactcaaggacaagttgtgatttagtttccaggcgaaggtgcaagccaagttttggtcaaaaaagggtaggtccccacccaacaagaaaagtaggtagaattggtgaatgtagtatccccttgagatataaaaggaggaccttgcccaccaaagagaaagaaaaaaaaaaagaaaaa

SEQ ID NO: 31471 - DNA, 231 bp, Oryza sativa
tggcgccccaaaaaggaccatttctggaataagttttttcaggggtctatttgcgaaataagttttttaaaaggaccaaaatgtgaaaaatccagtagtggcacacggctagattcctagatcccggacgcttggagtcggatcctctgccgtttggtgcatcaccctgcgccccaccactaatctgaggccccatttgatttcatgaaaaaaaaaacgtagggattccaa

SEQ ID NO: 31472 - DNA, 1501 bp, Oryza sativa
ttaacctcttcgaggagccgaaaaaattcagaaaacagagaaaatcggagagggtatggggcgttaataacttgttattttgataggttagactctgccagaccaatgtcaaataagctatttgtggcaaattgttaatacgattataatacaattgttttttataggcgaaacaattttatactagttaatgtggtggtaaccggatcacccaaaagccaaaaccacagtgtaaaaccggccttaattaacgtgaaactagcttttttccacgcataaataaaataaaagcaactagttaatctacggttagttgatcattattcatgaaaagtcgctgaagaaaaactcgagtacttgacgtacaattcattgccgcgcatctttcaacaaaccccgtacagaaaaatcttataccgcgcatgtttctcctgaagaaaccaaaccgtgacaccggtgccttctcgcggggagacgccgcgtccaccacgcatgttttcgcattggctcgttgcgcgtttccgcatgctactcttttttctttctataatggagtaaaaatttcgctatatgttttgaagaagttacaatcacttaatataaaattctcacaagaaaacagatacttagacaacaataaaaccaacatatataaggagaaaaaatggcatcatcttttcgcttatacttatacttataagccagaatttgaatttttaaccttaaatttggagctaatttcgaggttttttcatcgaagtttatttttcagcctttgattgtagatcactaagaacacgtatataaaagttatatatataaattactttttttttgtaaatacacatttcacttatttcacgaataagcgaaacaatggctccataattgctgaagtttatctgtgaatcttcactgcatgatagtaggttctaattttcaacgtgcagaatatatgagctccctgcccgtcggtttcgcgtttttgtttcaccgtaccgcgcactgtctcacctcacggtgtcactgcagtgcagcagatgcgtcacgcatggcggcgacgccgtccatcatgcgtctctgcccgtctctcccgccttcctcgagggcccggggcccctctgtgcccaagagcgcgataggcgatcggctcgaaacggaccaatcatctccggcatgcacaatctctccagcctgcacgtctctcctcgttgcgttggtctatctatcctaatccggtggccttcttccaccaacaatcgcctttaataacagttcaaaagaaataaaaaagaagaaaaacaatcgcctttaggcgtcaccggtctctgtcctgggggccacctcatccaacgttcaacctaaaaacgctgtgcagtgtgcagctgggacacgctacatgggccctgtgttccagtgagagtcccagcgacgctcggaggaaggacgggtggagccgtggggagtggagaatggagaacgagacacgaggaacaagcca

SEQ ID NO: 31473 - DNA, 772 bp, Oryza sativa
tataaaatccagaaagaagacaggcacataattatgcattcatattagctatcttttgcaagataagaaaagcaacatacctttcctaaaataatggggataagaagggttgtaaccagacttttaaatagtttctctgtgggcaaagacaccccagctccaacaccaatgtactttgcaagagaaagaggtacctaattccatggtcacaaataaatatgaacatattttacaaagaaataggagttttggcttttggaaaacagggaaaaagtcatccttgattattatctaaaaacaataagttgattgctcaatgctcattatctgaaaatacatacgaagattaatgccagaattaggaggttcaatgctacttggaagtctcaaagataatttgtttcatagtcaatgctggattttagcctacggcccaggcaatgttatagatatcttcaaggttctacagggatgatggattgcaatcaagtaaccatctctgatcaagataatttctatttttatctaaaataatattttcctcccataatcagttcagctcaggagaaaaataacttgcttctctaatgttattttcaatactaaaaaatatatattacttttaatggcatcaaacaaaacattgtgttgcaatgaatcaacaaaattaagtcggtagttcgataatgtgtttataagttgttagttataagtaatgctggtaagtggttcagaagacaaactagcaacaaagctttgcttacaatcataa

SEQ ID NO: 31474 - DNA, 1501 bp, Oryza sativa
ggtttcttccgtttctgatttgttttcatccctacatacatataaagtttagggttaattagatctataccattaaaaatttgtcagttttgaaatataccattactctttgtgtatttgtaacgagggactaggggagggaggagccgcatcgtcagggtagttggaggaagatgccatcggtggcggggaccgagggccccatggcaacgctgtcgtcggtgtggagctctgcgtaggaggacaccagcagcggcacgaggtggagggaggcgcggacatcctggccgaaggagcgctggagaggaaggagatggcggctatagtgaccatgtccatcgtcagtcatgcttaccgctgccgttgccgaactatcgcctgtctttcacgccatggaagagaggaggaaggagaaagggaaagaaggaagaaggggaaaggggcaggttggttcaatttttttttcataaatgaatccaaggggtaagtaatggcatatctgaaacatgtgtaaaattataatggcccaaatacgcgaatactagtggtaaatttgaaaccaacatattttttatggcatggatccaattaaccgtaaagtttattacaattagagaatataggaaaagttgtgagaaaccaatccttaggctaaatcgccatctattttctggggggggggggaacgtgtcttgaccacttactcaaagtgctgacataccgttgcaaccaaattttgtgaacccaacttctaaaaaatagcccaagtacaaaacctgtatgtaactagacatataacctgcaaaggaaatgaaaatttccttttgttaaacaccatataatttctgcatagccatatataataacaacaagtaatagccacacctagtaggacctttgttgccactccaatttggcccaccttctccaccttgagcatccttgctgccaccggagttgagggaaatgggagacttttctcgtcccttctctcgttagtttttaggagttaattaataaactctggagattagatctattatgttataaaaactctgggtgatctcatcaataccttggatgggattgacaccctcgtgcccgatggtggttagacactgcagttgtgtagtgcctcgcatctccttgccctctcaaggcactccattccaaccaacgcggtggtatccatccatagcgtccataaccgattccctatatatatttgtaccaatgatcaatgagaatctaatcctcttcgctcaatctctctcgctctcgctttaatctgaacatgttatcagcactgctcgcgaaggagaagaggaagagaaggaaattgttgacgcgaaatcttccacttgacatgccagatgtgcattgatcgcgccaacactgaggcctgggagattttgcttcttttttttattggcaacttggtttgtgaggtcctatgcaaagattttggaaggtgccgatgatcgaataaatggctttggct

SEQ ID NO: 31475 - DNA, 1501 bp, Oryza sativa
acagataacggagtctagccatgcatagtgggagaagtgacatctcatcagaggggcttcatcattcaacttgaatagcattttcctttttccaagagatcactgtcttctgttcgtgttcctgatgagttacttcatgctcttgatagtgatgactgtcatgtgtctggatttctaattttttgagtttgggaagcatactcaactttatttctactttcttcaatttctccacgtcaaccttgagcttctgtagacatcgaaatttattagaaaagaagacaagttcctgatccttgtaggatcctagacacaacgcaagtgtgacaagagagggaagctttgctagcttgttaataaactcctgagttacttttgtttccttcaatgtaagcatagtcagattagggagggctaacccattattcagttgatcagatgaaaagtccaactccccgtctagaaccataaacttgaggcgacgcaagaacaaggtggtgaatacacttgatgtaatattgttaccttgtaagtttagagtcttaaggctctcaagctttcttagagcacttaacagagctttgacattaccatttgagattttccaaataactaagccctcaagatggatcatctctccaagtgtattatccaagccttgctcaaaatcttcaagttctatggaatcaagtgtatgtagctgcttcaaattgacagtttgcttgggtaatttgaggataaaaccaaacacatgccttagtgtcttgatcatccaaaatgcctttgggagcttccggactttagtttcccttacatccaatgtttgaaggcttgtaagatttcctatggatgatgggatgttttcaagtgagcaagaagtgattccaaggtattggaggtgaacggctttgcctattgcacgtgtcaacctgttacctatctcaatgccttgtatattgataacacggaggaactcagatccatgcaatagttcttttatgtgagatttgatattcttcttctgcatagaagctatagtaccttgttgaggggaacaacatacatatgcttggatgctttttgtcatggtctccaattcctctttaggctcttgctcaaactgggagaagatggatcgtagcttcggcaatggatttgctagaacagcatatttatcagtgtaattctgcaaggagagacgacgagcacttgtcaatgtggggatatcatcaccactatgtacctctaggaagcttgcctcatgtgcttcaaactgcaaaaattcatggactttgttttggatggtaacagtcatattgctaacattggaatcatcgtccatttgaaccagactgactagattcctagccgacaactctttcaagtagaagtagccaatgtcctccattgacttgccaacttttgaccttagaaatccctcagctacccacatagacactaggttgcgtgcctcaatggtaacattggctggaaatgcagc

SEQ ID NO: 31476 - DNA, 1430 bp, Oryza sativa
tcacttttgtccgcctgcgaaaatactttttctagtagttggggggggggtgaaaagggaaccgtcgtttctatgcaacggttcagagtcgactcttaacatttattaaaaaaaaattgttgcaggggaagaagaaaaggaaataagggtaaaaaaaatattttggtgtaataatagttaagagatcttattgtctcactattgtatgaggatggtttctaagtgatatatattaactaacaaaccaatattgaactttatatttgtacatgctcttacgtaaagttgctagagtacgattaacttctaggtttaaaatcactgcttatatacctggtattgtcgatagtttacaagaacattacgtagtattagtaagaggaggaagggttaaggatttacctggtgcgagatatatatcgcattattctaggagccctatatgctgtcgcaataaagaatcatcaacaagggcgtttctggtgcagtagtgcattgtatattcttatcatttcatgatgccgtgtaaatcgcttatagcttttgtttatgtcatgccatatttgtgtctatgcatatatacataggaggagagaacaggggaaaacagagaagaatactatgcttttatggaacagagaagagagtaaatgaagaagagaaaggtatataacaagatgggggaaaagtatattattttacctcatgataatatgtagtgagcttatagataacttaaattagaagacatgtcaagattaggtcatatactcatatccccatggattcgggcaataactctatctctcataatatatccacatttgatggaaattgacactttgaaagcttgttcaatcgcttttgtttttacccctctttttgaaatcagtcggcccttctttcacaggctaaaattaacttgtaaattcctttgcttgtaacttgtacacgcatgttcctgcagaaaaggatgcatgcatatcgctcgatggtttggatagaaaataacttttaggcccaagctgcgacattctttttaaccttttttgttcgtaaaattgacggtatgcatgcatgcgtttagaattctacgctcgtgaagtgttgatactcatcaaattccaaactctctgctgctatcttgtttgcaaccgatggctgctttgaacttctcgagattttcccctcaaaaaacttctcgaaattttgtaggcaagaaagtatgtgatttgagcccccgactgtgtgcgccacggctgacgcgcacattggcacgcatgactcgttgaacatttagacgacccggtaagcccaccaccgcagcacagtataagtagcacactttgcatgcagctttcgcaagcatattcgtgcgacgtaacgtgcatgcatggcgcctagatcatctccggccattggcggcggcg

SEQ ID NO: 31477 - DNA, 1501 bp, Oryza sativa
agagaattgaaacagccggcatggcccgctcaacagttatgacagtcccttctttccattcatctctttctacaaatgcatgagttttccaaaaaaaaaaaagaaaaaaaagaagagacaaaccgaaacagtgagctcggatcgtgccccattacttaggattagggtatgaacagtagtttataattagttatattttttattatgtcatatatcacatttaataaataagccatctgtttagctatcttgaatatattcatatataactaataatgatataattctctaaacaacatatatagtgttgattgtgttataataacaattaatagctagcccataaaaacgttaactactagactaatctacttgcgtgtagaagagagaaacctctcttagcccaaaataaaatgaaattttgtcgtatagggatggaaagggaaaaaaatatgataaaaatattttggtgagaattaatggttggaaactttatatattgttcaaccatggtaagttgatagcctctataaaacaaagtatcatgctatatatgaatcgacaacaactcattttttcccctccgcactaaaaaaaattatgtcgaattttctcctagacacagacactattatttatgccgttttttacttagttcgaataagattgatggcttagatttttcggaagcatgtgaaatgatacaaaccattgacacataattaatcgaatattaattattataaatttaataaatgcatttatttgattttttaaaaggaacttctaattttttacgaaatgaactgtttagtttagtagttcgagaagtaagctcacgaaaaacgatggagcatcatagtcgagcagctgtttcgaacacaaccttaattttgtttatccacctacatgtaccaaattaagattaaggttgagaattgattttttttcattagaaggtttgtttaaaaatttatgaatttttcgtgtagcctccttacaaaacatacaaatttgtgtatctgttccaagatatctttcatgtattattcaaaaaaaatatttacgtgtcatatatgagagaggaataacttgtgcaaaagataatagaaaaaatattttatgtatagcatactccctcaatccaaaagtcacatatttctgtggtcaccaacaccaaagatcaagaaatcatatcatgcatacaaccaataagtattaagatgactgctcaggttctcgtcaataatttattctagccttatactctctccgtcccattttaagtgcagtcctagttttccgcgtccaactttaaccatccgtcttatttaaattttttttgaaaaaatttaaaaatataagtcaccagtaaagtaatattcatgttttatcattgcataacaacaaaaatactaattataaaaaaatttaaataacaccgtgtttagatcccaaatttttcttcaaacttccaactttttccataacatcaaacttt

SEQ ID NO: 31478 - DNA, 246 bp, Oryza sativa
tcacttttgtccgcctgcgaaaatactttttctagtagttggggggggggtgaaaagggaaccgtcgtttctatgcaacggttcagagtcgactcttaacatttattaaaaaaaaattgttgcaggggaagaagaaaaggaaataagggtaaaaaaaatattttggtgtaataatagttaagagatcttattgtctcactattgtatgaggatggtttctaagtgatatatattaactaacaaacc

SEQ ID NO: 31479 - DNA, 1501 bp, Oryza sativa
tcgatgaaaaaacctcgaaattagctccaaatttaaggttaaaaattcaaattctggcttataagtataagtataagcgaaaagatgatgccattttttctccttatatatgttggttttattgttgtctaagtatctgttttcttgtgagaattttatattaagtgattgtaacttcttcaaaacatatagcgaaatttttactccattatagaaagaaaaaagagtagcatgcggaaacgcgcaacgagccaatgcgaaaacatgcgtggtggacgcggcgtctccccgcgagaaggcaccggtgtcacggtttggtttcttcaggagaaacatgcgcggtataagatttttctgtacggggtttgttgaaagatgcgcggcaatgaattgtacgtcaagtactcgagtttttcttcagcgacttttcatgaataatgatcaactaaccgtagattaactagttgcttttattttatttatgcgtggaaaaaagctagtttcacgttaattaaggccggttttacactgtggttttggcttttgggtgatccggttaccaccacattaactagtataaaattgtttcgcctataaaaaacaattgtattataatcgtattaacaatttgccacaaatagcttatttgacattggtctggcagagtctaacctatcaaaataacaagttattaacgccccataccctctccgattttctctgttttctgaattttttcggctcctcgaagaggttaagcgtgttttgctattttgcaaaaagctcctcatgtttattaaaaatatcgcacataaccgactgacaccctgtcatgttttatccagaaaaccccttgtcttccagtgaaatacaatgtgaagaatatagctaacaacttgatgataatatcttagataagatgttgtgatgtatgggccggaatgaatcacatatgtcagtagttttgcaacttttgttatgtaggagtatatatactcccttcatcctaaaataaataaaactattacgagatgtaactcatcctactactactcaaattcagagtactaaaatatgccatattcccctactaattttatttattttggaacagaggaagtatgtgtcatcactttgtattgtatgtaatgtttttcatcatgtaggtcttttctttctgaacaggatagattataacaaatgatataaaagattacagaacatgtggttacaataactatacataacaatatatcgacctaaaacaaagaggctccacataatgtaatattttaaaaaacatgtaaccataatactgaccaactctgacatacgaaaaagcaaatgaacgaatatcgaccatcatatttgttcctccaacatagcagcaaaccagtgttgccgatcaatttagcgactcggacttaaaggctaaagccaaagccatttattcgatcatcggcaccttccaaaatctttgcataggacctcacaaaccaag

SEQ ID NO: 31480 - DNA, 1501 bp, Oryza sativa
gactgcgagccgacgaggacaacttccgaggtcaccaagtcctggtgtcctatccacaagtccaggaagcacaacttgcaagtttgctgggtttttctcaacgtacaagctgaaatctgtgcttgcaaagagcgtggaatcctgcgtacttctctaactcgtgatgtctattgtcctattcacaagacgaagaatcacgacttctcaagctgcaaggtctttctccgcgccatgaagacgacgcttcccaaggtccaacagtcaggaacctctctcgaggagacagacaaggaacaaggagcgacgttgacttcggatcgtttcgttggagtaatcgacatcgatcccccactactagaatagtgaatgtcaacgaccaaaaactaacgacggctgcataatcttggtcgttgatactgctttgggccgatttctggtatccgacgacgctagttttttgtggtcactaatgcgtagtgggctgcggtcgttgttgttatttactcaggttggatgggcaattgcaaatggtcgttattactcagcgacctgtgtcctcagctctccggccactgccgccgccgccgccctcggcttcggccaccgccttcgattcgctccacagctgcaagcctgcagctgctgcccatgctccctataactttgctctttgctgctctttgccacacaaaggaggtagcggaacagcgggaggaagaatccccatcattggcataggaaaagtctatcagatcccctccaatccactgctcccttccaattccgaaatcccctcttttccccaaagatatttcgccccaaatcaatatgaatcaacagtttttgattccaaatccgagatcccctctgctacccccacatatttcgccccaaatcagtataaatcatgaggttgagagatgagaggagtgttgattcaccgccatgtctcgcagccgcagtttatcaccggaggtgacaactaggggctgcatcgaatggcctacatggtctcctcagggctcccaaatgtcaatcctccccaccactgaacatcttaatgccaagctcctccatgagtacatctctccacctgatctgcccagccactctgttatttgttccagttcacttgggactcatcaatcgtcgaaaatagtcacaacaggtattctccaatctcctaatgtaaacatttgcatatgatttgtgaaacatattgaattatgtgctaggttaaatgttaaatcttgccaggttaaagtgttggttgtattgtcctcttcgaaactaataaaagctgcaaagtttgctaggtggatactgattatttctatgctgccctcaacctgaaatgtttgatatggtcctgacaatttatttttgtggtagctatggcactttcattagcattaggctgtgtttagttggatccaaagtttggattttggttgaaattggagatgatgtgactgaaaagttgtgtgtgtatgacatgttg

SEQ ID NO: 31481 - DNA, 1501 bp, Oryza sativa
aaattggagtggcaacaaaggtcctactaggtgtggctattacttgttgttattatatatggctatgcagaaattatatggtgtttaacaaaaggaaattttcatttcctttgcaggttatatgtctagttacatacaggttttgtacttgggctattttttagaagttgggttcacaaaatttggttgcaacggtatgtcagcactttgagtaagtggtcaagacacgttccccccccccccagaaaatagatggcgatttagcctaaggattggtttctcacaacttttcctatattctctaattgtaataaactttacggttaattggatccatgccataaaaaatatgttggtttcaaatttaccactagtattcgcgtatttgggccattataattttacacatgtttcagatatgccattacttaccccttggattcatttatgaaaaaaaaattgaaccaacctgcccctttccccttcttccttctttccctttctccttcctcctctcttccatggcgtgaaagacaggcgatagttcggcaacggcagcggtaagcatgactgacgatggacatggtcactatagccgccatctccttcctctccagcgctccttcggccaggatgtccgcgcctccctccacctcgtgccgctgctggtgtcctcctacgcagagctccacaccgacgacagcgttgccatggggccctcggtccccgccaccgatggcatcttcctccaactaccctgacgatgcggctcctccctcccctagtccctcgttacaaatacacaaagagtaatggtatatttcaaaactgacaaatttttaatggtatagatctaattaaccctaaactttatatgtatgtagggatgaaaacaaatcagaaacggaagaaacccacctctaccatttttgtttcctttttttttcagaactggaaaccccgaatacaaaaacatgatcgaatattatcaactacaaaaatgaagtgaataatgttatgaatatttatcaaaatataaaaaccacttaaactgaacttctaccttttttttctaaaacaatagataaaaaattccaaattttagcaaataacaataccactttatattataagaataacatcacaattcacataccacttcgttaaagtccaatttttcatcttttgaacaacaaatattgcctagagaaaatttcaagttcttttccgagaaattttgcggtaagtttatgacctattccactttctaacaaatagtgcctttattgtattcgttttcgtttgaggcaaaaaaaagtccgaatctgttttgttttctaaaagtttttgaaacaaaaccctaccgttacttcttgttttcaaaaacaggtccagaatctggaaactttctgaaccgttttcaaccctcatacgtgtgtgttggatcgggtgtattctagttatgcataaatcgggagggttctcaatatggttctttttt

SEQ ID NO: 31482 - DNA, 528 bp, Oryza sativa
atagaatttgaatatgatttttagtggagtggtagatgttagtatctctaactggcaaaaaaccccccaaaaaaaaaatttttttttttaaaaagggggaaaaaaaatttttttttttttttttcccaccaaaaccttaattttgcattgaattggagagaaatatttacactaggaggtatcccctcaaggattagaatgttcttcctcttttgactacattatttgcgttggtaacagtttttattttccaattaaaaccagaatagaaaacatgtatagaaaaaaaagaatctatgtgcgcttaaaggaaaacatatgtttttccttttatgattaaacatttggacacaagaataatcgatcagcacatgaataataagtcatacaagatgggtccttttcgatttgtccaatcaattgcaagttgattctggaggaaaagaacattaaatagagtaaagaagacgtctccagtattatttccgcttttgctgaatgtatatattcaccaggataacaaaacaa

SEQ ID NO: 31483 - DNA, 1501 bp, Oryza sativa
ttccatattcatattgatgttaatgaatctatacatatatatatctatctagattcattaacattaatataaatgtgaaaaatgttataatgactaacattatgaaacgaagggagtaacgattatgatgataatatctgttttgtggcgtcaaggcgccggcagcagctagctagcagtcaatgttaggtgcaggtgaatatgcgttttgtttctcatgcagcatgcttgcatgcatgaatgaccaagccaatagcggcgcggtgggtggacgctcatgaggctagcaactcacgaccatacgtgtgccgctcgatcgactggctcgccggccgagttcactattaatttggctgccgatacagttgtgtgttcagatttgtgagttgtagtagctataggctagtatactgcctccgttttttcttaaaaaaagaaaaatattttagaaaatcaaagacatatatcaagctagcaatgggctaaaaaaatctactatatcctccattaattcaaaagttctttatgagaaaaatccaaaaactaaaaaatcactcttgtaaggatggaccgacgtacagtctatcgcaaggtataagtttaagttcgggttaggcaactatattgtcttgttttgatgatttctgttgactcaggatagattttgatatgaggccatatgcatatgaaaggtgacaatgtaagcatttcaacaaatccaagatcacctaaattgaagttggcatgaagacgctaggtttatttgaagccagtgatgtttcttaagaccgaactggattccaaaaatgagcttgaatatcttatagatcttccattcatccgaggtattgtttggtaatgttttatatttctcatgcttaattgtataaatatagttgatggtcacactagttatagaaaaatatagtactacaccaaattagtttttgttaaacccatcattgaatataatacttttttaattaaataatgctttttttatgaacttgtccaatttatagaagtttaatttaggatgcagtgaaacaaattttcgcatcgacatgagaatttcgtaagctattcgactagactgtatccatcccacaagtttgtacattgccaatagttaggacgacatggataatttgggatcactagaacggataccatcatctcaatcgggcggcaacccccatctcaatcgggcatggcgtccgtcacaggctagaagtcactgatgtgaaaagttatctcaatcaggcaaacggccgtcacagatgaacctatctcaatcgggccataattaaagcccgtcaccaatagcttttgacccagacgatcagttaaactatagcccgtcacggatgacctatctcaatcgggcctaagttaatgcccatcatagatgagtcctctcaatcgggtctaagttaatgcccgtcacagatgagtataatctccaaaaaaataaattttatttttaggcatgccgtctagc

SEQ ID NO: 31484 - DNA, 271 bp, Oryza sativa
gaaggacttatttttctccatcgttgatgctccaaattaacaagtcttcaacaaagaaagtctaggtttgaatatggtataccatgttcgatcacatgcacaaactgattaaacaaaacatagaaaacatggggagtgataggtgatggatttccctctttcacccaaaaaaggtaaaaacaaacttctgtaattgctggaaactcatcgagtacaggctaaaacttcattaatcaatcttattaaagacagaaacagtatatcgaacctt

SEQ ID NO: 31485 - DNA, 1501 bp, Oryza sativa
cgaggacaacgacctcggcctccccgtcgccgccgtctacttcaacgcgcagcgcgagaccgccgctcgccgccgctaatggctaccgacgacggcgacgacgacgacgaccctgacaccgcgacgaccgatcttgcatggacaaaacaatataatcgagcttaattaattactactacttctactggcattttctattagttttcctatttcccctacattaatttcactgtcaaataaggcacactgtgattagctgcagctagctagctttgctcgtgtgtgtgagctagctagctcgtagctacagggcaggcctacagactaccagttcgtgcttgtttgcatgcacattatcagattatcctagttgatttgtgaattaatcaaggtgatcataggattgtgagtgagcaatcgcaatcgcaatgtgcaagctatggttgactagcagcagtgagagatctctagctagctacactagttgaagcaatggccatccatggcaggagagtcctagcatcccccctgcatatatgcctacctactattcaactgctgttcttcgattcaattcgctggtgcttgcagtgtactttgtttgatcctgtgatcactacttcttgccacttgtttttgtaatccgatcggtgtcactttttctgtatccctttatctcactttttggtgacatgacatggatatatatatatctgtttatatatgtatgcatgcatgatgcatgtatctaataatcttgggcgattaggccggcattgttctcgccgaacgtatcggctgtgagcttcaacggtaagctggtgtgtaaatgtatggagctggaaacattcagaggcagcgtagattcttgacctccttttccctgtcatttcgatcgttttaatatcgatggtttggctctctttttttttcctgtggatgagtagtatacttccttcgagcggataatacttgtcgttttagacaaaggtataaggtcaaactttagaatctttgattataaattatttttaaaatatttgtctttcaaatatggtgactatatgtatagattagtcttaaaaaatacattaataaaatcatgtatttgttaacacttttatacatattataataaaaaataatggtcaaaacttttttttttagagatcgtgtccttattcaaaacgataagtattatcaactcggagaaagtagataataattggacatcatgaagatggagtaaaaaatgaattggggagtagatcttgatcaaatattctctgtatgtatcaatgtgtgaagacatttttgttctctcgagtaatacgaagagctagatatggctacaaaaactgtagcaaaattaaaatcagctggttacctgcaagaaaagggaagattcggcccgttcttttcatcaacaaaagttagatgaagattaagattttcgtggcacgcttttcaaactgttaaatggtacgtttcgtgcgaaaac

SEQ ID NO: 31486 - DNA, 334 bp, Oryza sativa
cagggatgggaactaatccctcctgcacggaaaatggaacgatctattagcacatgattaattaagtattagctaaattttattttaaaaatgaattaatttgatttttttaagcaactttcgtatagaaactttttgcaaaaaacacaccatttagtagtttgaaaagcatgcgcgcggaaaacgagagaggagggttgggaaagttggaggccgaacacaccctaagtattctgtaaaggaacattggacatatcatattactgttggaccagactttagatgagtaattttcttgagaaaaatgcattatgatctttccttgaaataatga

SEQ ID NO: 31487 - DNA, 357 bp, Oryza sativa
aacaaaaaaaaatcacggcggcggcttcactgacaccgccatgcgcctcaccgccgctgccctccgccggccggatctgggaggggaggggaggggaccgccgccccgtatccgtgccgccggcctccccctccctcctccggccggatctgggaggagggaggggagcccccgccgccgccccgcgcgtcgtcgtcgccgccgccccgacccgtcgtcgtcgtcgccgcctccgccggcctccccgctccctcctccggccagatctgggagggagggggaggggagccgccgccgcagctccgcgtgtcgtcgtcgccgctgccgccggcctcccccctccctcctccggccaga

SEQ ID NO: 31488 - DNA, 180 bp, Oryza sativa
cggagtgattgatgccattctgtcatgtgatcaagttcatgtccatactacatacgtcgtctggtcctttagagcaacatgacttcaggacgttgctatcaacggctattgatgataaactagtaataaaatttgtcgatgaaattacttgccgtgataaatgattccgttgtcgccagg

SEQ ID NO: 31489 - DNA, 484 bp, Oryza sativa
atattataagtttataacatgatccatattagtcacacacactcacaccaacatccgcatatcttttcaaatcaagtcattgaataaatcatttgcaaaaccaaatatttatcacaaatattaatcatgacaatgttttcatattaagtaccatcttcggctgaaaatatatgccctcaaaaatgtttcagaaaattgttcaccatttgagggaaattactgacctcaacactccaatgcagatgaaatatagcaacatagctttttatcccctgctcacttctggtgatgaagaatgataaatatgttcttcgcatcttctcatccattatcttttgaaaaataaattcttcttatcgtccattctgaagggagaagaatctgcaaactgacatgttgccacaaaatgatatataattaaatttgccactgatgcttgtcctttcggctgttaagctcatcagccgatgacaaattgacaata

SEQ ID NO: 31490 - DNA, 1501 bp, Oryza sativa
ttattggcacatccagtacagtgtagaaatgtaagctaagtctgcgtttatcatttgaattctttagtactttatatagatgtctacatcacaaggcaaatttagatcaattgtcaagaaatatgaccaattgggttctcgaatttcgactctgacaggagcagcgagtatgtggttttggaaatcctcgctgcattcgtctatgggcacaagccattggttttagaaattccccacagtaacactgcacatataaagctaaccccctttttaaatgctaatatatactgtattaagcttatgatttacattccagttgatcatttccacgcccacgtgcacagaaagctacagcggaacacctgaccagcaggccatgaccagcaccatatgtgtgtgactgagactccagagagaatgttcaaattctcaattctaaatgccaggtggtgtaaaaagttaccgcctttatccacgaacatgtactccctctatcccataaaaaaccaacctagaaccggatgtgtgtcacatccggttctaaattcgtttttttaagggatggaggaagtaggaattttgggattttagtattatctccgtcccaaaatattgtaatctaagatagatcaaatttacgaaagttatctatctagactcgttattttaggataaaacccatcctaagttacaacatttttttgacggatgaagtattttcgtagagattaaaaataaaatggacaaaaagacacacgtaccctcatcaaaattacatgaaggtaagtgggtaaaaggttcaatattttaagatccctaagaaatataggtcaaatttgaacctagatctctatatttgtggacgaaacaggaaattacgagctgaggaacgaaaaacaaactctctctctctctctctctctctatctatctgatcgttaatccttgtcaacagtccttccaaattaaggtcattcagacgtccggtcataaaaaagaggaactaaaactacttttctatcctaattcacgcttcaagctggttaattaataattaaaataacaatttacaaacgaccggattaactgagtcgtgtcccatcccacctgcgcacccagcccggtaatctccaattattctccattctcccccacggtttaagatcattccgttcgccatgttcaacgagcacgtaagaacacacatgtacaccccagctacgtacgtacgctcgctcgctagctgcgagcgatggatcggcacagtataaatagagccccagtttcatcagctttctcaaaccacgcagccacgacacatcgatctcccatctccttgtgcagccgctgatctctatagctagcatcctctgatccattgatcatacaagcacttacctagctaagctagctcgcttgcatttgctatatagtttgaatttgtcacccacagcgtcgacgttcatggcacctgttccggccaccgccgccgccgccgccc

SEQ ID NO: 31491 - DNA, 856 bp, Oryza sativa
aaaaaccaacatgagctaagacctcatggtttctcttgtttgagtcatagaattcctatattttttcctatgctgttaccaaacaacatattttgctaattactttggatttcttccttgtaggattcaacaatacgtgacatttgattcctgtttttttcaaatcctccgttctaaaatagccctaattagacacttcctaggagcgcacatgtttaaaaaaatctgaccattgattagatggattgcattatcgtaacagtagcatagactaatttaatagttataaaattcataaataataaatatgatatgtgccaatcttagtatcacaatttggtcttttattaatttaattctaaaattcaaaactaataattaacatgttgtaactgatatggacacttctttttaatataagcaacttataatttcaaaggtaactaaaaattattagaattttatatttatatagtatcagtaataatagtccattaacttacgggttgatgactaatgtatttaaatcgattagattatggaaaatagctcaatgttcagcactttactatggaatcatcatatccaggacgtgcactctgttttgtcttgaaaaaaccttcaaggattaatctgtggtgttgattgtacaaacccatgcacatgtcagagatggcagcttgattatgctaattaagtggttgcttcttttcttttgcccctccttttaaaaaggagcatatatacaatgtcaatgtaaattctccatgtccacgctatccttttacttgcttgtacattactttgtattaaactatgtataaatgtatattttctttatatcattctttgcagc

SEQ ID NO: 31492 - DNA, 673 bp, Oryza sativa
aaccctcccaacgcacataccatgaaatgggcccaacatcctgaaagtgcatctggacccctagtgggttttggtgataaatgacaacatatatttggggactaatcaagtttatcaagataagtgcatatattagtcccatatattattgacccaagaagagggagatccctacaacacaaaacaaagtggtattcgactcaaggcaatttaaatttattttaatttgaatttcagtcataggaaaatccgcactattaagaggggcttgtgtcgttgtcttgaattgtgtgtccaagtactctagagtgaccttgatctatttagagagagacacaatgcaccatactcatgaagggaaaaagcgagttgcagtttccagttcgggacagagtaccaagacctaaagttcaggtcctttggatcggaagttcaagtccccatcctagctattggccgagtctccagactgaacttccggtgtttgaatctgtgagtaacgaccagttgtggggatgggcgagtatttaaaccgggccaccccctatttgaggggttggctggaatacatttcaatacctctctccatagcctctctagggtttctagcctctaccaccttgattcttgagccaaaaatcttgtgagtgatgggattttgacttttgagaga

SEQ ID NO: 31493 - DNA, 1501 bp, Oryza sativa
tgcaatgatgcaggagtgcgattaagttgcgtcagcggcaagggattattatccctttctatatccggcggcggcgcgctcccggccggttggaggcggccatggacagcctgctacgccacgaaagcatcattatatctgcccagatgattcatacacatatatgatctcaaaaggcgatcgatgtgcgcacgtacatacaggtcacaactggtcatgcctacgatagatatgccgtgcaacatgcgttgctcggagcacttcaattaagatagagggaacaaatgttataagaaagattttcatcggtagtcgactgttgagaaaagatgtgcattctatgtataaacacaagctactgaactgaaagccgagtgccaaaccggttattggtattattcatgatcattcccagattattctgttttaaccagtcgtgggaactattggccaactatgctggatcctatgactcctccctggtcctgagtttcttggaagccttatctacaggttcaatgcacgcacgcacgattgacgacgacctgaacgactcttccggtcaataatgccagcccatgtggtcctccgcagtccgcactgtgcaagtgtgcagcgtccacttgaaaatccacagaagccaccattcttcagagcctccctccctgcttcttcaatacacttccagaactaggggcatgttcgatttagcctggtgtagttggagaaaatttttaattttagttatcatatcggatatacagatatatatttggagtattaaatgtagtctaataacaaaacaaattacagattccgtcagaaaactacaagacgaatttattaagtctaattaatccatcattagcaaatgtttactgtagcactatattgtcaaattatggcataattaggcttaaacgattcgtctcacaatttacacgtaatctgtgtaattggttttttttcctacatttaatactccatacatgtattcaaacattcgatatgacggcacgaaaatttttgttttgggaactaaatagggtcttagaggaaaagtaaagaatttggatttctcaggattaatttctatatgagttattcgatttgttaaaataaagtatgagaaagccaaaacaatattttctttcctacaagttgcatagagaaaaaaaaatccactcaaacctctaattttttttctatagattgatatgtacatatatttctatcccttcacttttcctattcttttccgcatgaagaaaaaaaagagaacttttctaaccatctctgcacttccgggaaagcggccgatcgacgctttacaactgctcgtgcatgacaaaatacaagaataacctacggatcaatacctgcatgattactggcaatgatcaactcaccttacaagacatcagtgctcgactacatatgtactactacgtgcaaagcaagcagctgtccaccgacgaacgagtgacagaacgagcgtaga

SEQ ID NO: 31494 - DNA, 1501 bp, Oryza sativa
gcttttggatttatggttgtcatcctgcttttatgctttcgcccacgtgtaccttatctttctagtgtttctacccgtctagggtttgtccatgacggtagtagtttgagacctccaccaatgttgtaataaaactttgttatttctggattccactattattctgtgaatactagcttgtgtatactgggactggtactgtaatcacaggtaatgttgtgacccccagcctatgccggtttatattcttgactggcatagtttggggcgccacaccccgttaggatttagtgcctaattggtaagtatttgtgttttatttatgtttgtatctgcatattaatttttcattttgcatatcttgacttggttcctgcatagagatttaatatacacaaaatgatctaaaattgacttttttttaatatgtcaccggggggtgaaatgcccacctgaaaataatatatatatatatatatatatatatatatatatatatatatatatatatatatatatatatatatatatacacgtcaaacagacttagacagggcaaagcaataactgcgcaagggcaggcaacagagagaatacacggggaaatacaaggaaagagaaacacaagggcaacagaaccaccctaaacacacattgatgttttccatcaacaagatcacatagccaaacacccaaacctaatgctagctccctagcttgacaccatctactccacaagcaacctagaaacaccaagagttgagaaataccgggaggcattctaccacgcacaccggctcggcttttggagatcaaaggttgtggttgtcgaagaccacccgcgtaagccatcaagagtcagatttcatcgtattgcagatttagatcaatgaccaccaacgtccttcgggagaaggaaaccccaaaggagggagagccattgaaggttgcggaaaaggctgcccgcatcaaataatcttcaatccagcattatcaagttgctagccaatttaacgcccaccaacgtctcccgggggaaggaagccccaaaagagggcgagacactgaacgtatgctgtcaaggacaaccaagtaaaggagatgaagactagacatgaagccagacaaaagagatgtggtgaaaggtagcaatcctattagtggaggggaacatcaacgacaatggtggagtcaaaaatcgccaaggaagcccgggaaacaaaccaacttgtagacccaaactatcaatcacacgagcatgccagagagagtagattgaagaaagagggccaaggaaccgcatactcatgatatatggtggatcaagggaaggttatttaggccggacaaggaacaacgaccgaaattaacaccaaccatgagatgaacagggagagacacaggggaacaaaggaggggatgaggcaaaccgaagctggagtaggcaaagggaggagaagaacaggaggagacgaacaccggagtaggcaaagtgtcgagg

SEQ ID NO: 31495 - DNA, 296 bp, Oryza sativa
ccatgtcgacaacagttagataggctaccccaaatattgtactggtgtgattatcatgaataagagtaataccggtttcggccaacaggatgtagggttattacttgataattcaggggcccgaacctgtataaaaatctctgtctccatctctttacctcagtcttgcatatatcctagcaccgacgatcctcatactatgcaaataccagaattgcgacatcaaacgtcgctagtggcgcgctaggtagggggattttggtgcttcaggatttcgacgagatgggtttaagaga

SEQ ID NO: 31496 - DNA, 1501 bp, Oryza sativa
attaaattaataattaaatatatttttataataaatttatcttggttcaaaaatattactatttttttctataaatttgatcaaacttaaagtagattgactttgactaaagtcaaaacatcttataacctacaacggagggagtaatatatacattagtgctatcatgagaaacatgctgggtttaggattcaaactcaggtgggttgggggaaaaccttacaccacgtcaacggagttatgctcagttcttaagatacaatgtgtttacaattggacactattattaccctggactaattaatcctgtagaagaataaagaatttatttccccggatgaagaataaagaaattttagatataatacaatatacaagatacacagtgcgcgtgatccaatgggaagcaagatttcactggaccacatggacatgtggtggatgagccaccaaggcatcctgccaagaactaatagtagtactacgtactaaccaactcaattattccaatgcggcgtgcagtgtcgagccctgtgctttgttttcacctatattttcaagttgcaactcgcctatcaaaccaaattcagctggcgggtacggtgcgaataataaatgatgaacaaatgctctttccagaggaactttgtggagaaagaaaaaccacatacagctcatgaccagataagacgagcaaaaacagaattggagggggaaaaagtaaaaaaatggagcggagtaaagggaaatatacccgactattgttgcttactttgcttgtaaagaattgatagaaaactgaagattgatacccaatagaaggatcttctagaaatgagatggattttatatggtgatttggttttgtagccttagtgggcgcggtgtcttacgccatggagcacctagccatagttgaggtcttaaagagctgcgcattactaatcacaatcacatgatataatatcggcaaatgcacctgctaatccagataaaaaccaacgaaatgcagctagcatcgtatccccaatttgcaagaacgaacttaattgtgaaatgcatagcaactaaaacacacaaaatttccatcgtctctttctgatgaaccagtataagctgctagcttgaagcgagacagcttagctgaagggggatcgaggagagattaatttgcagaagcactgctcgatcgtgagctagattgagcgaagaactcacctgccatgatcaggactaggatggggatgaccaacacagcgcaagcggcgggggtgcacgacgccgctctcgctgccgtcgccatccttgccggtcgatcgaacgggcacttgttgcctcacgcgcgcgcgagacctccaaccgcgagaggtcgaggagaggaggagacgacgcctctgttgcgttccacttggataggcttggagctgacagctgagtcgagctagtagtttttgctgctatataagctagcgatcgatcgagcacgtgtgagtacagcggc

SEQ ID NO: 31497 - DNA, 1501 bp, Oryza sativa
cacttcttaaacaactatagccggagatttaaaatcttgcttaatttacctgcctgtcctcgttcccatcttcagggtctatcgctaggttcctcgctcgcccgatgcctcctgcggtttagccatggccttgctcaacgttggacaactgttataaaaccgacccgatatatatctcggaaactgaacatggaagaaacatcataaaagattcaaacatgaagacgacaccgagatacgatatttgataatagagttcagccgatgtctacatctcccggttaccgattacgggcgctcctccctgatccagcatattacagtgtatccggatatccacgaccctccaccggctaggccgccggcctatcgtacccacacctatgctactgtcgtctttcggttacaattggtgtgcccctctatttaagagaaaggctaggatagagtccgactcttactctagttctaacacctattataactccaagttctaaactgtaacagactatatacacatattcaacacaaactctaacaacagcaataagaggaacacaacgggatagggcgtcgttgggggtgagcatcaatttaatttgcattggcggcgagcttgtcaagaggaaggtggaggagaatgcggtgggggaagacgatgttggggagcgacatcgggatatggcgacgttgggggacaacatcggtggcagtggtggcagaagtcgagagaggcggcgaacccggcagataaggaatgcggagatgcgtagagccgagtgctgcacttggagccggggccatctagcgtttacgtcctagcgctgcgcttggagccaagccgacagagcattctgtcggatcattgcgttgtccacgtgttggccaccaggagtgggtttgcacctggttactacctttttttttcccctgcggtttctctgcttcatcttggagacggcgggtgaaacggaattaatacaaaatcgcacttggattcagacgacgacataccaaaattttgattaaaaacatcttcaatttttataataatagagatagagaagagatatgaaagcattcgcaacttgcattaatttcactttctttttgaaatcaccgagtgtcgtatatactacttttggtccttgcaaagatcgataagatggtcgtaaaaggaggtagtatttgaatcacttcccttcaaaactcgcggtttatggtggttaatcaaagcgattgcgtacgtacgaccaacgtactcgaccaatttagtcgtgcctaagcttcaccaatcaccagagatctccacggtataaaattaatattgagatggcaccgtacaatataaatagagcctagtttcagctttgcccaaatcatgaaatcaagtagctctccccgatcgattgagtactgcacaatactcgacctaagctaagctagctagctcgcttgcattgccaggcgatactcatggcacctgctcatcatcaggcag

SEQ ID NO: 31498 - DNA, 1501 bp, Oryza sativa
cgaccgtccgacgcaggcaccacatctcgcccaatgcacgaccactgattgcgactcctcaagtagcccctttaggatccacagaaacgtgagaacaagaacgccgcattgaccgagaacttaacctgcacaagcataaactaaacacatcaagaccagatcacacacaacacaaacaaggatccgctcatttcgaacaaagatgaaacagggagcaaacagaaggttgaacggacccgctcagcagggacggaaagcggcagcatggacctggcggcgcggcgcgcgcgacgggagaccttcctgaacaccgagtgcaggaaccggaccaggaggtccaggctgcggtcctcgtctccgtcgtcgtcctcctcctcccctgtgtcatcgttgtcctctttgctgccgttccagtaggacgcggcggcgcccgagagcgcgagagggcgagaggttcccgaccgtctgagtttgagagtgaaaatgacaaaaatacctctccgcatatatttttttttgacaaaaatatccctccacaattctactatcatcaagtgtggtagtagtagaaatatatttaaaccgttcgatcaaatacgatcaatgattcagattattctctactacaagtagagagcaccagagtaggactctttgttccgtgctataaagatcttcacaagggttatggtttggtgatcaaacccaaattgtagagtacatcggacgattggttaacacaataacatgtctaggacgatatatttttcttgtgttttgtctgaccagtcatagctcgtgtggtataccaagatgggatctaatagtcatagctaggactgtcaaaaaagctcgaggctcgcgagcagctcgagcttggctcatcctaggctcgattcgagctcggctcgagctttaaacgagccgaacccgagcctgagcaaaagctcgcgagctttaccgagccgagctcgagcttctaccgagcctggccgagcttgactatgtatagtttatattgcatgttcaccttattaatataataaactaatagataaatatgtatattagtatctatttacacaataaattaccatgtgttagcgcaatatatttattttaatcattttctactcttttattagtgtgattaactagaaaataactatacttatcaaaagattatcattaaaatatatattatactatttatggccgagctcgaacgagcttgcctaaaagctcgaagatgagataggctcggctcgagctcggctcgagcttgtgtcgagctcgagcttgtgtagacgagctcgctcgagctcggctcgttgatagccctagtcatagcccgtgtggtatatcaagacggaatctcagatctggcgaacgtagcttactttttttttcttctcttatatttttctcccgcttaatcagtttttcttatacacctatttttgtacggttcttttatacattagattagcatgggaaatga

SEQ ID NO: 31499 - DNA, 1501 bp, Oryza sativa
cggtgctgaaattgtgttatctgcagaaaaaaagactgaattttgcaacagcgagagcacttcactggaaatgtgcaccaattctgagcttccttgtcaccaggtcagatcagtatttcagatcattttgacgtacacatacgcatcaggcggcattgacgattcggatgaatgcaacagctaaaacgtttttggtggcttgcgagcgcgtcggcatcactcgccaccgatggggagaaatcgcggacggcatgatgcatgttgacgtccgttttcttcccctcagaacgctgtacaatttgacccatgaagacacttctgacgagcttcttgttctctgcaagtgtcacggtttcgtcagggaacgaaatttgagtcgtcaataattaatgggtgtgaacacatgatctaagcagtcaaatgtcagaagagtttgtttcgttcgtcaatggataacaaacacgagcggatttggtccatagattatcatccccaccatattccttacctaaaacagtgttctgttaggtagttagttaattatcatcctgtgttaattagcacttgtattagcaaagcactggcccgccctatcagtttcagataggatttagtgaatcttgtaaagagactgtcaattagcacaaagatagcattccagtgcaagctaaagtgggcagatcatttttttaatcgagtccaaatgagtatagtggggttcagaatattaggtcagtaggagcaatgtgacaataaaagattaaaatcagcagtgaaagtctccagatcttccaaaagaaaactggcacgctggtaaaggggcttgacgctttcaaaaagagccagaattggaccccatcaggtaaatgtcaaattagcgtgtcatgcaaaaagtcatggcatatgagtgagtagacaatcaaaatatcagagtgtaaaaaactagataaactggataaaaatggcacgtttttcaaactgctaaacggtgtgtttcgtataaaaactttcgttataacatttttcaagtttataataattaaaactcaattaattatacgttatttaccacatcgttttacataaaacacttaatctttatctttatcttcatttttattttcaagagattcaacactaagtgatatggataacagaaatacaatattcaattaatcatgagctgataactgatgccatttgatgtacaagtctaaataatagaatatatgttcagtatttacaggcttgtagcacagaaatgacatgaaaattttacgcagatagtccaagcttatcattgtacgtgccattattatgtaggattaaagccttatcagttatcagcttactgggctggcagaaggaagaagtatcttctgtctgggctcggcccattctagtctttctgaatttggatactgataaatgatgagaaaaagtacactttacgtccctcaactttgggtttaatttcgttcacatccctcaaccgtaaaac

SEQ ID NO: 31500 - DNA, 1501 bp, Oryza sativa
atcattaccaggctataatcaccatttcccaaccaccgccacaaatgatacagtactgtattaaccaaatgaaatgaaaagaaataacccattaattatcactaacggggagtaacctaatcatgcccacgaccgacggccatggccggtcaagcacaagcggctagctaatcctccatctccgccttcttgggcgggccgaacctcttctccagccgccggagctccgccggagtgagcccgaacgccctctcgaggacggcctccctgatgccggacccgaacaccgtcgccgggatgcggacgatgccggggttctcgctgttgaaggcgccgtagaccgtggccggcgtgtcgccgacgttgagctggaagtgcaccatggcgcgcgggaacaccatcacctccccctgctcgagcaccttggcgaagaggcggccgccggagtcgacgaacccggcgtacacgcggccggcgaggacgagcgccgtctcggtggcgcgcgggtggtagtgcggcgggttgacgccgccggccgccgagaggtcggcgcgggcgaaggacatccccagggtgtgcaggcccgggaactgcgccggggtgacggacacgccggcgaaccccgtctccggcgagaagttccccgcggcgcgcacgccggagaaggcgaagtcgcccgccgtcaggttggcggggctcctgcacgggtaggccgggagcatggcgagctccaccggccgcccacgcccggcgtccggcacgcagaagtcctgcaccgcgtcgggatcgccccttgccgccatcgccggcagcagcacggcgagcaagaggaggagacaacgacgacgatgcgccatcgattctacgctcgttctgtcactcgttcgtcggtggacagctgcttgctttgcacgtagtagtacatatgtagtcgagcactgatgtcttgtaaggtgagttgatcattgccagtaatcatgcaggtattgatccgtaggttattcttgtattttgtcatgcacgagcagttgtaaagcgtcgatcggccgctttcccggaagtgcagagatggttagaaaagttctcttttttttcttcatgcggaaaagaataggaaaagtgaagggatagaaatatatgtacatatcaatctatagaaaaaaaattagaggtttgagtggatttttttttctctatgcaacttgtaggaaagaaaatattgttttggctttctcatactttattttaacaaatcgaataactcatatagaaattaatcctgagaaatccaaattctttacttttcctctaagaccctatttagttcccaaaacaaaaattttcgtgccgtcatatcgaatgtttgaatacatgtatggagtattaaatgtaggaaaaaaaaccaattacacagattacgtgtaaattgtgagacgaatcgtttaagcctaattatgccataatttgacaatatagtgctacagtaaacatttgctaatga

SEQ ID NO: 31501 - DNA, 1501 bp, Oryza sativa
acccacaaacaataagtagttaagtcgttttcaacgtgtcaattatacgggagacgacatgtttccgtcgacatgtacggtgctagcttagctagcccggagctgctgaggcgacagcgaaggtacgtacgttgccggcagcggcagcggcagcggggccagattgcccagacatggcgcggtcaagagagcggcagctgacacgaagcgggctaccacgccgctacgcccaccggtgcgcgcgcgcggtgacgaggcagccacccacagagaggcctctcgcacgtacgcgatcgcgcgccgatacatcatccgtctcgatctcctagctcgcttcctccctgcttcccaccggcaccgcggcacggctaccgcgcgcgcgcgcgcacacacaaaccaggccgctgtactcacacgtgctcgatcgatcgctagcttatatagcagcaaaaactactagctcgactcagctgtcagctccaagcctatccaagtggaacgcaacagaggcgtcgtctcctcctctcctcgacctctcgcggttggaggtctcgcgcgcgcgtgaggcaacaagtgcccgttcgatcgaccggcaaggatggcgacggcagcgagagcggcgtcgtgcacccccgccgcttgcgctgtgttggtcatccccatcctagtcctgatcatggcaggtgagttcttcgctcaatctagctcacgatcgagcagtgcttctgcaaattaatctctcctcgatcccccttcagctaagctgtctcgcttcaagctagcagcttatactggttcatcagaaagagacgatggaaattttgtgtgttttagttgctatgcatttcacaattaagttcgttcttgcaaattggggatacgatgctagctgcatttcgttggtttttatctggattagcaggtgcatttgccgatattatatcatgtgattgtgattagtaatgcgcagctctttaagacctcaactatggctaggtgctccatggcgtaagacaccgcgcccactaaggctacaaaaccaaatcaccatataaaatccatctcatttctagaagatccttctattgggtatcaatcttcagttttctatcaattctttacaagcaaagtaagcaacaatagtcgggtatatttccctttactccgctccatttttttactttttccccctccaattctgtttttgctcgtcttatctggtcatgagctgtatgtggtttttctttctccacaaagttcctctggaaagagcatttgttcatcatttattattcgcaccgtacccgccagctgaatttggtttgataggcgagttgcaacttgaaaatataggtgaaaacaaagcacagggctcgacactgcacgccgcattggaataattgagttggttagtacgtagtactactattagttcttggcaggatgccttggtggctcatccaccacatgtccatgtggtccagtgaaatcttgcttccca

SEQ ID NO: 31502 - DNA, 205 bp, Oryza sativa
tcaaatgaatttctttagcaacagaatttgatttgtctggcacgggcaacttggttgataagcttggatgcatttgtataactcatgtcacgggcttaaatcagcgtattatggttatggctgatcacttgccagcagaattagcgatgattcgttgttccgggtggaccctgttctgtaatttctgactttgttacaattaagg

SEQ ID NO: 31503 - DNA, 893 bp, Oryza sativa
attgatcaatgaatatatggaaagaatcatacagcaaattgatttttcgtatccgtgttgttgtactaattcgtatccgattaaccatcgaagaaaaaaaaaggacatgcactgccatatatatatatgcatgcctaaatagctagcctagcactcctggagaaaatatggatggcgtcccggagagaaagcacaccaaatgtcatgcatttttttcaatagattgatgactagcacggcaaattggaagggagtacctgtcgtcatatttttcatcaaataatagtaagcatgtatttacgttataagtccctaaaattatatatgtaattttaacgtatttagactataagtctcaaaattattacatatgtaaatcccaaacttatatatgcaagtgatgtaagtctcaaaattataaattattggcgactaagatatagggttttcgaagattaattggtaatcctaattagcaaataacgtaaaaagtatagaagaaattagaaaaaaaaaagagcggagtgatagacacgtcatgatgaatcccaaaatttgatctcaatacgaattcgtagaattcgacaaagttcaggtaggaatacaatttagaaattactgaaatttagaattaaaaataaagaatattagaagcagtgtccatctagaacacaacaaaatattttttaaaaattaaaatttaaaataaaatacaactccaaattggtttttaatatgaattcgaaagagttcaagtagtatctatttatcatattattgaattttaatattactaaaaaatatttgttagatgatatcatgttaaaattatagtggttaaatttaacacaaaaatcaaatagaatcccagtaatgattaagagaaggaatga

SEQ ID NO: 31504 - DNA, 167 bp, Oryza sativa
ggtttgaacatatgtttttcttttgcatgatatatcatatatatcttgttgtaaagatttaattgtagcgaatacaccagtgtgatcggttcgtagatcgggataagtaatttagaagaaaaaatatttaaagagaagaggtaagaacaaaaggaaacgattggcca

SEQ ID NO: 31505 - DNA, 1501 bp, Oryza sativa
aatatttggttatagtcagctattacaatgtttaaaccaagggccaaagagtcattagacatccgctttcatgttgacagagctgaggtagccctccacttaggcaaatttggtcatttataaagattaattctctctcttatggtaattctttaaaaaaatttgaaagagtggcatctcaagagtggcactccgtaagagtggcaaatagttaaaaacccccccttttagctgccgctgcaagaacctggttctggttcttgatgcgaacgattgaaagacaaagtatgattcgtggtgtttgagatagattaaaatgaaagatgaacgcaagattaattgagctttaattattataaattttaaaaataaatttatttgatattttaaaatgatgatttatagaaagtttttttttaaaaaaaatgtaccgtttagcagtttaaaaatatgaataacggaagttaacgtaaaatttatatctttaaaaaagatgaacaaaacaatcattattctatgtatagactctcagtatatgcaatacgttcatcacttaaaaaaaatataattagtccatcactatggatatatcatttgattttcttgagataacttacaaacagaaagcatatgagtaaataaagaagataacagtccgctcaatctgattcattaacttaatgcactacataaaaagtatatccatagttagtttgaatattactactgcatatcatgttactagccaataaacaataaccaactaatcaaaatagtaaaactggaatgtacacacatacgagaacaatacaatacacaacctttttgtatacatacaaaaaattaaacaaaccaatacattagattcattatcaagatgtagcttgattgggactaacattgtcataacattcaccattaaaaaaagaaatcgttgctgtgttttttttactgcattttatccatctcataaataattcatctgttacttggtactatccttcttaaagtttcgagttgctactgcaattctttttagataatggattttctatatgctaccgcgaattggccgaacacattcgtcatgtcgaccaaaattatctaacgttttaactttagtcaaagtcaaactactttaagtttaaccaagtttgtagaaaaagtagtaacattttcaacctaagacaaatttattatgaaaatatatttaattattgatttgatgaaactaatttagtattataaatattactatatttatctataaacttagtcaaacttaaaacaatttgactttgaccaaagtcaaaacgtcttgcaacctaaaatgagaattttcagaatataccacccaacacgcattgctttcaggatttgtcccccaattcgcactactttcagaatacaccactggagtgcggattttctttattccgtaccactctgtcccctagcgtcaatcgcgccgtcgtcctccgtcctcttggcgctgccgtcg

SEQ ID NO: 31506 - DNA, 978 bp, Oryza sativa
aaaatctgacactactaaatctaacgagtaaagcgatatacaccaatacaccatcaccaaccacacttgttttgcgagttgtgactttgactctttgggctctcacccttgatgctcttttaatttgatgtttgttactacctcctactcctcttaatggcattgtctccatctcattatcatgtcaaggacgctaacatcaaatcctaaaccttaactatatgagccgccactagtgagaggttgacaaagattgtaaaagcaaaagaagaggctcataatgttttagaatgtcttcctcctcatggcagcagtgacagtactagctaggcttttgtacctatagtgggcatagtgtctaaacagctgaggtcaatggtgtcggtgtcatttgtgcatggggctcaggctatcgttagattctgtgagaagttgtgggagcgagaattattaatagtgggcaaactgggcataggtatggccaagatggttgaaggactaggtgatcggaggactaaatggtccagcagatcgaaagctaggagtccacaattttggatgagtgtcactgaaccaccacaagaacggacgacgtgtctcgaacgcactaatttccactgttcatcactagttcactactccctccatttatattataacacgttttgaacctttttctggtaatttttttaaagaaaattaaccgagtttatagagaaatttagtgaacatatctatataacaccaaaccaaattagtttcattcaatctaatatgagatatatatttgttttatgttgaaaattttctatgatttacaataaatttagttaaatttaaataagtttgactataaaaaagttaaaattgtgaaggagtaataatgaaaaaaggtctattttcaaagatagctttattttgctgcacaggtggcctataaaaaactgcttatgtagtaaatgggaaggcctgtggcca

SEQ ID NO: 31507 - DNA, 254 bp, Oryza sativa
ggaagagggtggcgatgcgccgagagtattattgatcgatagattgatagattacaatgaccccggttgtacatatttatacccatagggagatactagtccttgtcggacaagaaagaaactaaaaaggaaaagataaagtccttatcggacactaaacacactttcctaaagataaaaggaaactaataaactatgcctaattaatagataactgtcatgtcgcatctttcttgaactcgaactcttctaga

SEQ ID NO: 31508 - DNA, 1501 bp, Oryza sativa
attgctgagatgtacatgttttatagatagcaccttactttaccattgcgggtgctcttaggttggccataaccaattttgaattttagaattaattcagttcttttttgttctttgactttaccgctaagagaagatcgaagtacaagaatctgacctcaaaactatgttacatgcatggtatgagtcacaaccaaaaaaatgctcaaacaagcaggcctgaacgatgcggtgattgtagaaaattttggttgtaacaacaaaagatttagtcgacttctttaagaaaggttaaaggacgattttcattacgaagatccaacgcgaacaaaatttgattagacatgaatgagcaaccaaagctagaagggactgttactcaggcttctagaccaggtttgagtccaactctatttcgtggttgatcaaaaacgattgtaatatgccccgtgtgatttaatagtcctttttccctaaataaatttagttaaccatcgagctagtggattattctgattttccttagattgtagtagcctctaaaacctgaattttgtgataaaagtgacactaattaaacatatatgttgtgatttgctcgctttgatttagatatgttaaatttgtagtcgtgcaacaaatttgctcaatttatgtttttatataaaaatatcaatgttttaccaaaatttactcctttttcactgctttgttgccttgttataatggttggtacagaacccaaaaacaaaatacttccggtcttattgttttgattatgcttatgtgaatcgcttattaacaatttaaaggcaatttacgagtaaaacttttatatacgtgttcttaatgatttaaaaataaatattataaaataaattacaatgaaaaaaaaatgaaaaaatcagctctaaagttaagtattaaaacttagacttttacttacaataataagtaaacaaaataatagggttattcataatatggcagggtttttggttagtaaaattaaagtaagaaaacacagagccatgttaaacacgaccacatgtatcacccattgacctcctaacaacttgacagtcaaaaacgtgtcatcatggttgcagttaaaaaattataaagttaaaatgatttttaaccgcgtggtgggcaatagagtattgtttacaaacccccttgcaaaggaagaaaatcaaaccacaccttatacaaagaataagaaagaattctcccttcggtccatctcaagcccaatactcacaccaccccccctttgactcccgcacacctcccctcctttttttcttttccctccccttttaaattctcacgcccacccgcaatcgccgcaaactacaaagcgagccaaactttgccccacacccaaggccacgcgcgagagaagagaattcgccaattcggaggcaaaaatccaagcgcgacgcagctcagcccagccgccggaggaaggagcatcaggcgaggcgcggcgcggcaa

SEQ ID NO: 31509 - DNA, 694 bp, Oryza sativa
acggagaggaggaagacagaccgagccgtacggagaggaggaagacagagaggagagatgagataggatcaagggtattttggtcatctcaacaagaaaaaacattacaaaaaacattaaactgagaagaaatggatggaatggcattgcaacaagttacccctgtttgagggtggcattttaacgaaaccacttttgggagtggcatttcagcgaaaccccgttttgagaatggctaaatgtcaattttctcctctattggagggtgttcagacatccgttgcgaataaacatgaactcttgtcttcctcctcctagaatttaccttaaaaaagattagccaagtgaggtagtaattcaaacttcccttccatctatttatcgtgcagagtactcgatgcaaaaaaaacaagcagaaaataacacggcttggaatctcggggaacgaattaaacaaacgccattagcttccaaattaagcgacaatccaaccaacccgtcctgtcactggcactgtcactgccgccgtgccaccgtttttcaaatccccatctccaaaccattggcgcctcccatcacacccgcaaattacccattctacccctccattcctcacctcatctcacccctcttcaaaaccaaacctccatcaagtcttcgtctacatcacacactacacaaccaaagaaagaaa

SEQ ID NO: 31510 - DNA, 436 bp, Oryza sativa
tgtaaaaaatagataaatttcgataacatacgtgtgtcgtggatatggattttcataccttgatgggatctccacccgttacttgtatgtcacctaaatatttatcaaaaaattgaaaaacattgataacatatgttaatatgaaatatatcagtgcacaaacatacaataccaaatttgacttctacaagttaaagcaaaaaaaaaaaggtttaaccaaaaatagttatcatacattcgcagctatatttgttatttttcttacatcttacagaaattgaattgtaatatatttaatattaatctatcttgtcaatttattttaaatctgtaatgactatttaaatagcatttacggaactagaggatatcacctatcctcttgaagaataaatacactttcccgtgtgttgttggtatatttctgctcgcagaa

SEQ ID NO: 31511 - DNA, 1501 bp, Oryza sativa
gaattggctcagggcgtggactgttgttgactgcgccggcggccaaagcctgggggcctcgcgcctccgatagccatcgtcggcgcagccggtcaccgcgcccctcggggcactgcgttgcaacggcctgcaggctccccatccaacctgttttgaaacacggaccacggagtctgacatgcgtgcgagtcgacgggttttgaaacctggaatacgcaaggaatctgacaagtggcaggccctcgcgggccatacctttggccgccctgatcttctgtgaagggttcgaattggagtacgcatgtcgggacccgaaagatggtgaattatgcttgagcggggcgaagtcagaggaaaatctaatggaggctcgaagcgatactgacgtacaaatcgtttgtctgacttgggtatagggatgagaccaatcgaaccatctagtagctggttccctccgaagtttccctcaggatagctagaaagaccaatatccaatgtccattatttctctcctaattcatggagaaatctttctctggtttagactaggaaaacccctaccatcatatgcaggaatttgagcagctttgctcgtcacggtggaaattgtttctgttctctctttatgagagagagagagaaacaatggacattggatattggtctttctagctatcccgagggaaactttggagggaatcacctactagatggttcgattagtctttcggccctatacccaagtcagacaaatgatttgcacgtcagtatcgcttcgagcctccaccagagtttcctttggcttcgcctcgctcaggcttagttaaccatcgttcgggtctcgacaggcgtgctccaactcaaaccctttacagaagattagggtcggccggcggtgcggcccgcgagggcctctcactcgtcagcttccttgcgcatcccaggttccagaacccatcgactcgtaggcatgtcagactccttggtccgtgtctcaagacgggtcggatggttttggtagtagcacctcgatcatcataagaatcggtcttcaggcctctgctgcaaagcactaccgtattatcacatgtctaataggtaaggcttagtttgtacctcagtctaatgggtaatatccacgaattaaatttgaaaatatatattttttcaatattttgcgtttatatacatgcatgaaaaatatttgcacaaatataccacctccgtataacggggatgcgggaccgaggaggtgctgctcttttattccgtgggaccggcagtcgcgcagtacgcccgtgcggcaccgcctcacatggactcgctggagggcggtcccgcaccacggcgctgcgcgacaagcacagtcccgcgcatcagtgccgcgcaactgccctccaccacgctaaacagtgcagctcggttgtgtctggattaattatagacctaacggaggccaaaattaacaatatgactaaccagctagcttgtactttctcga

SEQ ID NO: 31512 - DNA, 448 bp, Oryza sativa
aggaacgaaactccagagtttttgactctgcggtctcttcggtctcaggggttctagagtcatcctctcagaaggccatctatggtcgttagctggcgacctggcattgctacttttggggttttcttgggagggtagtgtgactctgccttcttcccgctatttggagttgtgtttagctgttgtagtagtctcttcctttttctcggtttttgtttttattttttctctcttttcttgacataagtcggtctgactgattatggtgtgtatcaaacactcttttcttttaaatatattgacgtgcaatctcttggtgtgttcggagaaaaaaaaactccatgcaaaatgcagccttgcatgcggttgctggctgtcttgctaaacccaaagtgccgagtgcccacttcacttgcacggtttgacctcattttgccccgtttttagg

SEQ ID NO: 31513 - DNA, 607 bp, Oryza sativa
tttgtttgttgtttccatgtttgatcgatgtttgactgcaagtcggtgctatgtatttgaatatgatgtatggatgtttgcatgttagtgattggattttctgaatggacgaagaatttgtgatttgtaattggcttatggtagcgaggggtttgaaccgggggattgggggtggcgggggaatttttttttactaagaatatttttgcaagcatgtggttgtagcgcttgtgaagatggagctaggaggccaatctagaaaaatcatgtattttttaggcctttatactatatactgggtgggcggttgcctgggaaaatttgttttggttgtttgcaaaaatcttttttttttaagtagcggtaggtcttgtcttgtcccgtgcgtacgtatatatatgcgtacgttacgtggttttctatcacgttctctcccatcttccttcgtgcaacacctataacactgtcaccgtcacacacgaccaaataacccgagccatgtgtagtcatgagtcatgacgccacgtgtgcgccaacctggttacacgtgtgacaagcctttaatctcagcgagaaacgactgtatactcctggcttaatttttagc

SEQ ID NO: 31514 - DNA, 1066 bp, Oryza sativa
tggattagacagctatagatacccatgtagacataccattgaagtagtttactattaatctagtctattgctgagatgtacatgttttatagagagcaccttactttactattgcgggtgctctaaacatgcatttaatccacaatgtaaacacataaatgtatgtgtgaaagagaagcgggtagatgaaatatttagtttagcacaatattgtcatgatgtaatttttaaaattagcacaatttttttgatataaaatttaaaacatgtagttttgggataaaattaacagtagctccatagtttgcatatactaacttaacttaaataagtagttgtgtgatgatgttctcaaaatatgtttagttttatgaaatttagtgtgattacattatgttgaccatttctctaaaaaatgtgaccatttttcacagaagttaatatgatttttacatacttattaaccaagatttgcccattttaattaagaacctgtagccggttctcaatcttgatgttaattaatttattttttacgctttctattgtcagccactcagccttaatcttttgtattgttaatacgtagtagaactatatatataaagatcttgctttgaagattattctattgttattcaacttataaccatagacgtaaaatacgtttcatacaggctgtggagtggcgtaacaaacctcattcactcgaagaatttggtgtgaaaaggaccgttcaaggagtacctcgatattcacaagatcacagcatttactagctagagcaatagcaactagcaagccgtcacgagtaccctctcgtctcgtaggcgtaaaaccccgtctacctcgcgatttcgtgacagaatttacctctcgatcgtactctaagcttctttgaaaactcccaaaaatcaaaaccgcacatgtacgtgccatctgcaaaatttcgaatgacgttcaagcaaggcgcagcacacacgcccgacctgccacggcggcgccaggcgtgtactaatcttaatctcatatgtctgcacccgttttttccccctattcttttagc

SEQ ID NO: 31515 - DNA, 911 bp, Oryza sativa
tttgagcggttctcgttaactgagtcacaagtgacctatattaattcccgcaaaaagaaagtaacctacgcaattgagttcattttcgccatgagatggctacactgtcaacaaatttatagcccgagcatactagaagataaaaaaaaagaaggaaaaagatagctagagcagtacctcaatcccttcctggattgcacaaactgttaagattgaatctgaagctatctttctcttctacttggtcgcaaagctgtgacccttatgccagttagtgtttctgattttgcagaagccgttgccgttcttttcacattctactttattcttttctcatggagatatctgagactgttccctttgttcattcaattattgaggcaccttccttcacattgtgattgtgttgtgtaccttttggttctgtgacgctgataagaataatgcctcttttttttttttaactttgtcacatctattgctatcattaaaccaaatagaatggcaataagttatacctctctagttaatagcttatactaaccacaaatctgagttataaacttttagttacatcattattgtagttgtaactctgacttctgactacaccgtgaaaactgaagcatgtttttcgacataactttcaataaattaactatatcaatgtacaccgagtcaactttccttttcatagcaacagagaagttcaatgccatttggaatttattttgtggcactcttgtggttaaaggctttatatttcaatattgaccaacttgataggctgcgatgtcttattttcttgatgataaatgtgaagaaaagaaacccaaaattgtttggcctgatcatcttactctctctctctcgcccccctacgtttctttcttataccttgagttagtaaa

SEQ ID NO: 31516 - DNA, 343 bp, Oryza sativa
tgcctgcaggtcgactctagaggatcccccgctcccccgttctgtctcccttcccctcccccctgctaataatctcggcgtcgatggatcgatcggttggtctgtgcgtttcacagtccgtgtagccgcctccggccaccaccaccatcaccaaccaaccaaccaaacaaccgagcgagcgatcgtgcaggcggcgtagcgtgaggtgaggtgagcagcgcgcgcgcgcgcgcgcgcgttccccaccgtgtcagtcgcgggcgcatgtggagagattctccggtgacgggagggtgaaagactgaaagcaacgggcgcacatggcggtggtgctgtgcatgca

SEQ ID NO: 31517 - DNA, 343 bp, Oryza sativa
gtactggttacagcaacagttttttttttaacaaggctttccagtttccacatgcgtgtgtaacttctttgtaacatccagtgtgagtgccggcgcgtctttacatacatatacatacattatacatgcacatacgtacatatacgtgtcgtgaatgggcaggatctcttagggtgtgtttgaggagaagggaattgaggagattggggagttacgcaaaatgatgtgagccattagctcatgattaattgagtattaactattttaaattttaaaaatggattaatataataaagcaattttcatataaaattttttttataaaaatgcaccgtttagtagt

SEQ ID NO: 31518 - DNA, 952 bp, Oryza sativa
ctttcgccgtcgcatgcctcctccccgcctccttctactgttgtagccgtggccaccatcctccccttcctgccgaatctgggagggagagggagaggaaggggagggaagggccgctccgccaacctcttccgtagccgcaattgctctcgccccagtctacagttggatctgggaggtagggagggaaggggacagctacgctgccaccgtcctcctccctacaatcggatctaggagggagggaggccgctccgcagacttcccccactaatccaaagctattgccaataatcaaagtctatgctttaatgtgatctccttttgtgcactagttgaactaagcatggctaagcatctcctaaaccaacatctagtcattttaatacctaagttatcaatggcgtaagggaaacaacatatagctgagtaataggacccatcccacatgatattgtaaaacaatgcaatatttaatagaaatgcgggacatttgtaaattgggtacaatatgatcaattgcaatgtatgacctgccttgctctcgcactgatggaaccacaacaacgtcttcgagaaaccacgaatcgacgaaacgggcgaaatctacgtgacaaacaaagcacacaagcaaaacgtgctataagactactgaaacaggaaacaaaactatttttaatggattctatacatttttatgaatttacttagacttgaatggacttaatcggagctcggatgaattagttacgatttttagaagattctctgtgtttttactattaaagaaaagccttaatgtatttattgcgcaatattgccccagggatgacgtcagcagggggggaaggcgccggcatgcgggccccatgagtcagcggctcaagagagagagagagggaggggcgccggcacgtggctcgactcggcttcaaagccggcaggccaagca

SEQ ID NO: 31519 - DNA, 160 bp, Oryza sativa
ccctgagtatttttgagtcggtgaactgcagagatggatggtcatggtctggcatgcatataatactctctcttaatccctgaatacgatacgatctcatcagagacagtggagctcatgtgttgatttaccaaaattagttttctgtggtgcttgcagc

SEQ ID NO: 31520 - DNA, 1501 bp, Oryza sativa
ccatattcagttgtagttactaataaaaaggtgaaatatcttagctgaatggaagttcacagacatcacagaagacggacttgctctaaacagctgaacttagcatgtccatgaaattagtatgatggactaatacgaatgatcagcatcaagtgcatttttatcatttggaaggttttatagaaagcataaaagagtcgcttatctaaaaaaaaactgaagccgcttattatattactgaaacaggttttataagtctttgctgtgcatacaacagtggctaaaaaaacaacttgtggcttaacttgtttgcaagtccaaatttggagcaaaaccccttaacaggacgagcaacatcgtttggagtttggactactcgctcctccaatagtaggctcttatgtagcaacattttcaattgaactcatcattttgttttctctttatcccaacatatggggattttgagttatggcttttctgacaataaaaaacaacaactaagcaaagccagattaaatcttctcaatatttctgcaacagcacacttctccaggatcagcaagttgttcctgctgctttccactacccctcacctttgttcctatcctcttcctgtaccaaggcttgggggtgagtcagtggacactgacgtggcacatggatagaagcactgaagcagtaccccctctaccaagaaccacccagtggcacccaaagtccaagaaatccaccactaaacaaatcctaaaaaaacccatctcaacagagacaagcaccgaattttatcctctttgcttgccatccatcacaaaccccaggaaaggggatttctgaatcatcaatcatcagttcatcacactcgcatacaagttcaagtttttttgttaatctcaaagatgctaagccctgatcacaaaaaatacgaactaaacaagagcaccctccagtccccaactcccaaacatctctcaccacatctcttgtcccccccaaaatcatcagagaaagagaacaccacactacagggcagcacagcccgttcctctccaagaaacgaacaagcagcagatgatgctagctaaggcagcatccaaccatacaagcgaagagcagcaaagatgggggaagaggagggatcgaccggggtacctgctcggctcagctcagctctgctccagtagtggcggagctgtggactgtgcgggaagaagaggaggaggcagacgagacaaagccaaggcagccgcactcgggtggcagtggcgagctgaataaataaatagcctagcctgtgatggtgtgggggctcagctagtcagctgtgctgtgcttaggccggggctcgcgtcgcatcgcacgcacgcaccggccccatccttcccccatcaccccgatcaccggccggcgcggatggggtcgccgtggggaggtgaggtgtcgcggatttacctcgacgccaacctggagttaattaccgccaataattaacctagggaga

SEQ ID NO: 31521 - DNA, 861 bp, Oryza sativa
ttttgagcctattaaaccgtcgttagcacaggtgggttactgttacacttatggctaatcatggactaattaggctcaaaagattcgtctcgcgatttccatacaaactgtgcaattaatttgtttttatctatatttaatactttatatatatgtccaaatatttgatatgatgtttttgggaaaaaaaatttgagaactaaactgggcctaatgggctttccccgacgccctgacggaaagggcaaaaacgtcttcggaatacagatgagatattactgcacgtttgcatgtttcagtgattcacctacatctctactgatccttttacagattattcatgttacaagtatgcacattttattccttcagccccaacaccacgcccttgcgatagaacggacgggcagcgagagggattagtaaagaataacacagtcaagaaacaggagtcatcgaataacagccatgcaggttcggaactggattgatcgaccagaaaaggttcggaaacggattaatcgaccaaaaggttcggaaacggaaatggactaatcgaccaggaaaaatgcccccgtccatccggtgattatactgatatactaatttgatatactaattttcagcccaggcagcaattcagcattgcgctgcggtaggcaagttgaaaaaaatatttataacaaatgaaaatctataaaactaaatgagcagatcaaaatctttgaaacgtggattggttggggtgcgccgggcccaagcagtagtgcaacgctagggcgacacgcgagagccccgatagcaagctaccgtggtgggccttcccccacaaaaaataaatttaatatcaaagtgaacaca

SEQ ID NO: 31522 - DNA, 1501 bp, Oryza sativa
ttccgctgttgttctctgatagttgttggcctacctggccctaatgtaagtatttaactcttttagtctaaattcattcgtgatatgttgtgatccaactatgtatgtgtgtaccaactactgatccagggattggtacggataaacacagaagatttccgatttccaaaatcgggggtctacacttaggccctggtgtggtggcggtgtagcgcgggcgttaaaagttttaaggcgtctatgggtacagcaacacacctctatagagtgtatgaattgtgatatgtcactccctgtttcgggtagaaactgcgaacgcggcaggaaaggaacctatcggaggttctaatccctgtggtgccttatatgcagtagattttataattacttaatatgagcttttactacactgtgtttatgaacatgcataaaaatttccttgttggattatgggatttggagatatatgtattatgcaggtgcattatgggcatatatttattggattgctatagttggacttgttgagtaccattcgtactcatcccatatatattatcctttgtagatgtttgagctaactctttaggcgtcgaaaaagttctcttggaagatgaacagcaaggagaaaaatttgggagttgtatacgaagtaaagcatggtcagtatcaagtcaagataaagatcattactggaaattgttgttgaggtaaatttagttattttgttgataaaagctactttctatggtttttatttaatgggtttcgctacaattgtttcagttatgttactctggtgtgcacatttcttggtaagttagttcttactaaggaatgagccatagaccggtattctacctcggaagtggaatacaagggtcgctacaagcaagtgcagaaagaagtaaatactctctccgtcccataaaaaacaaatttagaattggatgtgacacattctactccaatgaatttagaaagatgtatgtccagattcataatattaggatgtgtcacatccagtactgggttggttttttagggacgaagggagtatatgtgaagagtcaaatgcgtagaaattgtgaaggggcctctggtgcggaataagcaatgatgcaattgttacttcagttactgtcaaccgatttatatagcatctccttgctctgttgctacgtacagaaagcatttcagctacaaaatccttcacaataacacaaagacacagagtaacagacactaaataacagaaatagagatttctacgttttttaagtgaacttccctctagtctattgttttagccacgctggaatgcttctcatgttcattattagcactcttgccaacaaaagaaaaaaaatcctttttgcaagcttctttatgaaaattagccccacgtagtaggagatggaaggtaattaatagcatgattaattaagctttagctaattttttttcaaagatagattaatatgatttttaaagcaacttt

SEQ ID NO: 31523 - DNA, 795 bp, Oryza sativa
caacccatatcatcagtacttgagtcggtctcactgcttataaaaaaacatgcaaatcttccccgacctctcattcaagagttgcctttatgcaataatgttggctgccataatcaattttagttttttttttgtctcctctcttaagagctatcactcatttcatataggttgctttattgtttctgattgcgttttataccacttctcttatactatactcagatatgaaatagggaagatggataaatttgataggtttcgtgatagcgatgtcagtaatttgacgagttttgtgataatgatatatatgtagaatgatgtgttttttttactaagacaattcattagtactccatccaatgtaagtcattctagcattttccacgttcataatgatgataatgaaactatatagatatatatgtctagatttattaacatcaatatgaatatggcaaatgctagaatgacttacattgtgaaccggaggaagtagttgattaattaaatgccaaattcatagtaagccatatgatagaagattgaaaatttgtgaaaaagggaagcaatttcgcctcgtttttggatgcccacaatcttaaccaagaacttcaactcgtgcgcccccaaaaaacccccacctttctcttatcccctctatccgccgctcgccggccatctccctcccccaccaccaccaccaccgccgcctcctctccggcgagatgctgacctgcggccgcttcctctcctcctccgccgccgcctccaccccctccctctcccccttcc

SEQ ID NO: 31524 - DNA, 1501 bp, Oryza sativa
ggtagaagaggtgatatcagcaaagcaccgtgatttgatcatccgataccataattattgttttcgtatttactatatatctatcgatcaaatataaatatagtatgattacattgtaataacttcaataatataatgtgtgtgtaactttcacacgccgggtccatgtcgatattctgaaaatcaccaactagctcactcgaaaacatgtggtgctctgttctaaaccggccaagccgttgttgctgacgacgtgaaggcagcatgggagcacgacgccggatcgatcaacggagcggaccgcggcgcaaacgtggttgatcagcctgcagtccgaattgtattcgcattaaatctagagaactaaaactaagtaatctctacccagctaaataaatcattgctcaaccgattactaacagcagcataataattaaactaaccgatctttagctccatgaagctaaactatgtacacacatgggcttagcacacgatgattggttcgttgtagtccacgacatgcgtggtatgtacatacacgtacgagcttgacaccaaccgcatctgctctagtaccatgtatgctatttggttgtaccaggagcagaccaacagtataagaaccggtgtcagatgataccgacgacttgtagtaaaatatataacaaaactatttatccatatattataacatcatgatttaaatataattagtatactatgacaatgataaataagttatggcatcaacgaatcgattttctggatccgccactctcgtgcgtatttgggctaaaaaaaggggggcaaaatataagggaccacctatacatttatcgacaatttgacagatataattatagtacaatcgtagtataattcttatatgtaattacactgtaacttgcacgtaactacagtgtaacttgtatataagtttcatgtaattttaaacctttagatctattacaagatttgttttggtgaggaagaaaaataaaatcacagcacacatatatgtgtaaggatttgttcccacaacttctgttttaccgaaataacatattacgtagagatttttgaaagtgacatacaagttacactatagttacagtgtaattacatgcaagttacagtgtaattatactatgattgtactgtaattacatctgtcaaatttttgagagaaaatttatcgataaatatatagcaaaatcgaaatataatggtgcatcaaaaattctatgcgagggtcgcacgtcgcgagaccggccttgtcgttgtcttcccgcgtgcgtgcatttcgcgcgagtttgtcgcggcaaactcggcgcgtcgcgatgtatatatgctatagtagtagtatcgttgaaccagctagctccgaatccttcaacgtgcgagaggagcggctaattaagctaagttattagctgaattaatcgttcttgcacagctagctagctaagctgtctgtctagctatctgcgtcgcacga

SEQ ID NO: 31525 - DNA, 1501 bp, Oryza sativa
acttcaacaattgaaaataaaattattcacttaatttaaggggtaggatgtattgaaaataaaattattcacttaatttaagggggtaggatgtaacatcccgggttttagctatagtcttagtcacgctaatgacttggtcacactggctgagagcggtgtcgattgagccacgatgctggctaggacctataaatatgttgattgttgttctattatggatcttaaatgattttttttcgatcgtttccttgtcatctatttatcaagtcatatccatatgcatcattgatttattgttagttagactaatctggtgaggagtgggataatttagtttttgttcattgtcgcgttgctacccatgaattatagcgcacattagtagtcaccgagagatacacatatgcacaataaaaatcacaatagaagttacgacactttattcacaaatgatcagtgtatatctgcatacatgcatgcatgcatacatccatattatgctttgcaaatgttctgtaacatactcaactcatagctattatatacaaatcaatagaggaattgtgaaaatgaaaataaaactagagcaattaccaatcagccctcgagctctagtaaaatcttaaatattatgaaaccttaaggactagaatgtaagaattccataggtatacgtataaaaccaatttcctgcagtaattataatttactgactttagtttccatgtaatcaccaaaatgacatcaaagaggaaattacctttttcaccccaaattgattaggtgaaaaatgtggcagcaaatccttttccaaaccgacatgcaagcagctgcatcaccatgccctcacaaattacatacaaatattagcctagctagtagactagccatcatgttgttttggctgggagacaacctcgaggaacagcattagcagcagttgcaacagtagtagagtagtatggctccgcttagaagagcaacaacagctgtagtagctcagtgaaatccagcacaaatcaatacatcaattaaccatagctgcatagcatccatagtaaaagcaatcagtaagagagagagggaggtcagaggagtaaaaggagaagcaggggtgtgcagttcttggatgaacaagggtttcagatttagaaggagcaagaaactcaagtcaagaagcaagatggagcaaagatcagcaaggggacggcttcaagaggaggaagagaatcaccagtagcagtcagcagatcaagaaagatggcaggaagcagtaccagtagagcaagagccaagaagaagtacctgagtttcaagtaaagaaaggagttttagttccaggattagtatgccatagtacaaatcaatctggaggtgcccgagtttaaagaggagaaattagagttccatcgggagaatccttgaatcagaatccagaggagcagctgcagaacaagagaactagagaagggaaccagatatcagtcacctaaaatca

SEQ ID NO: 31526 - DNA, 1501 bp, Oryza sativa
taaaattttgattgagagaaacaaatttactcatgataacatggataaatctatattagtttatttttaattttacggtattctaaatttattctaaattctactactagcttaaaaattaaaatatcatatataataaccaacctaatagcccacccacacaacagtcaattatagatctatattacatcattaatatctaacttactcacctctcacataatagtagtttattagagtacgtattacagcttatgaatctattcatttcttctctcattcatgtgtcatttacatcatctttgttatactcagctttaagatgtacactacatattttttttctcacaaatttgttatactcactttaggatttacactgcatatttttcccacaaaaaaactctgataccctcaccaactaccagtcagaacccgtttctatcacagaacaatcgtagcgaggggaggggaaaaagacgaccccgaatcgccttaagacagtgggtgttcttgtcgtgcgcttcaccgtttgtcttgttggacccggagaccccacatatccagatctgcaagcttcctcctcctccttcctcctgatcctttagcttcctatatacgattccaccatcgaaggccagggcccagacttgcttgccgcaggttactgatccaccgaaggagggaggcgcccgcccgccgccatggccgaggtgacggtggtccgtgcggagcgcgaggaggagtccaccctggagcagggtctcctcgccatcccggaggtgagtttgaatccgccctctgtttctttggcgcgccggcggtgaatcagcgatcgtgcttgtgaatcgtgttgagaatttttttttcgttcttttttttgggaggtgaatcgctgttttcgatttcagtgaggagtgaggaatatgttagggttgtttgtttaggtacaccaccttaagtcttcggctgagcggaaaattggaagggaaatatttctcttctatgtattcgatatcgattcgtggaagttaactttgctgaacaatcgtccctacttatagctttttttttaaaaaaaaaacaactaatatctgtttgttctatttttcttaatttttaagcaaaaaaaaattctggcttgtggattattcaactcctgtactgcgcaatatgggaaaatggcatccttgtcctggaaggacttacgataattttggctgccgcatgccaacgcaactacctaggaaccagcatagtgctgcagcagtacagctgcttcctttgcgtctgaactctgaatgttgaagtcaagtatacagtttagatttgtggtcttactgaattgatacattattcagtcagcaatgcacatttaaacttaagttactctgtgacgactgtcaatgcacattgatttcttaccgagttaaaagttctctatagtcattataagctgttcagttattgcccaacaaaaattgtttgatgagatggcact

SEQ ID NO: 31527 - DNA, 954 bp, Oryza sativa
gcatattttgattgaacatttttcatcattgccttgcaaattaatctaaggacatattttgattgaacatttttcatcattgccttgcaaattaatctaaggaccctagttaaaaaaaaacttctgcatcacattgtaatattaaggtgtccaacatatatcatgtcttatggaatattgatcttttttcttaattcaattaacaataactacttataccatgcttacttcaatccgaaaccatattagagattatactgttggggtaagattgtttgggtagattgactggtaaaaaaaaagagaaaagaataaattccaggaaggttgtcaaaagtgttaaaaatcattggaaatactatcagttttgacatactagaattctaaacaaatacgccagattgtagggtgctgaaccatagtgatcttaccaattcttagaatttacttctgtaatagactgttacagaatatccttaataagtcatagttgattagcaaacaatataggactaaggaatacatactactgtgtgaaaaaaaaattacttcaacaattgaaaataaaattattcacttaatttaaggggtaggatgtattgaaaataaaattattcacttaatttaagggggtaggatgtaacatcccgggttttagctatagtcttagtcacgctaatgacttggtcacactggctgagagcggtgtcgattgagccacgatgctggctaggacctataaatatgttgattgttgttctattatggatcttaaatgattttttttcgatcgtttccttgtcatctatttatcaagtcatatccatatgcatcattgatttattgttagttagactaatctggtgaggagtgggataatttagtttttgttcattgtcgcgttgctacccatgaattatagcgcacattagtagtcaccgagagatacacata

SEQ ID NO: 31528 - DNA, 166 bp, Oryza sativa
ttttattgaacattcatttgcttcagtacatgacgaattgagcgttttacagctacgcatggaagctgttctctgcttcgtgccgaaagtaaactgatcaataaaagacaggctactagtatacaataaagttcctgtgaaattaatcgtcccactctctttcagc

SEQ ID NO: 31529 - DNA, 1501 bp, Oryza sativa
cgccccgcagctgctgcctgcctgaatcggttccgtggctcctcatgagtctatccccaaattaaccctagccatcaacccctctccaatcgatgctgctgctggctactgctctcaacgactgagattggaatttccccagccccagcgcccctgattcgagcatggctcagaccagccgtgtctccccaagctcctcttctctaatcccttctctcttttcttctgtgatgtgatctaattggtgttctcttgtgtggtaacctactgtgaatttttatgcttgtgaactagtcctaatgaccaacgtgatgatgctatactcaggattatcctgctgtctgtagggttccagattgattgatttgctatagatggatgatgactatatgctatggatgaatgaatgaatgcttacataatatatcctatgaaaatgcagtactgaaattaaaagcacactaacatgattttgtccttataaatgtgcttgcatatagaataaccgaatttctgaaattagtggcatattagcaggattaaatccctaaattaggtttattgaatgatgcagcaacttacatgttctataatttgataattatggcaagatctgtactatatatagttgaattataacctatgaaatctaacattgaatataaagagatggtgactgatttcttaaataatttactgctattgactatatgtcctgactcttgcctctgtataatttacttgattcgacttattcctgcagggagaaattagacttattgatgacctaactatactatggtttttattcagatattatacgctattgtttcctgagaattttataaactatgatagcatacacttaaactcaagatatatttgtgcacactaaaagatgtcattcttttctctaaatatgttctactcttccaactgacctacaattgatacctattattctgctaatggatcctatatcctctatttagtttctaaactaagaatagatcattgcctacccatttatgctctgtctatttaacttgaaatactagcacaatattgatcttaccttaagctcttgaggttaaatagaacagtgattatttctaactatgcatgtagtcaaaattcatcctatgatagctttactgaacattgatttatagaactatatacagatataatccttagctcaattgcacttgtagatcattagaaataaatcttgctgttaaatatgtactgagatggctggtctgtacttgaattttccttctaagactccactgaatttaggatgatattatcctgtccaactactcataaaaactttgcctagcttattgaactaaggatgcacattcagtaatataccccaacacctagtactagtatatccacagatcaacatggctgccatctactgagttcatttttcaggtttaatggatataactaagggcatgcacacaactcctaaacatactattgaaga

SEQ ID NO: 31530 - DNA, 1501 bp, Oryza sativa
aaaaatctctacgtaatatgttatttcggtaaaacagaagttgtgggaacaaatccttacacatatatgtgtgctgtgattttatttttcttcctcaccaaaacaaatcttgtaatagatctaaaggtttaaaattacatgaaacttatatacaagttacactgtagttacgtgcaagttacagtgtaattacatataagaattatactacgattgtactataattatatctgtcaaattgtcgataaatgtataggtggtcccttatattttgcccccctttttttagcccaaatacgcacgagagtggcggatccagaaaatcgattcgttgatgccataacttatttatcattgtcatagtatactaattatatttaaatcatgatgttataatatatggataaatagttttgttatatattttactacaagtcgtcggtatcatctgacaccggttcttatactgttggtctgctcctggtacaaccaaatagcatacatggtactagagcagatgcggttggtgtcaagctcgtacgtgtatgtacataccacgcatgtcgtggactacaacgaaccaatcatcgtgtgctaagcccatgtgtgtacatagtttagcttcatggagctaaagatcggttagtttaattattatgctgctgttagtaatcggttgagcaatgatttatttagctgggtagagattacttagttttagttctctagatttaatgcgaatacaattcggactgcaggctgatcaaccacgtttgcgccgcggtccgctccgttgatcgatccggcgtcgtgctcccatgctgccttcacgtcgtcagcaacaacggcttggccggtttagaacagagcaccacatgttttcgagtgagctagttggtgattttcagaatatcgacatggacccggcgtgtgaaagttacacacacattatattattgaagttattacaatgtaatcatactatatttatatttgatcgatagatatatagtaaatacgaaaacaataattatggtatcggatgatcaaatcacggtgctttgctgatatcacctcttctaccgtctgctgcaccgtgaaacaaacgccagctcagaagaagctcaacctgcttacctgcagttctttgccccagagatctccggtgtctaccaccggtcgtcgtgctcgccatgcgcagcgaattcaggagagatgggcggtgccatgggatttgtttatgattgattgactttctaggcttttaaagccttgctgttgcgcaactttgttcaggttgaagatgatacagttttaaattttcattgaccgggtttaagattagttgcggatgcaggcaaaattggttcaccgggaaatgtaaggagtgttcccatccagctagatggacgcaaggaattgcttgtttcagtttcaagcaatgcaaatagtacttttggtttggagggtactgcacgtgttaacaacaaaaaagaagtta

SEQ ID NO: 31531 - DNA, 1501 bp, Oryza sativa
ggtattctcgcagctcgtcaagggagaaaattgatggctcagaatgataaaccctcgatgcactgtaccatgagtactcatacatgtggatagcaccggactcattgaagatgggattcacatgctcgattgtgataacagaagggagagctatttgttcccctgtaatcggattgaccaggtgcatctcggatacgtcatcaacagtaaccagacagcccagtgaggacccgatcagaaacctactacgcacgggtggctctggtagagtaatcttgtactccctcttctcgacaagactgtagagagacacgacgctatcgccagcagattcagaggtgtagagcaggcacggtgtctgggacaatttatagatacctaggctgcgcattccattgtaggcggagcgccaggagttacaaaccgaccctgcgcgcacgaggtcagggatctccaggagggcaaatatctccattaagatgtcctgatgcagctctggtaaatttgccatgacactctctgtcattgatggctgatcaccatcatctttttccacttccttcagtaaactgggagaaagggctaggaacttggacacaactctgaagagtaggcagcacaaatttttgggacattttgctagatcccctaagtttataatcctggctatgctacaggccgccattggaacagatcgatccccacttgaaaggtgaaattcgtcgtctgcttgaaaacttgccgagttggaacatttgatgaagtgagaggcacaaggtataccttcatatacctgaagttagccaacgcaaactgaaacggacacggacaccaccggaatttgttgccctgaaaagagaaatccgactctgaatcagacttgttcccgggaaactcgtgtctgcgcgcgaatccactctgaatcagactggatcgcacggattcgtattccgaatagaggtcagcaaagcttcatggagaactcaccggcggcggaatagctcggcgcgaaggatgagcagccaccgtcaggccgccgtgcggtggagcgcaggaaatccggcggttgatttcgattttggccgccatagcacagccaccgggccgccacacacactgccgcatccccgaggactggacggccggcagttgaggcggcgaaggtggcgagtggtggtggccaggtggggctccgggccggtgtcctcgtcggcggagaggatgcggcgtgcagaggctcggatgcggcgggtgcgcagccactgtagtgtttttcttttttcgaaatctcccttccgaaatgaaaatatgaaatgcccatactccatactccatagtgatataatctatttcgaaatctcagattttaaaaaaaatcgaaatgtcaagtggaacatatgataggggaattttactatttgccactcttataagttacttcattttcccaatataattattgaactagattatttagcaaagattaagattaaaaaaataa

SEQ ID NO: 31532 - DNA, 340 bp, Oryza sativa
taacagcatggaaaaggagagcatatagggattatcagatcataccaaaacaagaaacttgtcagtttgcccactgtacatgtacatccaattcctactggggaaataatgttgtgcctgagaacagtacttgaaaccacaacagaagggaaagtcctataatttggccctgactgttcgtgtcatgtttaagaacagtgttcaaatgccaatcaggtatacagcctgaaacttctatcatctaaggacgacaaaccactgctattatatacaacaaattttctgatttcagtagttggcactgcttctgagtactgacagcatgtgcgctcattttagt

SEQ ID NO: 31533 - DNA, 502 bp, Oryza sativa
gttttgctagtagcacctcggccactataaggaccggtcttcgggcctctgttgcaaagcactatcgtactaaccacatgtctaatgggtaaggcttaactcggtgctcagtctagtcctgaacaaaaggacacggatagagatggatgaagtcgttgcgacgatggatatctctgaggcaaatgaaggctacacgagctgcggctcggtaatcgagatgtctaggcaaatgaagactacacgggtcggtgcccgttagtcgagatgccatggcactggactagtacacgggtggtctcacccctatgcgtgtggcgcacccggtctagatcctgttgctaggggctcaatcctggcctgcctgtcccgggataccggccgtaggcagggttgggtcggtacttttgttcacggctaggatgggtgaagggttatgtcacatgtttacgatgggttccaaggccatggaatgcggagtaaagatgtgtcttgtgggtaaaga

SEQ ID NO: 31534 - DNA, 242 bp, Oryza sativa
gggcaggcaattggttgctagttgaattttgagatttatttttaatccatgcaaccagcggcacgtttcaaataagaaattgaatgctagtggaattaagtagatcaaatgacataaactaagtggtaaaataaaaatctgtatccatatgacggcgggtactgtacaatattaatctgcacactcgtgcagaaataggcagagttttttttagaaaaaaaaactttctgaatcgaaatcca

SEQ ID NO: 31535 - DNA, 525 bp, Oryza sativa
ctgcagccctgggtctttcgttctttttaaggatattagtgttgctataccattactaatttgtctatttgcatgcagttcatcgagccttcaacatttgagattggcgacaattaccactcctcgattactgaaataaatgaaatgaataagagtcggttggatagtatgctgccgtagcagcgtacagagagctaattcgcgatatgggtggtttccgtgcagcataggatgctcgcagttatggtctctaagtacaaacatggagtcacagtaagagggatgctcggttggtaacctgttcatataccgagccactcttactcaaagatcggtctgtacaagcattgacactatggataatacaggcagaagcatgagggtcgatagagatagtacaaaccagagatagtagatgcagaaagttaaccagagacagtacatacataagtatgaagtatgggcggtaggtccgaaacatatgcggaaaaataaagagttagcactgtattggtttttagttga

SEQ ID NO: 31536 - DNA, 1501 bp, Oryza sativa
tacaagaacatcatggagaactgccaggagaacgcgatggtgctgaagcaggggctggagaagacggggcggttcaacatcgtgtccaaggacaacggcgtgccgctggtggccttctccctcaaggacagcgcccggcacaacgagttcgagatctccgacttcctccgccgcttcggctggatcgtgccggcctacaccatgccccccgacgcgcagcacgtcaccgtgctccgcgtcgtcatccgcgaggacttcagccgcacgctcgccgagcgcctcgtgctcgacgtcgagaaggtgctgcacgagctcgacgcgctccccgcccgcgtcgtcgccaacggcggcgacgccgccgccgcgtcggcgagcgagagggagatggagaagcagcgcgaggtgatctccctctggaagagggccgtgctggccaagaagaagaccaacggcgtctgctaaagcaagtcagctgcgcagcggggatcgtatactattattatggtccacttcgtaattgcgacttcttaatttttaccgtgtcgatcggtttaccgtctcaagtctgctctcatccgattttcggattgatgctgcttaattatgtaccaagttaattaattcttagaggacggaatagttccgactcaatacgaagcattgcctgtataagtcgaacacgggatcatgcattttacgttgggtgtgtagcagtgaattgatcagtgatgctccatctctactctgaacgtgctacctccattccaaaaaagaaaaaaaaaacttttatgaacgaatttgtgtatgaaaattaccatctccgtctcgtaatataataaattttggttttagattgcgtaaagtaaatctcttatatgatgatgatgatatgaaggtagtacacatttttctgagactggacggtagactgtctggtactgggagagaagacaccaacaaccaagggagaacgagacgttcctggcacggcgtgggttcgcatttggactggaattctctcatcgtaaggcccatcagtcatcagtagtccatcttaggccccctgtaatttttctgattcatttttaggaacaaatgcaccggatttacttgaaaaaaaaaaactgaccaagtacactcgaccgtccaaaactgataggacggctcagattgctcactacaccatacatacaactccctgcaaccaacgttgcgatggtgtcaaaatcctggtgatgtttcttgatcatcttcttacgacaatcgcacaaccatgaaaagaaagagtgttcattgagcggtaagcattgagaatgcccgccgatagctctgagcgcaacccaccacagttgtcgcgactccgggcatgcgaccaagagattatcaatcgtctcttcgcattgatcccaaagaacacatcgatccagatatgacaaaccacgactctgaaggccggttcactgtctagcaacggttaagggcgaccaaccaaaggaagtag

SEQ ID NO: 31537 - DNA, 201 bp, Oryza sativa
cccatttctctaagcccacagatcagtagcagtaccttttactccatcctggtttagtatctgcttaagggaccgagttggccgggtacatacctaacaagcagcagctagcgcgcggtgtggtacctagcttggacagcgaccaatggtactgtttggcgacccatgatgatcactggccgggccggcgcgcatgcatga

SEQ ID NO: 31538 - DNA, 181 bp, Oryza sativa
gctgagaaggggatggaaggggaagaaggcaaaaagttagttttattctgaaaatgaaactgtggagcatcttttcttaaaatgtccaattgctagacttatttggaacatagtgagttgtgtgtttgattcgaaaccaatccagaatatacatcacttgtttgggaggtggcttcaggat

SEQ ID NO: 31539 - DNA, 859 bp, Oryza sativa
cggattcgagggaggaacgaagctagggttcacgggagagggagagaggaggccgggcgggaggaaggagacgaccggcctggcgcgtgggccccacgcggtcggacgcgcggtcagcgcatgcgcggcgcgcgtgtgcacggccggctcggctcggcctggcttgggcgcagcttgggccgggcggccggcccaggagaagaggagggggaggcggcctgggagaaagagggaggaggagggagtgggccgggagggggagaggaggcccgggagaggagggaaagagagggaggagagggagactttggccgtgggccgggagagagagagggaggactttgagccaaatttggcccaaaagaaaaaggaggattatttttagatttttctttttaataaactttgataattgtttttgttgcttaataaatattcccggcgctctgaaaattcaagtaaaatttgagggctccttttagaccaaggagaatttaacaaaaattctccggaccacattcgaatttttcttgtacgtattttagtgtttgccaatttcttttcaaattttaattaattctattattccttttagaaaatgatttttaatttcgggatgaatttatcaggacgtgacatagagtacccactagttggggttttgtttatcctatggtgaacaaggtaatagtaaacaatagcaatgataaggctataacaaggattaataggaagtgctaaataaaacagtgattacgcgggaatttaaataaagcggtaatgcaataatttaaatcaaaataattttataaactgggattcaatatgctcaagggtgatgtgacttgccttgctcaga

SEQ ID NO: 31540 - DNA, 438 bp, Oryza sativa
tgctaagcgatatattctgtgcaaaaattatctaaatataagttaatttaaaatatcgaatatatctatttatcaagtttataataattgaagtaaattaatcatgtgttaataactttctcattttacgtgcaaccacttaatcttcatcttcactcaatgtctcgctgaagtagaactgtagagaactagaaattcgtcatatttgtcccagttccaattgaactcagtagctcatttgctcccaggccacagggccatttcggagtagctggtctccctgagtatttttgagtcggtgaactgcagagatggatggtcatggtctggcatgcatataatactctctcttaatccctgaatacgatacgatctcatcagagacagtggagctcatgtgttgatttaccaaaattagttttctgtggtgcttgcagc

SEQ ID NO: 31541 - DNA, 1501 bp, Oryza sativa
ctcttctttcaatattccttgtttttaattctgaattttagttatttttaaattttattcctacttggactctcttttttttgctaattttggattttattttatttttattccgatttttgattaatttcgtattgggtttctatatgtactcttcaatattgcttactccgtttgaatcttcagaacatgtcaatatattttgccaatcactttgcattgcttaatatatttatcatattttattcagtcatagatggacggggaattctgtaattagttttgtattctaattacctattcagctccaacacatactatatgcaggcaacgtgcatgtccgattcctcgtcaattaaaatattgtaattacttctcagtttcctattatgatagaataggcttagcttagagcagtagtttctattcatattcatattcttcaaattaatctacaccgttaaaatctagtcagtttgtgatctaaaggtttaatattttttgttttttctccgattaatgtgggaatttttagccccaacaacgaacgtggtaccttcttttaagactgttttaataatataacttgttgggtggcccacgcaattgcgcggctagcacctaaacaaaatcatatatttttcatatatttttcagtatgattttacttaaaatttattaaataactatttcgttgtcttaatactttgaaatatcaaaccttagcatccccatatttctaattatgtagtttttaaaagtcacaccagctgctacctttgtcatatcgttctttatttgcttgctcgatctactactatttatattcattttctttgaaaccttaaaaaattgtatcttatagtttttagagtttattatttcgttgggtttcgtttttataatttatagaagtcccgtcaaacgctgccattatactcctctacagcctgttcactgtcttttctctttattgtcattgggattttcaaaatcgaacataagtatcattcggggttcattttttactttctataagtcccatcaaaccgtcagtggctttgccattgtattcctttatggctcacccgctgcctccattatttattgtcattgagattttaaaatcgaacatgattatcattggggttttttttactttgcagaagttccaaatctttaaaaattggaccttgtagtttttagagtttattgtcttgttgggtttcattttttataatatttagaagtcccgtcaaacaatgccactatactcctctacggtccatccaccgcctacattttattgtcattgggattctaaaaatgaaacataactatcgttggaattcattttttgttttgtagaagtctcgcgaatcgtcggcggctctgcaactatactcctatataccccgctcgctgcttctcatttttgttgtcattgatattttaaaaataaaatatgattatcaatggggtttattttttactttttaga

SEQ ID NO: 31542 - DNA, 1501 bp, Oryza sativa; identical to SEQ ID NO: 23558

SEQ ID NO: 31543 - DNA, 1501 bp, Oryza sativa
cgtataaagtagtattaaaggttccgttgaacaaacctctaaaaccacgatctttgtaggataacatttttacgctaaaaaacaacggtcttttatggattcagggagtagtatttttatatatttacactaaatttcctaactagccgaatgcatggtcaaatgtcatgtaaaaaaatcaataatattgtggagtacattttaagagagagagagtaacagcattattgtattatatgaaggtactttcatgataaataatttagacatggtttaatttttcacatatccaattcaacaatttgaaaacgcgtacaatattaaagtttctaaggttagtttgggatataagaaaacaacatacatatttttgtgacgagagggagtactacaatttacagaaaggtgcatgcagcaatatttggtctccttaatttccatgccctttagtctttatccaatattccattaaaacaataaattgggtgcaaaactagtgctatatattcaagttaacagaatattggtagggcaggttttagcagcaatcctaaaacggtcctaaatgcaaccattagttaagttaatcagcactgtgtaatttgcacagtacgtttgacagttcgtgtttactgagcaggtattatattaggaactgaagataaaaacagattccgccatagctaaaataatccaactatcttcgattgatcggcatcaagtagcacatatacacgtggccagagctagcaactatttccacttactccctccgtttcgaaatgtttgacgccgttaactttttagcacatgtttaaccgttcgtcttattcaaaaaatttaagtaattattaattctttttctatcatttgattcattgttaaatatatttttatgtaggcatataattttacatatttcacaaaagtttttgaataagacgaacggtcaaacatgtgctaaaaagtcaacggtgtcaaacatttagaaacggagggagtataaactgctatacataggaaaaaaaagcactcaaaacagcaagacatatagggaagtagcggtatgtagttacaactcaacctacctaactgagcttaatttaatcaattaattattaaaccggagacagacacgattagataataaattacgggattgaccaggtaggtcgaggcgcccaaccagcacaggaaaacccgtaacaactaactcgctgtggctctcctcgtcccctacaagctgaaaattagctagggttgagcaagattatgagtaaattaggctatctgaaccgtagaagaacttaaccattctaggcatgatcagtgctcgtgtgtctaactgttccagaattgaaaaacattaatgtaagaagatagtatcttgcttgtgtagactcagtctcattaattatatatatttgccaatatgtaatatatagatagatatactttgtcgcatggtttgtttaactaattaatttgttcttgctagcta

SEQ ID NO: 31544 - DNA, 1501 bp, Oryza sativa
ataccttaacggtaccaggcccgatgatacttcgagggtacctgatatatgatgataacttgattgtatcgggtccgggtgatacctcattggtaccggtgataccttgagagtaccagataatatctattgaatgataccttgagagtgtcgaatgatagctagctcaagggtatcggataatatctcaacattactagatgtgtaccgtaaaaatatcacagagattttattgtcatcttatatattagcacaaccatctagcacataatcgtctaactaaagtacgtagctttagacggaaagaaatagttagcactttattagttaaacatgtgcactgcaaaattttaaaacaatagaaacaagtctacaatcgatgccaacagagacaggagcacgtgatatgtccaagggttggctgcgtgctgcactgagagcctgacagcgaggtgcttgtgagcatcgtgccaggatcagacacgcggggcttcgagtcatggggaatcgtacttgtgctcgtgggtgtatagagaggtataccgtcaaaacggtataccgtcctctagttgctctctttttgtgtatatgtataaaaaatatatacacaaataaaaaatttgtatacgatgtatacaaatacaaagtttgtatacatcatatataaagtttgtatatatatgtatacaaaatataccaactttatatacgtatatatacaaagtttatatatgtacatattagaaaacacatatacaaagtttgtatatgtgtatacaaactttgcatatgtatatattaaaaaacccaaaaaactgaaaaaatatatacggatagaaaaaaaccgtgcgaaaaaaaaccgcagaaaaaacagaacaaaccaaaaaaacgaacgtgcgagaaaaaaggaaaccgaaaaaaaaagaaaaccgcaccgccgcctgcgccccttctccgcgcgcgacacgtgtccagtcacgtgggagaggaggcgcgcgaccgatcgcctattagcgttctcagaggatgctgcccagttcaagagggagtaggactgatccatgcagtaccagaccagggtgccactagggagggtattgtgtaacccatatctatacccaattttaaccattcacatctaaaaaaatatctatacccaaattaagtggatattattcaatgggtaggggtaacctaatgggtaagagaagagacatgtgagtcccatatgtagaaatggaccaaaatttgtagaaaattgctcttttatataataaatcatctctgtaaatttcaagcaaaattgataagattttataatgtgaatgtgagtttaaaaattttatgtcagatttttacccattataaacgggtatgaacaaagttcttcaaatatgtaataacctccccatatccaaacttggaatgataacttttctacccataccaatttaaatgatagcttttttatctacgtagtatatcttacccaaataatatg

SEQ ID NO: 31545 - DNA, 984 bp, Oryza sativa
atatttacgaagtaggaggacccgagccctcctatcgagacccacacacactaaaccacccggagagcttagctgcctaggcttgccgtcccacaaacgagcttttgaaggccagaagctcctgcaacactccaaggatgactctcattttctaccacttgcaagatcgtcacaactctaggattggcgccattgaaaacatagtcattgcggtacttccaaatcttccaagccactagggtcaccaaagagttaatccccattcgcaccttcttcggccgattcttggtcgcttggctccaccaccttagaaagcggtcggtagagggctaaggcgctacctcggctaaccccagcctcaagaagattgccgtccaaacttggcgagaaaagacacatgagatcaaaatgtgttggatggattcttgacttagatcacaatggggacagctcaccgagtgctgcagcccacgcctagccaattgatcagctttccaacacctatcattgatagccaaccaaatgaagaatttgcatcggaggtgaccccaacacttccaaatacacttccaacacctattaaataatttataaatccctgaaacgaaatcaggcactacaccatggcatcagattaccaacagacatctgttggtaaaaataaacaatcattgatagactgtatgttagtaaaagcttttggcaaaccatatgtcagcaatactcatatgtcagcaatactatgtaacaagatatgttatatgttggcctttgctgacatatctgtagcaggctaccttgtgacatggtgtagtgagggtgtggcactactaaagagtcttgctactaaagttacgctattgatcaaggctttgcacaaaatataacttccatggctctctttgtgaacaccagcaaatgcttgtcagctattcagcatcatttttgtgttggctaattgttctagtttatttttatgttctt

SEQ ID NO: 31546 - DNA, 881 bp, Oryza sativa
tgagtacccccgtactcacccttgctctgtataaataatcccccccagttgctgaagaagatgaagcgattcttgctgatgaggagttcttccaggagcaagccggctacgatgagttttagggtttcggcctagttcccaagtcgcgcctgtgatgattggtccaagtcctggcttccgctttccttttgtaatgcagttgtgagctcgggatctgtccgtagcccaacatgactgtactcctactctataataaagagacctctgttgctgtgatattctgtctccctgtgataccagcactgtttcctgggactggtatcgattaacaggttaatttgaaacgtcacgggctagttccggtcgggactatttcggggcgtgacatatattccctaaataaccaataatcggataatgcggtgagaaggatgaaacgggcagagccaaatcatccctgtgctgccttgtgtaattcctataaacactcctaaattaccatctggcattctaataaataaggtcatgggccacatttacttatgtacatacaccatcaaacgtacatatgtaggtacgtacaaacacccgctcatccccctcccctttattattatttttttttttggggggggggcgccaatttagtcgttaaactttcgctttgaggtcaatatgatccttgatatttcattttgttcgaactagtcctcagagtttatctttcagtctactatggtccttggaaaaaaaaaatcacgttgccatgccatcttgtaacataatctatttggtgtttgaatctcctgaagatgaagatggagataaagattaagtgtttcacgtaaaacgatgtgataataacgtgtgattaattgagt

SEQ ID NO: 31547 - DNA, 699 bp, Oryza sativa
atcaagtcagctttccaatgccaccaataccaagtactttggacttcacaccaatgagaaccaagtacgtttgtgaagactgctctgaaggccaggagtctgctgagtcagcacgttggtacaagttcatgttcaaaactgtaccaatctacaatgtttcgtggtgcatgtatacatggttcaaaacatagtgaagttaactttccaacgcaactgacggtgcatcatttggacttcccaagttggagttattgccaaattactgaacaccactccagaagaccaacagcctcgcgaacccacttcagaagccatttcgtggaggccctttcacatttttagtcttttcatttccatctggaattcacccctatctagcagggctgttggtagtgtaaataacccctaagaccattgcaaactcagacttttgataatcctattcggaaccctttgttcagctgtgtgctaacaaaccccagagagagattctctaccccttttctcatgtgttttccttcgcgcagattacagaaccgtccgcgtcatcggcacccaatccgcgctcttgatcctctgagtttaggttgcgtaggttggttctttgagagtgtggttggtcgaatccttggttcaggctgccgtatagagacggtggttggctccttgtgcgtgtcgtcaggttgcactaattatcgc

SEQ ID NO: 31548 - DNA, 543 bp, Oryza sativa
tgtgccatcatgatatacacatagtagtacatatctacatatgctcaagaaatgatcaatcgatcgattgatatatatgtgtgttatttacttgagttcttgatcgatctttgggttgagtcggttcattgtacggtttgcttcttcgtggtgcaattcatccgagcaagtttatttgacttgaggctttggcatgtgttttagttcgttttatgatcagatagaattttaatttgttagagtgtcatgtcaaagaggtgcaatctacacagttcatcaatacatgatgtccactgctctgatgtgtatatcacatctatatctcttgtagagcaatatattccatctctcctgtcgagctagagctactactagagctagttactaattgatttacaacctttcttgctctctaattcatccgtgctttttaccttctcaatttctagcacaagcctcatgctgcaatggtgtgtcaccaagcacaaaaaaaaactacatagcgtaaagagctaacctgaaaatgacaaataattttttttc

SEQ ID NO: 31549 - DNA, 241 bp, Oryza sativa
gagagagagagagagagagagagagagagagagagagagagagagaggggggagaaggggtaacgaggcgccggcaaggcgtcccggcgggtacgtcgaacgtccggctcgtcgcagtcaaggtggtagcatgcgggatgcgccatggaggcgtagaacttgctccactcatagcgaagcccgacgccgacgtttcacgcgttcgccgccgcgtcgcaccggcccggcgcgtgccgtgtca

SEQ ID NO: 31550 - DNA, 1501 bp, Oryza sativa
gcccagtctagtcaagctagagacgagctgagcgagctaacgagctagagtttttcgtccagccaattcaaatgaaataactgacccagcgaacaaagacccatttagttcgcgaaaagaaaatttttagatatcacatcagatgtttgaccggatatcgaaaatgtttttcggacacgaatgaaaaaaataatttataacttgcatggaaaccgcgagacgaatcttatgagcctaattaatccgtcattagtaaatgtgggttactgtagcacttatggctaatcatggactaattatgctcaaaagattcgtctcgcgatttcctccctaactgtgcaattagttttttcatttatctatatttaatgttccatgcatgtgtttaaagattcgatgtgaagtttttggaaaaaaattttggggaactaagcggggccaaaataactgacacaatctctcacattctcactgacccggcgaaacaaaaaaaaaagattaagggcttgttcactttgatatcattttcaaccttaccaaattttggtaaagttgccaaagaaaaatggttacatttaaggcctgttcactttaatgccattttcaaccttaccaaattttggtaaagttaccaaaaagtggctacatttagtttactaccaaattttggtaattatataagaaatcctgccaaaattttggcaagttactaaaattttggcaactttgccaaaattttagcaatgacaaaatttggtaaggtttttttggcatcaaagtgaacatgtccttagtttgctgccaaattttggtaactatataagaaatcctgccaaaattttggcaagttactaaaaatttagtatttctaaaatttggtaaggttttttttagcattaaagtgaacatgccctaaacaatcccctatacctctcacagtctcaatgccccgtgtcttgttagcgcggtactccatggacctcgtactccacgctgaagacagttgtgatgcaagacaacctcttggggttattgtggggtgtgtttagttcacaccaaactttccccaactcccaatttttcatcacatcacatccaaaatttttctacacgtaaactcctaacttttttttcaaactaccaactttccatatacttctctccaatttcagaaactaaacacagccgtagtcatttgggaggcggacacaactatgcgcttcgttcttcgtaggtctgtcacctagtattcattaaaaatccttatattcatgtccatattatttgggtaagatatactacgtagataaaaaagctatcatttaaattggtatgggtagaaaagttatcattccaagtttggatatggggaggttattacatatttgaagaactttgttcatacccgtttataatgggtaaaaatctgacataaaatttttaaactcacattcacattataaaatcttatcaattttgcttgaaatttacagagatgatt

SEQ ID NO: 31551 - DNA, 405 bp, Oryza sativa
attcctgcagcccgagaatttaacaaaaattctccggacccattcgaatttttcttgtacgtattttagtgtttgccaatttcttttcaaattttaattaattctattattccttttagaaaatgatttttaatttcgggatgaatttatcaggacgtgacatagagtacccactagtatgagtttaggtagatgcttggcggattaagtaggcaacattaggtggtttgataacgctataccttgggaatattcgtatcgcttggacactatggaattgttggtttatggtggaattggacatacacctctcttcctctttcaaaacccctaaaacctgttttcggtggggtttgggtgcatgccagttgtgggaagtagcaccccgaccactataaggattaa

SEQ ID NO: 31552 - DNA, 196 bp, Oryza sativa
ttgtaataattaaaactcaattaatcacacgttattactacctcgttttgcgtgaaacacttgtttaggagattcaaacaccatcataatctatcatagtggaaaaagtaaaaaaaaataatcaaagtttgtaacgactaaatacgaacaggagcaattgaaacgagctactgcaactgccgccttttctgtaaga

SEQ ID NO: 31553 - DNA, 1501 bp, Oryza sativa
tgttgtatgtgcaaattttgtaggagatgtaacactgttgatgatagaccagcaatatgctttgcctggcatagccctggatgaagccacagttgaagctagactgctagaggctatgctgtttgcttggtcacctgttcaaagctgtaattttggcaattttatgtgtgatggttttctgaagaatgcaaaattcagttggtattggaaagtgaaagaggagtttagccaacaatttcaaagtctatgtcagagcaatccaaattgactgactttagcatggaaaatccaccgtgaactccacttcacagcttaaaaaaaaagctctgcaaatctgcaattacaggatgattgcttggattaatagcaggctatgtggattaatgcagaaaacataagtcaaccctctccaactggggaaaaaatgaagcaacataaaaggggaaaaaaaagatctggcattgtcttcgttgacctgactttggcgttcttcatctgaactcctcgtttattggctaatctatggtttgtggacctgatcaacaccagacgggttaactacgtctacatttgttatgattaattgcgccattaggatattaattaatctggcagtctgttttatacgtgaagctttgtgtaagttgctcttagttgcgtaactgcaaaagtttgtgccaaaaaaaaaatggccgctcgtaaaatgtcccttacacgaatcgccaccatgcaggtcttgttaatcgcttaattactcacatagttaagaaaattgcgttcgagaaaaaaacatagttaagaaaattattgtattttaaactgtcagtagagtaaactatgggctagacagcaacatttttcgacaattctgaaatcataatagatttttttcggttgaatttaaactgtttttgcacacccacccacagattcaccatattggcgtggcggtaaattccgccaattttattttttgcggcgcgaacgaggtgcatgcaaacatgaattgaaccaagcccggatctaccgccgccgcagcagcacggacaaaaaaataaaaataaaataaataaataaataaataaaagcgcgccaataattcatcatccataatacaagcagccgcaacttgcttcttcctcggcatattcttctccatgctccccccctccaaattccgattccttcatgtccacgaggtactccgaaagagagagtagtagttttctgcaagctagagagagcgaggagagggagacagtccagtatggaaggcaactgttgcatcaaaaaaatctcgaatccgtctatcaatcgagcggagcaagatcgccatttgtgcagaagagagagaaagaggaagcattttacggaggaggtgaggtgaggtgaggtgggctataaatatagttggggaggggagggaagacccgggattaggcgaggagagggaaggaaggagggagggaagggacgcaccttggggggtgggaaggagaag

SEQ ID NO: 31554 - DNA, 242 bp, Oryza sativa
tgttaattgcacacttcattgagtcacttggtaatgatcttaatagtcaaatttatgaatcaagcagcttcgtttgaaattatctttagagttctttcactactttagattgtgcattacagccttcgcgcattgcaagttctgtatagcaattctctgacaggccggtaggggacacacaaagcgtcttcgtccttgcaatgacagtacgtagctgtcgtagcacatgtttatcttctaga

SEQ ID NO: 31555 - DNA, 1501 bp, Oryza sativa; identical to SEQ ID NO: 24486

SEQ ID NO: 31556 - DNA, 282 bp, Oryza sativa
tggtaattgttagctttaggtcaaataaaatggctatattgttgtaaatatcttaatttgagcagctgctagggatgcaagtgggtcatattggactttggtcagcccattgatgcatcctagtccctttgcttgaccattaatgcaagtgccacacgtgcaaaataaacatccaactaaatgggaagcgaaccactaagtgggtgggttttgtatccttcaaacctgtcacaagctgtcatatttcatttttgcaataattactaagaacatacatgtaga

SEQ ID NO: 31557 - DNA, 1501 bp, Oryza sativa
aaagctacgctcagattgaatggttttacctacgaggaagcactttcgatcaagacctaaaagcacacacccactactgtttcccgacgcctactattttttctactccctccatttcaggttataatacgttttgactttaatcaaagtcaaactgttttaagtttggctaattttacagataaatatagtaatatttataatactaaattgatttcatcaaataaataattaaatatatattttcataataaatttgtctttggttgaaaatgttctttttcctacaaacttggtcaaatttaaaatagtttgactttgaccaaagtcaaaacatcttatatcctgaaacagagggagtagacaacataataaaatttcatctttacttaatgagttacaaccaattattacacaaattcacacaataacgagcacacaccaacaaatctaaaaaagctcgcccaaataacatgaagcaagcataaactaatatgcaccaatacaaggtaaagaccccacaagatggtgaaaagttgcataccatttgactcgagtttacgacatgcagtatttattagcttaatgtcatcatcacacctttatagttgagcctaaaaccggatccagcacgttgcccaaaaaaaacctacatataatatttgagcggtgatttgtcaaaaaaaaaacaaatcatttctcctaaaccatagaatccaacatatagcatatgctcctaaaataataagtttcatgttttctttatcaatacccacaagccaatccccaaagatatgagatgaactatgtggaggatataaaccataagaaacctgtaatgctctccagagcaaaatggcactccatgaataaatgatggatcccctcatttttattgaaaaaacaacatctcacactaatatttcaatttctcctaaccaaattgtcctttgttaacactatccctttaagcaaataccacataaaaatcttaatcttaagaggcatcttaagtatccagttaattttgttcctcccaatataagtattattaattaaagctaagtatatagaccgaaccgagttactattttgatgaaaatttcatttaaatatttcactttcttctgtcaaatggatatgcacaattgaagccattgttatcaagtcgcccgactagtcgtgattagtcgtaaagtcggtcaagctagtcgactaaagagccatgacttgaccaaatagcaagtcgtgcgattagtcgtggttactcgtggttagtcgtagattagtcgtaaattcagccgtaaattagttgtgattagtcatagcaaatcaccaattcaccatgctaattggcttattgtgtttagtactttagttttatttcttgtcgacttattgttttgctttgcaactctatagtccatagtttatattatatacattccttagcacagtataatactagtaaagattatatattgcatccactgtttttgca

SEQ ID NO: 31558 - DNA, 232 bp, Oryza sativa
cattacagtgaatgatttgtcaagaattttgatatttttactttcacaaattttgttgatgggacatagggacagcacaaatgataaagtagatcacacacttctagaattagtgctgcattttcaataacatttactatgtctggtttcttatgctaactaacttctgcacttccagttacgaattaggagcgcttgttgctgaagattgtgctgaaaccacttatgaagc

SEQ ID NO: 31559 - DNA, 919 bp, Oryza sativa
ccattttgctctggagagcattacaggtttcttatggtttatatcctccacatagttcatctcatatctttggggattggcttgtgggtattgataaagaaaacatgaaacttattattttaggagcatatgctatatgttggattctatggtttaggagaaatgatttgttttttttttgacaaatcaccgctcaaatattatatgtaggttttttttgggcaacgtgctggatccggttttaggctcaactataaaggtgtgatgatgacattaagctaataaatactgcatgtcgtaaactcgagtcaaatggtatgcaacttttcaccatcttgtggggtctttaccttgtattggtgcatattagtttatgcttgcttcatgttatttgggcgagcttttttagatttgttggtgtgtgctcgttattgtgtgaatttgtgtaataattggttgtaactcattaagtaaagatgaaattttattatgttgtctactccctctgtttcaggatataagatgttttgactttggtcaaagtcaaactattttaaatttgaccaagtttgtaggaaaaagaacattttcaaccaaagacaaatttattatgaaaatatatatttaattatttatttgatgaaatcaatttagtattataaatattactatatttatctgtaaaattagccaaacttaaaacagtttgactttgattaaagtcaaaacgtattataacctgaaatggagggagtagaaaaaatagtaggcgtcgggaaacagtagtgggtgtgtgcttttaggtcttgatcgaaagtgcttcctcgtaggtaaaaccattcaatctgagcgtagctttattcgattgatctttctttttagttgttactaaaacaacttttgtagactcttcttacct

SEQ ID NO: 31560 - DNA, 338 bp, Oryza sativa
caagcatccttctccccgttgggaatagtacaaggaaagaagccaccctagactacaccaaccatgcaggttgcacctactggatagatatatatcttgggatccatgtcaagtgatcatgcaacttagccattgttgagcatatattatatatacataaaaaataaaaagcctaggttcattgtactgtaggtgaaaacaagggacgagcatatcaggaagtgatgttaccgcttagcgatatgattatggtgaactttgaaggtatatcagaatggacattgacgaaattaaactgcatgcctagcttgctatactactaccactatatatgtagg

SEQ ID NO: 31561 - DNA, 746 bp, Oryza sativa
gtattgcattacgtgagaaaccctagccgtcactcccctccccgagcaaaaccttagccgcgcgcgggtgctagcacatctgcgcgtggcgttccgtccctgtacgtgtggataccgtagaggcgccgctggtttgcggtgctgattggagtgggaatacaacgaggagaacgcacgaggaggagaaggtcgagctggtgcgatcgacaacttcctctacatcgacgcgcgctacttcgcgagaattcctttgacttcttagcgctttcttccactgcacaatgcgtcgagtggtaatgatatatgatctaatacttacatggttcctggtttacgcgatagaaaattttaatttttgttatcgtagcctacgcatatcccaacatatatgacgagttccgacgatggcgaggccctctcctcccacgcgcgggcgtgacgccatctccgtagccgtcccttcacttgcctgatatcggcggacgagatcagcacacgcgagcacgaatcccctcggttcgccccccatgcgcgtggcgataatggcgcctgcggctacttggcgattgaaccagctgccgcggtgacggacagcgtcgttgtcaggcggcctgttgccgcgagctaatgaatattctcctccaagcttcagcggcgtcgggcagctctctctgttttgctgaatgtcttctgtaatgaactgcaaatagaggactaggagggtgtggttgtgtatatgtttgtga

SEQ ID NO: 31562 - DNA, 316 bp, Oryza sativa
cacacccctcactgtgaaacagtctgttctattatcctgaacatgagatatacatgcatgctccagtacttgcgcatgttccagtacatgcgacaatagagatcactgggatatggttcattaggataaggagattatctccaaatttgtttcaccttcttatccattgtaactgaatactgtaagccatggtagaggctgtttctaccactatttaacagagatgcggcccgaggcaaagggttcaacgcttcacattttatcacatggtatcagatcctttttccacctcgatagatcgcatctttcatccaca

SEQ ID NO: 31563 - DNA, 161 bp, Oryza sativa
aacctcaatagtagttttattatgaaagatgagatacacatgccaacccaaaagaatggacaatgccaaagctagtggacacaaaaataccccgcaaatgatctgcacatttgaaacatattattcacttagcatattatacaaggtcatattatacagca

SEQ ID NO: 31564 - DNA, 1501 bp, Oryza sativa
attaaccgagaattggaccacttcgccgcatggttcctgctttgcgatcgtcagtagtgacgaatctcgcactaatcgtacgatggtttcaccctcctcgtacaaggaatacgcattacctatacctccatactataaaaaatcaatataatatcggatgtgtcatatcggattctaaattcgttttttataagacggaaaaaacagttttaaaagtgacatatcttattattactaatctggacatacatctgttcagaaaaagtacttcaattaaatcgaccaatttatttttttttactttttttaacctttcgagtgcgtgtatatcacgaaagcaactgcaaaacatgcgtacgtacgcctgcttcctctcagagctacacaagttggagaaagttgagcctcatctccactatgttcggcgaaaatgtaaaaaattacctaagtaagatgcatcgtgcatcggggtaacctagctagtaattagttaccgctgctgccagttttggaccaaacataacatggaaattatctggctttggtgtccctttcaaaaatgtcactatatagcctgtcttctcctgaatggattgggaccgggagaaatctcaagaaaaaccactctgtataatctgaaccgccaaaattaaacaaatgggcactagcacactggtgttccaaatgtccatgattagctgcgccgaccaagttgaaaaccaattcagatacaaactgactactgtagagagggctcatgtatgatgtacataggcatgactagcgattagcgaaatgctatataatttcaaatttcatttgaaagcgaaaggaagcacaacagtcttcttgccttgatcaatcatcaatccacgtatcttagaataccattaagcggaacgaacaatgcaaggccacttgtttcagtttcagaaccacttcaagctcgatatatattttgaaccaatttatattttaaaaatagtactgaattttctgatgcgtacgtcatgttcagtagtaccgaactatttacaaaccatagattcactacagctagttaattttcatatttcgcattaagctgctagagatatttcattcacgttacactcaattttttttaagataatagaaatgggttacatctccggcctctgctcgtagacacacagccaaaaagtttagaagtgaatagaaaagagcttaaaaaagacgagatgggacaaacccccaacttctaccgataatatgatctactaaaataatgtttttaaaatcacgtagattctaccatgagattctgtaggtactacgctatccaaactgaaataaaagttacttggttaccaatttcaagcgtgtagcaccattgcgtatagtatcctgttgtttctgtgaaagcatcatacaataagagtaaagccaattagaacacacgaagataatctgcatgatgttagacatttttttatggttaagaactatatcattacggcat

SEQ ID NO: 31565 - DNA, 237 bp, Oryza sativa
ttggattaaaatatgccgaattatgaccaaatttccaacagtgatcacccaatatgacctgaaacagcagaaaaatcaacaaaaactagtctcataaacatgtcacaatcgatgcccatgtcaaatgtaccttcggtctgaatctagcgatttctaggtagacgtgacaattatgcggattctagtcgctattgagaaatatacatagcgaaggaggcaaggaggattctaggtaga

SEQ ID NO: 31566 - DNA, 1501 bp, Oryza sativa
acttggctgctcgcacaggccacgtgcgatgaagggcctcctcgcctaatgggcccgacaccgagccttgtgtattatcgagccaacgcagctgttgtgggtcgccgcggccttattcattttccctatatttttcacccaaaaatatcatttaatgtttacaaaactaatttgtaatcactttgagccatcattttaagatataaaattgctgaaaaatttgtgtgtgcattttaatttatttctaactaaatggaaccaaggaaagaacctagaaaaataattaaggcttccagtaaaagtttttatccatcattcatcacacgcggaatcaacttcggtaattagtttcttttggcaatatttagttttctatttataatcacatccatttcctaatctacaaggtataaaattcagagatatttgtgatgtatatacaaatttgagttgcacatgtgttataagtacacaagcaatcttaaccatccaaccatatttgtttgatattcagttccaacagacatatttgctagtatacacacatgtatgcgtgtgtgagaaaaaaacatttaatatctgtgtgtttttagcggtttaaaagccaatgctttaaaataaactacagcaaccccctcccacctaaaatcgaactcagacaaataagttttaaaaattatattttctctttcagctaaatgatgatcctccaatccatcctttcattaatatttaacttacaccacgctaagacaaaaggatattaggtgcaaggactgtgatagcctagccagcaaaaagtcatcacaaaccacacgataataagagtatcatataacaggagtacatgtgcagattccagccgaagacaggacagcaatagtttacaatagtttagtgtgcttacataacgcacagaagcatttccaccaaagattttttttattttttttgaacttttttattttttaattttaaaaataacccctttctaaaacttatttctcgaatctaaaccttttggccaaaacaatactgagttttatcctggcgtggccaaataacgctgtcacgccagctagaccggcttgaccaaataacgctatcacgccggtctggctagcgtgataatgttgttttgtcaacccagtccggctagctgggccaaaaggttcatatcttgaaattaagttttgaaaggatttatttttaaaattaaaaattgaaaacgtttaaaaaaaaccgtcttccaccaaactcggcatgcttacacactcccatctattttaattttagcaatcaatgacccaactgcaccggatgcaacaaatatggcagcaacattacagccccacattagcttatctcgaaattcccctttgggcatcccacaagaagtcaacagcctgtgtatatgcatgccagtacatatatgaaggtgaatctagggtggaaaacaataataagccttaaactcaaaagctaacataccggttgatac

SEQ ID NO: 31567 - DNA, 759 bp, Oryza sativa
ctatagctgtagcgcgtttctcgttaaaagcatgtactactagtatcacaaattacaggcccggtagatcctactactaggagttaatagttcctagaggtgcgaggtgtgtcctagatagatatccgatcgaacatccaataatcatccatgtcagcaggaactctcaacctatgaaatgaaggggaaaaaaaagaaacagaagagggaaaatatatatatggtcactggatgctgctacttttatacaccagaagaaagaaaaggagggtgaatatgtataccagacataaggaggaggagttggttctcctagcgagcgttgacggactggcatgagtcatctagttatctgcgccacaaaaggctgcagcagccagcgaaaaggaattgcctctgctgctgctcctgaatcgcgtgaaatcatgggggtcgcccgctcgtctcgtccgtctcatcgctccccctcctgtactgacagacacgacgagattcctctcctctcctctgctccccttctcttccttccatcatcgatccgccgcagggaggagggatcaggcgacgaccaccaaaaacccacaccgatccgatgagagagagagagagagttgggaggccagatccgatctccccattagtaacttatccctggaaagaagaagagagggaggggcacgcgaaattccatccctgcccctctcccttatctgactcactccttcccttcgctcgctattcacggactcatcgtacgct

SEQ ID NO: 31568 - DNA, 1501 bp, Oryza sativa
catacttacgcactcccatctattttagcactcaaagtcccaactgcactggacgcaataaatatcgctgcaacattaccgccccacattagcttatctcgaaactccccattgggcaccccccaagaagttaacagcctgtgtatatgcatgcacatatatgaagctgaatccagggtgaaaaaaaaaagaataacaaacttgaacttgtaagctaccacatacctgttgagataatttctatcttcgctcttcagtttcctcacttcctccacatcttcaacaatctccctttgtgccatcgcctcaaattcatcaaatcgcctgatacttttgacctgattatcattcattaccttgaacatcaattgtgacaagattgatcaagaaacgagtcctattgttagagagagaagaattcatagacttcaatatcaatagttttcaggatgtcttcccaatgttaagagaataaaatgaacatttgcatactgcagggtaaggttagaagttagaaccagagcgggccagtgctgtgcagtggtttgcaatttagtgagttgagtaatcattactaatgcaagctatatttttctgttagtaactcttcaaaatgattgtattctctgcatatgctttctttttttacaaatataatctaacatgaatcacacacacccacatttctttaactatatgcaattatttttttaggcatacaaatttgagactggtgcatacatgggttatttgcattcttaacatgtactgcagaagattgacatttcctaacttcaatctatgttggcaacttggcatcaacaaggaagcaaaaatcacatcgttcctagaacatatcctctctaagctttgaatggaagcctatctagcactccaaacatatcctctcgaatttgcaatatctttgatataacatcctaaagtggattttgcaaggtggttttacccatgcaatatatgtggaacatacacaccaaactctctcctatgtatcaatctctctctctctttcaccaacaaaccaagcactggaacaatgccaacataccatcacagttggtcaaaataaagagtgaggattgatgaagtatcaaagtatcgttgtagtttgccaaaactgcctgtttaagcttcccataggcaaaaccaccatggaaaatcacattctatggggttatatgggttaaactgtaaactttttccgtgtgcacattttttttgggtgtgtacgtgttctggggggtggagtgggggatctgaagctggtgttgaagttccagttggtggattggacttctgttcaaagtttaggaggtggaccatttattctaaccaaacagcattatattcatgtggccatctttttctcccttttctgttgagaaagatactcccttttatttaataagtaataacacaaggttgaactacatagaaagattctcccttttatttaataagtaataacacaaggttgaac

SEQ ID NO: 31569 - DNA, 1501 bp, Oryza sativa
ggagattgggaggaactgattttttccaggggagtggagattgggagagcactaattttttttcttcaagaggaagggagttgcgcgcgtgaggaggggccgagggggaggagaggagttgcgccgtgcgttgggggaaggggcggacaggagcgcggggccagcatggaagggcgcacgcgcgggagaggataagggcacccacaatggttatctataagctctttacaagagatctatgtcagcatatttttctatttggaaggtattaaacgaatagagagagcaaagctatctactaacttagagatagtctatagagaaaaacgaggcaatgcatgagagagctatagataacaatgtagacatactattaaggtggtttactattaatcgagtcaggtgaatgggagggggagggtttgggcttgttagttgctaaaacacctatgataggtatggcctcaataaatgcatgtttaaaaaaataaaattgactgcattaaaagaccaaaagggcatgaaagacaccatgtatataactttctagtttattgttgtatacaacgtgcttaattatattcattctatgactaatttcatgttaatacactgtcaagaacatcggtttaaaaaaaactagtcctatttctaacaaaacaatttgaagaacaaacagaagctcctagcgtactgtgcttccaactggtgcttcttctgcttacgaccatcttctccacatgataccgcggcgacatatgtacggtcgttggatcactaagatgatgaaccagcaacttatcccttcctatctttagatcttgactaagaaaagaaaggaagctgtcacgctacttaatctgcaaaacgaattggtacccgtcagaatataagaatgaattgaaataaattacacacgaatcacgctggcaaccgccggtgacggcaccggtgaacctcgcgacgataagtggcggcgacgatgaacctcatggacgaccggcggtggcgatgacaaacctcatagcaaccaacagcgtgtaacgtcgtggcaacgaagctagcggatgaccggcgacggcgacgaaaccttgcagacaaccggtatagcagccgtggcgaccaacctcgcggacgaccggcggcgtcacggcatggcgaccaagctcgcagtagcagtagcacagcatcatccaccatccattttgctttagaattcgtgctatcaaaaaactgagtattaaacgaattagcgtcctattcctatccctattccctaatccgatctgcgtccggccatcgtcttcttcttcttactgtgggagtgcaggcctattcttgttgggccctcaacagaactcggcccagcaactaaaaattctcacagcctctttttttttcttcttttctggctcgaaaaatctttttatttttcttttcgtttctcgaagttaagaataggacgcagttcttctctcggctctcgctctcgtcgggagaa

SEQ ID NO: 31570 - DNA, 1501 bp, Oryza sativa
ccttgtcatagtggttgaattaagaatctttaacatcttaaagaaaggctatgtcgggcgcagcacacttgtttaaaaatgatagattttaatccttcatctttagtcctcgtttggaagtgatgaaatgtggatggaatcaaaatggatggtctacttgattaacacggtgaattaatatcttgagaaattaacttaacaaatagctagaaacaagtgttctaaacaatacagtagaagaaagttattttcagaaatcgtattttcggaagtgtggagcaaataaatcgatccagggtagattacagttgatcatcacttcagaaaggggccttagttttatggatgacttaattatcactgtgcgggtacagtgatattgaacgtgctaaattttatggagaactgcagttaaatataattcttttgtataaatctgatagcagatgtagatgtctaatattacgcacgttgatgtgcaggttgatgcgttgctcgaggaaatcaagaatacgccggttagcatgatttccgatgacttaattatcagaactgtgcggcagtacgtaaacctctgaattgcagcttctgttattatttgttgtgtgtcttgttaaccatcctaaattgataattactattacctgtccttgtctgcttctctagttctattttggctcgtcagcagattcttgttcaaaatgttctccgatcatgggttattgctgcagcagttctctcaggctattgctgggggtacaacagagtggccaaacgtcctgtggctggctctgaaccaccaacagaagatgaggtgtagaggacttgacagtgttttcttttggagatgggagtctagaagtctgggagaatcaagaacgtagtgaactaagcatgtgtcataatctatcctgtgtatcagtgactctgtgttaactataactaattagtcctagagctaattggtgtggggattctgtaatgagagatctcgttcggtttgacctgtacatgtttctctggttgcggattctgttgccgaaactgatatgtgtaatgggagatctctttgggttgatctctgctttattttgttgagcaaatttgcaagaagataacggtttttgcccttttttgaatatcttttgcctcctcacgaaaactgacacgtgctaggctagtttgtaaaaaactcctcgttatatacataatcttacatcgaccctctcaacacctgatgtctaagctgttttttttttaatataattgtgaagtgaaaaatctgctttcagggtagcactgtagacataaagagtataggggtgtttctgaaaacaatcttcccttgttccacctatccccactccgctagccaatcaggaggcatattcatcagccctcggtcgatcgtgcaaggtgggccgtgggctgaaggcggagtcgtggacgcggagacagaaacggcgtcgcttcagctgcaatttttagttccccccttctt

SEQ ID NO: 31571 - DNA, 1501 bp, Oryza sativa; identical to SEQ ID NO: 31401

SEQ ID NO: 31572 - DNA, 296 bp, Oryza sativa
gtcagttgtttgctgaagctccgcaagactgcaggatcgctagcgaagtggagtaatcagtgaagccagctgtgaagcaggagtgaagatcttgagaacccgtcacagaacctaagccaccctctagggtagagtcgttagtcgtgtgtttccttgcttgtgtgtgtagcgcgtggtttgcatcagtggggtgtgatgtaaccatgctaggttgtttgcttaatcaacttgcagaataagcctaacatacatcataacagcaaaagacttagatctgttaaggtactatccttagt

SEQ ID NO: 31573 - DNA, 1501 bp, Oryza sativa
ctaccacctagctaagtctgaaaatatctagcataccacttagtctactttgcaccttcactaaaattagaccataactcctttagtaaaactctttgatcaacatgttaaacataatgcactctaccactatatatgaaattacttaatctaattcaaaatattaccactatatgcactctaccactatatgaaattacttaatctctatataagttaaacagtacatagagatgtaattttttatttttatttcattttttgatatttttttcacacttaggagaacataggaaccaaccgtataaaaataaactcaaacggacaaaatatgtgacatgtagaattttccaaaactctaccgaaacggacaaaatatgtcatctattaaaataggcgtaactttctcatacggacacggaatcaggcaaataatatatgcacgggcatctacagaaaaagttacatccgattctctccagctttgccgggttcggcgatattaaaacctccaaattccgcttgcaagattgtgttttcgaggagagaagtttttcggtggagctttggaaaattccacatgccacatatttcgtccgtttgagtttattttttacatggttggttcctgtgagttcctaagtgtgaaaaaaatatcaaaaaaataaaataaaaataaaaaagttgcacatctttctcctctgcactagttcggagagaggagaggagaggaaaaattctacatgtcacatattacgtccatttgagttcaatttttctatggttggttcttgtgtgtccctaagcgtgaaaaaatatcaaacaaataaaacaaaaataaaaaaattcgggggggcgccagccactctggcgcactccccctagccacctcagcatcgccccgccacgtcggcagggggacggcgccaaagaggctggcgccgtcctgttgaatgacggcgccaggcactctggcgccccaaaaaggaccatttttgggataagtttttctaggggtctacttacgaaataagtttttcaaaaggaccaaaatgtgaaaaatccaaccaccctacgagagtgtctattaaagggcgcgacgaatataccgagagcgtagcgtgaagctggagtgaatgcgaagatagagcagctggccttcacagctctatcgatcgctccaaacggttcagtgcagaggtccgtttcctgaaacctttcaccctcagccttcgtcttgtatgcatcgtccccatcgtctcaactcttttccaggttctttgaaaccgctgagaccatggaaggtgtagaatcctgcaatggccggcacgccgacgccgacgatcgccggacgtccaagaaggatcgccggaccacgtgggccagcgctttcatcctcggtaacacaaaacacatactcattatctcattatttcgagatgattttgcatctgtgattgatgtggatggatgcatcatatgctgtcacgtatgggggcag

SEQ ID NO: 31574 - DNA, 439 bp, Oryza sativa
tgtcgcatataggcaatgtgtttatccatataaggatagtcggcaacgtgtgaactgttgcgtttgccatatcacacgaatgatctggcgcctactagctactgctggaatggaagaaatagcccgccacgcgcatcactctctcctgaaaatcacggcgcatcttctaaaatgccaaaattagagcagccatttttttgccgtatgcgtcgtgctgatctgtctcgtcacgaatagcaggaaaaataagatcagtccaactttgcaatgaatctagacgcgcctgcattgcaaggaagaactaccgctcaaaagtgcaacagcgatggatgctgcctgcagggagagtccagccgtggtagtaacacacacacacaaaaacctgtggctacagtaaacgcaacaaagacacattcacacaacacgtccacgtataaga

SEQ ID NO: 31575 - DNA, 1501 bp, Oryza sativa
taccacctagctaagtctgaaaatatctagcataccacttagtctactttgcaccttcactaaaattagaccataactcctttagtaaaactctttgatcaacatgttaaacataatgcactctaccactatatatgaaattacttaatctaattcaaaatattaccactatatgcactctaccactatatgaaattacttaatctctatataagttaaacagtacatagagatgtaattttttatttttatttcattttttgatatttttttcacacttaggagaacataggaaccaaccgtataaaaataaactcaaacggacaaaatatgtgacatgtagaattttccaaaactctaccgaaacggacaaaatatgtcatctattaaaataggcgtaactttctcatacggacacggaatcaggcaaataatatatgcacgggcatctacagaaaaagttacatccgattctctccagctttgccgggttcggcgatattaaaacctccaaattccgcttgcaagattgtgttttcgaggagagaagtttttcggtggagctttggaaaattccacatgccacatatttcgtccgtttgagtttattttttacatggttggttcctgtgagttcctaagtgtgaaaaaaatatcaaaaaaataaaataaaaataaaaaagttgcacatctttctcctctgcactagttcggagagaggagaggagaggaaaaattctacatgtcacatattacgtccatttgagttcaatttttctatggttggttcttgtgtgtccctaagcgtgaaaaaatatcaaacaaataaaacaaaaataaaaaaattcgggggggcgccagccactctggcgcactccccctagccacctcagcatcgccccgccacgtcggcagggggacggcgccaaagaggctggcgccgtcctgttgaatgacggcgccaggcactctggcgccccaaaaaggaccatttttgggataagtttttctaggggtctacttacgaaataagtttttcaaaaggaccaaaatgtgaaaaatccaaccaccctacgagagtgtctattaaagggcgcgacgaatataccgagagcgtagcgtgaagctggagtgaatgcgaagatagagcagctggccttcacagctctatcgatcgctccaaacggttcagtgcagaggtccgtttcctgaaacctttcaccctcagccttcgtcttgtatgcatcgtccccatcgtctcaactcttttccaggttctttgaaaccgctgagaccatggaaggtgtagaatcctgcaatggccggcacgccgacgccgacgatcgccggacgtccaagaaggatcgccggaccacgtgggccagcgctttcatcctcggtaacacaaaacacatactcattatctcattatttcgagatgattttgcatctgtgattgatgtggatggatgcatcatatgctgtcacgtatgggggcagt

SEQ ID NO: 31576 - DNA, 309 bp, Oryza sativa
atcatttgtcctttttggcacagatggttggttgaactggaattagatatttgaatgaatcagtccccccacccttttttttttcttttgcttttgctaattggagaccaccatgccagtggttgtttctgctgcctcatggaaaaactcttgatcaaactgtgtcgttccaagtcaacattcatacaaatggactgatttgtcaatattgtctactattgccaccagttttctttatgtctgatctctacagctatggattattttcagttgttttaattcaataaaatcatgtacttgtaggtgagc

SEQ ID NO: 31577 - DNA, 1501 bp, Oryza sativa
gcatactgtctgatggagaatcagttagtagtgcctattgattgttcaaacagtgcccttggttttgttgtagaataatcgagtttccaggcattgataaaacaaaacaaatctttaccttctactaagttacaacccactaaacatttaaagttcaacataataattattagtacatcttaaaatctaacatgcaagcatatcacataactcactaaacacgtaaaacttaacattcatacataacaattatatctaccattccttacattccaaacctcaacataaaagcataaattatcatttctcacacttttttcataatttttcaacccaaaccaaatttatctataaattttatggcatttaacatatattcatttaatttaacgcatccatatatcccgcggtaaaacacaaggctccatctagtgtttttggagcttcttacaatgggtgctcacctcacaaggcaatgtagtgtcttgcagccgctgcgcctcgccacctgcgtccatttctcttgttgccgttgctgctctcgtgctcggcgtcataggcgatcatccacctcctgggctttcacagccgcttgccgttccaccttgagaccgggcaagggctccctgtaagtttcttctggagatgccaatgttaaggggaatctaatcagtaaacataggggaatcaggagtggagcaggcaatttgtttgatttatgtggcgagaatggtatgggggagaaaacgaggagagattactattggttgaattgctaaaatcaagaagaaaatgatgaaatgcttcctccactctaaattataaggcacaaccatcactaacgcaaacatcaagaaatagttattaccatattctcgtttggatcactttaataaatgtaatgtatgcacctaatgaaattagagatcttgaagttagaagatttttaaaaactaatttaggaaaatggagatgctaagttaactatatggtgtgcattacattatgaaacatcacgaaaaaagtggttgtgcttggccttatatttcagaatgacggagtagtattaaagagatacagtgaaccactataaaacaacacttattacatatctttaactcaaactgtatttatttagagagggaggaagcagtgtgtaattctaattgacacagtgaatcattacacattttattcagtcatcttacgcatgcttgtactttgaacaatataaataaaatttataattctttaataaaacgaatagtcacgctaaaactcaacaccatcttatatatattagaaaacagaggagtattttagcattcccttttaccgctggcctctcaccatgcattcattggcttgccgagagctcaataaagctataagagcactagcagagtaacagaggaagcacttgccagccacgctcctcttggatctccactcctcacgatgggttctcatcatcgccccaccgcagggcaatgcagcctcg

SEQ ID NO: 31578 - DNA, 1501 bp, Oryza sativa
atcgtcaatatatatgaacagactgtgtctttcctgatgatgtgccgccaaataaaaacttgatttaattttcttttgcagattaccgctagcaatctccctatcagttcgacacccagcggtgtggaattcgtatatacaagtatggttcacacaacaagggtgcaaatatctttgacatgctcatgtttggccacttcagtctcatatctatggatcgaatcagtacggtattagttctcacattttgtgaattccaaacgaccaaaactagggttaaattcaaaccagaaggcattcgaacaattggccaaagctaaattcatgacctttcaacagtaaacaccttgtaatttaccgttatttttttgttgtttctgcagagtttcaggcttacattgctcaccgtgaacctctgtatcggatgtgcctttgattagtatttatttaaggatgactgaacatggcattcactattctctctgtctctttgtttactaaataatgtcccctgacaatgttatactagggactgttgggcagtttgtgcttatgcacgtaacacctgaattttaatatcactagaaaaaacgcgcggctttgcacgcgtggtacagtgagcctggcccattgggcctagtgaacaggtaacaaattaatacgcatatatggaatagccagattaatagtagagataactaaagcttatattagagcttataagttggctataagattgtctctatatttctttttcctctctctttatcttacttataagaatttaatgtgtttaccttgaagcatgtgtagagttagattttactcgaaagccaacactatatatatatattttaatctctatcatacacgtaagtttatagcccactattatttttgttctaagagcaaattttatgagcaagttttatagcagaggtgattgagaccaccaatttattcacatcatcaactaattaattaagatgtagcatatgtaataaattgtctctaacataccggctccaattttcatccaatccacaccattcttttcttggagtttgtgaagagattacccctttcatgaggggtggttacttctcacatactgtcttgtagctcgtgctgcaactaactaataatatgtagtctatttttcttcactctccttcgatgttctatagctagcttattgctttatattgtacttgttctaaggttgcattcgataaagggacaaacaaaggaaacgtccatcatttttcacccatatgtcggagtgtttttacataaaaatatctgtagaaaagttacttttttaaataatcatatttctatatttttcatgtttgaaacagtcctaaatcacctgatgaagcgataatggcacacctcttttacgtatctcattttttccctcttctctcaaatatagcctaaggtatgtttgtaacttaggaaaataaaatacatggaagaaaacatttggaatataaaa

SEQ ID NO: 31579 - DNA, 201 bp, Oryza sativa
ggcgccgtgctaagaccgcgtgcaggcggcaacgctgcaggccggcgcgccgggcgttccagcgcgtcgcgtcgttcttcgtgcaggagctcctggaccggcgagcatccgccggcgctgggccctgcgagcacggcgttctgcatcccgcagtcgtcgtgcgcgaggcgtacgcggaggggttagggatgtacctcgagt

SEQ ID NO: 31580 - DNA, 290 bp, Oryza sativa
caaaattcaaaataaaaataaaataaaatccaaaattagaaaaggaaatgagagtacaagtaggaatacaatttaaaaatagctgaaattcggtattaaaaataaggaatattaaaagaagagttcatataagaacccaatacaagattaattaaaatttagaataaaaataaataaatccgaaattagcaaaagaaaataaaataagagttcaagtaggaatacaatttaaaattagttcaaattcggaattaaaaataagcaatattgaacgaagaatccatgtaaga

SEQ ID NO: 31581 - DNA, 1501 bp, Oryza sativa
atcaccagtgcggtttgggggacttcgtcttctactttcactctggctcattcgtgcacagccgccaaagttaccactatatctagggttaggcttgatttaggaatggggatcaggtgaaccaatatgagtgcaatgagaaggtataatggtcatttcaaccaatatgagtgcaatgagaaggtataatggtcatttcatatattctcagttaattttatctaatattcacaatctcttattggaggcctaccaaatggtcatccagagttggggtatatggcaacttcattttaaaaaagcagaggaaaattcacaaacctattttaggagaacatcacaattacatctaaaagtagtgtcaagaacgtaattgtccctaacttataatggtttggaccattagaaccacttcgatggttcgtcattgaaactgtaaacgatgcccaatgcatatctctactaattaaaagcggagtcgttcgccttccatcacctcttcttactatcgccgtgcattgtatctttcacaccttcatgttcgtaaccaccatctccggtgcttatcctcaatccgccttccctatccatctcaattgaccttcctagcccatcccaaattgtatgggtctggcccattgcaacacacgagtatattatatcagtgactagaatagaccactctcccatcctacctagaacaatttatcttggaggtgaaggaaaatgatgttttatttagttctgttggaaagcagccatattgtgaaaacctccctacgcttctttaccacaaactacctcctccagtcctcccccaccacaacgagggtgccaccaccccttgacaactctgaatagaggcaaccttcactggaacaggatccctgcagtactctatattgacatgtaggttctatattattgctagtgcctcctaatgcagaagaaggcctgcgcacaagttgcttccacttgtatagtcccagtacttaggattgccggttgctacacacttttattggtacattaggatgtaggtttcaatattttggaccaaaatttctagatattatattaaagattcactagttttcatatattctattatctgattctgctcaaaaatttcaaaatttctctgctttagcaaaaggattattcaaatttttatttttgaattaaatataaaatcatggtacgattttttttatggagctacctgaactatagtatcaatcgttaaccaaataaccaatctgtaccagggcgatgcagggcaatggtgccaccaccggcttagggaagaagagatggaggaggagccggccggtttcgcgggcctcgttactcgtaagcacttttaacgtacagccagcaagcccggtggtggcatgctggaacgggcgagacggtggcgctcgaggatgagtacgctcgatctgaagcgctcgtgttggggagagagacagaggggaagagaagacatcaaaataagggt

SEQ ID NO: 31582 - DNA, 1501 bp, Oryza sativa
tcttctccaaagcttctctgactgaaggggggaaagattgagcaagaatgagtacaaccaccgtactcagcaagccacaccagcagatgcatgattaatgcaagggggtacaaggggataataataggggttaggttttacagtaaacagcatttaaaagtcacttagttgcccaaagctattttgtaaacacgatccaagagctacacaatattattaatcaaggacgtgaacctacacgaacttgccttaacccaaggcctacgatgattcagaccgaattggcaacccgacctgggtcccagctcgtcccaagccaacccaggccaacctttccacattttagttgttaagcaaattttaagaattaaaccactaacttgggtacattgctaggcttgcccatatccgatggctcggctattcgaatagatttactctgatcagatgtgtacatctttacccacaagacacatctttactcccgttccatggccttggaacccatcgtaaacatgtgacataacccttcacccatcctagccgtgaacaaaagtaccgacccaaccctgcctactgccggtatcccgggacaggcaggctaggattgagcccctagcaacaagatctagaccgggtgcgccacacacataggggtgagaccacccgcgtactagtccagtgccatggcatctcgactaacgggcaccgacccgtgtagtcttcatttgcctagacatctcgattaccgagccgcagctcgcgtagccttcatttgccttagagatatccatcgtcgcaacgacttcatccatctctatccgtgtccttttgttcaggactagactgagcaccgagttaagccttacccattagacatgtggttagtacggtagtgctttgcaacagaggcccgaagaccggtccttatagtggccgaggtgctactaacaaaaccctgcacctcgagctcagcctaaaaccattttgggagttttgaatagagggggaggtgtgtgttcaattccatcacaagccaaccattccacagtgtccaaatgatatgagcatccctaaagtctaaagttataaaaccacctaatgttgcctaattattcagcgagcatctacctaaattcatactagtggaaccatgaatagagtacccactagttggggttttattttcctagggtgaacaaggtaataataaacaatagcaataataataaggtcataacaaaggtaaataggcatggctaaataaaacagtgataacgcgggaatttaaataaagcgataatgcattaatttaaatcaaaataattttacaaactaggattcaatatgctaaaggatgatgtgatttaccttactcagagagaacggccttccgaaccttcggcgacaaccgcaaaccacgcttcaggaacctccggaacgacagaagctacgcgaagcacacaagcaaagctacaagcctataaagaagtaataacga

SEQ ID NO: 31583 - DNA, 1501 bp, Oryza sativa
agattggttatttggttaacgattgatactatagttcaggtagctccataaaaaaaatcgtaccatgattttatatttaattcaaaaataaaaatttgaataatccttttgctaaagcagagaaattttgaaatttttgagcagaatcagataatagaatatatgaaaactagtgaatctttaatataatatctagaaattttggtccaaaatattgaaacctacatcctaatgtaccaataaaagtgtgtagcaaccggcaatcctaagtactgggactatacaagtggaagcaacttgtgcgcaggccttcttctgcattaggaggcactagcaataatatagaacctacatgtcaatatagagtactgcagggatcctgttccagtgaaggttgcctctattcagagttgtcaaggggtggtggcaccctcgttgtggtgggggaggactggaggaggtagtttgtggtaaagaagcgtagggaggttttcacaatatggctgctttccaacagaactaaataaaacatcattttccttcacctccaagataaattgttctaggtaggatgggagagtggtctattctagtcactgatataatatactcgtgtgttgcaatgggccagacccatacaatttgggatgggctaggaaggtcaattgagatggatagggaaggcggattgaggataagcaccggagatggtggttacgaacatgaaggtgtgaaagatacaatgcacggcgatagtaagaagaggtgatggaaggcgaacgactccgcttttaattagtagagatatgcattgggcatcgtttacagtttcaatgacgaaccatcgaagtggttctaatggtccaaaccattataagttagggacaattacgttcttgacactacttttagatgtaattgtgatgttctcctaaaataggtttgtgaattttcctctgcttttttaaaatgaagttgccatataccccaactctggatgaccatttggtaggcctccaataagagattgtgaatattagataaaattaactgagaatatatgaaatgaccattataccttctcattgcactcatattggttgaaatgaccattataccttctcattgcactcatattggttcacctgatccccattcctaaatcaagcctaaccctagatatagtggtaactttggcggctgtgcacgaatgagccagagtgaaagtagaagacgaagtcccccaaaccgcactggtgattgttggcgtaggggatgtagtcatagtagtcgtgcggaagaagccgctagctttatcctaaagggttcaccggtgatcagcagcaggttagcggcgaccttccggttgccacctaccctgctctgggtcagccaaatgttctccctgtaacgcttaactgattggatagggtttagggttttcagggagaagatgatcctggagagatatgatcatcatctgtccacgacatcggtctcc

SEQ ID NO: 31584 - DNA, 1501 bp, Oryza sativa
ctctattttagaaaaaattagaaacttgaaccaactaaattcgagctaagatgaattagttatgaattttcaaagattaaatcagattaaatcatttatttagattttaattgaattatgacgcaataatgaattatttttgaaaaggaaaagggaattattgcgtcagcggctagggttcacggtgaaccgggtgcacggcggcggctcacggaaacgaacggccgatattgacccatccaaaacggacggccaagatccatcggtccacggccagaccacgagagacgacgacgatgacgtcagcggtgacgtcaccaccggcggcggctcaggcgcgcaaactcgccggcgaacgacggcacgacgacgcgaacggaggacaccaacacgtagagggcgacgcggcgaactcaccggtgaccaaaacaacggcggaagatcaacggacggcgatggcgtcgaggaagaagcggctgcaaccttcggcttgacgacggcgacggtcctccggcaacctacggcgacgacggaggggcggacgaggtcggcgacggcttggcgatcacgacggcagccttcccgagcgacgacgacgacaggatcggcggcggcgcacggctggacgaacggctacgacggcggcgctaggctacacggtgctagggctctaccggcgacgagaggcgaaggcgagggtggcgacaagtagcggaggacttggggggtccttttataggggttggaaggcggcggcgaagacccacggcgaccggcgacacgaaggaaagtctagggttcggaggagagagatcgatccgaatcgaactcgaatccacggatttccaaacgatttagccgacgattccaaaagagaaaaggtagaggagatcccgaagatcttttcccctctattgatttcaccggagaaggaaaggcacgagcgaatttggaaggagacggcggcgcggctcggctagggttccggccgggcgacggcgcgaggaggacgacgagtccgacaggtgggacccacctgtcagcggccgagcgcgcgcgcgggcggctgcgggcggactgggccagcttgggccggggagagggagagagaaggttttgggccgactttcggcccaaagccaaaagaggattttaaaaacctttttcaatttaaattattcatgaaatgcaattccatttattaaaaatacttccttagctcaaataaatcccagaaaaatctaggaattatagagttaagcaaagtatttaatgaaattttatctggccccattttatattggaatttattatttaaaattagatcttcttttctaggcttttaaaataaattctaataattccaattaaacaacaatttatatgtttaggatttttagggtgtgacagtgaggcttcccggtatcgctttagagagcaattgagttgagttttgagttagggtttcgagtttagtcgaaatttttgtaaggtgtgatgt

SEQ ID NO: 31585 - DNA, 1501 bp, Oryza sativa
gcgcacggtggagctgcggtcgctggccggcatggggaacacgtcgatgcagcgcatggcggaggagcacctcgggtgggacggggtgacgacgaagccgaggaaggtcgggacgagcaggtgggacgcgcgcaggctgagcaaggagcaggtgcagtacgcctgcgtcgacgcctacctctccttccgcctcgccgtccatgtcgtcgccgcgccggagccggacgcgacgtcgtctacctcttcttccgagtaatctgatgcattggagaagaaatacttttggtttctgaaagttttttatatggttaagacataattagggtggattaaattattgagttccaattattttctttgtgtacgtgtgcctgggttatattagcagccaactttgtgttcagtgagggaaatcagaaccagatgtcttacatctgcacaagctaagtcttatactgcagtgcacacactgtctaatgaagtataattttagtatattagagatttttgttgggtcagaaaagctttgtgacataggctggaggctcaggtttttcactgagctttctgcacaaagttaatctaatgttttcaccagattagcagccatgaaaaagccagcaaaatgctgaaactctgaacgcaaacttgccatgcatctaggttcataaaatactttctcaacttcccgtctgtttagctgtttacctttagagagcatttttttcgaacggtcaggccgttgccgacgttttgtatataagaagaagatgccccgttttaagaagaagcgagaccaaaccttacaatgctgccttgttcatcagcagtgatgactgacgggatgccaaaatttcttgtatatcctctgccaatgttcttcctgaaaacttaatggcctgatattttatatcatctgggtgactcaaattcagccatggcctgaacctgaacctgaacctgaacatgttcagtttagacttaaaaaaaaggagatttagagggagagtttttaaaaagaaattgtaagcgtgttgaggattgaacacagaaccttaggattaaaaccatacaccccaatcgtttagacttgagagctacagagcatcagcagcgatggccttggccgtctgtgcaagacgaggaggaggaggatggccatcagcagcagaaacagcaagagaggcttgatgtcgagcaggtgatgagcagtgccagctcttgaggcagagccggacatggtcactgtcgtcgtcgacgcggtcgcgaaatgtctccatgtcgtcgtcatccctcctactgatggtggacacgatcatctccctcttccaatcctcgtagcgcgggaacccgcaatacttctccccgaactcgatgtacttctgctcatccatggcgcgccaaatcaatcattcaacaaattaaacaagattaatcatcgatcaagaacaattcgagatccgttttatattagcttctgtgtacctgaggctcgatgccg

SEQ ID NO: 31586 - DNA, 546 bp, Oryza sativa
ctatgccgatttagttaataataataattggtactctagtggtaaaataagtgtaagtgtaagtgaagaataatttgatgtaattgttggtgacttggtattgtaaatttgtaatgtttagatgtgtcatgtatcaccaattgctacattatctaaaaaaaattcaacaattgttaagttgataaatgtggagtgtgatttaagtataatgtgatagatcatagtaagaccattatttgtatataactacgtttgatataaaaatcaaagtaactagagtaccagcttctaaatttatgatgtcaccataatctggaatcgtgttttgatacttacaaggttttttttttccttttgcacggggaatattgtctcccttcttccatttttgtatgacgctgatatacaactcaaaaaaatattttaatatttgacgttggtatatacactgaaaatcattttccaaaagtcatttcaaatgttctttcattttgtcaaacatgtcactgtcagaaacttcctaaacaaaaggatgcagggagtact

SEQ ID NO: 31587 - DNA, 841 bp, Oryza sativa
ggcggggctccggccgccggcgggcggctgggccgcgcccatcgttcatggcgaccggcggcggcattctttttttttaatttgtgatgattcactgagatgtatttgactgagaagttacaaatttgtgattcattgtttggatctgtgatgtatttgagtaatttcttaggatattgtgatgtatttgatttgtgagtataaataactttatgatttgtgatgtggatttggtgatgtgaatttgggatgttagttagatttggggattgatttggggatttgcctacttgattcgggagaaaatgaaaaggaaaaaagaaaaagaaaaagggaccatttgcactgccgctattgtctctttagtcccggttggtaacatcaaccgggactaaagatcccctctctttagtcccggttggtggtaccaacggggactaaaatacatctttagtcccggttatttcaaccggtccatctttagtcccggattcttactcccggttggagaaccgggattaaaggggttcccaaccgagagtaaagatggtttctccaccaatgctcattgcaacgcatggacatatcgaccctaaaaataggaaataaaaaaattctatttttcttccgtcctccgactccagtgcaagccatgagctttccgatgggaagtgcgcagccagtttcatcatccgccacgcctagctctaactcgatctgttttttctaagtacatagggaatataaatagaggctatataccctagatttttttctaaatcctgcactcctcccgcacctctcagctctctcccgcacttctcccctcccctcacctagc

SEQ ID NO: 31588 - DNA, 1501 bp, Oryza sativa
ctgattgcttcaattactagaacattagcgtgctggttggcacgctttccttatagcccgatacattgttcagtgtgtgtttgaaacatgaaaattttataagatattttagcagttagttcaactttcatgttccattaaatattgtattctcttgcatatcattctgagcataatctcctgtaatgttaatttgggattgtgtgttctctacgtttccggtggacgattaattataaatgttgagtttctaataatttcttgatataattaaatactattaagtattaaaaaagtagaaagtaggtggagttaaatattagacggactctaaaaaaaatattagaagattaataagttttcttaaaaaaggactgattgtaggaaaaaaaaagttatgggaaaattgtaagcttacaaagcttgctctcgatgatctataatactcgatccaactcctaaatgctagaagcagaatttgaaattaagttttggcctatgggcggtctttgtgttcactccacccctcatttttctaggtcactacagtctgctcctttctctttttaagtaaaagcagcaaaaactttgttgggcttgagctacagaaaagctgaaaagccctgccaaattgatcagtacgtgtcgtaacactcacctcttatttaattttcttcatgtcttacttctaaccattctgtcattttccaaccatattttatttaataaggggtattgtagttttttcactccatacttgatctccctaagaaaaagggcaggaatattttatacttttggagaaagtacaattgattcgcaagatatgatgataacaggaaacagaaaaacggaggaattgaaatggtcgattggcttggtgctacacagtgatacggtagccgaggagcatgtagctctttttttttattttccttttttaataactctaagttttcttctatcggatatttgaatgcatctaggagtgatgttgctgcaaagggctataatctagatatataaatttggatctagatactttaactggacttattttaaattatgatttttatttgattggttctagaagtctctatgtttattgcaagtgatgtacagtttagaagctaatctggaagcttgcttaactttttttttctaccgcatttatctgaatatttagctgtgacaagtggaccaataggcacacatggaatgtagattaggcgtacatgggagcttagtactcctaggatttgctctggtccaacaaaaagtatctcgaagtatcggtatctcatgttatcaaatcgtttccgatcgttagatctagctaggttggacaatcagaaacgatttgatatcgtgaggtaccggtacgttgagttacttcctgttggacggaagcaaatctcttatataagctagctactccaactccaagctcattactgtgtctcgcttgctctcgtcgacaaggagaagatggtgtccaacc

SEQ ID NO: 31589 - DNA, 1501 bp, Oryza sativa
tgagtgagcattgagcaagctactgatccaacacttaccttgtattaaggagaaataaaaggtgtaaaactgcatgtgacaaagcaagcccaagtggtagctgcagtctgcagatagtagatcacacacaaacacaggtcagcaggtaacagaagcaaaccacatgatataatgagagcagaaaaatggtgctcattaataagaaagttagctgaagcagttggagagaagaagaaagttaattacactcatggagtacacagctactggtgccatgaagaagatactgatcaacttgagtggcattgtcggaaataaaggggcaaatggagaggcatctcctcacatggccctccctacctgtcttctttcattgaccttggatctcctcctcacttccaggttaaagatatgtttttttttacaattgtatatctatcttgatttgattgtgtgagagtttaattgcttcatacagtttttagttaaactttgttctccaaatggggctactagtacaacagttagagtaaaatctggaatgcgaggaagttcttagttttttactcatgttttgtactggaaaatacgaaacgctagcacaaggtctagaattcatttttgtcaatagaaaatggttgaacatattgtttatatgcagctagctagctgtttgagcttttcaccatttctgtttattgtatgattagagctacctaaactagtatagcatttgttctaaaaaaaactagtatagtatttattaggccaactttgcagaaagctttccactgaattggattttcatatgatcatcgtgttgtcacaatcaactaacagttgtcgttttgcctatattatcaatcttgaatgcataagttgacaatatatattttcgcaaccaccacggctggcattttgccttttcttatagggagaactatgaatccttttggtagactaagaatgtttgtgaggaataagaaagggcttttgcttctaaatcacttcaaataatacagctgggcagctactactttccctggctagctccattgatatcataattattcagtatccatatatgataatcatagaatgatgatttgagtatagttcaattgcacactagcactgcttatactactgtaaaggtgcatagttcaattgcgcaagtttagtcagcaatgagtaactaatacagttacaaatgagtagcagcatcatgaaactgaagataatttatagccccctaataaagccagtgcatttgtctcactgtacatcatcaccaaacttcagttaattaccccctaatagaaaaaaaggcagtgaatttatcacattatattcttgagacagagtatggctgtttgcatatgtgtacaaaatgtacaacaacaacaaagctgtaaatctaccagctgcagctgggcatccaacctttgacagtgaagtttactgtcttttactgaagctgaggatgagatatcaagagata

SEQ ID NO: 31590 - DNA, 746 bp, Oryza sativa
  unsure (1)..(746): unsure at all n locations
ctgtcccttganaaccatcttgtgcncgcacgccngcaggtcgactctagaggatcccctttccgtgcgcactttgcatgttgggaacagctgattccaaacacagccttgattcgtttttaagatagaaaagaactaccacagagttgtagtgtgtcaagaaccggtttcctttgggtatatcatgcgtgagtttctctagttttgttgaaacatcaagcttattatccattttattggcagtaaactatcgacttgctatgttagaaaaaacttctcatagaaacgagagtgtcagcaagaacaacctccgcgtgtaggagcattccataagtaagacatgtcataattttaactttggaagaattgtacatctatatctatactaatataaaaaggatgagttgagcctagcaatgcttcaggccaaatcatcgtncctaatccctaccatccatccgcatctgcatcgcatcatcaccctaatccctaccgtccacccacatcgcatcacaaatccgcactaatccactgcaatttcaccctcccacagcgacctcatcctctctccaccgaattttttggcctgcgggctttcccccggccccaacccggnnggaagggaaatggaaacctttccttttttgggggggggttcgccctagcgcacggtgtatcgggccatcgcgcttgcgcgccatcctaaacactccccgcaaacgtcgccctccacccacccctctaga
